United States Patent 11,549,145 (METHODS AND COMPOSITIONS FOR INHIBITING AND TREATING NEUROLOGICAL CONDITIONS) - sequence listing, part 126

SEQ ID NO: 2339 - DNA, 198108 bp, Homo sapiens
tttgttttcaatacactcatatatttttactttgtaatacaatatagctgtcacatacaatggctctagtaggcttaaatcaaattgcaatgggcaaggaaagccaaagaagggtttacacaatattcaataagcaacagtatctgttcagtgtgcaataaaataaaaaagttctaacctagaaacacagaaaaagaatttattgtttttaagtttcagaaataaaagtaacagaatagtgtataatctgtaacaagctggtcctgtaatttctaaactacagtccaattaaaacatttaagtaatagaaacaatctacatgtttttctaccaggtaaatatacctgagagggttacctataaagaaataggctttaaaacttttaaccacaaagaaccttctgctgcgacattatgaagatgggctatgcatgtggccagactaagtcatttcccggagattctgctcactgcttagctgcaggtagtggtccatcaatgacagagtattttacatcaataccagctcattcaaccaaagaagcacagtaatattttaaaatcacctgtttatattcattagtatgtaaaaatcacaatacacagatttggaaacatataacgtgtccataaaaaagagtatattatgtaagcataagctttttaaaaaggccttagcaatgcaataatgagggaagcagactctacatgttgactacagtgaagatatgttaaaattataattattgtcattgccaagagcttagaaataaaaacaaatttaaaaaattaagacattctggtagcaaaattacagctactgtaacaacagctccaagcaaaaaatcaattcagagcttgaatgcaatttgtgctttgtttctataagaatgcagtgttactctcagacatttctaaatgattagattcataaataagcagttaatttcttttcatcacaatttatttctaattcatcctacggagattatagatagaactaaaaattacttagcttttttccagtactttatataaattgagatcttttttaaacagtgatttattgtgtttcttaaggtaaaacaacaaaaacaaattctaaaattgtaactttaaattaagtggttaaaatttcagatgacagagccgataactggtaacagcttcttgaagttcatattaagagtccaattagaaacactaacaactacctggcaatagtttgaaagaatcagaagggttcggtgaagtgaaaaaaaaatccgaacatgcaaaataccccccaaaacacatgaccttctttttcattttataatctaaacttgtaaaatatttataaatacatgatcattctacacaatacagatcttctagagcatttctaaaggatattacagtttttggtcttaaggaataaagactaagatggaaaaggagatgaaaacagtgaaatctgaggaagcaatacactctctacacacaagcaaactagttcatccagtcaagttagcggttacagttcagtacatgattttcaaggcaactaagaaatcaagacacagatatttccccttcctagagtttacaattctttcaaaagctccaatgtatccataaaggagtgctgatttttgtggggttttttcccagaaggaaacaaagaataaataggggaaaaaaagtttccatccctaaattcacatacacaacaagttaagttaaactataagctagttttagactacccagtgaaacagaattgttggtactatctgaggcaggtgctaccctccctagtcagttcaaaacatgatccagtaaaacaaatacacattgttatgcctcaaacaactataaagcatttcattattcttcaaatatcatgtttaattaactcctaaggtaatagacttctagaatgttgtatcttaatggtgtacctgaatcaatactagcaatagaatgcaaaattcaaaattgctataaaggtaaaatcatcataaaaagaaactcaatccttatgtaaaaaaagggagaactgagtgtgaaatactaacaccaaatgtctgaaggcagaatttttgtttgtggaagacagagcgaagagatagatgcacctaatcaagaccaaatagaagacagtgaagaatatgaaaaatgcttaaaaaagaagaaggaaaatggagaagagacaggcagcaaaagaattactagatagatcaaaaataagagaaaatgaggcatgtgcatatggcttttttgtctgtcctttgtgttcctaaataacttaaaacgtaagtggcatgtaggccatactagcaggcaagaatgagccttgtgatgtatacagatgaagaatctgaggctaatgaattgttttgttttttgtttttgcttttaattcatacctgaaagccttgaatccttgctaaatattccagttgttttgaaggttgtactggagaacaagggggagtaggagaacttccttttaaacctatggcttcagctgtagaagatgttccattcataaggagttccctggcaattgtagctgaactattcgatgtgggagatatactgaagaaagagcttgaaggttggttcatatctttgggtgacaaatagcctagagtagtgccagagattactttgtggcggctggcttccatctcttgataaacatcaggagacaaatgaagaattccttttggagctataaataaaatgaagaacactgttattacacttaaaataaccgaaatagaaacatagcattattaactcaatggctttacttggtgtagtaacaaagaaatgagaaacactgccaaacaagtatctttgtcatactgtagaggcagttgcagcttctattgaaaggtgaataatgtctatttcaattttcctaaaattagaggtttaaaaacatccaaaaaaagtggtttcaatgggacttatgtgtagtagtgaagctataaagggacaagggaaactgaatgtgtggaagtataatggggcagaaaatcaggaatgtgcagtgtcttcaccctgcaatttaatattttatatctcataaaagaggcatgaaaccccaacacatacagcaattgaggcacatcaggtaaaataaaggctgaatcagtccaaatttctttggaggtacaaacgcatgtattcaacagcctagtgatcctctcacctccacaaggatgtcccacagacaactctaactcacgaacacataaaaaagcaaatgggtatcatctcaaaactagcactgtctctaacttgctttgctcatactaccatgtggctgctcatgacccaacctagactcctggcaaccatctctgatttactcataagcaagtagttatcgtgttgctcaaacatctcaagaatatgaccattgtagggattatctagtgcattaattcaagccaggccatggacaggttctgaaatcaagaggagtgggggctatgtcattagttgatggagcttaaaccatattagagaagcactttcctttgactatcatttgtctcagagaagtttcaaaccacatttcaaactgcttattcttatcttttgatcaggtatcaataactctcaaatgatattatcttttaaaattattggtaagtcaccactcataaagaatgtgctctgagagacacaacttaatttcctgttcttgccccttcctctcctgatgctaaccttctgattcaagctttcaatgtttctctgctgctagtattctcagtgtccatttcccaaaatgtgttctataacatggtccccaaataaaatggttccataaataaaaactgaaaataatgcaaattacataatacaaatgccttttgtgaaattaaaaatacacattagcatagtgaagaatcagaaaactcaaagaacaaaaatctattcgacttggtttaactcaggattcctgagtttactttttgtccaagcctttaacatagcatgaataaaacagctaacactttgggaaatgctggaggctagcccaactctcctctgactcagtcatttccaatgacctgtctttgagattgatgaccttttcttctgcttgacattgtctgctattgaatccctctggtaactttttcagtttatggtattttttagctccatgctttctgcttgctactttttaaagttttctttttgttgaaattctcactttttttcatgcattgttcaccagacctcagtgggaatgtttgtaaggattactttgaattctctgtcaggtaaatcacatatctccatttcattagggtcagtttctggagctttatctcattcctttatttaggaaatgttttcctgtttcttcatttttccttgattctctgtgtttgtgtctgcacaaactggcctcatactggagaagatcctaaccaatcagcctggacagagattctggaggcctctcaaacttttatgctagtctaatccactttctttgttcttggcagtccccaggcatcagtcccttgcttgtctcagtcccatcagagctctgagacaagcaagactgaagccaattcttcaggcaactcccagataagttgggtcattggatacatggtgctcctctttgcctctccaggaaaaagctgaaagctgaagcttttcaacagttagctttgtgctgggctgagcaggggatggttacagtgaccaccaccaccagccacctctttcttcattggccccggggttgctaaaatatgccatgtcctgtcagcactctgagactggccagacagaagccagtcctctgggtagccccagaaaagctaaggcattggatgcgtggtatacatctttccccttctaggcagaaagaagctgggagctgggggtggagggtggttgtcctgattgtatggccctgcactgtgaggagggattatggcatgagggtatcttaaatttccctgccaattaagatctggctggtttcatgctcacccggcatacaggagcctcttaactggtttctggatttctcacaaagaaaaattgcctataaattattgttgaattgctgtgttccagggcttcctattctaccatcttgccaaggctagaacattctcttacttaaaggtctttcaccagtttatcagttacactatagaacccaaactccttaggataacctaggaagcccttaataatctggctcctacttatcgctctatcttcatctacgaaatatttcatgaagatcccatgctccagttacacagatatatccaatactccaggctgtttgatcccaacacatctttatttctattgttcggttacacacatgcacatactctcttagttaagctccaactgctattgtgctagttaagcttcaggcatcgcaccaaccaatactgtcctgacctcaagtcatgctcagtctatcaggagaggaacgaaaatggataatacaatgtgataggggtctcactagagacaggtgtatagagcagtgggaatgggaaaggagaagtgctaaaagctcagggaaggcttgctggagatgacgatgacagtaaatttcaaaggatgaggagaatacagtccaggaggaagaggactgagagcagatggccagcaggagcaagggcagggacctggagggtttgtgttctaggaaacctcaggccatgccttatcacaagagcatacagagtcagaattgcaaatgcaggtggaggcacgcaggggccaaggtccagggaactttatcctgatgccattaagtataaaagagttttgtaagtttttttaaaaacactttaaatagcttaaaataatacagacagtcctccgcatgcatgagtcccatatccctggattcaaccaactgtggatagaaaacatttgcaaagagaaacaacaacaacaaaaacaacaacaaaaaaccccacacacaataaaaaataatgcaacaataaaaaaaaatacaaaatttaaaactaatacaatataataactatttacatagcatttatataatatttgatgttgtgtaatctagagaagatttaagtatactggaatatgtgcataggttatatgcaaatatgatgccattgccattttctatcacggacttgagcatctgtggattttggtatctataaggtgtcctgaaaccaattcttcacggatatcaagggatgactgtatatcaatcctattttatgtattttctttattcctttatgttagctttcaaattctctacattaacatgtgttagtttttttataatcaggaaaaaatttcaataaatttttttacaagaaaacattatgtactgaaaaaagttaagataaatctcatcagccagaggacattactttcaacattttgctttaaagatatgtttttaatcctgttttatctatgcactttttagttgttgtttacttgaaaaaacaagttaaatacataggaataaaatatgatcctgtcactgtttataaaacaatatatttctacaactaatactaaaagtataaaatttcattatatgaactgtttcttaaaacaattccatattatcagacatctaatttatctccagttttttgcaattataaacacagtgatgaacattcttgtaactcaatccttattcacatgaaaatttatttcctcaagttagaagcggaattgctagttgaaaggatattttagagtttttgacacttaacaaattgccctccaaagaagctgtaccaatatcagacgcccacagagatatatgaaagtatcttgtttcctattttggtattggaaattactataaaaaatcttaaggctgggtgctgtggctcatgcctgtaatcccagcactttgggaggccgaagctggcaaatcacgaggtcaggagttcgagaccagcctggccaacatgttgaaaccccgtctctactaaaaatacaaaaaattagctggacgtagtggcaggcgcctgaaatcccagctacttgggaggctgaggcaggagaatcgcttgaacccgggaggtggaggttccagtgagccaagatcacgccactgcactacagcccaggcaactgtctcaaaaaaaaatctttgccagttatcaacagtaacagaaagcaggtcagtggttgtctggggagtggagctggtgggagtgacagattgcaaaagggcatgagaaatcttttggtgagatgaaaatgtcaagactgattaaactgtagacattatgtgcagtttattatacttcaattatacctcaataaagttgtaaaaaaaaattgccaatttgacaaatggagtgtcatattactgatttttgttttttactatctgcataaacattatatatattttagtttaaagaataacttaaatgttataattctaacttctatactcaatttaaaaaatcaagaaacttaacagcattacttcagtattgttattatacaggactaatgggtttgccaatagcaatattataaagcaacaaaaatgctctccacactcaagagaggcattacctcacagcataagaacgtggagttcaggctctcctattctacagtaaagcctaagtggacttttcttcacaaataaagattactttctacagagttcaactaacagactagtcatagaaatagcataaaaacatagatttatgtggtcaagaactgaatgacttttaacttgaacatcagtaacagtatttggatgggtgttaattcacttaggatcttcctgttgtaaatttaagtcgcttttcaatagtataaagatctaaaagtagaatcaaagagtaatttagggtatgcatatttaaggaccttattttgctaattaggtttctcccaaaaaactaccccagttcatacttctattagtaggatgtgactgttttcccacacttctcccacaacacgtttcagttactctaaataatcattgccactctacaataattcattgttaatttatttttgtttggttactgctcaggataaactttttctcatgtagctactttaggtctgtgccttctttgacctcaattttgctcatggacttcaaccactacacttccctcgctcaggcttgtaacatccattatattcattcaccctttatctgaagaggtcctgaacccattctgccatcatctatcttttgtccctggttttgcctttgatgctcccatcttggtacagtctataactacagtacacagttacaatgcagatacaacatgggcactgttctagtactttacttctcatttaattcccataacaaccatatgaaatgggcattattattttcctatattagagatgaaaaaaactgaagcatggagaagatatgaaactctcccaaggtcatatggataataagcagcaatgctagaatttgactccaggcagtctgcctctagagtttgaatacttaaccattaccttaaatagcctcctaaaagaacaggtaggaaactaaatgcaacatctcaccagctccaaacccctaaggcttaaatccagtaagtaaatgcccggggtttgcccagattggttccaaggatgacccatgtcatgatggttgtccctagatgttccagagatgagctcaccaaaatctcactgaagtatacagagtttatacatgattttaaaggtctaaagttgccagggactgtgatatcttaacaccaggctattgtacccacttgacatgtttttgctcagtagatctgtgcttctttcagatgggtatatgaatcctctggcacacaaatcttcctggagcatctttatggagctccagttcttactgaagagttgaagagggacttttgaattggagagctcttaaaaggttttataagcgaacttaggagaaccttgcctttcaatgatcactgatgtcatgattctttcagagatgctgaagaagataagtgtttgtgagtagcaagtggtatcagaggtattaaaacacagcaagccaggcagcaagaaagataatgccactgatccaaatggttactgccactccactggaactcccagtttctctggaagtccttggaatgggcatagctatttcacaacaaataatttcttttcatttttcacagaaaagctttgaaaaaaaaaactttgtttccattgccagcttgaatttacgcctcaacaatgttggactataaatttgtttataaatacccaaatatccaataatactcaggcccactttgctacagtgagtttttcacaataaaaaattataattaaaaattcttaagaactagaaacaggggcttctggttcaaaacaggaaatgtgagaaaattatgaacaacagcatgattatctgtctctagtgatttttaaaaatcatttatatgagaactggtaggctctaagtaaggtctgtagtctagttcattgtattatgacaatttcctagttttgaaaatgtactatagttatataagacatcaccactggaagaagctgagtgacgggtacatgcaacctctttgtaccattcttataacttcttgtgagtctatcattattacacttttaaaagtttttttgaaagcaccgttttatgctgctttgggcctctccctcaacatagagaccccagaacagggtggtgatggggacaccaaagtgggaaggactggtggcagcaccattcctagatatagctctgaggataagcagggctggcactggcaatgcctgctccttgacaactttgctcacggcctttgcctaatgcacaggccctggctccccaggctctgggtgcttgacttttagctacatgaaagcaagggagatcctgatgacagtgtgggcctcatagccgggaccttgttctctcccagggtagcctgaggccacgtattagttaagagtacatgtgacccaagggagcctactggaccaccatggtcatgtccctgaaggtcagggacaggtggaatgcatccttggcatgatctttagctactagactgatgtgagctacagaaatcccccttcctgctgccctgttgttgggatcaaatcgaacaggtagtatttgtaagtgactccacctcttcttttacacacagctcactgcaaatctggtcttccagataaggccctcagacccttagttctgcctaatttttaagccaaatatatactacttatgaaatcaaaaatcaacaatgcaaaatataaactcttgtggaaaactaaaaagagaaaatgttagctaacagcaaaacaatgaaaaaataaaaaaataggtaaataatttgttagaggtttcttcttaagatcagtttcagaatcaccttggaaacgaaaaagacacactaaaaaaagagtcattactgaacagatttttttttttttttttttttttgagacagagtctcgctctgtcccccaggctggagtgcagtggcgccatctcggctcactgcaagctctgcctcccgggttcacgccattctcctgactcagcctcccgagtagctgggactacaggctcccaccaccatgcctggctaattttttatatttttagtagagacggggtttcaccgtgtcagccaggatgttctcgatctcctgacctcgtgatccgcccacctcggcctcccaaagtgctgggattacaggcgtgagccaccacgcctggccaaaatgatgtattttaatgtgctcaaaaagcataacctgaacagtggtgaaaatcaaccttgctcttacccttagagttgaacggaagcactgattttattaatttgtgcattttattggtcctttttttcctgctacatttaacataatgatgtatgtgaagggttcttaatttggtgaatgtttatgaataaaattactgacaaagaacttttcaggaagatgtttgccttttggtgaacacagtaccaacgggaaaatgcacttagtccagtcttgcccccaaaaaggcagaatcccaggtcatgacatagcatccagcacacctccaagaggaagaaggaggaatacaaaatagtaaataatacatattcctcaaaacaccaataatgaacagaaataacagcaataaaggtttttcaaaaatgttttaaagatcaatttatgatgaactgggaaatgcctttggaaagcttgtaccttagtcaaataaaagtgcgagtgagttttcaaattcaggactggctgctattttttctttaaaacaggcaaatggaaagtatttaataacaaagaatataaacctgggtatggtgaataaattcatcattcatcttttttttttaaaccttacacaaatgcagtaacttatacttttgccagaaattttctttaacaagaagattctggagcccaaagtgagtcatgcaaatcaaagaacagtctggcacaggggttattaatagtgatccaagggcccctaaatagtttgaaataggttgacttcacaacaagggcagtgcacattgtatatgactcagagtcagtgtggtgcagggaagtgattggggagttcaggaattccccagaagcgcattcaccactcatcttaataataaggaagatttcacttagttggcttatttagaagaaatttttttcaaggctcagcttttcaataaagacacaactgtgactatttctaccaagtaagacaaaatagttgctgtgaaaatgatgtttgagagcaccttgtgaggataatgagtcatcttcaatttttagtttatttaagtggggttaaaatgttgctcgtaaaataaagatcgttcttcttggttatgattcttctcagaaaaactccattagttatgatttccctacgacagaaaaacaccaaaaaatggattatataagtctgacatatgacaaaagtgacctgatctctcagcaggaagaaacacatactgaaatgtctaccgcagcagcttccaaacactgcaccacaatactcctctgccaggattcctattgcttcctagtcaatacctgcaaacggctcacaatacaataatagtacaatacaataacaataataattctggctaaaactcatagagtccttactagatatcaggcttgttccaaatgctttgcatatattagtttagtaatcctcacaatgaccctcaagaagtagggactatgaatattcccattttacacttgaaggccctaagacacaggtgatatgactggcttaaagtcacagccagtaagtggcaggtgttggggcagtatccaggcatctggctacagtcagcaagtataactacctttcagtagtaaaacaaataaaccaagaactactgttcttatatctatacatttaagaagttctgggcatttagattcttgaaatattctaacaccatgatagagacaagaaactgtcaagatattgaacttcatttcttcatttcagacctattttctaggctcaatgaacctcagtctcccctctcatagtaaaagaaaagatggaggtcagtgcagtggctcacacctgtgatcccaacactttgggaggccaaggcaggaggatcacttgaggccacaagttcaaaaccagcctgggctatacagcaaggtgctgtctccataaaaaattaaaactttagctgggcatggtggcatgcacctgtagtcccagctactcaggaggctgaggtaggaggatcccttgagcagaggagttcaaggctgcagtgagctataatggcaactctgcactccagcctggacacactgtctctttaaaaaagatagagagagagagagactgagatttttctcactgtaaaaccacccattgggaaaaatgtaaaaataatgcacttggctattttcacaattttgtttgtgggaagaaaataaattcaaatattaggttcacacaaagaaaaacttaagcacagccttaggatgaaagaacttaacccacaaaacactttcttacaattctccttatatgatctaattatgatttaacaatttactacacattagtctattattcagtctattatatattattcagaaacttatggaagaatccacaatattattaataaaaacaactaactggaactgtataaatattaagtactgggctgggtgcagtggctcacacctataatcagcactttggaaggctaaggcaaaagggctgcttgagctcaggagtttaagaccagcctgggcaacacagcaaaacctcatctcaaaaactgtatttttaaaataatatatatatataaagtacttatccaatttttaaattttcttgtaaaaataacaaattcactttttagaaccaggaaagaagcagcctagcaagaaataaaatttagacaaaacacaccttagtccagccaaatacacacaaaaaaacctgttctcccacttttatctatgtatcaaaggcagagagggactttcacccttgcaaagctgtaacaactctccccaacttccctgatgtggtagtgtcagaaaaaactgagtaggcagcttggactttcatcctagccccgtggtgtcagtggagatcatgtagggacactaaacttctacccccacctagcagtaataggatgccccccacctccgtgctggagtggtgtcaggagagaataaaggagaatcagaactagtgggaacaaggtcacctcactatggtgtcagtggagaccatatggggaccagaatttccactcaatccagggctgggggtaggggaaagggtatggctataacagcacaacatgaggaactctcatggtgacagaactgttctgtatcatatttatattaataccttagttgtgatattgtactatagttctgcaaggtgttaccagagataaacaaggcaaagggtccataggatctctttgtattaattcttacaactgcatgtgcatctacaattttctcaaaataaaatttttattaattattttaaaatttattgtagagacaggatcttgctatgttgcccaggctggtcttaagctcctggcctcccacttcaacctcccaaagcattgggattacatgcatgagctaccatgcctggccatcaaaataaaaagtttaataaaaaagaagtcttgggtgacaccagcaagatggtagaacaggaagtcccagcccttattcctaactcatacattgatttaacaatgatatacagaccaaaatacctttttgagaattccagaatccagttaagaagttgcagtatcccagatgagcacaaagccaagaatggccacactgaaacatgtaagaacaatttcactttacccacaccacccccctaagtcagcatagcttagtgccacatagcttagtgccgggagagagcattccagatcacaacttctcccttggggtaaaggtgagtggaatgtgcatccaacattttacgttttcagagggcttcccaagggactaatttttgtcttgcttcacttggagtgccgacagagccagcatattttggatacctgggatatttagttttcccggcaccatttgttgaaaatgtggtacacatacagcatggaatactatgcagccataaaaaagaatgagatcatgtcctttgcagggacatggatggagctggaggccattttccttagcaaactaacacaggaacagatattaaatactgcatgttctcacttacaagtaggagctacattatgagaccacatgaacacatagaggggaataacacacactggagcctatcgaagggtgaagggtggagggtggagggtggaaggtggaaggaggtagaggatcaggaaaaataactaacaggtactaggcttcatatctggatgatgaaataatctgtatgacaagcccccatgacacagtttacctacataacaaacctgcatgtgtacccctgaacttaaaaaatgaaagttaaaaaaaaaagaaaatatactcagtgggtcctcaaataatgttgttttgttcaacatcattttgttataatattgatgagaaaaaaaatcaaatcccacctgggccactgtcttatgtggagttctcatgttctgcccatatctgcactggttttctccaggtcctccagtttcatcccacatttaaaagatatgcatattaggttcactggcaggtctaagttgtcccagtatgggtgtcgtgtgtgtgtgtgtgcgcacacgcgtgtgcacatgtgtcctggaatggaatgacatcctgtccagagttggttcttgcctttgctccctaagctgctaggataggctctgaccaacctcaatcctgaactggaataagtgggttagaaaatgaatgactgaatgtatacaaatgaatgtaaaattaaaatctgtaaaatgcacaataatcatataatatggtttggctctgagtctgcacccaaatctcatgtggaattggagtcccagtgttggaggaggggcctggtgggaggtgattgaatcatgggggcagacttcccccttgctgttctcctgatagagtgttcacaagatttgcctgtttgaaagtgtgtagcacctcccctgcttgctctctctctcctgctggccatgtgaagatgtgcttgcttcccctttgccatctgccatgactgtaagcttcctgaggccttcccagaagcaaaatcctgaacagcctgcagaactattatccaattaaacctcttttctttataaattactcagtctcaggtatctctttacagccctgcaaaaacagactaatacattacacaaatgcacaacaataaacaatgcagtataaaagtgttcagtgagcccaccatatttgttattgtttgttttttaattgtgtggtggtaggaagtactgcttacaattttcactttgcaaacatttatactttgatttaacccaccaccaccatgactgctatcactcacttattcaccccacattgagtaaacaattatcttgtttttattaaactttcttaattgtacatgtaagctcatatttatttcaatgtttaatattacaatttgggtctttattgagaagtctggtgatatttctctaaccacaaatatgttgtgagaacttaactcttgtttatatcaatcagcctatgataaaactgatttcgttatatgtcatttcacttaaagtagtagtttccaagaacctatcaatgatgttaagtaagaacttactggatttaatttttttagtggtaaagcaaaaaaaagaagtctaatgttctgtattaacacaaaatgtaataaagtaaaaacaacaatagtacattggtaaatgcaccagactggagcccagctatctgggtttgagttgaggcagcagatattctccttatcatgctttcttcatctgtaagatgaattagtcttaaggaacttttcatttctttcagccctaataatctatgaatcatcttaacacaaaccagaaagcttggaataaaagaacacacttgaataacatcacccaaaaagcctgttgagtgttttttaaatttgactattactaaagtttttttaaatcttaagaaaaatcaagtaatgtagatggctgtgtcactgatgtaataatagttaaaacaaacatttcacatagtttctcagccatttagtgtttttacatgatccacccaaatatcaatctggtatctgaaacaatagtttgaacattttccatgtaataaaacatcttaaatgttttataaaaaaagattctggtacatgatatataaaacattctttcaaaaaaatgcgtacttaattttaatggaatttcttaaaaacactattctctttttttcctttaattatcagcaaatgatatatctagaaataaaggtgctgtctagtggcaactgcagagaccctggagtcagaagacatgagttcaagtcttcactacctttaactaagagtgtctttagacccgttataaaatcaactgagcctcaattttcctgtatgtaaaacatgtgaggttggacattctccaaccttttcacacttaagcctccttatgttgtttttcttctatgtataccatgcttaaaggatctgtctttcagacagactgcatttattaagtaataataaatcatctttcaaagactgccaacctgagattcagaacatcttgaggtctgaattcaaataaaattctaatccaaagcaaagcaatctactaagagtaactgtattacttccattaggttgctgaaatactaattatgccaaccattattatattgaatccaacaataccacgctgagaatctcaggtctggatcacacctaaattcctagaattctaattgttatatgttataaactactcaaaagatcattaatacagtggggaaaaaagtgaaaatgcaattcttgcatttgctcaaatactgagcaccaacaatgccagacactgtgctatgtgatttactttttaagattaaaaaaaaggccgggcgcagtggttcacgcttgtaatcccagcaccttgggaggccgaggcgggcagatcacctcaggttgggagtttgagactagcctgaccaacatggagaaactccatctctactaaaaatacaaaattagccaggtgtggtggcatatgcctgtaatcccagctactcaggaggctgaggcagaagaatcacttgaatccgtgaggtggaggtggcagtgagccaagattacaccactgcactccagcctgggcaacaagaaaacgattaaaaaacgattaaaaaaattgatttttttttcaaataatatttgtctctctctcttttttttttttaagatgaagtctcactcattctgtggtccaggctgcagtggcacaatctgtgctcactgcaacctccacctcccaggttcaagcaattctcccaccttggcctcctgagtaattggaattataggcatgtgccacaccatgcctggcaaatttttgtatttttagcagagatggagtttcaccgtgttggccaggctggtctcaaactcctgacctcaagtgatctacccacctcagcccctgaagtgctgggattacaggcatcccaccttttcttactcgctgggggggaggggggagttgggcaggatggtggtgtttatcttaaatatggactcgtctttcaataagcaatttcatctttaaaaactactgaaatcatcaataataccaaaaagggtacattataataaacaaatactttctaaaaaaatgaaagaatgaatgatgcattaacattatacaaagaagttttagggaaactatctgcactgccttcctgaaccttaatagttttcaaccatacagttagttccctgttgcttattttagtgcttcataattgatgctttgactactctcacatctcttatttctgttgccaaggaaggagatttttgtcttttcaattacttgtactccatgtagtacgtgcaagaagattacagaccaagtacatctttattcacatttgtttaaaacacacattactttaaactgactcatgttaaaacacaagaaagactcaatgattaagctgggtgcagtggctcatgcctataatcctaacactttgggaagccaaggcaggatgacttcaggccaggagtttgagacaagcctgggcaactccacaagaccttgtctctagtcgggggagtgggggcaaagctgggtgtggtgccacgtgcctgtaaaattagctacttgaaaggctgaggcaagaggatcccttgagcccaggagttcaagtctgcaatgagctatgatcatgccactgcacaactgacagaattttgctaacagagtgagaccctatctcaaaaaaaaaaagacaacgattaaaactggcacatagatagttagatgaacagaggagaacagaaagtctggaataataccaaattcataatcttagtatatggtaacagtgaactctcaatgcagtggggaataaagttgggtccatactttcagtataagtaacagatggatcaagacttcaagatttcaaaaaatgaaactataagagttccagaagataacttaaaagaaatgttttgattggaggttccaagatggccagataggaacagctccatgctgcagctcccagtgtgagcgatgcagaagacgggtgatttctgcattccaactgaggtaccaggttcatctcactggggcttgtcggacagtgggtgcagcacacggagcagggtggggcatcatctcacctgggaagcgcaaggggtcggggaattccctttcctagacaagggaagctgtgacagatggtacctggaaaatcaggacaccgccaccctaatactgcgcttttccaacggtcttagcaaacggcacaccaagagattatatcctgcgcctggctcagagggtcccatgcctacagagcctcgctcactgctagcacagcagtctgagatcagactgcaaagtggcagtgaggctgggggagggccgtccgccattgctgaggcttgagtaggtaaacaaagcagccgggaagctcgaactgggtggagcccaccacagctcaaggaggcctgcccgcctctgtagactccacctccgggggcagggcatagctgaacaaaagtcagcagaaacttctgcagacttaaacgtccctgtctgacagctttgaagagagtagtggttctcccagcatggagtctgagatctgagaacagacagactgccacctcaagtgggtccctgacccccgagaagcctaactgggagacaccttccagtaggggctgactgacacctcatacagctgggtgcccctctgagacgacgcttccacaggaacgatcaggcagcaatatttgtcattctgcaatatttgctgttctgcagcctccactggtgatacccaggcaaacaggatctggagtggacctccagcaaactccaacagacctgcagctaagggtcctgactgttggaaggaaaactaacaaacagaaaggacatccacaccaaaaccccatctgtacgtcaccatcatcaaagaccaaaggtagataaaaccacaaagatggggagaaaccagagcaggaaagctgaaaattctaaaaatcagaatgcctcttctcctccaaaggaatacagctcctcgccagcaacggaaaaaagctggatggagaacgacttctacaagttgagagaagaaggcttcagatgattggtaacaacaaacttctccaagctaaaggaggatgttcaaacccattgcaaaggagctaaaaaccttgaaaaaagattcgacaaacggctaactagaataaacagtgtagagaagactttaaatgacctgatggagctgaaaaccatggcacaagaactacgtgacgcatgcacaagcttcagtactgatttgatcaagtggaagtaagggtatcagtgattaaagattaaactaatgaaataaagcgagaagtttagagaaaaaaagagtaaaaagaaatgaacaaagcctccaagaaatatgggactatgtgaaaagaccaaatctacgtctgattggtgtacctgaaagtgacggggggaatggaaccaagttggaaaacactctgcaggatattatccaggagaacttccccaatctagaaagcctccaagaaatagcagactatgtgaatagaccaaatctacgtctgactggtgtacctgaaagtgacgggaagaacggaaccaagttggaaaacactctgcagtatattatcccagagaacttccccaacctagcaaggcaggccaacattcaaattcaggaaatacagagaacgccacaaagatgctcctcaagaagagcaaccccaagacacgtaattgtcagattcaccaaagctgaaatgaaggaaaaaattttaagggcagccagagagaaaggtcatgttacccataaagggaagcccatcagactaacagcggatctctcggcagaaactctacaagccagaagagagtgggggccaatattcaccattcttaaagaaaagaattttcaacccagaatttcatatctagccaaactaagcttcataagtgaaggagaaataaaatcctttacagacaagcaaatgctgagagattttagtaaatgggctaaatgctccaattaaaagacagactggcagtttggataaagagtcaagacccatcagtgtgctgtattcaggagacccatctcacatgcagagacacacataggctcaaaataaagggatggaggaagatctaccaagcaaatgggaaacaaaaaaaagcaggggttgcaatcctagtctctgacaaaacagactttaaaccaacaaagatcaaaagagacaaagaaggccattacataatggtaaagggatcaattcaacaagaagagctaactatcctaaatatatatgcacccaatacaggagcacccagattcataaagcaagaccttagagacctacaaagagacttagactcccacacaataataatgggagactttaaacaccccactgtcaacattagacagatcaacgagacagaaagttaacacggaaatccaggaattgaattcagctctgcaccaagtggacctaatagacatctacagaactctccaccccaaatcaacagaatatacattcttctcagcaccacatcgcacttattccaaaattgatcacagagttggaagtaaagcactcctcagcaaatgtaaaagaacagaaattataacaaactgtctctcagaccacagtgcaatcaaactagaactcaggattaagaaactcactcaaaaccacacaactacatggaaactgaacaacctgctgctgaatgactactgggtacataacgaaatgaaggcagaaataaagatgttctttgaaaccaatgagaacaaagacacaacataccagaatctctgggacatatttaaagcagtgtatagagggaaatttatagcactaaatgcccacaagagaaagcaggaaagatctaaaattgacaccctaacatcacaattaaaagaactagagaagcaagagcaaacacattcaaaagctagcagaaggcaagaaataactaagatcagagcagaactaagggagatagagacacaaaaaacccttcaaaaaaaatcaatgaatccaggaagcggttttttgaaaagatcaacaaaattgatagaccgctagcaagactaataaagatgaaaagacagaagaatcaaatagacgcaataaaaaatgataaaggggatatcaccacccatcccacagaaatacaaactaccatcagagaatactataaacacctctacgcaaataaactagaaaatctagaagaaatggatagatttctggacacatacaccctcctaagactaaaccaggaagaacttgaatccctgaatagaccaataacaggctctgaaattgaggcaataattaacagctaccaatcaaaaaaattccaggaccagatggattcacagctgaattctaccagaggtacaaagagaagctgataccattccttctgaaactattccaatcaatggaaaaagagggaatcctccctaactcattttttgaggccaacatcatcctgataccaaagcctggcagagatacaacaaaaaaagagaattttagaccagtatccctactgaacattgatgcaaaaatcctcaataaaatactggcaaaccgaatccagcaacacatcaaaaagcttatccaccacgatcaagttggcttcatccctgggatgcaaggctggttcaacaaatgcaaatcaataaatgtaatccagcatataaagagaaccaaagacgaaaaccacgattatctcaatagatgcagaaaaggcctttgacaaaattcaacagcccttcatgctaaaaactctgaaaaaactaggtattgatgggatgtatctcaaaataataagagctatttatgacaaacccacagccaatatcatactgaatgggcaaaaactggaagcattccctttgaaaactggctcaagacagggatgccctctctcaccactcctattcaacatagtgttggaagtcctggccatggcaatcaggcaggagagagaaagaaagaaagggtatttcattaggaaaagaggaagtcaaattgtccctgtttgcagatgacatgattgtatatttagaaaacctcattgtctcagcccaaaatccccttaagctgataagcaacttcagcaatgtctcaggatacaaaatcaatgtgcaaaaatcacaagcattcctatacaccagtaacagacaaacagagagccaaatcatgagtgaactcccattcacaattgcttcaaagagaatacaatacctaggaatccaacttataagggatgtgaaggacctcttcaaggagaactacaaaccagtgctcaacaacataaaagaggacacaaacaaatggaaggacattccatgctcatggataggaagaatcaatatcgtgaaaatgggcatactgcccaaggtaatttatagattcaatgccattcccatcaagctaccaatgactttcttcacagaattggaaaaacctacgttaaagttcatatggaaccaaaaaagagcctgcattgccaagtcaatcctaagccaaaagaacaaagctggaggcatcatgctacctgacttcaaactatactaccgagctacagtaaccaaaacagcagcgtactggtaccaaaacagagatatagaccaatggaacagaacagagccctcagaaataataccacacatttataaccatctgatctttgacaaacctgccaaaaacagaaatggggagaggattccctattcaacaaatggtgctgggaaaactggctagccatatgtagaaagctgaaactggatcccttccttacaccttatacaaaaaaattaattcaagatggattaaacactgaaatgttagacctaaaaccacaaaaaccctaaaagaaaacctaggcaataccattcaggacataggcatgggcaaggagttcatgactaaaacaccaaaaacaatggcaacaaaagccaaaattgacaaatgggatctaattaaactaaagagcttctgcacagcaaaagaaactaccatcagagtgaacaggcaacctacagaataggagaaaatttttgcaatctacccatctgacaaagggctgatatccagaatctacaaagaacttaaacaaatttacaagaaaaaaatcaagcaaccccatcaaaaagtgggcaaagaatatgaacagacacttctcaaaagaagacatttatgcagccaaaagacacatgaaaaaatgctcatcatcactggccatcagagaaatgcaaatcaaaaccacaatgagataccatctcataccagttagaatggcgataattaaaaagtcaggaaacaacaggtgctggagaggatgtggagaaacaggaacacttttacactgtaggtgggactgtaaactagttcaaccattgtgcaagacagtgtggccactcgtcaagagtctagaactagaaataccatttgacccagccatcccattactgggtatatacccaaaggattataaatcatgctgctataaagacacatgcacatgtatgcttattgcagcactattcacaatagcaaagacttggaaccaacccaaaagtccatcaatgatagactggattaagaaaatgtggcacatatacaccatggaatactatgcagtcataaaaaaaggatgacttcatgtcctttgtagggacatggataaagctggaaaccatcattctgagcaaactatcgcaaggacagaaaaccaaacactgcatgttctcactcataggtgggaactgaacaatgagaatacttggacacagggtgaggaacatcacacactggggcctgtcatggggtagggggctgagggagggatagcattaggagatatacctaatgtaaatgacgagttaatgggtacagcacaccaacatggcacatgtatacatatgtaacaaacctgcacattgtgcacatgtaccctagaacttaaagtataataaaataaataaataaataaaataaaataaaaataaagaaatgtttttaatttcagagtcggaaaggtattatttattatacccaacttacacatgctataaaagaaaagactattttaaaatgtcattcaaatatattaaaaagaaaaaccaaactttaaaagaaaacagagaagaattttcatgtcataaaggcacacagatgcacacagtcctaccaagtaaaaaaaaaaaaaaagagagaaaaagactaaccaatctaatgtccaaagggacatcagatatggttatgtcattcacagaaaaagtatagaaatggctcatagatctaccaaatacatagtctcattcttaataagagaaatgcaaaataaaactatactgaataccatatttcaactatcaaattggcaaagattcaaaactttgatagcacactgtgttcctgaagctgtagggaaacaggaaatctcctacactgatggtagagacgtaaactgctgtctattgacagtactctggcaacatccatcaaaattaaaaggatacatactctgtaatggagtaattccatttgtaggaatttctccaacaaatatgctaccacatacgtaaaattacttatgtatgaggtttttacatggcagataataggaaaatactataaacaatctaaatatccatctgtgaaaaattgattaaataataataaatccctatacatatcaataggaaaggatcttcaggacatactgttaagctaaaataaaatgggtagaacagcatgttcaaaaggctaggggattgaataatatatatttgaatttgtgtgtgtatatatgtgtgtataaaatgtatatacatttatacatatgtatataaatcatatatataaattctgggacaatacacacacaaaaaaccacaagttacctgcttgaaggtcagggtggccactgcactaatgaggacaaaaaatacggagagctgttttgcatttttaatttttccccatttaaaaaccccagtaaaaatagaaaatgaaaaataaaattaatgaaatagtggaatttgaactaaacttcaactaaattcatcatcaaaaatgaaattgaaggtaaaaaacgataaaagatttctacttgttacagcatggaaaattagatactttgaagggccctcccactatgaaacaactggtatttcttgtaaatttgaacttacacatattatattccactcccagaaactcttatacatgtgcacccatagaaatgttcaaaaatgttcataataatattgtttataatcacaaaatcctgaaaatatcccaactgtggaccaacagatgaatggataaatcattatgggatattcacatagtggatgaaatactttatgtaacaaaacaaaataatcttaaattgcaatcttaagtggggggcgggagagggcagaattccagagggcaatataccatacgacgctatttttctaaagtttaaaaaaaaaagcaaaattaaataagtactgataaggactcatttatttgatgaaattatgaggaataaagggtggggcgactacatataaaattcagagatagtggctacttctgctgggggaggcatagccaatgggggatatgaaagaggagaacaaaggtgaaggtaaatatattggtaatgtctagttcttaaattgggcggtgggttcatgggtgttcattatcttgcttcataagttatataagtgttaaatacgttatgcatcaaatattgcctatttttctttaaaaataatagcagttaatgtttcttcacaaattgtaatacactttaagattttataaaactccatctttctagacaaactgaatgagtaattaggagcattacctttattttctccttatgcttactgtaaagtttctttgctaacagagaaaagcaattaagtagttcttaatacttcaactttgaatttctgcaagatatttatctgtgttatcattacagtctgctcctaattttgaaaagactaattttaaacaccttttgatccccatagacctcttagaatacacagtacatattctaaatttcagcatacatttcagaaattgaaatttcattcagactctagaaaactgtttcttcttctttaccttcagaaaagtttcctcaagacttcagtatacagataattctgcttccctagctgtttaaatataatatttatggccgggtacactggctcacgcctgtaatcccagcactttgggaggccaaggtgggcagatcacaaggtcaggagatcgagaccatcctggctaacacaatgaaaccccgtctctactaaaaatacaaaaaattagccgggcgtggtggcaggcgcctatagtcccagctactgggaaggctgaggcaggagagggcatgaacccgggaggcgaagcttgcagtgagccaagattgcgccactgcactccagcctgggcgacagagcaagactccatctcaaaaaaaaaaaaaattatatatatatatatacacacacatatatataatatttatgtttaaatgcagtcagattgtgtatttcaggccaaagtttgtaaatgtaagtgttttaaatattcatttttttctgattataaaaccagtatatgttcattatggaaaactaatctatttttccgtatgttttagccaagccctacaaagaaatgggcctaagctctgtatacttatggctaattcccttcagaatgacaataagtcagagtcccatcagcagcatgtgacagtctgtttccccaacagttggaagtatcatttttaaatccctgacaatttgcgtggatcagaaatttcataacatttatttttaatccccattttcctgattgctaaacattttttcatgatttcttatctgctctttttaaatgtcttcttaagacctttggccattggggtgtttgcctttttttaaaaaattgacttttatgtgtcctttgcatatattcaatttgttgctatgctgcaatttatactgtcatttgcctttttattttcttatgcggctccttgaacttgtttttagcatttacgtatataaatccatcttttttactttatggtttcatccgttgctcttatgcttagaaaaactatcatactgcaatgaataaatgcatcctaaaaatgctcatattatttccatttttaaaaaaaatgtatctgatatctttttacatgtaaaaatgagccaagcgagtttttaaaatcacaatttaaattcattaaatctttccggagaatattgcagaaaaacatgttatctgtgctaatctgattaaaaacttactctctaatttcagattctttttcctttaaatcaatggatcttcagagacagactcaactggtatgactaaaacagaggcaagcttaacattacctctaatcttccttcctagcttcagtaggcaagaaaggagaattcttgtcaatgtaattttttaaagactatagcttctcaccactcaggtaggtctaatatacagtcatcaatgtaaaagaaggatgatatcattctgaaatatttggatctttcctcctgtgttcagaggagaagcagcaattctacctgcaggctcaaatggacagcaatgagaatatgtatgttcccattgctcccaattgcttcagatagccctctatttacgggacctttgtttgaaaacaaccagatattcagggactgggctgcccagtacaagtaacccaccaatccttctaaataagatcactaaaagctggctacattcttacatttctaacacagtatttatgtctaaagaaataattaagttggatcactcagctttatatttacatccaattggctccaactgttttaactgtctcactacaaagtggtttctactatgggaaccccaaagggaatttgttcagggagctctctcaaaacactattaaagaaagtatatattaatctgtcaccttaaaagtccaacacttatatacctcccttctatctcccacccctacccacccccccaaaaaaaccaaaaaaacactagaggttctaaatatagtacatagcatttgggaaaccagcaggcaatctacccaatgtcatatcactgggacagtgtagcctcctggtttcaggatgttcagtgtttaataatacatgcatatgaaacaaaagtgacaaaaatattggtaagtcaactaagatcctaaagaggtcaataagaatgctatctcattccacaagtatttgtctttggtcatctctaatgaacctacaagtgccagcatatttcacaggggctaaataaaactttttaaaaggttaacggaaaaatatttatgtgaaaaatgcctccgaataatcttttagtgggtggatttggcacataccagtgaatacctttgagcttagtccaatcttgaattaagctacagttcaccttcaagaaactatgaacctgcttttaagtaaaagcctgtattaataagaaacatggaatgtgaatacaaaaagagatgttatcagctgaactgtatctaaatattttacaaagttttccaagagccgtgagctgtcagtagatctttaaaattcatgatctttttttaaaaaagttattcattcatctgtaaaaatctagttttttatgtgtacaccaagcataaaattgccctatgctaaacttaacataaacctcacattacagagttatgtgtttttattcttcaacataactattacagtgattcaaaggataaaaacacacttagaatagtctaccttctgctgcatttcagtacaatgaagaaagcctgagcagcacccaaaaactaggtccatattttaaatctgcaggcaatcaagcaaggaaaataaattgaggaaccaggctatgtaatcacaatcacttgcaaaaccatttaaactattttctagttgtaattgttagcagtttcctatgactgtaatcttttaaaaaatatcttccacttaaaaaattaaatgcacatgtacattaatgttttttgtctacttatagttaggtgctatgccagattaaaattcccctctttcccctttccaattctacattcccttttcatttttgtacattatggttccaagctaatttcgtattatttatccaaataatgggtggctaaaaatttgatctttaaaactacaattttgaagcaatgtagagtttaacaaaacataacaaacaaaaaaccatagtgagttagccatttcatgatgacagtgtttttcacaaagtaatatgttaccttttcagatgttattcaaggatgggtaatcattttataaatgttacataattaaagattctcaacattataaattagtatgcataactcttaacagagaaaattgaataataagatgtaaattgagttgttcaaggtcagacagtatgtcagtgaggcagccagcactggcaatctcaaattcctgtcttcccccacatgtgccatcccacaagatccctgctctaacctttgcctgcaaaatgctaactctggtattcttcacaggacagaaaccatttagaatagaatttcaaacttaagaaactgattaagaagttaacctaaatattaccataatatatgaatttaaattaattttcagctaattggtccatcatctgaatgatcaattcctaagcacagtccaacttcttcctaatgttgtatttaagtgccaatgagctggctcaaggggactcaggtttcacttgtgagaactaacccttggggaatgaaacagctacttttcagagctgggctgcccttatcctctatcgtaatccaaggaagggacaatccagtgttcattcaaagaactcttagagcagctttctcacctccttacagctgggaagagataacagaacattcttatttcaaagccttaatctgaaccattgtagaccatgaattcctaaagcattaaccgtctggttaagatttaagctggcttcaaatagttttctcacttctaactttatgtctcaagcaaacccgttatgcattcttacacatttctgatcacttaaactcactggcctctttgtgatattccttcccatgtctgcacaggacagaagtatcccccacttgtcatcccatgagatgtatcccttagcaagttaaaaaaaaacaaacacataaagctaggggccaaaacatcattgtttaatgatggagcctgcaggttatctataaagtgatttcacgttaaaattgtcaagttaataactatttgatctttatattaaaatacataaagtttatattctttgaaaaaaaagtttagtgcctgaatgtaactattcaataataagctatatattcttggtcaccatatgtatgcacaaaccatctgacagacaaaagtataagaatggaatttctggcacgcctacatagaatagtatcatttttataaaagacaagagggaggaggcatggaaggaaatcaacattcattacgtgcttactaggaaacaggtactgtgctaagtactttacataaaactgcaatcaatttcatgtttattacattccctcaccaaatcattataaaccaatatattcaaacatcaaaggaactgaacacaaactctaggaatcctgaactgattccattttttccttgggctatgtgctaaggccatcatattcatcacccctatttatacaggccaagggctcagaagcacattaatttaaattattcccagaaagcagccccaaaatgccattacctcactgaaataattcttttcaagaggctagttttgataatccaagaattcaattcttatgagcatactttgataagaatttgttactaatttcattatacatcaagagacgagccactaatatcaaagactaaaaccatggattacgataatttacagatttaagctttttcagtgcccagaggttgtaaagaagatagatagggttggaaatgggatagactgggtgtttttactagccaaatgttttgattcactgatttacagtaaaatgttaacttcagtgaaatagatacttttcaggaagtgagggagagtattaaggaaaaatgtctaaacgtccaatgtaaaatatcttgatcatatacatttgaaaaaaattagtaaactgaaattgttttttaagtgtttgacaatactgtaagtggaacaaagcagcaattttattcttacacttctgacatttcacttagtgactttaataaaatattaaaattctaatgactcagcaaaacgcaaaaaatgcttaggcaatgttaagtgaaaacaataaaattttatgtatatcataattatataaaaatttgtgtgcataaaaaataattggaactttgaaagttgatttgacagtataatcagcttatagataattacttctttatttttattataaaaattatttttatattatttaaattattttttatatttttatattttttataatgttgtttcaataaaaatggcaactttaaaaaagcatgtgatcactacatgtattaaatggcagtctgtctgcaatggcttaactgtgttaagtgtatctgtgtcttagttttccagctattctgtcagttccaggaaagcaaacaccaggactcctttgtaccctccaaaatacttaacacagcctctcagacccagacagacccaaccaatcccagtgacagctagtcactgagccactgatgaacaccaagtgcagacaacataaaaatgagaacttactattatttgttggttcaggaaacccaggctttggaccactccatcctttgttttcccctgtctgaaagattaaatcaatcgttcaaatccagagaaacaagcttattcaaaaagaaaaaaaaaaaggtgaccaattaagcaaaggcaaagtcctctcacatggttattctgcatattatctctatctttgaccctgggatgatggctacaaaagaaactaacatgaagggtatcatttattccttttctgcacctaaatctacttatgtccttctacttttgtctgatcatgtaaatttataattcaaggcataaagccaatattcaatatatgtattattagaatgtaagctctagctaggtggtgaaaaaaataaatctttttttttttttttgagacagagtctcattctgtcgcccaggctggaatgtaatggcttggtctcagctcatcgcaacctccacctcctagattcaaggattctcctgcctcagcctcccgagtagctgggattagaagtgcctgccaccacgcccggctaatttttgtatttttagtagagatggggtttcgccatgttagccaggctggtctcaaactactgacctcaaatgatccacccactttggcctcccaaagtgctgggattataagtgtgagccactaagcctggccaaaaagtaaatcttattaaaatagtaaataataatcatcaccacaaatgcttaagtgaccaaaagagcttttgtatgattcccgaggtcaaattaacaacctaacaatcaaacatttctgtagacaaaaatgttactatgtccatctagaaaagtcctatggtaagggtcaccaaatactgctataatgacatatacaaaaaatacaaatataaaaaaaataaaaaaataaaaaaatgacatatacaaaaaaattgaaaactaagtcctaactttaagtcctaactttaagcaaactaagtcctaactttaagcaaaacatgtaatattctgacttttgccaaatgattagtgtttggtataaaatacattctgaaatgtagatgctttgaagtagtaagtattcaaatcaaattaataagtgactttagttatattatctttctgtacagctggtaacttatctcttatgatgatcagcattttatatttatgttaacggtcaaaggtcaaatagataattaagcctagatataaacacaaaatacaattgctgcaaatagtttacccatgttcatttttaaaaaaaagttgttcttattgaattcattcctttttaatcatacatcttagggtgacaaggaaatatatagtggcagacagcagaagcaaaactgaaaataaagaatcctgaagagtaagttgacagtatgttagaaacaaccagcagcttcatatgaactagggagcatctctttctctctctaattagctcttttatctctttaaaacacaaattcctgtcttcatcaacatttaccatcctgagagattgctgctataacctttgactgcaaaatgctaacacaggcatccttcacaagagagaaattactatgtaataaaatagactgatagtagtaatagctaatagctaacactgaagatttaaaagtggggttgctaatgcgctaagtgttttgcataaatatggattatctcattttcatcctcacaaaaatttggtaagataagtgatattaacattcaattttacagacaagcaaacagggttagagttcctgtaattactctaaggtcacacagataatatgcacaggtgccaggacatcaaactacatcttctaactagaggagagtaatcatgctacctttgtactgccattatcaggagagaaaaaagaagctaaagaaaggaatgagcaaaaaagttacagattaagtaaaactgtgccatctaagaatgaaaagaaaaacagtgagatgaagaacagagtttggaactattaagaagaatgctctaaaggtacggccaggatggaaaggactactgcaaaaacaaatgagagaaaacagaagtagaccagttccaagggatgaaagaaatttaaaagattttgaaaagcagctaaaataattattcacatgaaaacctggtgaacagaaagaaacaaagtatgttcaatttttcttttacattcctaccatacttttaattttattcatacctccaaaacatagcctgtacttatcaaagtgctgacaactgtttaggttcttagagaaataattacgtttccagaatcctggagcagttctacaattagccacaggattctagtctttctaaacaagtttttcatttttaataagtggaattaataaaatctgttttatttgactaaactaatttcttctattcttaccttatgttacctcaatactatacaattggctggatgtggtggctcaagcctgtaatcccagcactttgggaggccgaggcgagcggctcacctgaggtcgggagttcaagaccagcctgaccaacatggagaaaccccgtctctactaaaactacaaaattagccaggcatggtggcccatgccggtaatcccagatactcaggaggctgaggcaggagaatcgcttgaacccgggaggcggaggttgcagtgagctgagatcgtgccattgcacaccagcctggacaacgagagtgaaactccgtctcaaaacatgtatatattatacaatttatccagtaggtaacatatgattttcatctgagagctatgcctaacttcaaaatttctttcttttaaagatcattgtttgaagagtaaggggaagaggtcaggagagatgaggtcaaagtaattactacgagaacttctctcttgaaaaggagaaacccagcaagcacaaagtacagttcatctcccaatccttactttctgtatttcttctactgtacccctcagacacaaacgagaaatataaaaggagatgatatggtttggctctgtgtccccaccaaaatctcacctttaattgtaataatccccacgtctcaagggtggaaccaggtagagataactgaatcaagtgggtggttccctcatgttgctctcttgatggtgaatgagtctgacaagatctgatggctttataaggggtttccccttttactcggtattcatttctctttcctgctgccctataaagaggtgccttttggcacaattttaagtttcctgaggcctccccagccagccctgcagaactgtgagtcaattaaacctcttcctttataaattacccaatctctagcagttctttatagcaaacaaatataggaggcaacagcaggaggtaagtcaaagtctggaaagtggaaagcagatgaagaagttgtagctagcttagcagatgtgagtaactgaaacctaacctgcagaggaagaagccaacaaagagctcacagtaaggtgatgtgtcacccagaaccctagaaagcctccagaattaggagtacacctggtacatttaaagatgaatcctggaaggggctgaaacagaaagatttgtctggaagtcttttcaaggtattatgaaatctccctatcaactctttgaccccatgcagtcaggtgcctaccccttcctaataggggtttcctgttgggagaggctaaaacagagaggctctggataccaggcatagttgagggtgaaatccatgtgtcaccctgcaaataaggagatgggagttccaaggtttcatactgaaaaataagattccaagactcttttctcatttgcccctcagaagacacatccagggttccaaaccacaggaacagaaagataatgaggagaacagaagaaaaaaaatgcaaaaaaaaaaaaaaaaaaaaatcctcaggcacataagagaaagactacacccattaaacaagaataggaaggcttaaaaggaatattctgagaatgaggaagaactctgggaaatcaaaaataaaatagctgatgtgaaaatgtcagagagggactagaaaacaaacttgaggaaatcttcctagaaaacagaacaacaacaaaaacagaaagagggggagaaaagaaaaaccacaagaccatccataagattggcatctcagaaataaataacagcaaaaataaaagtaaagaaattattaaagaaataagaaatttctcagtttaaagtatatgaatttctagattaaaactcaaatgtccaacacaatttatcaaatacacatataaaatacacatatctcagaacccctgagaaaatagaaaagcatcgagagggaagagaagggtaaaagtttcatatacaggctgaagaatcaggtgttgaaattttaacagcaatgctgggaggtacaagacaagggtgcgatgccttcccaactccgtgaaaatttacttccaatttagaattacagcttagaaaaaaactatcaagtgtgtggcaaatataaaaaaatttcagaccacaagatctcaaaaaaaaagtttacttcccatgtatccttcacagggaaggccctaaagtatgtactccattaaaacaagaaagtaaaccaagaacaagggaaactgtccagaaaatagtcaactcaacaaaggacagaggccagagaaattttcaggataatggtgaagagaagaaccttaacagcagctctgcagcaggcatatcgatcaatctgcaatacaagaggaggataaagagctctaagggttgggtagggtgtacgttgggaaaggaacgaaaaaaactgcatgatgtgcttgactggtaaagactttggggacagaaagatgtagaaaagtgtatgtgtggagtatgtaccagagttaaaccctcattttccatagcagaaagtacatttaatttttttacttttatattacttctcataatatttaaacatgagaaaccaagagatagcacaaactacccatagtggtaagtaataaaataaatagttacaataggtggtaaagtggttgcctctggcaaaggggaagcagaaatggccagtggcagggaaggagaacaggatattttggtattttaaattataaaccttgagtttttatactattaatcttgtataaattctgcctttttatatatgtattattttgagtatgagtactactttgatgaatataatgatcaaatacaaaaaagagtagtcatgtcttgacttcaacaaactccaagatattaagaaaaactctaagatatctgaatgaagaaaatcaagatgcaagaatggcatataaaaaagaggtgaagagagtattccacttttccttagaatctggaaacataacaatgacaaacagccaatctgaaaaagacaattgcaacttttcttgaaccctttagagacctgagattacaaggtaaacaagcaaaatgaattctagtgagtgataaatccttctgggagagataggactcacaaaaatgttaacagctttggcagggcagggatagcagagatgactgccatgaatgtaagtaagaagaaagtagatgaaatgttaaattcttaaagcctgagtatgagctagcatgatagtttagaaaaactgggagctccagacagcagctcttttccattgtcctgccctggattctcagaaggacaactggggctacagctgcagaccagagagagcccaacttggtgcaggaatgcagctggttaatggctgcactgagggataagcacagaaccttgccacttctctaggccattctccaatacaaaacaaaaaatttaagccaccgggggaagggtagaaacaaatcctatatgccgttggggcaaaggcaggaaattctctggtcctaagagctcagtaaagcttcattgcttctgaagaggattgaaagcaaaagctatatgctcctggggaaaaaaaaagatagaaaacctacttgagagtaagacactacaccagtataaagcagaggtctgcaaatgctgggaaatgtacaggaaactctctcatgcccaaactgcccaaaaatccaagataaaatttggttaccacagagaagacagcaaaaacagaaagatccacctctgacatccaggctcacagaatctgccagaaaatgaagctggacaaaaaaatcaagaactatgacacccaccacaatcccaggattaaataataaatagcagcagtctactacagagcctgaagagagataaccccatgccatgacacagcaaagaagagacctctaaacctgagggctgagcagagaaactgtgaaaaaatcctctcaaaacctcacattacacaaagcatgggtaacagcatatcactattgaaggaatttgtagttaacagtgactatggcaataacaaaacccaaaatgaattcagttaataactagactgatgcaaccctcgatccaaaaagtctgagagagagacatatgctgatttctcaacaaatactatttgacttagcctctactatttttctgttgcaaggtccaacactcattcaaaaattatgagatacccaaaactgcaagaagaaataaaccactgccaaaacacagggaagtcaacaaaacagggcccagggatgaccctgatgctagacctttcagaaaggtattttacaacacctatgattcataggttgaaagaccaactggaaaaagcagataacatacatgagcatatggggaatttcagcacaccaatagaaaccacagaacaaaaacataaggaaatcctaaacgaaaaatattagagatcaaaacattgatgtcattattaataatgcattaattcagactgcacacagctgaagaaatattgttgaacttgtagacaaatcaacagaaattactcaaactgtttaataaagaaaatcctataagacaataccaatggtctaatgaatgtataaatggaaactccaaggaaaagagggagaaaacaaggaataaaatatattttaaaagataatagctaagaacttgtcaaaataactgattccatgacatcaaatcacagatccaaaatgctcagagaaccctataaggacaaggaggatgacaaagatgaggatgaggatgaggaaggaagagaagcaggaggaggaagaggaagaggaggaggataaagaagacaaggaaaaggagaagggaagaagaaagaggagggaggaggagaaggaagagggaagaggagagaagaagaacaatagggaaggaggaagagaagaaagaataaagaggagatagaagaaagaggagaaggaagtagggggagaaggaagtaggaggagaagaaaaaacgagagaagaaatgagaagaaggaaggaagaggataagaaggagaagaagaaaaggtggaggaaaaggagaaggaagaaaaatagaaagaagggaggaagaagggtgggaaaagagtacaggggcagaggagaaaggaagaaacaaaaaaaatcaattagatacatcacaaccaaattgttggaaaataaagaaaagaaatatattaaaggctgagagaggaaaaaaaatacatcaacaagaacaagtaagaattacaacagactttacattgaaaattatgcctatcaggagacaagggagcaagatctttaaagtactaaaagaaacaggaaacccagaatcctatatccagaaaaaaataactttcaaaaatgaaggtgattcattggaggcttaaaaaagaaaaaataacgtgaaattttctgctagagcagtcactgaagagcagcagccatagttctgcattaccccatgcccatgggcctcaaccagggcccaaggtgaacaagaatatgagcaagctgaggcagggctgccaccctggacaccttaccaagcacacaaagcttgtgtaagacatcatctgggaggtgtgtggcttccccctgaaagtggcatgccatgaagctgctcaaagtctccaaggacaagcgggccctcaagttcattaagaaaaggatgaaaacacacatatgcaccaacaggaagcaagaggagctgaggcaatatcctgactgccatgaggaaagcagctgccaagaaggtctgagcccccaccccactttgtgtataataaaacctgcaaagaaaaaaaatgaaagtgaaataaagacttttttggcaaacaaaagctgagagaatgcactgcctacagatctgctaaaataagtaatattaaaggaagtccttcaagcaaggaaggggtataataccagaaagaaatttgaatttacacaaataaatgaaggatattgaaaataatcaaaatgagagtaaatataaaaggcattttctgctgattttaatcacttaaaaagataactgactatataaagcaaaattagtaacagtgaattgtacggtttgaaaaatatagaaaactaaaatgtatagccacaataggaggtcagagaaacttagagaagtaacctatgtgaccacaatagaggtcaaaaaagaaaaaaagtaaacagagtaagtgcggggaaaaaaaaaggcaactaataaaatggtgtgtttaaatacaacaatctcaataacttcagtaagtgcaaatggtctaatcaccctaactaaagggcaaagtttgtcaaattaaattttaaagaacaagacccaattatatgctttctaaaagaaaccaatttaaagataggttaaaagtaagcacagggaaaaaaatatcccatgcaaacaccagtcaaaataaaactggagtagctatattaatatcaaacaaaacagatttcagaacaaggaataaagggaaatatccaatagaagtggtcaagtcaacaaagacacaacactaactgtatacatatataacaacaaagtttcaaaatgcataaaacaaaaactaataaaactgtaagaagtagaagtaggaaaatccaaacttatagttggaaactttaacactggacaaaacaagtaatcataacagatacagggcctgaaagaagaaatcaagagggaaatcagaacatattttgagttgaatgaaagtaaaaacccatacagcgtgtatcccagaggtaaaaaaaaaaaaaaaaaaaaaaaaaaaaaaaacaagagagagacaagaaaaacccaacttgtcaaaatgtgtagggcagagctaaatcagtacttaaagaaaaattcacagcattaaatgcttatattagaaaaaagaaagttctcagatgtatagcctaagcttctacctcacaaaattagaaaagaacaaaaaattaaaaacaaaaacaagtgaaggataaaataaagagcagaaatcaaaaaaactgaaaatagaaaaacagagaaaaatcaatgcaactaaaacctaattgtttgaaaagacttaaaattttataaaccccctagctaaactgaacagaagaaaaagagaaaagaaataaatgatcaatatcagaaatgaaagtgagtatcattacagattctgctactactaaaagagtaaagaaatgttatttagattttgccactattaaaagaaaaagggaatgttataaacaattttatactagtaaattcaacaacttagatgaaatcaactaattctttgaaagactaaaactgccaaagttcattcaagcagaagtaggtaacctaagtaaccctatctatttttaaaatctgagtttgtagttaaaaaaccctttccacagagaaaattctaagcccaaaagccttcactggtaacttctaccaaataattaagaaataccaaccaggtgaggtgcctcacgcctgtaatcccagcaccttgggaagccaaggcaggcggatcatttgaggtcaggagagcaagaccagcccagccaacaaggtgaaaccgcttctttactaaaaatacaaaaaatcagccaggcatggtggtgcacactgtaataccagctactcgggaggctgaggagggagaatcgcttgaacctgagaggcggaggttgcagtaagccaagatcgcaccactgcactccagcctgggtgacagagctagactccgtctcaaaaaaacaacaaaaaaatcctgtttttgctggttttaaatattgcttttgccacactcatcaaaagtcttattgataaatcaatatattcagtcctcttatttgatctctctgcagcatctgactaccacctagcagtcattctctattcctttttgcaggtagtctttcctcctcttttttcctgtaccttgcatgcatcttatctactattcaaatcttacccattacatttgtgaaatatctctggagtctttccattcctcctctctaccttcactgtctcagttcagaccctcaatatctctcacctaaacaactctggttgcctcctgactggcctttctgcctttggtttcactctgctcaaatccatgctccccattacttagagttatcttttgaagaatgcaaaccagatcaattcacattcatgttcaaatcttaaataagcatttcttcaaaccttctacttcgcataataacagtgacctcagcttttcctgactttccaggttcatcctctagttttgttatatggttaaaattcctcactccctgcacttaaagaacgatcagctccttgagtgcagagaccaagtctcagtcatcttattaaaatcagtcattttaagtgtctggcatttagtgagtgtgatgattaactttacatgtcaacttctctgggccacagtgccaaatggtcaaacattattctgagtgtttctgcaagagtgtttttgggtgagatttacatttaaagtggtgaactctgagtaaagcagatcaccctccacaatgtgggtagtcctcatctaatcagctgaagggcctgaacagaacaaaacgctgacctccctgggcaagtgggaattttccagtagactgtttttggactgaaatttcaactctttcctgagtctccatcctgtcaggctgtcccatcagattttacactagccaagcctccacaatcacatgggccaattccttaatatatatacacagacagacacacacatacacacacacacacacacacacacacgttgatggttctttttctttggagaaccctgacttatacagtggttatgcaaaaaatgtttttcaaattaatgaaattaattaatgctggttttttgttgtgtttgctttcacttaatttacaaatacatgtctgtgaggagatttattttgacatatttttatagatcactcaccagttttaagtcaatataaatgtgttaagttaaaacaacatatatacaatataaggactatagaaactggaacacatgttaggtttcacgttacaaatacttttaaaagaagaaaaagtgttgactagccaggttataaaaacagaattgaaatctctagcaataatacacagacaaagattttttaaaatcattcaaaagaattgcctagaaaacaaaaaagtacatctaagtgtctttatatatttttgtttctaattctaaacttttaaaatgtgttcctgtagaaactaaaaaaatctctgaaacagaattcttgtgtgagaagatggcctggtctaaagcatattacttttgataaaagtaattagtaagcctgttttgtgaatgttcacataaataaaatgtttggtagaaataatgtctacatatccacagataacaaaatgatacttaatacaaaatggaaataagccaatttctgccaagttatctgccaagttctgaattcagggttctctgcttcccttgtaacagatgtaggtgttaatgatgtcattaactgttgcagaaaaaataggggaccatgaacacaggtcttggcagaaaataaacaacctatgagttcacctttaaatttaaagtaaatagaaaaattagtttatagagtgtctgtccaatacagttcctgccctaaagggataagtcagaatttttatttccagtgttttcagctgtattccaaaaataaaggctaacaacctgtgttcttaaaaggcacaaattaagactgtgtctatatggcaaaaacaaccagtcaacaagttaaaaatgttaaattggtattacataaaatatgtacaaccatacaacaaactttttgtattttctaatcataagattataaatactcattaatatctcatcttactccatatgttattttgtgcttggatcatctatctttgtattgcctcagaaaagttaaaattgacatttactttaatatcagttaagatcaaaatttattaatcactttgatattatgacagataggatacatacatgtaaacttaactcttaccttctcaagttgatcctgaagattagtggatgctttataaccaagttgtaacagcattgcttctgcagcattttttttggctatctttttattaggtcctgttcctgtagcaacttcattgcctaccttcacctgataagattaaagaaataaattaaagaaatacatttatgataaatttaaacaggaagtccttacatcataaagcaattctactctctagcatttgaaaacataaagttcagtccaaagtaaaaatggcaactaagataacatttatgtaatgttgtatatgtacatgaaaaaatggtccttaaagtatcaatggaggattatctcaggatggtagaattttatagaatttttacttccatatatatttatatgctatttgattttttaaacactaaatttatattatttatataagcagaaaaataaaatttacattttaacagcgttcatgttggttatgactacattttagcattcttatatttcaattaataaactgaaaaggctaaaattcatattggtgccatttaaaataatgttcaaattgcaatattatgtaaacattcaagtttacaaagatttatattaaatagttcctgaagagaattaatatacaagtgttcctacaacattatgattaaaaacaaggcttctggccaggcgcagtggctcacagctgtaatcccactttgggaggccaaggcaggaggatcacaaggtcaggagtttgagaccagcctggccaatatggtgaaaccccgtctctactaaaaatacaaaaattagccaggtgtgatggaacacacctgtagtcctagctactcaggaggctgaggcaagagaatcgcttgaacccagtaagtagaggttgcagtgagccacgattgcgccactgcactccagcctggggccacagagcaatactccatctttaaaaaaaaaaaaaaaggcttccaagtcagattgggatatgaaactcaactctattatttcctagctgtacgaactggtacaaattatttaatatctctaagcctcaggtttttcatcagtaaagccggggtaataccaactactgcacaatgttgctttgaaaattaaacaagataatgtatgtaaaccacagcatttaatccatcacaattgctccaaaaaaaagatttttatcattagaactattctacagttatcttctgtgagcaatttatacatgtacttaaatacacatcaaccatacaactataaaaagtaaagtagatagcaaaaaaggatagaattacaaggagaaatagaaaatacacaactatagttgaatttctttttacacagtggtctcagtaagtgattgaagaagtagttaaatagttaatcacaactttggaaattaaacagtgtaattctggtcaggtgtggtggcttatacctgtaattccaacactaggaggattgtttgaggccaggagtttgagacccgcctgggcaatatagtgagaccccatttttacaaaaaaaattttaattagctaggcatgatggtgcatggctgtagtcccagctacttgggaggctgaggtgggaagactgcttgagcccaggagttcagggctgcagtgaaccgtgatcacatcaccacactgcaccctgggcaacagagtaagaccacatctctaaaaaaattaaaattaaaaattaaaaattttataaacaatgtaattccaaattacctaagggcaaaagaagaaattccagtgaaaactagaaaatattttaaataatccatggacatatatcaaaacttgaaggacacagcaaaaggagggtctagaagaaaatgcatagccgttaacagcttacaggagggcaaaaaagtaatgagctaaacatccacctcaagaagtcccaaacatatcagcaaaacaaacccagagaaaatagaagaataaaaagcaaaaaggaaatacaaaacaaagtacaataaagttagaaaagccaaaagttggttctctaataagactaataaaacaataaaccaaaagtaagactgatcaagaaaaaaaatacgagttcttctctgagatgggtatttttaaaaaagaaaagaagaagagaagacacaaataagaaatgaaataattaaaaagggagattaccatcacttctgtagcattacaaaataataaggattactgaggccgggtggagtagctcactacctgtaatctcagcactttgggaggccaaggcaggtggatcacttgaggtcaggagttggaggccaggttggccaacatggtgaaaccctgtcttactaaaaatacaaaaataaaaaaaaaaaaaaaattagccaggcatgatggcaagtgcctgtaatcccagctacttgaaaggctgatgcaggagaattgcctggacccaggagaaagaggctgcagtgagccgagatcatgctactgcactccagcctgggcgatagagtgagtctctgtctcaaaaaaaaaaaaaaaaaaaaaaaaaggaatactgagagcaatttcatgctaaaatttaaaaacatatttagatacaatggaaaaattcctagacaatacagattaccaaattgccacagaataagcctaaagaatatgactaaaactactaatgaaatcaaaccataattaaaaacttcgcaaaaaggactcttcagatcttctccataaagttctactcaatatttaaggaagaattatgctattcttttcatccaaattcatccataaaacacgaaatgagaaatcagtccccaattattttatgagctctcattttgattccaaatcccaacaagaacagtataagaaaatttacagaacagtttcactcatgaacatagatgcaaaagttttaaacagtataatgaataaagcaatatagaaaaagaaaaagattcatgacaaagttaggtttattgcaggaatgcaagtttggtttaacatttgaaattcaaactagaaatcgacatttattcataatgaaaattattagcaaactaggaaaagaagaaaactttttttttttttttttttgggatggagtctcactctgtcacccaggctggagtgcagtggcacaatctcggctcactgcaacctccaccttccgggttcacgccattctcctgcctcagcctcctgagtagctggaactataggtgcccgccaccatgcccggctaattttttgtatttacagtacagatggggtttcaccgtgttagccaggatggtttcgatctcctgacctcgtgatccgcccacctcggcctcccaaagtgctgggattacaggtgtgagccaccacgcccagtagaagaaaaccttttaaatatgataaagggcattttacaaaacacctacagcaaacctcaggaaacactgtacttaatgttgaacgaaactaattagaaacaagacaaggatgttccctattattactactgtttaacagtttacacaaatcctagacagagaaataaggcaaggaaaagtaaaaaaagaagcagaagggaaaagaactcattatttatagatgtgatttcatatataaggaatctaagaaactccacagatgaattataagaattgattagattgtaataagctcagtatgaaaaagaggactgcatttctacattccatccacattcaagtagaagatgaaaaatattaaaaagataacatttacattaaatgaaaatcaaatacctatgatgtgcaaatcttctacatagaaaacaaagtcttattgagaaactttaagaaaaacctcataaacagagcaaaatgccatgttcatggattgaagacaatactaatgtaatagtatcagttctcttcaaattgacctaaactcaattaattgaactcaatgaaaactcaatcaaaattccatatatctttttacaatacttgaacaagatgattccaaaatttacatggaaatgtgaagtgctaagaacagccaaaatccttttgaggaagagcaaggtgtgggacacttatttgtctggatatctagacttattatgaagttaatataaagaaaaaatttaaatttgactacactaaaaattactcttgttcttctaaaagcattatttagaaaggaaagtcacaacacaagaggaggtatttaaaatgccatataactgcaaagggcttgcatccagaatatacaggaggttcccatatatcagtttttttaaaaaacgagcagaaaaatgagcaagaaaagtgggcaatccatatctgaaaagttgaattgttttaccagttatcattttacttaaaaaaaagttagaaagtttcaataatagtttcatgccactttaatacatttcacaatgacaacaaaattcagttttcagctatacagcatgatactctaaccatacttttcttttttgtctattgtgtaaaatcataatattggctgtttcatctgtcccagaacatacagattcccatttggtatccacacttgagtactgttcatcatttattcttacatccttatttacagtttttatttgtgttattatttccaacagtactttttttttttttgagacggagtctcgctctgtcacccaggttctggagtgcagtggcgcaaactcggctcactgcaagctccgcctcccgggttcatgccattctcctgcctcagcctcccgagtagctaggactacaggtgcccaccaccatgtccggctaatttttttgtatttttagtagagacggggtttcactgtgttagccaggatagtctcgatctcctgacctcgtgatccacctgcctcggcctcccaaagtgctgggattacaggcgtgagccaccacgcccagcctccaacagtacttttaagcttcagtgaaccacccaattttaaggaactgggagaatatacaacaaaatggtaagaaaatacaaacttaaacataaacaatgtacaaatgatataaaaaaggtgctgtactctcttttaacagagtttcagtaaagacaaactaaatgacagttcatacagcacatgaaacgctgaaaacatattcattacagaatttctgtaacaactatcacaaattgcatagtttaaacctgtgaaatattttttaaatatttcattgcctttttttctgaaactggaaaccactatgtcgtgacaaatcagaagcagtctttggacctcactctgagaaggacaaatctagtacagtcagaccaggtactcagagccagatgaatacacaccacctgccgtaacagtgtctgcctcaacatggcaggccctatggataatctactcaaatccctggctagagtacctctgctccctgttattttttccaatgctttgtttgttcccccagcttcatcagtccctatgttgctgctggaatccttgctggtgaaaagattaggccagttatgtcagaagcttcctctactgctctgaggcctggtcttggacttgtcagctgtaatgctgttcccattcctgtattcaccttgtctctccgtctgctagatttccatctggcctattctgataccttcaagacttacttcttctaaaacaagtgcttcccagattcatttacccattcacccagcccttgcctcatgcaaattttaataatcgcatggttgaatagtttgtaagcagttatcctaatttgttaatataaaaagaccacattgccaaaggactttcattccctgctaataaacacaatggtcactcaaaacatcactttattataaaagttaagtaagtttataaatttcacaagtcatcttccttgagaagtcacaaattttataactattgtaaatatggtctctacatttaaatgttaatttctatctgtaaagaagctcaattattttaccatgcagtaaatttaagactgccaaatgtttgtctttaaatttaacagctcattcacatgaatcaaatcctcaaaaacctaagaaactaaaaagttctgaaataggatttaccaaaaacttaatttttatttattttttaacaacctggtgatctcaatcacaggctgaaaagttagtaatacagtgtgctgatatgcaatttggtttagttatcattattttctgtttgaaagattaaaatactcctcaccaaaaaaatgaaaagctttaagaaatctgctctggaataaaatacccaaataatgtcatcggagattttctttcgtttatctagtaatcaacataagtaactgcatccattttttaatatatagactttttctttggtaacagataaaaatgagcatctcatctctagatattttgctgccacattcaattataacaaatgataacattgcctaagtagtttatacaaaggccgttactttgataaaattgctgcaatactgtaatgaatccactggggcttccagaaggggaaaaaacaatatgaattcagtgcgaaaacatttaaaagcacagccaaatgtccccatttgactagaatgtttatgaatacccataaaatggaagctggcctaagatatgctaaattcctctttcaaaaggggtactcaatatactctgtagaaaaggatttgtttaataaagccaaagccagtttatattcccaatacatgtctaaaattcaggcgatttttttcttcaagctttggcattcaaagtatatgttccagaattcttcaaagttaagaatgttaaggaaaaaaatagtgaacatattttaccagtgaaaataatgaaacaatcatgtgctggatcctaataacatcttgacaataatgtgattactaaccagagaattcccctctttttggatatctgggttcccaggagtgacttatctatgactacattataagttaacatctccaaaaaaaaaccatacaggcagaaaggcaggcagcaaatatctatcaaatgtttattaaggtcctactatttacaaaccactgtattgggtactgaaagataaagaaacatggagattataaattgggagggaaggcacaacttagctatacacttaaacttaatcaatatgagacactgtatttgagtgccaaaatgtctaccacatggtcagcacttaatatttgttgattttatctaagttacataaaatgtgagatccttggatttgactaaaaagtttctgtgactaaccaattatttaaaaaacagtttgagactaagcacagtggctcacgcctgtaatcctaacactttgagaggctgaagcaggaggatcacttgaagccaggagtttaagactagcctgggctacatagtaagatcctgttgctataaacaacaacaataaaacaacatttaattagctggccatggtagtgtatgcgtgtaatcctaggctactcaggaggctgaaaagggaggatctcttgagcccaggaaatcaaggctgcagtgagccatgatcatgccaccgtactccagcctggctgacagaacaagaccctgttgccccaccaaaaaaaaaaaaaaacaaaaaattaaaaaacagcttggggaaaataataatttaaatatagactgggtattagatgattctaatgaatcatgtctaatgtaagaaaagctttcatatttcttagaaacatacactgaatatgtaaggctgaaatgacatgtagttagaaattatctttgaaatacttcagtaaaagaagagagaaaggaagaaagagagggagaagagaaaaattaatagctgaatcaagtgtggcaaaaatcttaataactgttgtgtttgagtgatgggcatattaatggtccattattattctctccccacctttggatatgtttgaaattgtaataaaaaagtaaaagaaaaatttcttaagactggagtttgagctggcaaatgaagatgaataggtaggggttgaaaaggagagcattttaggcattctacttcattcctagcccatctgccaatacactagcagccattccttgattttcttggctccacaatgcagcagtcagatctcagcaatcctgagtgcctcagcccccaccatggttagctagcctgcttactctctttttctaactttcctgacagcccacaagctcaggattttggccctgatccatctactacatccatccttctaaattttgtttctaattccatgtgtctccaattcccagtagttaacagactccggctacaaaatgtaacacaaaaagttaaaagataggcattaaatgataaactccatggtaaataacctgtgtgaactcagagtcccttggaaaactcatgttgtctattgtaacatgtccttgacacttgaatgtttccaccaagttggtaggtgagcctggacagaatgaatgctttaactggaaacagttttactttctgctcttaagtcctagtttgcctttcgcccaaatgcctattccatcctggggatttctaaatcttttcaatagttttaaaaggttagaaatacctgcatcacaaattctcgacgtcgaggcattcctctttctgaaagcaaaacataatccggctccttttcctttttggcctgttgaatttgcgccaggcggctaatagggttcatcccttggccatattctggtccggcctaaaaattaatttaagaaaaagttttaaaatatgcttgtgaaacctgttattgaatccttaaagaaacagtgcttcttccctccacccccacaccccaaaactgtgactagaaaagataaatgagtcatttatgaatatttataaaggaaaatcataaaatagacctgtaaccaaggcttctatgggacttggggcttagatgtattaatggcaaggtgtcaactatgctttttaaattgggcacactcttcagtataccagaggtgcttcacaacttctgttcatcaagaaacatcaaaaagaacagaagaagaccaaccatgaactgggaggagatctctgcaacacattatcattttattttattttatttatttttttgagacagagtttcattctgtcgcccaggctggagtgtggtagtgcaatttcagctcaccacaaactccacctgccgggttcaagcgattctcgtgcctcagcctcccaaatagctggaactacaggcgcgcccacaccatgcccagctaatttttatatttttagtagagatggggtttcatcatgttggccaacctgatcttgaactcctgacctcaggtgatcccactggccttggcctcccaaagtgctgggattacaggtgtgagccgcagcacccggccacaacacacataattttaaaaagacgtatccggtatccaaaatatattttttaagacccctaaaaagtactaagaaaaagagaatataaaagggaaatgggcaaaagagataaatacttcacataaggaaaaactcaatatatgaaatgataactaacctctaggacacagaaaatacatattaaaaacctcagtgagttactatttcacatccaccaaattagcaaaaattaagaagtctaacagccccaagtggtgagaatggggagtaacagaaactcttataaaacactgggagtactataaatcggaaaacaacctggcaatgtctagtaaagcctgagatggtacatcctaccccaattagcctattcctaggcacatataaaccctagaaaaccgtaacccatgcacagtagctcatatgtacaggaatatccacagatgcattatttgaaataggaaaaaaaaactagaatattcatcaataaaagaacagataaattacagcatgttcatataatggaatggtatatagcagtgaaaatgaattaattattgctacatgcatcaagatgaatgattttcagaaagaatagtaagtaaaaaaggcaagctacagaataatatatatatagtatattttatgtaaagcctgctaaaactacaaaatactgctgaaattaagatctaaatagtcaatacatcatgttcatcgatcagaagactcaacaataagatgtcaattctcctcaaaatcccagtaggcttttttcctttttttttttttttttttttggcagagtctcactctgttgcccaggctggagtgcagtggcatgatctcagctaacagcaacctctgtatcctgggttcaagcgattctcttgcctaagcttcctgagtagctgggactacaggcgcacgccaccatgcctggttaatctctgtatttttcatagagacagggtttcaccatgttggccaggctggtctcaaactcgtgacctcaagtgatccttccacctcggcctcccaaagtgctcagattacgggcatgagccaccgcacctggcccccagttggctttttaaaatttaatgtgtaagctgatactaaaattcatatggaaatgcaaaggacaaagaaccaaaattttgggggaaaaaaaaagactcagactacctaatttcaagattataaaactatggcattcaagacagtgtgtgtagtattggtataaagacagacaaagggaccaatgaaacagaataagtgcccagacacagatatatatacacacatacacatacacacacacacacacacacacacacacacacacatacacacacacacacacacacacacacacacacacacacacggtcacatgattttcaacaaaggcacaaaaggaattcagtggggtagtcttttcagccaatagtgttgggacaattggctattcatatgtaaaaagaaaaagaaaaagaaaaaaaaatcttcaagccaaacctcataacatttataaaaataattaactcaaaatgcctcacagacgtaaatgtaatttctaaaactataagatttccagaagaaaaatttttgtaacttggttaggtaacaatttcttagatataacaccaaaatcacgttccatgtaaaaaaactaataataataaaatgaaacaatataaataataataaaataaacataataaatcttcaaaattaataacttctgctctttgaaaaagacaagtcacagacttgaagaaaatatttgcaaagtacatatgtaataaagcacctgtatccagagtatataaagacctctaaaaattcaataataaatttattattatttgaaataagcaattaaaatttgttaagctggcaaaaaatttaaataaacacttcatcaggcctcatgtgacagtaaacacataaaaaattcttgatatcatctgccacagaggaaatgtaaattaaaaccaaaatgagatatcaatacccatctacatgaacatctgaaattttaaaaactatgctaggtgttagcaaggatgtgaaacaattggagttatcacacactgctgatgagaatgtaaaagtgcacagctgctacaactttgaaaaactaaagttgactatatacctactaaatgaccaagccattccactttgaaggatttacccaagagaaatgaaagcatatgctcttaagatacacacacaaatattcatagctgctttatgagtaacaatcaaaaattagaaacagcccaaatatccactgacaggtgaatggataaacaagtggtggtatatcaattcaatgaaatattacctgcaaaaaaacagaactaccaattcatgcatgcaacaataaggatgaatctcaaaataattatgctgggttaaagaagccagccaaaaaaaagagtggtttctcggcaaattaaggtagaagattacaaaggggcataaggaaaattctgggaggaatggatgggttcattatcttgatggtggttatagttttacacatgcaaacaaatacgaaaacatatcaaacagtgcactttaaacatgtacaagtcactctatgtcaattatacctcaataaagttgtttaaaggaactaaacaaataactttagaaaaacaaacatagtaaaactataaggtaggaaatggtcatacaaaactagtgatagaggttgcctagggaaggttgcatgaggacgtgatggaagaagagcatacagagagcttcaaagcttattgagaaatgttttatactcaagttgggcagtaggtctttctcacacttacttagtatgctttttaacttatacacaagtttatatatagctttttgtatgtattataacataaaagcaaaaattcaggccgggcgtgatggctcatgcctgtaatctcagcactttgggaggccgaggcgggcagatcacctgaggtcgggagttcgagaccagcctaaccaacacagagaaaccccatctctactaaaaaaaaacatacaaaaaattagccgggcatggtggcacatgtctgtaatcccagctactagggaggctgaggcaggagaatcactttaacctgggaggaggaggttgcggtgagccaagatcacaccattgcactccagcctgggcaacaagagcgaaactccgtctcaaaaaaaaaaaaaaaagcaaaaattcttggaaaccaaattatctttctgcatatgaactttcttcatgtatttttcctagaaataaaagtctgcgtatatcatacggtcaaaactttatttccacctatgaaaatttattcttgtctctactatctgtagagacatggagacatggataatcactctgttacagattacacgttacactaaacttatgtaagagccactatgcagtcttagctcttccggatgattgctgccatttcatcttgacaatctgtagtttggtgctccaggtacagcatccaggcagatccctcatggtctttcaaactatgtttaggattttggactttatccaaagagtaagaaaattactaagaggttttaagcagaggcatgatatgattagacaggtgtctctaaaagatcatactttttaaacgatcatttggtgtcaagagtacttgtagccagttaaaaccttaactgtagtagttcaggttaatagatgtctgtgagttggacaaaagagtggcagaagggatggaaaaaaaggaaccaacttaaaaaacattaggtgacaaggccaagcacagtggctcactcctgtaatcccagcactttgagaggccaaggcagggcggatcacaaggtcaggagttcgagaccagcctgaccaacatggtgaaagcccgtctctactaaaaaaacaaaaattagccacgcgtggtggcgcacgcctgtaatcccagctactcaggaggctgaggaaggcaggagaattgcttgaacccaggaggcggaggttacagtgagccaagatcatgccactgcactccagcttgggtgacagagcaagactccgtcccataaaaaaaaaaaaagaaaaagaaaaaaaagaaatattagctaacagagtaataggacttaatgactgataggacgtaaggggtaagagagaagttaaacgtcgggcgcagtggctcacgcctgtaatcccagcactttgggaggctgaggtgggtggatcacaaggtcaggagttcaagaccagcctggccgacatggtgaaaccccatctctactaaaaatacaaaaattagtcgggcatggtggtgggcacctgtaatcccagctgaggcatgagaatcgcttgaacccaggaggcagaggttgcagtgagccgagacagtgccattgcactccagcctgggcaacaagagcaaaactccatcttcaaaaaaaaagagaagttaaaaatgacccccagcagtttcagcagctggatgtttgtgccagtcactgagataaagaatgctgcaggagaaagaggtttagaagggaaaatgatgaatttgggcccaaaacttgaggcacctgtgaaatactaagtggggatgtctaataggtagtgcagagcatacggtattcaggaatcatctatttaaagatgaaattgaacccccagaagtagaagaacagcttagggaaagaggaggaaaaagactgagaacttcactgttgcaatggttagatgaagggaaaggaaagagcaaaggaaacttttagcttttgataaaatactggtttcaacttccacttatatcctgaaaaaaaaaattaaataaagggccgggcgcggtggctcatgtctgtaattccagcactttgggaggccgaggcaggtggaacatgaggtcaggagatcaagaccagcctggccaacatggttaaacactgtctctactaaaaatacaaaaaaattagctgagcatggtggtgtgcacctgtaatcccagctactcgggaggctgaggcaggagaatcgattgaacccaggaggtggaggttgcagtgagccgagatcatgccattgcactccagcctggcaacagagcgagaccctgtctcaattaaaaaaaaattaaattaattataaggggaatgaagagggactgatgagaaaagacaaatccacataataatttataagtctaagattgaaatcccaatgaaaaggtaaagagaagctctgagtctagcactagaagtagtatgcccagttcatgaagatgttaaataagtaggaatgtgtttccagtggcatactgtctttatttctgtttaatttgactcaaagaatgtctctgagttccaaggaaattattgttgatatagattgcaatgaaaagaatcagatacataaatccaatttagataatgatggagttcagtgtacattaagaattgcttggggctgggcacagtggctcatgcctttaatcgcagcactttgggaggccaaggtaggcagatcacttgagcccaggagtttgagacctgcctgcacaacgttgcaaaaccctgtctctacaaaaaatacaaaaaattagctgtgcatggtggtgttgtgcctgtagtcccaactacttgggaggtgggaggatcactcgagaccagaaaaatcaaagctgcagtgagctgagatcctaccattgcactccagcctgggcaacaagtgagaccctgtttaaaaaaaaaaaaaacaactctgggtggcaaaggcaggcagatcactttaggtcaggagttcaagaccagcctggccaacacagtgaaaccccatctctaccaaaaaataccaaaattagctaggtatggtggcacatgcctagtcccagctactctggaggttgacatgggagaatcgtttgaacccaggaggcagaagttgcagccagccaagatcatggtgccactgcactccagcttgggagacagagttagaccccgtctcaaaaaaaaaaaaaaaaaaaaggcagcgggggaggggatgacttggtttcttgctctgattgaaatgaactaccagcacccttgacaattaagttattccttggacagcaaatcttaaatcatcattctatataccaataaggacagtcttgtaataattgtgtccagaacatttgatctctaagattagaaagccttctttgtagtctcgtcttatagaggagaattacatttaaaaacagaatgtaaacacaaagacattatcagggcagttttacatgttaacaggataaccctatacagtgactctgaaaatccaaaagttcacaattaaccaatatcaaatgggcactggagtcagatgtgacaactggatctgaaagctgattctgctacaggatcttggataggtttcttaaatataaagggcctcatctgtaagatggaaatgaatgctgcatcacagagtgattaagtgatcaaatgagacaatgtgattattttattactttaaataaaaccaaggcaaataatcatagatattttacctgcttccattgagtgtaacaaactatagaccctcaatgtataagccatacaaggaagtgaggaatatgctaaaaatcaggatactattccaagctgatccatttactgacatattataaggtatgaacatacttaaaattatctagattccaactcattatacacatgttgttctctcaaaataatcttacatttcagagggtatctacaagctttattttaacataagacagacatggcaaaagtaactccaagtgtgatgtatatgaggaaaaatgcaggaggctaacctagtctgggagtaggagaggaccagaggagttcctaaaaaagtcaagtttatgctgagatctgaatgatgcataggagggaagttctgggataatattacttatatactggaagcagtagcaaataactgagaattcaaaatgtttctcctgtctcccacctctggggaataacatttaaataataatcttgcttttaatagctatagttaaaacaagagttagatttatatcctactatagaaatgtacagatcttttccagcctaacagtttattatgatgattattattatgattattattattattatcattttgagatggaatctcattctgtcaccaaggctggagtgcagtggcagtgatcttggctcacctcaacctctgcctcctaggttcaagcgattctcatgcctcagcctcctgagctgtagctgggattagagacgcatgccaccacaaccgactaatttttgtatttttagtagagaccaagtttcgccatgttggccatgctggtctcgaactcctagcctcaaatgatccacccgcctcagcctcccaaaagtgctgggattacaggcatgagccaccgtgcccagcctggtttgcctggtttattattcttaatttatcaagataaaacttagtttaatagagcagacagaagttatgtgaccagttttgtgccaccattccaacataaaatgctgttcctccatcacagaaaagccatagattttatatattaatagatttaagaaaacagttcatggatatattcacataaacataaaatgtgaataggtagtattagatacaaaataccaatagttaatatgtgttatttattatagtatttgcattatcattaataacaatgaatacttaataattactaatgcattttgtgcattgtttcagttaatacttataacaatcccatacagcaaggtcagttactattcccactttataaatgaagaaatatttttaaagttaggtaacttgctcaggccacagggattcatactcagaactgactccaaagttcattctcttaatagctatattctactcctgactgtgtaggaggagcatatgaatgaaagtgccagtcctctttggaaccactatgactcatgataagtggatctatttgtatttatttttagtctaccttacatataacatataattccagttcagggaatgcattacctactacatcttctaagtgaagtcatgtcagtattcattaaaaacaaatatttaagtagttatttttgtatatatgtatatatgtattttaaataaaggtacaaaggtataaaacctgtaaaaatacctaaattgtgccattgtgcaatcaaaagaaatccattgagattaaatatatttcttatctgtaatccttcatttgtatagcctgatcagaagaaggctgctaaatcagtgaggctgagccagcaactaaaatgctggcaatttaaggctttctctggaaacacagaactctagctccagacatgtcatacgtgtcaagcattcacaggcactgtcctgtactaaatgctgattcatctcattcctctgatatttaccttgcttctcttattaatgtaaataaattctgacccaataaaagagtcacaatatcttgaaaagctgtgtgctctatattcttctttggcaaggtatacacatctgaacgaatggcaacaaaataacaccatctacttcatatggttgctatgtggattaaatgtgattaaagcatgcaaagtgttgggacaaagtctggcacatagactgctttatgatttccagctgctgtagctatcattgttagtattagtcacatgatttttttgtgtgtatcctgttaccatttcatgatatcctaagaagttactatgcaacagccatgtgtgcagaaagaacactggattagagatcagagcggttcaggaggtttgacatgattgctgaataaaaatgggcaaactctttgaacacgttttgtaaaatcttatttgtaaaatgagggctaacatcatctaccttatacggtcatgagggggattatagtaaaggtgacatgaatggtaaagcactttttaaacaacaaagaaatacataaatacctaaggtattatgattatttgatgtacaaatgcaggtgcacaggtatttaaaaagcaaaatagaattgtcattaatttatagtcacatgtcctgccctcatttcaggactgtatatagtccataagttcagggatctgccttatagaaaaatgcttatctatagctactataatatttatttagtaaaactgactgatgttcacaaatataaacttacctttactattgttttagggcgttttttaaaaaatagttttggcttttccaccacaggaagaggtggaagttttttaagctcctgtaagacggtggtcgcagcgcgcttcttggagagttttttgctatttccttctccttctgcagagaactctcctactgacactcgagtaacaaagcttttcatatgtggtggtccactttctttaataacctattaaatacaagtaaaatattaaataatggataggcacttgagatgtattcttaaagtatgacttaatattcatatcaaaaccaaaattagtattatgccaaaattatagtatttctttaagaaagctattatgaaggtattatactgggactatttatgacacttgatgcttaatgcaattgaaacaaaagaaatctaaataaacacatttgattcatagtcaaaatgatttattactttaaaacagatcattctaattacagtttctccatgtcttatggaacacaaatttaagaacatcaaagataccattagattagataccatattagattggtcatctagaatgataatttgtatataattacatacctaacttcctcctatgtacgagtaagttgctggagaaacgagtagttctataaaccacaaggcactgtgcctgtggaagcctctcaaaaacagtcaatggataaaaataagctgtttttgatagggatgtcaaaagctgttttacagaaagggatatttattcttgtgacacgattttaaaaaggtaagtaggtatgccaaaaaaattcctagctttctagagtaatgagttatggacctgtcaactatgaatgtaatgttcctaaaccttgtttaatctgcaatactaaatatttaacctttaattgttcacattagatcatcattataaacatcagatatcctacatcataatatattgatgttcccaagaacacctaagaataataaaactgtctgttcttactcattgtagcctttaaaaaaaatcccaataattttttagtataagcaattactttttacaggttttccaaattttccgtatcatttcttgctggaccaataggatctcaagtacattctctccctgacttcctcattttgctgcttttaacaagctgtggaccgagaactgagataatgcaacttgtaagaatgtgtccaagagaaagcaaacagtttctcagtccaactcagatgatcctgccaatgagtaagatgtgggagctttctagtaggtgaatgtcatacaatgtgagggaagaatctccacaactctttcagcttatttcctggttcttgtctactttccagacatgagttgtaaaattagtgacctcttaataaaagaagtattataataattatttttttaagttttcttttttgaaatttcatacaattttatgaatatatttgcaatatatttatctagctgttaagtcaagagttgcttcattacatcttacttcttggtgattttgttagttgaggttaaagtgaaacatattttggcctccacacaattgaaaaaaaaattggatattaacatgtatgtcactaaatcttaacttgaataaatttaatttaatcctatttaaaatgccaaatcttataggataccacaaattatctatacccagaaaataacttttataataaaaattgaaataccatgtatacaaaaggcttaatacagaaaagaaaaaaatcagaaggaatctgtgttatcatcatgatttctattttcaccagggcctagatcatttcataatactgggtttgaacatatagaagcacactaactcttgcaggatactaatacaccagttaatttgatttgtttgtttaaaataaccacagcaagggaaaaaatgggaagatctctaccgagtacatacctcaaaactgacaggcatatttcgcttcagagcaatttcaaacactaagctgatctcagacttatttgcatctttgtcatcatccacatcctttcctgattcaccattctaaatcacaaaaaataggataacactgaatcttgacattataacaaactttacttttattctacagtcaagatggcctatttaaattacaagaagaaacaacaaactatatagactgtatctgctgcattctcctgtaaccacagcggtcaagggctttgctgccaggctttttgttactcgatttttagcttgttttccttgaaggaaaagcatttaatgcagactttggaaatcttttactcaaccatacactaatttgagtttagcctacatccctaaacctggcactcttgttttagagttctctacccacccaacccccaacacccaggaattcccccactggtgttctaatgtgatctatgaggatgaagttacagaaagagtacaggatgcaaaccaggagcatcctaattggagatctatgtctggcacaggcattggtttactttattcacttatttaacacatacttctggaaggcctcatatatgctgaacttactataactattagaaagagacagtattccttgctgtcaagaactgggagagaatgatctagtgggaaaacagatcaagaaatagataggagctctcatgaaagagtacaagcagaaaaacacctaagtctgccattaagataaatatcaaaggagaaagaaacaattggtttggggaaaggaaaactgtagaggttgaactgtagggtaagtaagaagctcactatgctgccgggcatggtggctcacgcctgtaatcccagcattttaggaggccgaggcaggcaaatcacgaggtcaagagatcgagaacatcctggttaacacagtgaaaccccatctctgctaaaaatacaaaaaattagctgggcgtggtagcatgagcctatggtcccagctactcaagaggctgaggcaggagaatcgcttgaacccgggaggcagaggttgcagtgagctgagatcctgccactgcattccagcctgggcaacagagcgaggctccatctcaaaaaaaaaaggaagctcactatgctatgtataggacatgcctgagctagagatactattttgaagtcaatcaagaaagtagctgaagccatgagaatgagtgagattacttaagaacagcctcaatgtcatttgtaaaacaaaagaggactgaaaaatccataaaatctcttccactttaaatccttgattctagattcacacaatgtaatctatattcaataaacatagtatgaaatataagccaaatcaatgttatttctcatcctcatatacatccccaaatccccagttgcctgggaagtgaactcaagggaagaaccaaagctctgaaaggtagtcaccctgcaggaacacatgaagcaagactgtcaggtcttcactctagtattcttccctatcagaacagattatttattttaattataaaatgctctgatttgtttcactgggaaagtagaaagaacagactgtcacatgcagcagcaccacacctgaggagatctttctggaataggttcattctgcagtgcttggagggctttcattgcagcattgtgtctagcagcttgtcgagtctttccttccccaaaaaattcattatttcctacagtgagctgaacataaaagatcttaggcactgggcaatgatacctaaaataagaaaataaaaacattaaagttagcttaataaaaccactctataatcattcataagatttgtttaaaatgataccaattatataatgtgctatactcttaataaaactttaacctcaaaaacatacttttttgataaaatgtgagtcaatacatctatagataatagcttatactgatctccatgaaaaacatatatagaatacaacattaaacataaaacaatacagtaaaaattatttaattatatcacaggatacttcctggtgagaagttttcggtcagattttgacagaagtaagagaacagtctgatgaagctacaacagaggctgggtcaggcaagactgttcaggcgacaacatgtagattaccgtgctttttgcagaagataattacgattagaaatatagattagaaatggaccgactacaatgcaaagtaataaggagagcagattcagcataagaataaggagtttaggccagttcttaagcaggaagtgttatattcatacattttacggtgcctgaggtaatgaggctaatgaggtgtgactaaaaagctgcaataatgcagatatgaagagataacagagaatgtaagaagaaacaaaaaaaccaaaagaaattaagcagaaaaaattaagatatgtaataaaatccattaattcaacaattatttatggagcgtcttctatttgacaggggactatgacaatgaacaacaacacttagagtggggaagataaacaataagaaaaatatgtagaatacctagtatgttagatgtagatgtaagaaaaagtaaagaggaaagggttcagaagtgtcagggaggtaggttttagatagggtggccaagagaagtttcattgagaaaatatcaattgtgtaaagacatgaaataagttagggaacaagccatgcagatctctgggacagtgcatctgaagcagagagtataccagcagcaagggcagcgaggcgggagtgtgccacacatgttcaagtaactcggaggaagcctgtctggcaaaagtttagggagacaggaaaagctagatgagaagaggtggcaagattccatagggccttccctacaaattgctgtaggcatttttaacccaagtgaaatgaccagccactggaaggttctgcacagagaagtgacaaaatctgacttatctcttggaataaccatctgactactattttgaggacacactgtaggggaacaatgctggaagcaaggatatctaataggctactgggataatcaaggggaaaggtgacagtggcctgaactagggtgtagcaatggaagtaacgagaagtcattgtttctagatgaattttgaaagtagagatgatgggtttacccaaagactggctatggaatatgagaggggagtcagggatgacatcacggtttcggaactaaacaactggaaaatggagtacccatctattgagacagtgaagattgcaaaagaaatgggtttgctgggggtggatttcaacagctctgttttggggatattcaattattagacctattagatatccaagtgtagatgtcaactggacaactgaatttattagtctggacttcaggaaagaggtccaagatagaaataatatttgggaatcatcagtatataggtggtatttaaaggcataatataatgagaactctgtgggagggtgtgatgggagaaaagccaagcaagcacgatgtccttcctgaaagtcaaacaggaaaaaagtctatcaaggagaagggagggattaactggatctaatgctactaacaggtcaagtaaaatgatgactgagaaatatgaccactgaattgagcaacttagcaaaataaacagaatcgattttgatggaatggtggatttacaactgcaatgctgaaaaaaatgagttaaaaatcactccagtcctaaaaaatgtttgtttccaagcaaaaagaagtccaattgaggtcctactatattttagataattactgcacatccaagtagtgacgctctatgtccaacctgagataaactggatagagcgcatcatgtaagcattcaccaggcagatgggactaatcaatgaaggtttactgaaggtgaagaactagaaatgttgattggtactgaagatgcagatttgtgaggcaataattgaaaccatgcaagtggataagcacctggaaagggtaagtgtaaaggaatcaaaaaagagcctaaggctcggaactgattaatgcctgtgatcaaagtgcaagggaaacaatagacagcagtgaaagagatgaaaaagggtcaaagttagaagaaaaattacaacacaatgtcagggacaggagtaattaacagtgtcaaatgaaggagaggaattcagagtatgaaaaaaaagaaaaagttgctgttttaaatgcttaacctaaaatcaattttcttgaactacagttttctattaatttaagataacgcattttaaatgtttttattataaacaaagattaaaaagcattaaaaaactataatcttttttgctttttggttacaacaattaaatattgtgtactgaagtgcacaatttcctatcatctattttattttaatccctttaatgcagaaatttattttaattccttaatgcagaaatctgacagactaatatgaataacgccggtcatcttcacttcatatttctcaaaattcaattttcccacctccacataactttgtttatttttaactggtggtactataaaactttaaaacagacaacttgaaatcagaaatttactcctgaagtgagatctcatatggcaaactttcaccatagagcaaatgtttacaattaattataaacttctgaaaatagaaggtccacaactgaaatgctaacagacctttaactacagtagagggagtgggcgccactataatcactaaggcctgctgacaattacaaaactcattttggtttgccacagagacaaacaaaatttctgttcattgtaactttactggaatatgatgtcataacacataaccatactgaaacaatctgctgattttctggccaaaatattaattgcacaccaaagagcccttggggcctctccctttttggtcatcaaatatggctcaatgtatgtgtatgtgcatgcatgtggatatatatgtatatataaattatattgtgtaagtatcagaggaaaaattaagtatgttgcatttttaacataaaaggtaaaaattctagcactaacaacaggaaataccaagactggatgcctgacttatttcattctgtttcacttcatcctcttacttaacaatgattcttaataatataccccacatggtttgaataccttatatatcacatctcctcataccatcatgacaatcaagattagccagagcactctcattaattgcatccagattgaattacaggggagatgatgcagaatggtttttgtgtgataggtctggtctcaaaatacttacttcctttggtaaagaaatacccaaagtttattaattataaagatcgatatgttctatttagtggatttccttctactttcacttatttcaagtattaagctcacttttagtaaggtatttgatatggtttggctgtgtccccactcaaaatctcatcttgaattgtaatccaaattgtaatctccatgtgtcgtgggagggacctggttggaggttaagtgaatcatgggggcggtttcccccatggtattctcatgatagggagtgagttctcacaagatctgacggttttataagcgtctggcatttcccctgctggcattcatttcctctcctgctgtcctgtgaagaggtgccttctgccatcctgaggcctccccagccatgcagaactgtcagtcaattaaacctcttttctttataaatcacccagttcagtctcgggtatttcttcacagcaacatgagatcagactaacacagtaggtataataagtgatgtacatatttttacaaattagtatatttacctaagcagacatagctattcttgaatgatttttctcaagtagaattctgtggtcaatgtttagatccccataatgattactgttaaaagatgaaccacgaaaactcccccatccaagttatttaagtttcagggtcaaatggttgcatttcttttaaatcccaaaaaagtcttgggatttgaaagatcctactttcatcagaattatcttccatgcttgttaaaaatgaagattcctgtgatccaagcctgatctgctgcatcagagtttctgaggatggaaccataattttaagctgccctgctgactctctgcacgataaaggtccaggattatcaccacatcccacaatgtggcccatgtgacttggcaattgcttcagagtccattcaaggagaccacacacaatgcttactgcacaatggttaggtctttctctcttttttttttttttttttttcctgagacgaagtctcgctctgctgcccaggctagagtgcagtggctagatctcggctccccgcaagctccgcctcccgggttctcgccattctcctgcctcagcctcccgagtagctgggactacaggcgcccgccaccatgcccagctaattttttttttttttttttttttgagacggagtctcgctgtcgcccaggctggaatgcagtggcgcaatctcggctcactgcaggctccgccccctggggttcacgccattctcctgcctcagcctcccgagtagctgggactacaggcgcccgccacctcgcccggctaattttttgtatttttagtagagacagggtttcactgtgttagccaggatcgtctcaatctccgaccttgtgatccgcccgcctcggcctctcaaagtgctgagattacgggcgtgagccaccacgcctggccaggtctttcatatctctttttcatttaatcctcactacagcctggtgaggcaggagatgtccccaaggtcaccttaagaggtaacaaatgtccccaaaagagttgctgggaaccaaatttaagtctgcctaactgcagagtccaggaaattccgtatggagcttcctaaaaatctgctttatcttcttccatttttgttaatttttgtttattaaattgtctatcttcatggaaggccagagaacctaatgcaagggatctaaagtaaggcccactgatagacttcagagatgttttattgagtgaatggctgctgaaacaaacagacaaccatgatgaaacactgtgtttctgcagcatgtcagatcaaatagacacaagtgcatgacgtaaaatcaaagtgaaacatcaaaatgaacagcgttgtgtgccacattacttaacagactaaatctgacaaatgctgcttgcaaggcctttttatccccatgtctccttgccttctaactgctggaagtcttgcaaaaaataaataaaattgtaaataaaataaaatagaatcttcctttcctttagatcccaaacaagtcttgagattcagcctatcttcaagataccacaagtcaatacaacagtaagaaagaatgtatactggttcctttgatttaatacttgatattccttacagtttttttgagtaaaggaaagattttacattcacttatatctgactgttagttgtagcaactttttataccacatatccttgccaacctccctaaagttacttcatttaatgccctctttatggactcattttgtattatctttctaaacaactaaaatcccgtatgtcctccctaccattctgtgactgttttattctccaacatctccactttcctgagtatcatttttacaaggtgagaaagacatatcccaaataacattaggatttttacaaattgaaaaataattacctcattctatttgatagcattattcataaatctcaacacagcttaaacattcatatctcccctacagacttacatcttaaaatatatgaaaatgctatcttccgatctaataaggagaggctttggatttctgtgtttatttctaacattgactggaaacagaaatgtcacttaacctttctatctcagtttacttatctacaaaatatttgtagaatttatgtttaaaggaccctaaaggccaaaactaagaattcaaatgacatgtcgattattttgactctttgtacactttttggcactgctaagcattctttttcttgctgtagaaaaacagcaggtttttatcatagagctataaaatagtccttggcacattttcaaacttgtatgtatataaaatatctagatagaagacagttctttctctattcatatctacaaattttgaaaaatatatcttttatgagatctaactgttaattcttgaggaatttcaaatattaggactgattagaaaagattcacaggtcagatgaaaatatgctttaaaagaggtgtatggatattctatttgtagaattactgtaagtatgttttaaatgcctagaggaaatatagaaagatatgcactaaaagctaggatagggtgttttgaaatgatagcattataaatgatgttctttcctctcataatttcaagttttaaaaaataatacggtacactagaataaaaatggaaaaaaaaatacttaattgaaggaagtctagtccctatccaaacaaaggtaaatctgtgtttgaaattaaatttgataaactagtggaatgatttatggaatacagaacacaaatcaagagaataagtaacttgtactgtatcactgacagtagtgccataatcaggactatgcaaagcacagcacgttatcaaagagccccattattgtaaacacacaatcaccaccctcaatctcatacttggaaccaacataaacttgttcttgccccttctctaaatggatatatagataaatcattatcacatcaccattatcataattagagctaaaacatacaaagcacttactatgtgccaggcactattccaagcatttagatactaatctcactgaatcctcacaaccccacttcattttacagatgaggaaactgaagaatagagatattcactaaccttcccagggccacccgacttgagctcacatttgagcccaggcagtctcactccagaacccatgctcataactgctataccatgctgcctctgaatgaactggatagatgaacactataaactgcagaagtactaactataaactctgaagaagtcatgctggactgggaatatcaaagcaacttaagtctctctagatgtatgagatctggcagattctgaagatctctgtacgccaaaagtcaggtgcaggatatcagctgccaaaggcaatgatggggacactgtaagtctagaagaccaagttgactgcaaagtcctatttcctctctgctcattttttgtctcctcttaacccacccatctggagcccaggtttaaatgttctcattagggaaatgcaaatccaaaccacaataagacactacttcacacacccactaggatggctatagtttaaaaaaaaaaagtcataaagacatggcaaattggaaccctcatacattctggtgggaatgtaaaatggtgcagttgctatggaaaatagtttaccagttcctcaaaaaattaaaagcagaattaccacttgacccagcagtttcacttctaaatatatacccaagagaaatgaaaactggggttcaaacaaaaactcgtaggtaaatgtttacagcagcattattcctaatagtcagaaagtggaaataacccaaatgtcccgatgaataaataaaatgtggtatgtccccacaatggagtgttttacagtcgtacaaaggaatgaagtataattacatgctacaacataaacgaacttacattatgctaagtgaaagaagctagatacaaaagagtatatactctatgattccatttagacaaaatatccagaataggcaaacccatagagacagaaagtagattagtggttgccaggagctgggaggatggagtttgaggagtaactgttaacaggtatggggtttcttttaggagtgatagatatgttttgaaattagaccacggtgatggctgtacaacactgtgaatgtactaaatgcacaatgaattgtatactttaaaatagttaatcttgtgttacgtaaattttatttcaatacaaatcatttttttaaaaaatgttgatactccctagggttctattttgtttctcactgacaagacagtttttgtaggtgatctcacctactctcattcacattcttggcagactcccacaaactagcctaccaaattttgtaaagggaagtgtaaaagacctcccttttgcactctaggatgttactgacctggtcttcttcctactcttgtctaattgctaggggggtatgtgaattacattaataattcaacatatacttattaaaggcctacttcatgctgggatggagttttagtttctagagatggaggactgccctcaggaaactatcaatcaagtaagtacacatacacacacacacacacacacacacacacagacacatacacatcaacaaatgagatgagctaggaagaaaaataaagcatggtatagaaaaagattaacaggggctcctttaggaggtgacatttgaacacagatttgaataaagtgagaattctaggcatggaaatgccagaaagaaaaagtgctctaagcaaataagacagcaagtgcaaaggccctgcagaaataacatgttggttggtccatttttgagaaagggcaagtgttccttgtacctgacaagccctgagtcaaggaatgattagtaggaaactaggtctgagaagtcaccaggcagcaaatcagaacttaattccacatgatggaagccactggaaagttttaagcaggaaagtggcacaatctgacatgatttaaaaggatcttgttgctatttacccgaggagaggcaagaagagaataggtgacaagccattccatagtgcaggaaaagtcatctctaaaaataggagactgaactgctcaagaaaatataggattgcaggcagtgctacaatttcacttaaggattgtggtcattatatcaaggtggactagtcagcatagatgtttttctgtagcttcctaggagcaactgcagcagagtcagaggagctggaattaaccagttacagttttgccaagcatcgctgctcattccaactgggaggcagtagaacacacaggaattaggtagccataggactagtgaaaaatgggtgatcaactctagtgaaaagcagccacgctgaatctggcaggtgaggaaagggtgcacccagcctggaggttctgctcaaagtcttcaggtgctaaaggacaccaccctatttcttgccctcctggtggtcagacagtgtgtggcagaagcagtaagatgtgcctcccctgtggtggctgacaagcaaagcagtgctggaagtgttcctactttgcaactgtgaagaagggtccctggcaaggcgatctgggggcctcttcttccagtgtgctgccactgtgttcccctgggtgctgcagcaggcctgtctgagaggtaaatggctagcactgtggaaaccagcagaattgtggagtgatgctgcaggaatacggcggggggggggggggaggggggggcaggagggcgggttccctggagtagtatttctcaagtgggtcccacatagaaaacactggagtcttcctaatggggtctagaaacacttgctaaaaagcagattcagggctgaccaaagggattcaggatggagtccaggaatgcgcacattacctaacagcctaggtggtttgcacacatgctacagattgagaagggcctcgtcacaggggccttcttccctgtttgtgaatacaaaggcttctgattcctgaatatcaactttgtactcatctgccttacagagtgctcttcctgtctttaatgggattttagttaattctctcaccatttgtttcataagaaaaaattaggattttcctattatttccagaatttgtttttcctatttatttccacaatttattttgctaattttgttgatccaaacttccaaaagaatactaaatagcagctgataaagaatattcttatttcttacttgaatgggaacacggctagtaaatactcattaaaccttgttaaaaaaaaaaaaaaaacactgacagtgtggacagaggaaaatatttttaggtttagaataagatctactggatttaagttccagctactagatctataaagactttgggcaagaagccttatgttctctaagagccatcagtaataagaacaattttgtctgtatcaactttcagctttattcaagtgacaaaccagttgaaaattattatacttttcatgaaatatagcatatctgtgtactgagggacaattttcaaatagatatatatgttcacacatatactctgcagttcaaaaacatacaattttttttaaaatgtaagttttttttttttgaaacagggtctcgttctgtcacccaggctggagtgcagagcatgattatggttaactgcggcctcaacctgctgggctcaagcaatcctcccatctcagtctctcaagtagctgggaccacaagcatgtgccatcatgcctggctaattttttttttttgtagagacaggcactccctatgttgcctaggctggtcttgaattcctgggctaaagcaatcctcccaactcgggcgcccaaagtgctgagattataggcatgagtcactgtgcccagccacttttaacttttcaatatatattcactaaatactgcatgctagtaatctaatagcagaatcttacgtactaaaaacttatggaaaatatggcttattgtttctttgagttgtaagaatattcctattatttaattccagcagcagatatcatctttggttaagggttctctgagaatgcactttgaaaacaactagtgtagaaaatctctcaagtccttcccaccaacaaaaggattcacgaaacgagctctagaaaatacttataaaacttctatctctccattaagtccacaagcatatgtttttgaaaagtttgttagaagtataaaaagcatgaaagtataaaagatacaaacatactggattttttaaaagagggtttacactctttttcgataaattaattttataatgtctataataaaagattcaaatggatgattacgtttgcactaaaatcttccaagaagtttaaaaactgtttgctttattacaacgtccagcccaggcatctactccagtgcttttgctgatcagaattaactatcaactttggatgtttgcccacttcacatactcccaaaagtaacatggagacattacatcagcggtattgcagaaagattaatgtgctttgtttggagatgcaaactaattatacttactgcatacttctagtattctgtctctttcactcaaatctaaatgaatttagtcatacatttgcatacagtttaatgataacaataatgtatagttaatagatactcactggaacagaaaaaatttacttggcattttcccagctaattgtttttacagcttgacttcactttatacattaggtgcattcataaaaaggtttacataaagcaaatattttcatactaaatcccattttcccactgttgcccaatattaaatcttgagttatatttctacaggaaaatgctggctccaacacatcataaaaattataattaaaaatctaaacatacatgccaaggaataggtatgtttaatacattattttacaaaacactttatcctctcacctgcgataagaattaatctaaaagataatcattttgtttcatagtctcacaatcattagaaggacacgtatgttttaaaaaaattgcagggttttaaagtagcttcgtagaaactaaaagtagaaatataatttattagctggaactgccacatggagatctcctgtcagattttaggcaatgcaaatagtctcagattattgacagtaatcatttaagggtcttagaaatttcttcggctatgagtaacacactttggggggttcattacaatccaaaccagatgatttactggaattatacagatgctctggagccaataccactgtctgactcgaagcccacttttcttttttgaggcagggtctccctctgtcacccaggctgaagtgtagtcgtgcgattatgcctcactgcagcctcaactttcaaggctcaagcaatcctcccaagtaacaggaaccacaggcgtgcactaccacacttggctaatttttttttatttttatgttttatagagatgcttttcaaagaaataggaaaatgaactttgctcaactacctggatcctttcatactgtttaatattaaaagtgtaaaaaaagcaacatttgctaaaatagtacagtacttggaactttaagaaaactcttccacttttaaagtaccttggattaacgttaaacaatttataattttcagtcattttaaattaatttgtaaaatttttcctgcacaaatcctctggggaatgcactatgtggatttcaattacctatgctctccttttcctgcattgctgcagatacgcaaggtatgcttttacatcggttagtcagtgtgaactgtctcttattccaggatgcacactaagctgagaactatccaatcctctttatctttgccatgtaccctgaggtaaaacacagcaacaaataagggagatgatattggtagagacaatattgatatccagtctgactaccacacataggaagaggctgaagtaatacttagagctttgaaaggctaacagttttggcctcgggttatgatggtttactcctgttcacaatacagatacgtgtattttagtcacactaaatacaaagtgtggccaaagacattcttttctgtggacaaaatagtttttgaagatattctgaaataactcagtcatcatgacatcctactattcccaaagagtggatgttgacatgagttagtgtagcatagcagaaaaagcacgagctttgatgacatattactcctgggctggagggccagctcagccctttactagctgtgtcaccctatgcaagatacatgctgtgtcagaacatagtagccccaggaaatcatagttgttggcctctttccctcttgacaactaatccatcagccttctttgatattctacaatgtttctatgaagctgcagcatctctaaagcttttggttattccctgtaaagaatacccttagctgtggttatgctggcagaatctctagactttcatttcacacgctcagtggcacccctagtttcccattagcgcttgtaccatacccgggagaacatcacttcatgcctgtctaggagatctgacatttggttcattggtcactcaagaatgccaatctaggccaggcacagtggctcacacctataatcccagcactttaggaggccaaggcaggaggatcacttgaggccaggagtttgagaccagccttgccaaaatagcaagactgtctctacaaaaaacataaaaaattatctgggcatggtggtacacccttgtagttccagctactcagaagcggaggcaggagcattgcttgagcccaggaattcaagggtacagtgagctcagcatcaaatgtacccttgcggtttgagtaccactgcactccagcctaggcaatagagtgagacctcatctcttaaaaaaaaaaaaaagaggaataaaaaatgaacaccaatgcagttcaaaacaccaagcagtgtgcagaagataagctgataaattcagatactataaaaaccagtagaaatcaactaaataagcctctggaagaatttaatgtaaaataataaataacattactacaatttttaaaaattgtaaaggccatttatttacatgtttggggttctgttctacacagactgttctgtatagactgttctgtgacctgtcagtcaattacagtacaggagtctagtaactcatttatctttaaagaagtgcatcttgaccagagaacatgagaatgtcaacaaatcataaggaaataaataaagcaagttggtcaaggtccttgtaactgaagccaagaaaaagcctgggaaattaatgaataataagctcccaggaaactcaaactgagaaaagcagtaagccatgatgagaataatacctgagatgattaaatatatagtccaaatattactgcctacgatcctaaatcttacccacccgcaaaagagaacagccaaaaagctgaagttgctcatttttatctcaatgagagagaggagggataaggacgaggcaagaaggggggaggagagggagggagggagggaggaagacagagggaggaaaggagagagagacagcacacgaacacgagcaagagaacaagggcaaaaaatacttgctgacagtaggtatgatattaagaatattgtattatattgcattagaaatatagacgattgaaagctgacataaagaactgatttggatttagaaaagatcagaatataagatagttttatttccattttaaaatgagtatgtaaacaactattaagttcagtacattaaaaaaaaaaaaagtcttgctgcctttattgatttggagaaagcctgccacatactcttacaaagacaggatgtcaagcaaaccaataagtcattcaaacccagtgtatataaggttccttaagtatttgaggaatcaacatggagaattctgaaaatctgagacccacatgggagtaaagaaagaatgcatcttaagcaaattttacttattgttctctttgttatcctgaaaaagtcactcaagagaacaaaaaagggtttgcaaataagaccatataatcctatttgcagaggatgacacttcttatgagacttagaaacctgcaatacaatctgagcttataagactgagaactccaaagcaggagagtgatcaagactgacaagagtatgaccatggtgatctctcaggaagctaaaatcaccccagttatgcataagaaattctggccagaaactgaacacttcagagctggtgaactcatgataaaatcaaacagatgaagagctaaacttataatcttagttgtcacttgactcttgtttaatcaaaatgtaattctaatataatcaaaataagtatatcctgttacttctcaaatttagaaaggccagactcccctgcaaatgcttgagaaccctgtattagacctcatagttcctcaacaaagggaaaagtttagagtaaatgatacgcatgctattccaggaatagtgttctaggaaggctacaaaagggacaatttctgcttatacacagggaaaaagggagttgtattcactgcagccctagtgtatggtatccagcatgatacctagcacttaaaaggagtccactacatatctgttaaatgaaggagaggttatagctaacaattactgagtggtttactatatgccggcactgagcatgcagtaactcatctaatcctcacaatagcctgataaggcaaatacatattgttatcatttccattttacagttgaggaaactgaaaaacagagaagataagttgcttggcctaggcggaaccaggtttcaaatgaagatagagtggctccacagcaccccctaacctcaatactacattactatattcctctcaacttaaaagtgaatgattgcaagggagagacaggaccagcaagggccaggttctcagctatgtgggagtaaagcaatcaggactagcagaaggacaagttcaaagtgaaaggatgcatgtgagatctgaatggggaagtgctgggagtgaatgtactttgtgactatagactccaagtacctcttaacattgggcatgatctgaccttgaggcggctacaagatgaggatgggctagatcagtggtttcatctttgcctatataccggaagtacatgaggagctttaaaaaatactgaggacaagtcagtaagaaaaagaccactgaggccaggcacggtggctcatgcttgtaatcccaacactttgggaggccgaggcggctggatcacctgaggccaggagttcaagaccagtctggacaacatggtgaaaccccatttctactaaaaatacaaaaattagccaggcgtggtggtgggtgcctgtaatcccagctactcaggaggctgaggcagaactgcttgatcccaagagacagaagttgcagtgagccgagatcatgccacggaactccagcctgagtgacaaagcgagactccatctcaaaaaaaagaaaaagactactgaatcagcacaaaaactagcacaggttatacacttacagaccacagaaaaggaaatataaatgattttatgcatatgagaagatgtttgacctcattcataatcaaagaaatgcaaattaaaatgccaaagaggtatcattcttcacctaattatattggtaaaaaactccaaaacattcaaaacagcctcgtctctagtctagattattgtaataacctcccaactgctctcttaatcagcaaaacggtttttatttatttatttatttattttttgctcaaaacctgcgttggccggggtgggcggatcacgaggtcaagagattgagaccatcctggtcaacatggtgaaaccccatctccactaaaaatacaaaaattagctgggtgtggtggcacacacctgtaatcccagctccttgggaggctgaggcaggagaatcatttgaacctgggaggcagaagacatagtaagctgagattgcgccactgcactccagcctggcaacagagtgagacaccgtctcaaaaaaacaaaaaataaaaaaacctacattggttttgcatttcattcatagtagccagaatctttacaatggcctacaaggccttacataaatcaggctcccagtcacatctctggcttcttctaccactcacctcttcacttactcttctctagccacactagtctcctttctgctcctcaaactcaccatataagcctccacgttagggcctttacaatggctgatctcctgcttctccctcagacatcctcaaggctcactctctcaccttcttaaagtcttcgctcaaatctcacctctcagcaagacctaattcaaattgtgattcccatccttttactcaaacagggctctattcttcctatataagcacttttcactttctaatctactatacaatgtacttgtatttattttttattttctatctcccccaactagaatgtacacttcatgaggacagaaatgtctgttgatgtactccaagtacccataagaatgtctcaccacgtgtatgtataaagatacattctgcaacactgataacatcagaagattcaaaacaactaaatgtccatgaatacaggactaagaagttaaataaattacagagaaatcacacagtgggatactaaaccgttcttaaataaataaagcagtaaccctatttccagtatggccaagtaaactctcactgaactgattctcctgcaggaaacaataaattctgaacaaactgtaaaaaaacaatcatctaaaggtaccaaaaagtcaatgaaacaggtggacactggaggcaagttaacatctggaaaaaaagaacagcataggatgcatttctctcccttttttttcttttaatagcttgaatttgaaggcaagcccatctattccatgtgaaatagctaaaatgccactggaaaatagtcatactggtttgaagacccagcgataagggctcatattccaaagcccctggaatatggaggaggaaatattagaaataaaaatctgaggccgagggcggtggctcatgcctgtaatcccagcacttttggaggccaaggtgggtggatcatgaggtcaggagtttgagaccagcctggccaatatggtgaaaccccatctctattaaaaatttaaaaattagccaggcatggtggcaggcaactgtaatcccagctactcgggaggctgaggcagaagaattgcttgaacccaggaggcagaggttgcagtgagccgagaccgcgccactgcactccagcttgggcaacagagtaaggctccgtctaaataaataaataaataatctggagagagagggagcttcatattctatgtataaaactgttcgaatctctatctgacccctgaaccacacacacacacacacacacacacacacacacacacacacacccctggaaccaattcaaagaaatttagctacgagattagaatttgaggtgcctgccacccaatgcagaaaagttttgttgagaccccagccaactaactgcctgcctaaaaaatttttttggccaggcatagtggctcacgcctataatcctaacacctttgggaggccaaggcgggaagattgcttgaacccaggagttagagaccaggctgggcaacatagcaaaaccccatatctataaagataagacaacaaaaccccatatctacaaaaaattagctgggcatggcagcatgtgcctatagtcctagctactcaggaggcggaggtggggggatcacctgagcctgggaggtggaggttgcagtgagccaagattgcaccactgcactccagcctgggtgacagagtgagggcctgtctaaaacatacacacacacacatacacacacttcacaggaacataatagaatctaggttctacaacatataattttacaatgtccagaatacaatccaaaattattcaacatatgaaacaggaaaaaatgatccattctcaagagaaaaaaaactgtaagcagaaaactaccctgaaatgaccgagatgttagaattagcagcaaagggccgggtgtggtggctcatgcctgtaatcccagcactttggtaggctggggtgggtgggtcacttgaggctatgagttcgagaccagcctcaccaacatggcaaaatcctgtctctactaaaaatataagaattagccgagtgtggtggcacacagctgtaatcccagctactcaggaggctgaggcatgagaatcgcttgaacctgggaggcagaggttacagtgagccaagatcacaccaccgcactccagcctgggtgacagaggagactctgtattcaaaaaaaaaaaaaaaggaactaacagcaaagttatactatgttcaaagagatcaaagaaaatatgcttttaatgaataaatgtatggagaatttcagcagagaacagtaattataaaaagtagccaaacaaattctagaatatgatattcaaatttaaaattcactggatagacataatagccaaaaggagatgaccaaggaattaagattaatcaacagaaattatactacctaactattagaaaaaaagaagttaaaaaaatgaactgaagcttagggacctgttagacaaaattaaaaataattaaaattaaaaaaaaggtctaacagaaggagaggaggaaaaggggggaacagaaaaatattaaaagacctaagacccaaaaatttcctttggtaaaaggcatatttacatattcaagaagctcagtgaactagattaatataaagaaaaccacacaagatatgttatagtttaactgctaaaagctaaaaagacatattatttatggggagcaacaattcaaatgatggatgacttctcaagagaaaaaatctgaggccaggagacaagtggaacaacatctttaaagtctttataaagtgctgaaagtaaaaaaaaaaaaaaaaaaaaaaaaaaaagaaaagaaaaaaaagaaaaactgtcaactccgaattctatattcaatgaaaatatcttcaaaactgaaggcaaaataaagatgttttcagtaaacaaaaattcagagaaatcattgccagaagacctgcactacaggaaatactaaagggtgttcaaactgaagagaagtaaagccagacagaaatctggatcttcagagaaaacaaaaacaaaaacaaacacaaacacaaaaacaaaacaaaaaaagggaaatgatagatatgtgggcaaataaattcaagacctttttctcttaatttctttaagatatagactaaagcaaaaaatcataacattgtggaagttatgatctatataaatgtaatacaaatgacatctatatatggggtgggagttaaatagacctatatggttgcagggtttctaaaattttcataatcagtttagaaaaaataatgcagcttcttacatactgacatggaatgctgtttaaggtatttttcaaaggaaaaaaaaacagattcggaatactattacagaatgatactttcttaaagtaaatacatatacatatacatatccagagaatatcctgaaaggataatacatgaaactggcaggggcaggggcaaaattgggtaactggaatgcaggggtggcatagtatttacattaatatttgaattttttatattttatactgtataaaataaatacaaaaaattaaatacccacaaaaataaaaaagtaaaggctctgagaacttctacaataagaaaacgtttaaattttccttgatccagcattttacaaacctatatgactataggaaactgactcctctccctttttcaaataatagctatttctatcccaacagtgactgtgtattgcttacaccatattaaaaaacacttatttttttaaatcaattttttactagttgtaccaactaaatctagtaagaatataacccaggtcatttgaaatattcttttttttttttttttttaaaaagagtccatcagagtaacttcaaatataattgcaatttcactggcagtctaataaaattccacccactaaagttctagacttaatattttccaagacattcttaaattcagtcactgtcccatgcttacctgtttttaaaaactcattaggtacctctgttattactgtccaaactgaatgatatcaactatttctgaaaacataaaaaattgcttgttgaacatacaaatgattccataagaagatgccacaatatattttagttgctaaagattaatatgaaatgatcacatgacctgagtcatattcttactagatttagttggtacaagtagtaaaaaattgatttaaaaaaatgtgttttttaatatggtgtaagcaataccagtcagtgttgcaacagaaatagttgattaatatgaaatgatatcaactatttctgaaaacataaaaaactgcttgttgaacatacaaatgattccataagaagatgccacaatatattttagttgctaaagattaatatgaaatataaccattattttgatacaaaaaagaaaaacaaacccacaaattcttgttaaagttcaacagatattatttaaattgtagtatcttgtttttaacaatttaacagtttaatagtgaaaattttttctatgatacattaatttcactggttcgagtttctaaatccacttgaaaattttctttaatagtatattttattcaatttatctttgtacctacactaacaaaggaaaaagaatacaatttgtgaatacccagaaattccttaatcatggagaatgtatacaattgtttctatgctctttgaagggaggacatgatcctagtttcatttgtgctaacaaggagaatttattaccaaaacatctgggagatgaatgagatgctaaaacgaaagacatggaagcctagcaacatattctagtctagctaacccttcctaagaaaaaaagatagtactaatagtaaggtgctaatgagccgtacttggtaccctcatgctcgacaaccttctcagatcactcaggttgaaaataaacttctgtattacaactgaaactaaaaattacactgaaaaggacgtgtttagcaccgtagaggctcctacatatttaaagctacttctttaaaattccatgttttagatgtttgaacaagacatcaataattccattatccttgttctggtttgatattatttttatctctcccaaaccataaaatttgcaaaagaaaaaattcaactgcaaaattattcaatatttggaaacgaaaatttaacaaaccctcttaagaaccaataaaagctatcaaatagaatacaaatagatacataaaattttatacactggtaacagcattcaaatcaaagaggtgaagtattctaagaatatttactccagttgtgttaggaacaaactaaattatgacttcctcgggccaactaaatccagtaagaataacattctgttgctaatatgatcatatgaaataattatttttaaaaagaacttagcctatcaaagtcaacttcaaatataaaaagtgttccccatcaatcaactgtatagaaacaatataaaattattcaagatttattttacaaagatacttctcaaacccaagtgcttcctataataatacacatcatatactgtttactgatcaataggaaaaaagaaaaaaatgaaacaaaattagaataaaatatacaacttctaccagaaaaaaaaagagactagaaccagcagggacaaataagtggaactgattagaagacactgacttaaagaattggttatatataaaacatagcttcctatattggatatacctaaacttataatcccatacactctattattcattaatacagactagaggtccacaaacgttctgaaaagagccaaatagtaaatattttaggctttgcaggccataaggtttctaacacaccttctcaatactgctgttgtattgagaaagcagtcatagacaatacatcaacaaatgagggtggtggtgctccaataaaattttgtttttatggacactgaaatctgaatttcatataatttctacacatcacaaaccaatcttctactaattttttcaatgatttttaaatatacaaccttagatcatgggacatacataaaaagaaagctgtgggctctagactgccaacccctgcctcatctagaaatacatgaaaagtagttactagaaatactttccaaacattctttctaataactgaatatcaataatgttgcatttttactatgccattatttttaccatatgtaagttctaaaacagtataatctgccaaaataatgacggaatcaaagctaagaaagctaaaatgaagtattcttaatatttcaaagccacaaaaaagaagcaataaaaaaaacagaaaagtgttgtttcattacacattcctaggtcataaatttcacgtagacttaaactaactctatataatacttgcccactgagtgatacaaagttattagttatattatgccaaatttagaatttcattaattccaaatgtaatatagtattaaaatgtggccaaaagaatcctggagcctgggtgacatggtgaaacctcgtctctacaaaagacacaaaaattagccaggcatagtggcccttggaccacctggtctatattaacgagctactagggaggctgaggtgggaggatggcttgaccccagaaagtggtggttgcagtgagccaagatggtgccactgcactccagcttgggcaacagaatgagacccctgtcctcctacccttgcaaaaaaaaaaagaatcctggtagtttcatagttaacactgtttcatatggtaatactgaaatgtcttagaaaactcaaaggacaaagttgtgaaaactgtattttaattatagcttaccctttaactagttgttaagatcttcagcaaatcatgtcagccagcatttcctaaagtttgccctgtatccacagatcattcattaatgtaacaggatctatggccaattgagtctgagaaatgctacacattatatacatctctagaagatttataatgtacttaagcagatcataaattctgagaagttccgcagtaaagaaaactgttggtttaatctggtattgtccaaacttaaccactttttgtgtgtcatacttattaacatccaaaaaaacctaaaatttcttaaaacatactttagaaaattttctaatctctagtcgaaatcagataaacatccctttgggttctaaattttagaattctgtgagactaattctaagtggtaattttgtgaaagctgttcaactattaagttcaggtttacaaacctggaacctctggatcaaatgtactcttttatactcccacaacactatgaacttcctctactagagcacttatctttaagtagacatcatttctctaactttctagacttactccttaagtgggagatggaaccatcctagtttcttcaacacttaggagaatgcttggatcactcactaaatgtgtttcggttttggttttgtttctattttattgcaataatctcccacttgatctacccataaccactcttgcctttctcctactgcttctctatgcaaacatggtcaggtctcccccactcaaaaactttcatctttgccaggtgcggtggctcacgcctgtaatcccagcactttatgaggccaaggtgggtggatcatgaggtcaggagatcaagaccatcctggccaacatggtgaaaccccatctctactaaaaatacaaaaattagctgggcgtggtggcatgtgcctgtaatcccagctactcacgaggctgaggtaggagaatctcttgaacccgggaggcggaggtcacagtgagccaagatcgcgccactgcactccagcgtggcgacagagcaagactccgtccaaaaataaaaaaaaaaaactttcatcttccactcttctgaaaatgaagaccaaatttcgtaaaatagccctggaggatctagtctctgcctaccctctcctgctttacctcttttatcactgcttttctttattttatctgctttagccatacaaagctaataaagatgaaactagacggcatagagaaaaaagcaaggcaggggcctggggaatgtcagggtaggacagggtggagtgggttggggtgaaatgaaaggcaagactgaaaaggttacattagaccttggcaaatgagagagaacagaaaataaatacctctaaaatgggagtatacctgacttgtttggaaactgcagccagtgtggctggagtgaagttggaacagcagggagcagcaggtgggttagagaagtaataaaggtctgaaaaagcagggctttgtagggtgatgtatatgcaatcaactcccatagttacctctctcatctagatctctcctgagtccagtctcctacatgaaacacatatttgacaactcctcttggatgtcttacagacatgtctatccccgaagtcttaactgcactccaaatctgtttcttctccattctttcccatctcagtaaatggcagtaacctctatccactggcaaaagcaagaatcctaaaaggttctcccactaaatttagaatagacatgaaattccaattaaacatcctccacactaggcagctatagcctttaattaatatagcaaatatggtaaagaccctaatcccatacatacagtactccgttaagtattaccacccagtcacatattacacacatacaagaaggaaatcacttgcatctgagtcccaatcaaggagttcacattcctatgggggcagagactaggtgaagtgggacagtgaatctgcatatcctctgaaatgcccaatgtccatctaagacaaaatggtacctgtacccagagggttagcccaaatagtataatagcttcgagctaagaggtagccatcatggaggaagaggtccttatggcctctgacaatatcaatttaaaaacaggaggtccagtgagcccatcaagcaagatcaacataccatatacctgtacttttatactctaaaaagagatgggaacacagactaggaactactgccgtgtttgaaaatgcccccatgtttgttttctgtgctactgtctgttacttcatagtgactagaaacaaactctacaacaaaaatgacaatacattatggtgtattactacagcagaatactatgtaaatttattaaatagttgtacacttagttacatggaaactcataacacattctgaagtgaaagcatagtatataatttgcataaatagatacactcatataaaatgctacagctgcacctctggtaagccaaaggtttgtatggacttgtcctagaaagcaggaaagtgaggaactaagaaggcaaaatgaaaaattagaaatagattttgaaaagtaagttttacaaacttacctgacaaatttaagagaagtgaaattatacatagtgtattcactgaccacaatggaatcagactaaacatcaataacaaagataacaggaaaaatctccaaacacttggaaactacacttctaaaataatccaggggtcaatgaattaacaagggaaatttttaaactgaacgaaaataaaatacaatatatcaaaatttgtgagatgcagaagtgagaaaaattcataacactaaatacatagatcagaattagccaggtgtgcacctgtagtcctagccactcaggaggctgaagcagaaggatcacttgagcccaggagtttggggctgcagtgaactatgattatgccactgcactccagcctaggcaacagagtaagatcctgtctcttaaaaaaaaaaaaatgttatgaagaatggtctgagaaaaaaaagaaagaaaagacgaaacgtttcaaataaataatctaagcccacacctcaagaacaaagaacaagaaggggaaagtaaatctaaagaaagcagaaggtagtaaatctaagaagagaaatcaataaaactggaaacagaaaaaaactatacataaaagcaattaaacaaaatcttggttctttgaaaaggataataaaactgacaaacttccagcaacactgacaaagaaaaaagaagacacaaatcatcaatatcagaaaagaatcagggattatcactagagatcctgtagacatcaaaagaataagggaatactaagatcaattctacacacagaaatttgacaattagacaaaatgagccaaatcctcaaaaagcacaagctatcacaacttacccaatatgaagatgacttgaaaagccctataagtattcaataaattgaactcatacatttaaaactcctaaaaaagaaaatctccagttgtgggtgttttcaggaagaattctgccaaacttttaaagatgtaatgtctactctataaaatctcttccagaaaacagaagaggagagaatgtctcccaactctttttatgagtacaatagtatcctgatataaaaatcagaaaaagaatgccaaaggggttatggtggggggaactacagacaaatatcgtccatgactatagagacaaaaaaccttaatagaatattagcaagtagaatttagcaacatacataaagaatcttagaccatgaccaagtatcgtttattgcaagcatacaaggctggttcaatgtttaaaattcaatcaatgtaatctatcacattaacaggtcaaaaatgagaaatcatatgatcagttaattgatgcagcaaaacatttaacaaaattcaacacccattcacgataaaaaaaattctcaaaaaactaggaagaagaacatgtccagttggatttaaaatatttactaaaaatctacacctaaaatcagacttaatggtgaaagactgaatgttttgtacatgaagaatgaggcaaggaggtccactcccactactcttacacaacacagtgcttgaagatctagccagtgcaataaggtaagaaatgaaacacgtattagtccgttctcacattgctataaagaaatacctgagaccaggtaaattataagaagagttttaattggcttatggttctgcaggctgtacagggagcattgaggcttctgcttctgggaggcctcaggaaatgtacaatcatggtggaaggcaaaggggaagcaggcacatcttacatggccaaagcaggaggaagagagaaaggagggaggtgctacaattttaaacaaccagatctcatgataagtcactcattatcacgagaacagcaccaaggggatggtgctaaaccattcatgagaaaccatccccatgatccaatcacctcccaccccacccaacctccaacattggtacaattgaatatgagatttgtgtggggacacagatccaaaccttatcaaaatgaaaggcaagcagatcagaaacaaagaaataaaaatgtccctatttaaagatgaaataattgtctgtgtagaaagaaacatatttttaattacctagaactaataagtgaattagcaagtttataggacacaagatcaaaatacaaaaattgaaatgtaggtctacataccagcaataaatgcatggaaggtgaaagtaaaaatacaagaaaagatttactctaaaatttacatggaaaggcaaagaaagcagagtattcaattttgaaaaagaataaagcataagaaaccactctatattattttaacacttattatgtaacttcagtaataacactgtgaggagttggcagagacacagagttcaacagaacgtaatagagaacccagaaacagacccacactagtgtggccaactgtctttacacaaaggtgaaaaagcaattcaatggaggaaggagagctatccaacaaatggtgctgaacaactggataaccacaggcaaaaaaccgaaacaaaaacctttgacctaaacatgacacctgataaaaagaagctaattcaaaatgtacatttaaatgtaaaccataaaacctttaaaagaaaacctaggagaacacctttggggatctagatttggtgaggagatttagacttgatacccaaagcacactcacaaaaaaaactgataaactggacttcatcaaaataaaaaacttctgctctatgaaaaactatgttaagaggatggaaagacaaactatgaacagggagaaaagatttgcaaaccacatatctaacaaaggatttatatctaaaatatatacaaaactctcaaaactcaacagtaaaaaaaaaacaattttatagaaaatgtgcataagacagagatatttcaccaaagacacacagccagacacacacacacacacacacacacacacacacacacgaaaagatgttcaacatccctaaccattatggaaatgtcaaattaaagccataatgatatataactacacatcagaatgaccaaaataaaaatagtgacaaccacaaatgctgtggaggatgagaagaaactgaatctctcatacattcctgattgtgatgccagacagttcagcaactctggaaaatagtgtagcagtttcctagaacactaaacatatatttactacacaactgaggtatcacactcctgtgtatttatcccaaagaaataaacatttatgtccatacaaaacccatacatagatattcacagcagctttatatgtatagctaaaaactgaagaaaaacaaaacatccctcaataggtgaagggttcaacaaactgtggtacacagaacactactcaaaaacatagaatactattcaaaaagtcacatactatgattccatttatgtaatattcttgaaatgacaaaagcatagagatggagaacacattcatggttgccaagggctagagatagtagggtagcagaggtgaagagaagagtagttaagggacaacataaggaagagctttgtggtgacagaataattctgcatcttttttttttttttttggagacagtctcactctgttgcccaggctggagtgcagtggtgtgatcatggctcgtagtagcctcaaattcctggtatcaagcaaccctcccacctcagcctcccaagtagccaggacaacacacatgtaccaccatgtctggctaatttatttttatttttgtagagataggatctcactatgttgcccaggctggtctcacactcctggtctcaagctatctgtcccacctgggcctttcaaaagagctaagattataggcatgagtcaccatgcctggccgagttctgcatcttgtttgctgcagtgcttgcatgaatctacatgtgacaaaatgaaacagaactacaacacatacatttaccaatgtcagtatactggtttgaaatattgtcctacaagtctgtaaaatgtaaccaatgggggagactgagtgcagagtacatgggcttctgtgtgccatttttacaactttcagtgaatctctaattatttctaaataaaaagatttttcaaaaggaagacagaataactaaatcaatagtaattagcagtatctacattctcaagtttccaaatacgtatcttgaaaatttacatcccacatatactatcattcctagtattttcttgaatgattttatttcatggtgatttttattctagaaaaaatacgttctgaagtgaggcttcgagtgttttacttcacagtatccaaaatacccaataacaaaattattttgtaaaatgggtttgagtcttgcagaaatagatttataatccaattctataacttacttcataaatgatactgagcaaattaaacttgagtctctgtttcttcgtaactaaaacagggataaaatatatataccttggagaaccaccacgtctgtgtataaagaaactggcagtgttctacacacagtagactacataacttttactgttatcatcttatctccctgaaggtaacacacattcctatgggcaggaacaatttcatgtatttcccttgaatcaccttactgctgtcagcatggtgataagtatacaaaaaatacccaacatgcaattttctttgaacttttaacttctgccattaaaattaccctttttctttactgtaaatggttatcctctgattttctgaaaagggttaggtttggagtctttcagttgtgtcttgtttttcaaatgcgagttttcttgtttttgttttttagagacacagtctctctctgttacacaggctggagtacagtggtaccatcatagctcactgcagcctcaaacttgttggctcaggcgatcctcctgcctcagcctccctagtagctgggactacaggcctgcaccacatgcccaacttattttttaattttttgtagagactaagtcttgctatgttgcccaggctggtctcaaactcctggcctcaagcaatcctcccaccttgccctcccaaagtgctgggccaccaggccagcctccaataagagctttttgatgaagctaatatgtagtttctaaaggcatcaagccaagaaagagtagttcaatggtgtaatagttcagagatgcaaaacaaagaccgagatttccaaacattctgcacatcccatattcttgtttctaactcagccagttaaaaatatttttttgatatccaataagtggcatttttccaacgtctcatcacttcatacagatcattattcttgcttaccatttaagtaaagacttctatttgtatttaaattgactaacactgctccccattacccctttctcaacacagaggtccaggttgccgaccctgatctttgcaattttctagaaattatctctaaactcacctattcctcattatatttgttccatcacaatagaaattataaaaaagataataccagcccccactctgtaatttggtatcttctctgaagaatttattctactaattcttctcctagttctaaactcctaaaaggaactgtcaagtaactatcaaataggattaacaaactcaactttaatactgctcactaagcttctttctcttacttataaaagtcatattaaaatgtactatgatggacagggcagtttgtatgatattatcatcaatatatcacaacaaaagttccaaacacaacgctttagatgtctttgagaaggttttagatatctttgagagcacactactcaaagatgctcttctatatttaattttttataagttagtatatatgtcttctatataattttatatatatatatatatatatatatatatatatatatatggtgcaaagatagcacagagttcccacacacccttcatctagctttccctaacattagcaactgacaaaaacacagtaacactggtcaaaactggaaactgaacattgatacaacagtattaagtaaatcgcagattttattcaaagattctgtactttttgagtaactggtgacactggacttccagatatgatggggataactgaatatccagatgtcttgggagaatttctattatcattcctaatttaacatggtcccagctgctctatgatgagctttgattctctatgagagcatagagtcatgctaacatagaatcttatgttggatgaaaccttggaaatcatttaaattttttttaagtataaattatgacccattaacaggtcatgaaataaatttaataaaccacaactataattttttaataaaacaaaatagaaaatattagagtataatacagatgttatcgtatcataaattttttgttttagtgatatatgtaaaaatgtatatgtgtgtggatgtaggtatgtatttatatactgggtcacattatttttaaaaattccttagcaaaggtcagagtcaaaaatgttttaaaagtcactcatctatatcaaaccaaagaaagttctctttaatattcctgacaaatgataacccccatctctaactaaacactattaaaggtagaatatttgctacttatacatcagacggtaatacgtattaggacatttttaatgtggaaccaacatttctctgttgacttttgatctacaactcacaaaaagggtgggttttttccttctaaagaaaaatactgtgcaatcctatttctttttttccatcaaattagtgaacagaagttcttacacctagaaatcaaaagttccaaaagaaagtttccttttcagttcccaagaagagactctgaaaataaagggcaataatagaagaacagaaaaatatatatgtaaggactctaaatgggagaatagaagtaatgccaagcaaaaacgtcaagtcgataaaggaacatctttgaggaaatgatataaatattggatcctgcccctggccagccctgcccggccatgcgtccctcctcctccccaccttgtggcgggcagcagccctctagctttggctccgtggactggctctcccaaagcagctgctcagggccgacccacacccccaggcctgccgaggtctccctggggagcctccctggcccggaccaggcatcgggccccgaggagccccctcaggccgtcagcatcaaggaggctaggtcctcaaatctgcctccgccagagagggctatggctgggttgaggaaagggccaaacgcctggcgggccccactgtgtccacacagccttcaccacggagcaggtccgtggcttggagggcatcttccagcaccaccagtacctgggccctctggagtggaagaggctggccagggaaatgcagctgtcggaggtccagataaaaacctggtttcaaaatcgccgcatgaaacacgaacggcaaatgcaggactcccagctgaacagcctcttctcggagtcactgcacgcacccctggctttccactcaccgtcttctggccttgccaatggcctgcacctgctgtgcccttgggcacccctgcctgggccccagactctgatgctgtcccctggctccttctggggtctctgcaagtggaacaagaggccctggcctctgagtgggcctgctgctgtgggcagcctctggcgtaccaccccccaaagcccaggaagtggcatgcatacgctgggaccagccctgtccacggggccctggggcctggtgtgctctgccggagacgggatgcattttgaggaaatgcctctgactccaggcctcccatacaggtctgtgcagattgcacctggcacctacccagagaactcagctgttctgtttacattgtggaggcacctctcaccctgacccacgcaaaggttctggagatttctggagaatatatttattaaagccacctcttcaccaaaagttaccaaaagggttggtttaggaagtaaatgaagggtcagtgtagagtcaaacgcagaagtgggcttgttatagggagggctttcagcatatgataaaagggtaatttgttttttaaaaagtgttggaaaaactggttttccagttggaaaaagtaaaggttgtaggctttgtgtgtaaaaaagaaaaccatgaaggattggaagggggaaaaaaaagaaattatataaataaaattatcaaactcaggcagataatttcatagaagtatgcattacttactagcaaatcttctcattttggaaaatgtttcactttttaatttttttagacacacaaataagaagaaaaacttccacattcaaaagaaagactaaaccatgcacaaatgaaccctttctgtttcctttaacatacaagaaagtgatttcatgaaatttattaaaactgttatttctggccaggcgcggtggctcacgcctgtaatcccagcactttgggaggccaaggcacacagatcacgagatcaggagttccaagaccagcctggccaacatagtgaaaccccatctctactaaaaatacaaaaaaaaaaattagccaggcgtgctggcgggcatgctggcaggcgcctgcaatcccagctactcgggaggctgcggcaggagaatcacttgaacctgggaggtggaagttgcagtgagcagagatcgcgccattgcactccagcctaggtgacagagcaagactctgtcccaaaaaaaaaaaaaaactgttatttctgtccaattccaagcaaccaaagtacttcatgtcattaaatatgtatgtgtaacacacatacacatacatatatacatatagatattcaccaaaccattattcaactatctggccacttcattctactcaaaatgcagatccttagcaaaatttatgacagaaaaaaataaattctgaagtaaaaaaattcaccaactagataaaactcgatgttttccacagttaaggggacatcttagggcgtaattaaagccctgctactcttactttgccccaaattcaaacaataatatcggttttcaagataatagcaattgaaaagcatcaaagaaaggagcaagcaatatgcaaaggtgcactgacaaaaacaagaaataagatgacaatctgactgacaacaatgatttggaaagtaactaaaagcacacttgggtactctagaaacagatgtctaggattatctggtataaggacaaaccatgtacatatctcatgaggcttgtaatacttattgtttataaggttgataatgagtcaacagcaaggattcttcatgctaagaattgtggcattttctatttaaggatataaaaaatatatgccataacttttagaaatatttctatccaaaattactgaactaagtaaagttttaggttccaaaaaaaagtgaaccctcagcaatgtggggaagctagctgtccagaacaattatccttaaggagtgtggttaactgtaattcttcccttcttctttacttctttcaaaagttctatgactattcaaaccatctcataatctttgatgttaatagagggtaatgtgttttgggttgtggggaccagtatttaaatgactggacatagaattacttggggaagttttaaaaaacagtgcggttcaagctctgcaaccagaaattctgatttaattagtccacataaagtctgggcatcagaatttttaaagctgcccaggaaagcctgatgttcagtcagtgttaggaaccacttaggtaaacagttttcttcatgacacctttaggagtcttcaagagagatacagtatgcagcatttccaaaatttgtcttcaaatcccttttaccatggaacatcttataacactgacttaggtaactcttcatctgaaaatcaaggtaaatattaagtttagaatcaagttgtatagcttttcaaactttgtaaaagttctaatgtggttaggaagagggaaggggagggaaaaaataaaaggatgacttacttttatcttgctaccacattttttatattacaaaaattccaaatgaaatattttaattttaacttaaaatttcatagtttattttaatcatgcttatattaagcctgtgactcaaaagcatttacatgttgtgaaagctaatttcaaagataaaaccgtgctgccctctaatggttcaagataaatatttttacctatacatagtagtaaggtgataaatacaattttattattttataaatgggaggattacattatataccagaaaagaaaaataagatttcaatttttggtataactgagcccaaaaacttaactatgactgctatgttcaagctcaagacccttttaactgtccaggcacactggctgacccctgtaatcccaacactttgggaggccaaggcgggaggattgtttgagcccaggagtttgagaccagcctgagcaacatagtgagaccccatctctacaaaaaataaaaaattagccagacatcatggtgtcccaactactagagagactgaggtggaaggatcacttgagaccagaaggtcatggctgcactgagccgtgatcatgccactgtactccagcctagatgacagaacaagattgtctcaaaaaaaaaaaaaaaaaaaaaaaagaactcttttaattatcaaacctttttttttttttttttttttgagacggagtttcgctctgtcgcccaggctggagtgcagtggcacgatctcgactcactgcaagctccgcctcccgggttcacgccattctcctgcctcagcctcctgtgtagctgggactacaggcgcgcgccaccatgcccggctaatttttgtatttttagtagagacggggtttcaccgtgttagccaggatggtctcgatctcctgacctcgtgatctgcccgtctcggcctcccaaagtgatgggattacaggcgtgagccaccgcgcccggcccaaaccatttcttaaaccaccacatttgcctatgcatgtgtaaatcaggataaaaatgtacacctcttctgcattctgcaatagccatctctaacttagcttctttttcaaataaatctatggcagtagtgttcaaacttgaatgcttgtaccctacaaaaacattttagaaagttacacatattcttgcatatttcttcttacagctaaagttttaattcacatttttaaaatttcattaagtacttgcaaaggatgtagtttctaatttactgtaaatatttacattttaaaataaaattatgtcactcttttaagtgtatccaaaaactgaactatcatagcaagctgacatccacctttatctactcaaaaaatacataaattctgttaaatacaacagaaattttacaccagctgtatcttgtttaacttgcattttactgcactctctccatttcatcctaatttcatattttataactaaaagtcttttattcctcattctaccataattctatgcaacaaaaatagatatattaattaaaattataggagtttgtacttccatgtaagttagaaaatattttgtgcaatgagccattattgaaattattagcagataatgaaacaaatattataattttaatacatcttttttttttttttttttttttttttggagacagagtcttgctctgtcgcccaggctggagtgcagtggcgcgatctcggctcactgcaagctccacctcctgggttcacgccattctcctgcctcagcctcccgagtagctgggactacaggtgcctgccaccacacccggctaattttttgtatttttagtagagacagggtttcaccgtgttagccaggatagtctcaatctcctgacctcgtgattcgcccgcctcggcctcccaaagtgctgggattacaggcatgagccactgcgctgggctaatttttttgtatttttagtagagatggggtttcaccgtgttagccaggatggtctcaatctcctgaccttgtgatccgcccgcctcagtctcccgaagtgctgggattacaggcatgagtcaccgtgccaggccacataatttttaaacaaaaagtaaaatattaatggacatgaaactcactgacatttacagagctttttttctttatattgatgtatctaagaaagaatatttcttactgctaaaatgagataagttctcaattctactcttatttcacttatttcaggtataatcactaagaaatgtaattcacattaaaaactaaatcactctgagttttgttataacaaggtcactcaattttttctatgccaaaacacacactgtgatctaccatcagaaattatttttaatgacgtggcaattgatgttaagtcctctcacaatttgctgaaagcaagtaaccagaaactacctgacttacaaaggatgcattacacatttgctacaattattcagattctccatttctgggaaatattccaaaacagtattactatgacttatcaaatgattatgaattatacctgctattgtttcccttagcagtttaattttatatagtccaaaagggtagaaaacatcaaaatattgttaattccaatatccttttgctgaaataacatttgttttataaaatgttttgatcttatcatacacttcaaatatattttacccaaatggtagagctgcaaacagctcatttaatttatggtaaacacccgctgtcaaccaaatgccaaatcaaaatctgcctttatttctcaactcaaatacatttcaggcttaaacaaaaaagattttaaatttgtctcataaaacaaggcccaaatatacactacatacaagagacaccaaaaacagagaaaagctaaaaagttgtactagcttaatgaaaacggaaagcagtgattgttatgctgatatcagacaaagcagagttcaagcaaaaaggtattaatggcgaacactaggtattaatgctaaaacctgcaattcttcagtgatatataacagttatgaatacctatgcaccaaataatgcagcagccacctgaagccaaaaactacaggagatgcaaggagatataaacagaagcacacaaatactaagagattttaacacatcactctcagtacaacacagatcaagtggacaaaaaaacatataaaagaccaaagcaacaaactcttacagaagatgttatgctgtatatgtgtgtacatatgatcctccatttgatctcaaagaaagcataaggaagtgccacaaggtggagatattacagtctcaaatcaaaatataacaaactagaaattaataacaaaattttaaaaagcaaagggcccttctacttgaaaaataaaccttttattaagtaatttgtacatgaaagggaaaatacaaactagaaaatcaatactgaaagaataataaaaatactacatagcagaaactatagtacaaatgtaaaacaatggtcgaaggagaattcataaccttcaacagttatagcaataaacgtattcaaatgaatgaattaaattcaacataaatttttagaaggtatatattattactaatttcatattagattttatttgctcatttttttcttctatatttatattggtattagactgcaacttccttttctgtactgtctttaccaggtttaggtgtcaatgacaactttatttgctaaaaagaattcagaggccgggtacagtggttcatgcctgtaatcccagcactttgggaggccgaggtaggcagatcacctgaggtcaggagttcaaaaccagccaggccaaaatagtgaaaccttgtctctactaaaaatacaaaaattagctgggtgtggtggcgcacacctgtaatcccagctactagggaagctgaggcacaaggatcgcttgaacccaggaggcggaggttgcagtgaaccaagattgcaccactgcactccagcttggcgacagagcaacactccattaaaaaaaaaaaatatttaaaaggcacaatagtcacactcagtaacacggggttttaagaactatcttgggggactgggcacggtggctcacgcctgtaatcccagcactctgagaggctgaggtgggcgaatcacctgaggtcaggagttcaagaccagcctgaccaacatggtgaaaccccatctctactaaaaaaaaattaaaaaattagccgggcgtggtggcccacgcctgtagtcccagctacttgggagggtgaggcatgagaatctcttgaacccaggtaggggaagttacagtgagcgaagatcgtgctattgcattccagcctgggcaacagagcaacactccatctcaattaaaaaaaaaaattatcttgggaagttcaccaccatttatcacaatgtttctatgagaaaatacattccaagtttccagtaatcaacataaaaacaaagtttggaacaaggcctatttgatgatcacccaaaatcttacccagaatttattagacacaatattacatttccaagaaattatgttattgcagaaacttctataaacatgtaacataaaccctcattaatagtcaaagcaaatttgttttaaaaaccatacttatgccgggcatggtggctcatgcctgtaatcccagcactttgggagcccgaggcgggtgaatcacgaggtcaggagttcaagaccagcctggccaacatggtgaaaccccgtcttcactacaaatacaaaaattagctgggcatggtggcacgtgcctgtagtcccagctactctggaggctgaggcagaagaatcgcttgaacctgggaggcggaggttgcagtgagccaagatcaagccactgtactccagcctgggcgacagagagaaactccgtctcaaaaaacaacaacaacaacaacaaaaacaacaaaaaaaaaaaaccaaccatacttaaattgctttctaaatccaacggacactaaaacttcacaaaaccttcactgaaaatcagtatttgaagaaaatgcataaaaagtgattgagcattaaggagaaacagctggtggataacgttttttgattcataaaggaaccctccaaaacaaagcagaaaaaaaagcttcaaaagtttttcggaatttttagagcaatgactggcaacctatataaacctttcagaattctgaatactgaaagcccacgtatttatatgtcacatgacatattaaaaagagcttcatggcctagcttggtggctcatgcctgtaatcccagcactttgggaggctgaggcgggcagatcacctgaggtcgggagttcgagaccagcctgaccaacatggagaaaacctgtctctactaaaaacacaaaattagcctggcatggtggcacatgcctgttgtcccagctactcaggaggctgaggcaggagaattgcttgaacccgggaggcggaggttgcagtgagctgagatcgcgccattgcactccagcctgggcaacaagagcgaaactctgtctcaaaaaaagaagagcttcataatttaaactgtcattgtacccagatttttttttaaacacaagtaaataaacattgctaagcaagattttgctcaactgaacaaaaaaataaagatattggtgaaagagcattgcttcaaacacaaaataaaccaagtatttttcagagcttgagcaacagattaataaaactagcctcaaataaaagaatagagaatgctatttatttctccctttctagacaaaagttgttaaaatttttaaataactttaggactagaaagatagaccccttgttgtaaaaacattacgaattcagtattaatcagatttaagtcatggctatattttcctaaataatcgcaacaaacttgaggggagaaaaacttacggtaattatctttttgttgccactttgtttatattcacttttgtagagaataatgcttaaacttttagcataaagaactcaaaaaggatttcaatagcattaaaaaaaagtgaccaaatgaaaatcagactaaggtcaacccaaaattatagacattttttaatttaagaattggctctgtttacttatgcttttgtttttgtctaaaggggatatgaaaaatgttaaacttgtgtgacatatcctgtaatcccagcactttgggaggctgaggtgggcggatcacaaggtcaggagttcaagaccagcctgaccaacatggtgaaaccctgtctctactaaaaacacaaaaattagctgggcatggtggtgcatgcctgtaatcccagctactcaggaggctgaggcaggagaatcacttgaacccgaaggcgaaggctgcagtgagctgagatcgcatcattgcactccagcctgggtgacagagcgagacaccggctcaggaccaagattaagtggtgatccctgggcctgcctggctgcctctaaaaacagaacaaaggagcatggagtcctgaagttctatcatggtaaatgtattaccaagttattagtacttgaatactaactctgtggcaagaaaacagaccagatattccttgggaatgaacgctgagaaagctgaaagaccagcttgaatggctatcaagctagacaaggcagaagaggtatgtgtataaaatgctgcatataattacacaaaggccacagattttccaaagctcatgtttaaatcctaacttaataactcctgatatgcgcagttttctaagggagaaatgattctctgggtaacattattccagggtcaagtaaattttaacacgggccaaaaatatccatatgcaatagagaatcagccattcctcctataaagcatacacccagaaataataacagaatcacagcctgatttaatttttttaattaagcagatgtaaattcttttaaatctcccacagtaacaatgtccagtacaaatacactgatatttagattcttttaaaggaactcaaaacactacagtaaagtaaggtaaagggtcatgcatggtcactgaattactttattaaaacctgaaaacaacactgtaaggaagcgttatttattctcctaacttacaggtgaattaaccgagaattagaagtcgaataacctgctcaaatccacataactatgattccaactccagagtttgtacttgtaactaaacaagctaaaatgcaataaaggctaacaattataataacaatcagtgcacaaaggcagaagctaagcaactgaaccagcctatcattctgtcctcaaacaccctataaggtaaatattattttaacctctagaaaaacatttacaatgtttttggccaaatgcttgagaagcaaaaatctggcgctttcttataaatatttttagcctcaaagaaaatggaggattacaaaatgttattttttaaatcaatgttattgaggtaaaatttacatttaatgaaatgtgcctattttaggctcagagtttgatgaattttgacatacactcatattaacaatcaccaaaatgaaaatacagaacatttctatcacccccaaaactttccttgtataggaaattcccagccccaaatctagacaatcaaagaacctctttctgtcactacggattagtttcgcctattctagaattccacaaaaatagaatcttacagtacctacactatgtatctgtcctgtcttcttttgctcagcatattgtttctgagattcatgcatatcattggatgaatcacaagttttgctgttgaatagtatgccaagtcatggttacattacagtgtaaccatttacctagtggtagatatttgggttgtttccaatttggggctattataaagaaaaatgctacaaactttcatgtataagtctttgaatggccatatattttcatttatcttaggtaaataccacatggaattgctgggtggtaagataagtactacatgcttaacttcataagaacatcataaactctgacaaggtgcctgtaccattttatatccccagcagcaatatatgagacttccagttgccccaccatgacactaggtgttgtcagtctttttaaactttagctatggttttaatttgcatttccctgatgactaatcactttgagcatcttttcatgtgtttattagccattcttatctctattgtctattcaaaaatattgtccatttttgccttattaatgagttgtaggtattcctttatatattctgaagtcctctttcaaatatatgtattacgaatgtttccttctaatatatgtcttgctttttcattttgtaaaaagtgtctttctagtaccagaagtttaaattttgatgacttataatttctcaattttttcatgatccatgtttaaattttgatgacatgtaatttctcaattgttgcatgatccgtgctttttgtgttctaagaaatctttgtctatttccaaagtagcaaagtattttcttctggaaattttactttaacttttacatatatgtctatgacccatttctgatttatttttgtctgtggtgtgaagtcaaggttcaggggtttttgttgttgttgttgttgttgttgttgttgtttttgagacagagtttcactcctgttgccaggctggagtgcaatggcacaatctcagctcaccacaacctctgcctcccgggttcaagcaattctcctgcctcagcctcctgagtagctggggttacaggcatgcgccaccatgccaggctaattttgtatttttagtagagacaggttttctccatgttggtcaggctggtctcgaactcctgacctcaggtaatccacctgcctcagcctcccaaagtgctgggattacaggcatgagccaccgcgcccagcccaggttcttttttttttctgtcagaaaggccaattattttactattatttgttggaaagagtatcctttccccattagcaccttcactggaattaattttgaaagaattaaattgttcatatatggattgatctatttcttgcctccatattccagagatcagcaaacttctgtaaagggcccaatataaaatattttgggctttgcaggccatatgatctattacatctattcgactctgctgttgtaacacaaaagcagactataaataagcaagtatatacaacacataagcaagtgactgtggctgtgttccaatgacactttactgacacacactagaatttcaatttcatctaaatgtcatgtgttgtaaaatatcattttatttttgatgtttttccaaccacttgcaaatgtaaaaaacattacttagcttgcaagccatacaaaaacaggcaagccagacgtgacccatgggctatagtttgccaactgctgttttattctgttccactgatccatatatctgtccctatgttaattttctgctgtcttgattattgtagctttatagcaaatcttgaagtcaggtagtgtgggccagccaattttgttcttttcaaaattgctttggctactgcaaaaacaatttgcagtagccaaattgtttttttgcatctccaaatgtcagcactactttattaattttaccaaaaaaaaaaaaactctactatgatttttgttacaactgcattgcatcttcacatcaactttgagagaactgaaatcttaaataatagagtcttctttaatttgagcagtattttatagccttcattatacaggttgtgtacctattttattaaatttatctctgaatatgttttcacgctatttaattccccaactgctcattactatttactagaaataccactgatttttgtatactaaccttgcaacttgtggccttactaaattcacttattcagtagcttttcagtacttttgatttattattttctacatacagaatcatggtgtctatgaagatagttttatatctcctattccaatattcccccatttgtttcttcttattgttgcacttgatagaactcaagtataatgtggggttctttgttgtttttttgaggtggggtctcactgcgttgcctaggctggaatgcagtggcgatcacagctcactgaagccttgacttcccaggcccaggcaatcctcccacctcagtctcccaagtagctgggactagaggcacacgccaacagagatggggtttggtcatgtttcccaggctggcctcaaactcctaagctcaagcaatctgcccacctcgacctcccaaagtgctgggattacaggcatgagccaccgtaccagtccttaagtataatgttgaacagaagtgataacagtgtgtattactgccttgttcctgatcttacaagtattcagtctttcactataaagcataatgttatctggaggttgtttgaagaagccctttatcagattaagaaagttctcttccattcctagtttgctgagtctatatcattagtgagcgctgacttctgtcaaatgttttttctgcacctaatgagatactgatatggttgttctcctttattctattaattgggttaattactttgattactgaatactaaattcatcttgctttcctagaataaacttcatttaatcataatgttatttaaattcggctgaatttaatttgctgatattttgttaagaatttttatctggctgggcatggtggctcatgcctgtaatcccagcactttgggaggacgaggtgggcagatcacttgaggtctgcagatcaagaccagcctgggcaacatgttgaaaccctgtctctaccaaaaatgcaaaaaattagccaggtgtggtggcatgcgcctgtagtcccaggtactcgggaaattgaggcatgagaatcgctcgaacctgggaagcaaaagttgcagtgagccaagatcaggccactatactccagcctgggcaacagagcaagactgtctcaaaaaataataataataatttttatatctgtgaccatgggggatactgatcttaagttcactcttcctcatccttgctttggtaacttgttcaaattttcttctctggtttatgagagttttaaaaagacatttctaatgcgtctttgttatgggtttaggttaatttctcccaaataaaaaaaaatcctaatttaacattaatgttaataatttaacattatttttaacaaaatatttaaaaagttaccttgctgcctatctttcagttctacatctattctataaagtgatatctacatgaagtagaatcagtttaagagttctgacacacattccatgtgtaaagcatatgagaaaagagaaaagaatatattccccaaaccaagggatgtagtatacaaaaggcaaagttctatatctattgaaacaaattgggcttttcaccactttatgcttacttcatttatccaagagaatttaatgttgtatacttggatgactttttcctattgggttgaacatatgaaactgacatatttgtaggtcaaagaaacgtcaaatattggcagtttcatacggtttaacctctaatttaatggccttggaatagtaaccaaagtgagctcacccagtctgtatgttgtttgatcagtatacaagcaccatctggtggcagaaaccaaaactgtaggtttgtaactgttcatatcactgctggtacaaatacagtcatccctaggttatctgtggggaattgtttccaggaccttcacccttaccccctacagataccaaaatccatggctgctcaagcccctgatataaaatgctcaagtccctgatataaaatattaatattttaatatttgcatataacctatgcacatcctcccatatacattaagtcatctctagattacttataatatctaatacaatgtaaatgctatgaaaatagtagttacactgcgttgtttaggaaataatgacaagaaaaaaatgtctgtacatgttcaatacagatgcaaccaccctttttttcctgaatattttcaatccacaattggctggatccatgaatgctgagcccatggatacagaacccagggatacgaggggccaactgaatattcaacatcaactgttgtactttccaatatgctttttaagagggtgttacaaatgagtgaaaaatcttatatgcaaagtttgaacaacctcagaataaatagcacaccaacatcacaatacttagcaacaaatcatcagcctatataacataaactgaaatgtaataaacaagctgttttcataaatcagaatcttggctattattaattttactgataattaacataatgcaatcaagtcaatttggatgtttcaaaaaacttctttcgccctatcaaatttccactgatagccatcactatctgtaaaatgatttccgtgtctcacagatttatttcacaggggtacaatgaaaaaccaagaagccttaagtaagtgtctaattctggccatagaaacaagtaacattcaggcaaaatagtccaaattgttttcttcttgtttaacttgctatgactcaacatatattaaaagaaaataacttgaccaacctagctataagagattgggccaagaactggatacattagctaaaggtaaccttgacataaaatatactaaacacatctaatgagaatgtaggccataaacttgttccaaactgagtgttaacaaataaacaaaccctttggggaagaaaggatacaccttcaatgaacaaagagctgataggtcactcaaacttgggttgaatcctaaactgccattttcttaagatatattacacaaacctattctgaaagctctagatgttatactacctcttgccacgtctacttccaacaagtctttaaagtcaaagataatctttgctacccttcattgtggccataaagagtgataaaatgactcctaaatacttcgtaggcaatttaaatgcaacatagtgcaaattaaactcttcatctttccaaaaacctgctccaactactcttgtggtgaacagtattactagccatccaaatatctgaagttatccttaataccccaaatgcaatcaagtctaccttctaaatatctatagacactgtcccctcctctccatctgcactattccaggcctgcatcacattatgcctgaattacaacaacattgtcgtaattctttatcccttcaagttttaggaatattgccaaagcaatattcctaaaacatatatccaattattttatccctcagcttaaaatccttcaatgactcccaatcaccttcagaataaaatccaaacctcgtggcatggacaattcaggacattcaaatcggggccctgcctagacttcactcttctcattccagacttaccgaactgtttctaagtccatgaatgaactaaacttctcaggattcctagcctttgttgccaaaatctgtattacttttccttgccctcctcacctggctaaatcctagttaaccttgaagattcagttcatccctcctggaaggcttctttggtgccccaatctggatggggtgcttagttccttcctaatgtttccatagcaccatcggggcacatctatcattctgttctttcgttttcctcttctactaaacttaagtctattagactgcctgtctttcctcaaagtctctactcaaacacaacatgtggcaatgagtaggcatgcaataaatgtctgctgaatgaagatgacctcacgaaagtccttcatttgctattactatctctgttttgcaaatgaggaaattaatggaggtccagagccttgtgcaagatcacttaactaaaagcatcagaactaggaactgaaccaaatgttctgactgtaatggaaataattttctctaaaaatctttgcttttgaggaaccgctccataaaataattgtaccctgcggagtagtttggatggggctaacctgtttctccaggttggacatataacccaggcttggctaaagtaaagtatgtccctacccccaaccaagtttgaatgattaattccaggatggacagtttactccaagtgtttgtggggacttttctaatgactatcaaaaaaaaaacttcaccttcttcactacaagtctacagactatacagtgtatgaagtatagcaaatgggaattggcttatttgaaaacaaagtagagaaaaaaagaaacaagagctagaaagagagaaatagaaaatgaggaagaacaacactaaagccctacatccaactatgcctgtacatctccccaagagatatcccagttacatagctcaaaaattcccatttgcacataacctagtttgagttttggccccatggaaatctacaccagcagatcaaggggccatttggtctgctggtctgccattttggccatttgctaagcaataatatttttttatctgtgaatatacaaaattgaaaaactgtctaaattcagccattctatttctctaatgtacataatttttataagaaagatgggagaacaaaagcacgaagtgttctccaagctttaccttgtactttgtcaaatgaatttttatatgctttctgcttcataatatatctgttagtgaaaagtgcctcaaatgataaagaaaaatacataaccggatgtaattattgtcaaacatcttgggcataataaaaggagacaggtacttcagaatccaagttgtatctacagagtttgctcatggataaatgtttttttctccactcatcattaaaaaagaagaaaaattcagttcttcttaggcctttgaataagttcaagtggagaaacatcatcagtagagggtggtaaaacagcataggtaatacctaattttgcttaatattactttaagtagaaaataaaaggaccttttcaaaaatccctctaaatgatacctgtttcttggacttcacctttcattccctgccttaagaagctaatgattaatctgggttctgacaaggaaaagacatctccttggatctttggctccagagtccctgtaatccattcaagtgttgccatctataaattaaaataaatatgagaaatcatggttgtaacagcctactgagtaatggttaggtctgcgcttctgtgagcagaaagagcttttcagttgaaacatggcttggtagcttactagtactttccgatattctttttacctttttgtgatctgcagaatatcataaaataaagacactccaaaaaaggaaaagtccatattatctattcatggaatggcctaaggcacatcctttatttatgactttggagaaatcataaataaaattattgtacccctcacaacaaccataagaattagatcttggaactagaaactgccaacaaagaaaaaatgccgacattcttaacagaaaatttagaaaagaaaaaaagaaaatcaaaatcacatgatccctgtctaatttcacatactaactcctctctcccttggttcactctgatcaagccacattggcctcttgaggccaatgccaggcacacttctactgcggggagtacttgctatttcttgagcctggaattctctctctctctctctctctctctctctctctcaacattcacactgctttttctctctcttcctttgaggtctttatcaaaagcaaccttctcagtgactaaccacttcttattgactgactacctcccctacaagaacatgagctccataaggacagggattagtgtctgacttttcattgctttagcaccagactttttaaaagtaataaatttagaagtaataaaagtagtttatttccatttaaaagtaataaattcactagtcagaactgtagcaaaatttcaataaaggaccacagataccaaaataaaacaaatataaagatgtaatactctcataaatctatttactagagtacattagcaataaaattagtatataataggctaggtgttccttactcaggtgactaaagatatctactgtgttgaagtgggcaactagctttatttatttacattggggaacgtcagattaaacataaaggcaatgcgtatattatacagagaaagagaaaataaaacaactacaagagaaatgtgttgtcccttgtgcctcctatgcggtgtggacaccaagctgagggctgggaagcctgccattgtatgcatcacaattagaagcagagatgttacaggagagaatgaaatataccaaggaagccaagaaaagctgagggtttaggcccattagcaaggggaagatagtagatacactctggaagcattacctaagggagaaaaagacggactagatgccaccaactgcaagtttccacacctcgtggacaaggcacacgaccacaaagaaaagaggaactaaaggacaacacaagatgcctctacagaggtgaggtatatagatgcctctcccttcctagcatagagaaagctcccccaggcatacctgagaggaaaagggaagggcagaagtctaatacagtgtgcaaattcttcttagagaacctaaacaataatatttaaaggaactatttacaattgaatagaactaagttttaaatggatacaattaaagataatttttcccctagcaagcaagaaaccaaaaagtatcagattatttatggactaaataaatatcttccctacacatctaagttatggtatcagtaaatacataaaaccataacaaaagcaccagcaaatatctgatcaaatataggaaagaatttctcaggcataaaagaagtgagagaaataaagaaaaatcaatagataagaccacataaaattttaaaactacaggatattaaaaacaaatacacaattaaaagccaaattttttaaagcaggaaaattacaacaaacaaaatagactgaaggttaacatcctcaacacataaacatttgaaaactggtgaagcaatggaataaaaatcagcaaattaaaatagacaaatcaaaaaggataacaaatatctaaaaaaaaaactgttcagcctcactagtaatcaataaaattgaattttaaaaactactacttgatggccacgtgaggtggctcatgtctgcaatcctaacactttgagaggctgagagaggcggataacttgaggtcaggagtttgagatcagccttgctaacatggtaaaaccctgtttctactaaaaatacaaaaattagccggaaatcgcttgaacccaggaggcggagggtgcagtgagctgagaccacaccatggcactccaacctgggtgacagagtgagacttcatctaaaaaacaaacaaacaaacaaaaaaaaacaaaaaaaacactactttttaactaccaaagaagacaaaaacctttttaactcagtgttctcagaatagaataagcattctcatatactgtaagaaattagtacaaactttagtgcaattgggcaatgctttattctttttaaagaatattccccttatagtaatataaggaaggaaataatcagtgatgtgaacaaagatttacatagtgattatttactgcagcaatcttaacaaaaaagagggcataaacaacctagataaaaaaatagacatacatttatataccttatgaagccatatgaagcattatgtagccatcaaaatcattttgtgccaggcacaggggctaacgcctgtaatcccagcactttgggaggccgaggcggacagatcacttaaggtcagaagttcaagacccccagcctggccaacatagtgaaaccccatctctactaaaatacaaaaattagccaggcatggtggcaggtgcctgtaatcccagctactcaggaggctgacacacaagaatcacttgaacccgggaggctgtgggtgcagtgagacaagatcacaccactgtactccagcctgggtgacagagtgagactgcgtctcaaaaaaaaagaaagaaaagaaaaaaaaattcttaaatatatgacaaatggccactatattaagtgaaaagagagtgcttgttttgcatatacaagatacacaaattatgatatatccatacaaagtacactaaccagcaataaaaaagggcaaaacccagatataagcaacatggatgaatccccaaacaagaaaatcattatacaaagtaaaagaagccagatgcacataaatactgtatgagtctagatataaaaagttcaacaacaggcaaaaactagtctatgataataaaatagtgattatttctgggagaaggatgtgtcaaagacaaagaggtctgaggaaactctcagaggtgattgggaacattctgtatctcgatctgagtggtgatcacgtgaggctatacgtatgtaaaaagtcatcaaataaagtataaatacatatatacatacataaaataaagtcatcaagaggtatacttaagatttgtacattttactgtatgtctatcataccttcataaagtactacaaaaactgcatataaaggacaacttcaacttggttaaatatatttaaatgcaaagaaaaaaagaatgtaaagtacatgaaaatataaaaggtggcaaattctgggattacattatttacattttttcttttttccctataaattacaaacattcatgttcactaatgtatttagacaaatcaagaaaaaaactgagctctgcttggtaaatgaatgagaaagtcaacactataaactgtgaaatgactttaagacttggtcttccctgcaacaaatacagggccctcatgacacaataaaaactagttccttcagatcttttacgtttgtggggtaggggaaaaaaaaaaaaaactagttcctgaaaactgggtttctttaagttattaatttaaatattccttgtgaacctgctttatctaaattccatgcacaatgcccaaggtcaattagatttacaatgaaaatactcttttgagtgtgagaaacttttataacatggataaaataataattaagaacaaaaccaaaaaagacatacaaacctctgattgtacatgccccgaaagttgtaattagctctataatttgggaatggctttggatctaatggcctgtagatggcaggctctccccttttcatagcaagcccattcagttccacagttggagttatactgcctgtttaaaaaaaaaacattaaaggcacacaagtgaaatatcttcacaattaaacatgcaagctatatttatacaacgcttaaataccatggaagaaggtaagaatggatggaccacctgtatgattttctaaggaactgcgaaaacaaagtaaaaaaccaagaaaatagttcctaataaaatcttgggattttgcaatgttttctgtacattaatgacaaaaaatctgagtgtgcaatcattactatcaaaacatagtaaacagatgattcttagattgctaaccgtgaatattattttttaaagtactgcatttcatcattacttaccccagaaagcttgcatgtatttaatcattaaaaacatcatctgtgaatatttttatttatactttggtaattaaataactaagcattggcaagaaagtcatcagtggttcttggacttatctaatgaaaaaagttttttgaattttttctataaccaacaaaacagagtaaatataagcaatgtttcctgaaactaaaatgtcatcgaatatattcctagcaaatattaaagatacgtacaagtagcattatcgataaaaacaaaagactgaaaacaacctaaacaaccatcaatgcagcatcagttatataaatgtccatagcataaaacactgaacagctataaaaggaggaagactactacacaccttgcttcttttattttacttaatatacctcggaggttataccttagcagtgtagggtataatgttaaacgaaaaaaagcaaggtaccaaatagtgtgtgctttatattatcttttgtctaagaaaggtgaaaatgaaaatataaatatatatttgcttactttttttaaagaataaacccaaaactaaaaaaaaaaaaaaaaaacttacttaggaatggaagctgtatgtctctgaatgtacactgtttcatagattttattttgaaaacatgaattttttgcataattacagaaatcaaaatttcatccaaaaggggtgggggagcaatctctaaaatcgaaagaaaactggaactaaatctatctacagtgacttaaccacaaagagaattatttcaaaagacttaaaaaactgtaaaatagccatgagatcctaaagagaaaaaaaaatcttaaattgttttcagtaatcacattgttagtaacaagtaatatgcttttacttaagtcaaacaaaattaaataaaaatggagacaaagtaatctctataaagaaaacaaagcaattaaaacctaattgattggtggccctaatcatacgaagaacagttatttcaaataactttaaaatatagtcaaataaccacatattctaaagatttttttaaaccctgcaaataaatcataaactatttttagtaatcatgctgttagtaatattggcgtccctgtctcactgcaattgctattataaaattattttatatatatataaaatatacataaaatagactaaagaattaatgtcagaaacaaaggtttttagcataaagagacacaaatataaaatcaaacacactacctaaaaccctgtagttttaaatcctaactgaaatcctaactgaaaatatagtcttaaatcctaactgaaaatatcacaatgaattcatgatgtattttctcttaaggaaaaaaaaaagtactaggtatttcctagcttaagtatccacttaagaggcctaaaagccataacccaacaactgcaaaatgcacattgtattcatcaacacatggaacatattccaagacagaccacataagccacaaaacaagtcacagtacatttaagaaaatcaaaattatatcaactactctctcagaccacagtggcataaaattggacatcaactgcaaaaggaacactcaaaaagcatgcaaatacatggaaattaaataacctgctcctgaatgattgttgggtcaacgatgaaatcaaaatggaaatttaagaatttgaactgaatgataatagtgacacaacttatcaaaacctctgggatacagaaaaagtggtgctaagagcaaagtttacagcactgaatgcctgcatgaaaaagtctgaaagagcacaaataagacatacatgtatacacacacacacacacacacacacacacacacaggctcaaaatgtctcctcagaaaatacttattacttactattcaacaacaaaacatacggattaattaactttacagcaaagaagcctggcatactcctcaccgcatgacaaaagtcgtcactgatgggacaagtcaatctcaggcgtctcctcatagaaagcactaaggtaagtccaagtcatttttctggtattcatgctaaaatgcataaatcatgaggaaacaccagacaaactcaattgaggggcattctaaaaactctgtggtcccatactcttcataaatattatggtcataaaaggtaagaaagactgaggaactgtttgttacagattgaagtggaatgaagagaaatgttaagtacatgtaacacatggtcttgattagctcctggagctgtaaaggtttgggatgattagtgaaatctgaaatggagtctgtggattaaatggtaatatggatcaaagttaacttcccgatagaacggtgtccgtgtccttaagaaatatacattgaaatattaaggggtaatgggacatcatgtctacaacttattcccagatggttcagaaatgctatcaatggggaataaaggtgaaggatacatgggaagtctatgtactatttccacaaattgtatataaatctgaaattacttccatagtttaaaaaaaaataaaagggagaaagcaaaacagttctataatatattcccaattactaacagatcaaccatgctgcaaatgaacttaactcctcattaggatataacttctttttaagacccatctacacactgtggagtcaagactggatctttcctccacagacctattacttctcaatactgagttacagtcaccaggtttataacaaaggtgccactacactgcagaggggaatggactatcttttcaataaatggtgctggattaaatgaatgtccatatattttttaaatgaagaaaaatattgaactctacctcacatcatacattaaactcgattcctgacagactgtagatctaaactgtaaagatctaataatactgcttctaaaactaacatgaggttatcttcacaaacttgtaagagacacaggtgtattaaatggcacaccaaaaaagcgctaactataaaggaaaagactaataaattagcttccactaaacaagaattttgtttttgttttgttttgttttttgtttttgagacggagtctcgctctcacccaggctagagtgcagtggtgcaatctcagctcattgcaacctccgcctcccaggttcaagcgattctcctgcttcagcctcctgagtagctgggattacaggtgcacaccatcacgcccagctaatttttgtatttttagtaaagttggggtttcaccatgttggccaggctggtctcaaactcctgacctcaagtgatccacccaccttggcctcccaaagtgctgggattacaggtgtgagctaccgtacctggtctcattgaaaagaatttctattcatcaaaatgtacccttaggagtatagaaagatatttgcaatatacatatctgataaattatatgaatccagaatatgtaagaaccctgtaagccagtaaaaagtagaaaaaattttaaaacagacaatgcagatttttaagtgggaaaaacattccaaccagcactttacaacagagcctagcctaatgccaacaggcatatggaaagatgctcacctgcatttgttattagagaaatgcaaattaaaaacacaatgaattactattatacctctcagcataatagctaaaattttgaaagctggagatatcaaatgttgatgaggatgtggacagctctcataccgctggtgggaaggtaaactgacattctttgacattatgtattaataccaaatacattcataactatgacccaacagttccaatcctagatatattcccaagagaaatgtatgcattttaagaatactgttcacagcagtattatttctaatagctcaaaactggaaacaattcaaatacgtataatagtacaatgaataatatgtaaattatgtatacttatgcaatagaatactacatagcaatgaaatactataccattaaatgcaacatagatgactctcacacacaatattgagaaaaatgagctatcacaagagtctactgtctgattccaacaagaaggcacaactaatctggtagaaatcagaatattggtttcctttagagttgtttaaccaactgaagtgggcatgagggaagcttccatagcactagtaaaacatgtggtgaagtgttcacagcataaaaattcatcaagctctataactgtaatgtgcccttgtctgtatacagtattagactttattttaaaagtttacaccaaataatcgattcattctctcagcttactataacactcaaccatggaaattcttatctccactggggcctttcagacactctcctgtttccttcctctgactcttgctggtttacttcctgctataatcctctaaatatggacttgacccagagctcagcacacaattaactgctcttgctttacattatatgcctttgctttacattatatgccttagacagcttgttctgttccattccaaatgccactctcaacactcctgcagagcgggaggcatacagtactcaatgcacgtgagtctctttctttcttcacccataaactatgacaatggttttttagtgtctcccaccttccctttacatgtcaaactgagcttcctaaaatactcctttaaatgcatcatgcactgctcatgaatattaattcctcccagctacgtataaaacttaatctcgtaaagctggcattcaagtcgtcccaattcactcactaactacatctccagtcttacctcctactagtcatttacctgctctaattaaaaaccatctataaaattttttttttaccaaatccattgtccagattcctacttcaaagcctttcctcatagtattccctctggctaaaatattctttcctctcatctataactgcctacttttcggtcaaggcctgtatcttacttcaactacttcagtccatgtttatcattacctgtaatactgatggctgttattgtctacttggcacttaatctttaccatcaaattacgtgttcatatataagactgtaagacactcactgaaagggacaatgttttatttctcttagatatgtaaaaagcaagtgttaaatatatcatggtggtggtatgctactaatgatcaaccagtattctgaagaggcttttaaaaattaaagaaatggacaatcttttaggaacttcaaaatgaagagaataagttttttttctattgtaataatattttggcttatttaagcttaataaatactgcaatcagttgaacagaagcagagacttgcaatcagaaagccatggattctgcagagtagtccttgaaagagcagagaatgtcaacctagcacagaccacatgagaatgaaacaagtgtctatgtgatttgattatgaatataaccaagtagagaatgattaaatacattttagagttattgttgacaggcacaaaatctttcttaacctccataacaaaaatatctaaggcgaaattaatattgactagaaggtaaccacttgaattaatcagttaacaaatgaatgagtaaatggatatatggctggtactaaagttatagtaattccattaacctaatgttatcaattaatacactatgtccaaaatacaggtttgcctttcccaatagataacgggacatatagattcactgaggtcacccggagaaaatgatggatatcaggcaggactaacttgaggctcccactcaggacaaaacagcatgtggagactcacagtgtaaactctgctccaagaaccaccacaagaacataccaggaaaactgaaagaattcacagaccctttgaaagaagcagcttgccgctgcaaactccatgagacagccaaaacaccgtgagtgcccaaagtgtgagagggggaaagtctgcctccaaacacacatcctcactggggaacctgaaaatccagatcacagaagaatttaaccttacctaggactgaaacaaatttagagagctgagcgaaatataaaagtagaagaagcaggccaggaatggtgggtcatgcctgtaatcccaacactttgggaggccaaggtgagtggatcgcttgagcccagtttgagacaagcctggctaatatggtgaaaccctgtttctactaaaaatacaaaaaaaaaaaaaattagctgggcaaggtggtgcacacctgtaatcccagctacttgggaggctgaggcaggagaattgcttgagcccaggaggcggaggctgcagtaagccaagatcaacgccactgcactccaacctgggtgacagactgagactccacctaaaaaaaaaaacaaaacaaaaacaaaaacaaaaactagaagcagcagcgataagagacccctgtagacactcccagtccctagggaagccattttttttttttttttttttttttttactttcatctcacagtggtccttggggaaggcagtcagtggaactagggaagtaccacagtgagaaagacttctagctgaacgctgtcataattttgactgaatgcaaattttcctgggcagaatctgggtggggggtgggggaggaggtgggaatagggggccggcgggaatagggggccaatggaaagtacagatatgagaacagaagccactgcaggcatggaagggcaaggcctgaaagccctgcttgctttcttagcaggaagacttctagcctagggcaaatgctttttctgcagacactccccaataccagcctggagtccagtagctccactgggtagctagacccagaagaaaaataaccatcgctgcagttcagctctcaggaagccccattcatagggaaacggggagagaaccacatcaagggatcatcccgtgggataaaagaatctgaacagcagattcaagatcttgcctctgacacagtatatccaaatgagaagaaaccagaaaaacaattctggtaatatgacaaaacaaggttctataacaccctcaaaagatcacactagttcaccagcgatggatccaaaccaggaagaaatatctgaattaccagaaaaagaattcagtaggtcggttattaagcagctcaaggaggcactagagaaaggtgaaaggcaacttaaagaaatttttaaaataatacaagacatggatgaaaaaatttccagagaaatagaatcataaataaaaaagagtcacaacttctgaaaatgaaagacacacttagaggcatgcaaaatatactgcaaagtttcaacaatagaatcaaacaagcagaagaaagaacttcagagctcaaagacaaggcctaatcaaattaacccaatctgacacagacaaaggaaaaagaattttaaaaaatgaacaaagcctccaagaagtttgggattatgttaaatgaccaaacctaagaataagtggtgttcctgaggaagaagaaaaatctaaaagtttggaaaacttagagggaataatcaaggaaaacttcctggccttgctggagatctagacatccaaatacaagaaggtcaaggaacacccagggaattcattgcaaaaagatcatcacctaggcacacagtcaatcaggttatctaaagtcaagtcaaaggaaataatcttaagatctgtgaggcaaaagcaccaggtaacctataaagaaaaacctatccgataaatagcagatttctcagcataaaatctacaagccagatggaattgaggtcctatctttagcctccttaaataaaataattatcagtcaagaattttatgtccagtgaaactaagcttcattaatgacggaaagataaaagtctttttcaggcaaacaaatgctgagagaatttgccactatcaagtcagcactaaagaagtaataaaatgaattattaaatcttgaaacaaagcctcagaatacaccaaaacagaacctccttaaagcataaatctcacagggcctataaaacaataacacaatgagaaaaaacagacaaaaggtattggggcaacaactagcacaatggatagaatagtacctcacatcttaatactaatgttgaatgtaaatggcctaaatgctccacttaaaagatacagaatggcagaatggataagaattcaccaaccaagtatctgctgttttcaagggactcacctaacacataaggactcacataaactgaaggtaaaggggtagaaagagatatttcatgcaaacagacaccaaaagccagcaggagtagctattcttacatcagataaaacagactttaaagcaacaacagttaaaaatgacaaagagggacattacataatgataaacggactagtccaacaggaaaatatcacaatcctaaatataaatgcacctaacactggagttcccaatttataaaacaattactactagaccttaataaatgagacagagggcaaaataataatagtgagggacttcaatattccactgacagcactagacaggtcgttaagacagaaagtcaacaaaaaaacaatggacttaaactataccctacaacaaatggatttaacagatatatacagaacattctacccaacaactgcaaaatgcacattgtattcatcaacacatggaacatattccaagacagaccacataagccacaaaacaagtcacagtatatttaagaaaatcaaaattatatcaactactctctcagaccacagtggcataaaattggacatcaactgcaaaaggaacactcaaaaagcatgcaaatacatggaaattaaataacctgctcctgaatgattgttgggtcaacaatgaaatcaaaatggaaatttaagaatttgaactgaatgataatagtgacacaacttatcaaaacctctgggatacagaaaaagtggtgctaagagcaaagtttacagcactgaatgcctgcatgaaaaagtctgaaagagcacaaataagacaatctagggtcacacctcaagaactagagaaacaagaacaaaccaaacccagcagaagaaaagaaataacaaagatgagagcagaactaaatgaaattgaaacaaaagaaatacaaaagataaataaaacaaaaagttggttctttgaaaagataaacaaaattgatagaacattagcaagattaaccaaaaaaagaagacagaagatccaaataagctcaattagaaacaaacaggagatataacaactgataccagagaaatacaaaatatcattcaaggctactatgaacacctttacacacacaaactagaaaacctagaggagctggataaattcctggaaatatacaacccttctaggttaaaccaggaagaaacagaaactctgaactgaccacagcaagactgaaatggtaattttaaaactgacaacaacaataaaaaaagcccaggaccagacggattcacagctgaattctaacagactttcaaaaaaagaactggtattaatcctattggcactattccaaaagacagagaaagagggaatcctccctaaatcattcaatgaagccattatcaccctaataccaaaaacagggaagtacataacaaaaaaagaaagccacagaccaatatccctgatgaacatagatgcaaaaaatcctcaacaaaatataagctaactgaatccaacagcgtatcgaaaaggtaattcaccatgaacaagtgggtttcataccagggatgcagggatagtttaacgtccacaagtcaataaatgtgatacaccacagaaacagaattaaaaacaaaaatcacatgacatctcaacaaagaaaaagcattttacaaaatccagcatccctatatgattaaaaccctcagcaaaatcggcatagaagggacataccttaaggtaataaaagcatctataacaaacccatagccaacgttatactgaacagggaacaagttgaaagcattccccctgagaactggaacaagacaaagatgcccactttcaccacttctattcaacacagtactggaagtcctagccggagcaatcgacaagagaaagaaataaagggcatccaaatcgataaagaggaagtcaaactgttgctgtttgctgatgatatgatcgtatacctagaaaaccctaaagactcaaccaaaaagctcctagatctgataaatgaattcagtaaagtttcaagatacaaaataaacgtacacaagtcagtagctctgctatacaccaacagcgaccaagctgagaatcaaatcaagaactcaaaccctttcacaatagctgcaaaaaaatgaaatacttaggaatgtacctaatgaagaaggtggaaagaactctacgacaaaaactacaaaacactgctgaaagaaatcatagaggatacaaacaaatggaagcacatcccaaactcttggatgggcagaatcaatattgtggaaatagcatactgccaaaagctatctacaaattctatgcaattcgcatcaaaataccatcatcatttttcacactactagaaaaaacaatgctaaaattcatatggaaccaaaaaagagcccacataactaaagcaagactaagcataatgagcaaatctggaggcatcacattacctgacttcatactacattataaggctatagtctccaaaacagcacgatactgctataaaaataggcacatagaccaatggcacagaatagagaacccagaaataaagcccaatacttagagcaaactgattttcatcacagcacacaaaaaatataaagtggggaaaggacatcctattcaacaaatggtgctgggataattggcaagtcacatggagaagaatgaaactggatcctcatctctcacttgatataaaaattaactcaagatggatcaaagacttaaatcaaggcctgaaaccataaaaattctagaagataacattggaaaaactcttctagacattggcttaggcaaaggcttcatgaccaagaacccaaaagcaaatgcaacaaaaacaaagataaacagatgggacttaattaaactaaaaagcttctgcacagttaaataaataatcagcaaagtaaacacacaacccatagagtaggagaaaatcttcacaaactatgtatctgacaaaggactaatatccagaatctacaaggaactcaaatcagcaagaaaaaaataatgccatcaaaaagtcagctaaggacacgaatagataattctcaaaagaaaatatacaaatggccaacaaacatgaaaaaatgttcaacatcatgaattatcagagtaatgcaaatcaaaaccacaatgcaataccaactgatatggtttggctgtgtccccacccaaatctcatcttgaattgtaatccccataatctccatgtgtcaagggagagacaaagtggaggtaatttgaatcatgggggcggtttcccccttgctgttcccatgatagtgactgagttctcacaagatctgatagttttgtaagggtttggcaagttcctccttcagtctttttctctcttgccaccttatgaagaagatgcctgcctcccattcacctttaaccatgactgtaagtttcctgaggcctctcaagccatatagaactgtgagtcaattaaacttcctcctttccttcataaattacccagaatcaggaagttctttatagcagtgtgagaacagactaacacaccaccttactcctgcaagaatggccataatttaaaaataaaaaaataaaggatgttggcgtggatgtggtgaaaagaaacactttttttttcttttttttttttttgagatggagcctcgctctgtcaccaggctggagtgcagtggtgcgatctcagctcactgcaacctccgcctcccgggttcacaccattctcctgcctcagcctcccaagtagctgggactacaggggcccgccactgcccggctaattatttttgtatttttagtagagacagggtttcaccgtgttagccaggatggtctcgatctcctaacctcgtgatctgcccacctcagtctcccaaagtgctgggattacaggcatgagccactgcgcccagccaaaaagaaacacttttacaccactggtgggaatgtcaactagtaaaaccactatggaaaacagtatggagattccttaaagaactaaaagtagaactaccatttgatccagcaatcccactactgggtatctacccagaggaaaataagtcattatatgaaagagacacttgtatacacatgtttatagcagcacaattcacaattgcgaaaacataaaaccagcccaaatgcccaccaatcaacgaacggataaagaaaatgtggtgtacatatataccatagaatactactcagccataaaaaggaatgaaataatggcatttacagctaactggatggagttggagaccattattctaagtaaagtcacacaggaatggaaaaccaaatgtagtatgttctcataaatgggaggtaagctacaaggacacaaaggcattgagaatgatacaatgggccgggcccggtggctcacgcctgtaatcccaacactttgggaggccaaagcagatggatcacgaagtcaggagatggagaccatcctggctaacatggtgaaaccctgtctctactaaaaatacaaaaaaattaggccaggcacagtggctcacacctgtaatcccagcactttgggaggccggggtgggcagatcatgaggtcaggagatcgagaccatcctggctaacacagtgaaaccccgtctctactaaaaatacaaaaaattagtcaggcgtggtggcacatgcctgtagtcccagctacttgggaggctgagggagaagaattgcttgaacccgggaggcagaggttacagtgagccgagattgcaccactgcactccagcctggtgacagagcgagactccccctcaaaaaaaaaaaaaaacaatggattttggggatctgggagaaggttgggaggggaatgaggggtaaagactacacattgggtacagcatacactgcatgggtgatgggtgcaacaaaatctcagaaatcatcacggaagaatttatcaatgtaaccgaataccacctgttccccaaaaactattgaaataaaaaaaaaaagataatgacatataatgttgttcgtattgtatgcaattagaacaactctttaaaattattcttaggagcttaaaattagaacagtaatttacttagcagtattttacatgcaggtggtttgcggaatttgtgatggggtttctttcttttttttttttcttttgagacagagtcttgctctgtcgcccaggctggagtgtagtggcgtgatctcggctcactgaaacctccgcctgccaggttcaagcaattctcctgcctcaacctcctaagtagtggggactacaggcacgcgccaccatgcccagccaatttttgtatttttagtagagacggggtttcaccatgctggccaggctatatataaatatatagttttatatattatataaatttatataaattatatttatataattatgtataattatataatatatacaatatattataaattttttaatttaaatataaacttaaatataaattaatttaaatataaattaatttatatttctattaatttacatttataaaaatttatatttatatttataaatataatttatatttatatttataaatataatttatatttataatttatataatataaatataatttataatttatatttataaaaataatatatttatatttaaattaatttaaatataaatatatatttataatatataaatatataatatataaaataaaatatatataattatataatatataaaatatagttttttatatatataactatatatttaaactatatatttaaaaagagaaattaatcattttttgtaattttttttttgcaggggtagaaacaaggtcttgctatattgcccaggctgctctcaaattcttgggttcaagcaatcctcttacccaggcctcccaaagtgctaggattacaggtgggagccactgcaccaagccactatcatttttgtttgtttgttttttgagacagagtctcgctctgtcgcccaggctggagtgcagtggcacgatcttggctcactgcaacctctgcctcccgggttcacgccattctcctgcctcggcctcctgagtagctgggactacaggcacccgccaccatgtccagctaatttttttgtatttttttagtagagacagggtttcactgtgttagccaggatggtctcaatctcctgacctcgtgatccacctgcctcggcctcccaaagtgctgggatgacaggcgtgagccaccgcgcccggcctactatctttactttaaaaaaaaaaaactcagtcaaattttctgtgctttgtattcaaatatgtttttgccaacattaaaaaagtaaacaatgcacttttatagtatccactaaagcaaattttaaaaacaattacaattactttcttcatcctctcaccttcattttttttttttttttgagatggagtttcgctcttgttgcccaggctggagtgcaatggcgcgatcttggctcactgcaacctccatctcccagattcaagcaattctcccgcctcagcctcctgggtagctgggattataggcacctggctaattttttatatttttagtagagacagggtttcaccatgttggccaggatggtctcgaactaattacctaacatgatccacccgcctcggcctcccaaagtgctgggattacaggcgtgagccaacgcaccaagcctccttcagttatttttatgctaccgtgtgtgtgtgtgtgtgtgtgtgtgtgtgtgtgtgtgtgtgtaggtatgggcatatgtgtactattaatacttgctcactctgttactagcctactataaatgaaacatacaacaagcagaacacacatagcagacaacataacagaaggagtcactgccatacctgggttattgttaacattacttttgggtggcttctgaactggtttgggaagcgtagattcagtcaaagctttattggcaacagcctgctgagccttctttatactgctgccttcggattcccatgtctgctcaccaagactcagctgcactgagaacatcttagaaaaacataaatagacaaagaaaacattaagacttttccaagaaataaaattggctgtctgagagaaaaataaacatcatagaatcagaattttagagctagaggtgaccttacctacagatcatctgcaacaaaatcttactctacctagtgaagaaattttaagagagtaccaaattctgttctatcctatccaaaagcttagtagcagatctaggtgtacattctgggtagaataaatcaagaagcaatctttcctctaaatggaatcacaatgttaatgtcattcaaatggtcctcacaaaagcagaataagtagaaataataagagaaactgtaagagaagccaaaagaccatgtgtctataatactttcataaaatctaattccttgaatgttacatttagcacaatctaggcaatgagtcaggcaattctattaaatattatactaccaaaaaactctgaatctccacaacaaacattgagccaatcactaaattctgtccattttaacatcataaatatttctcaaatcttcttcctctctctgccaactggatccagcctttcatcatctttagcttggacataatattcttccagctgatcactgctaaaactatctttctaaaacacaaatccaacttcatcaccccaatcaacatcaggttaaaacccttcaactgttcctgttttagcatggcacaaaggctctacctgtgcatcctcatctcacacacatccttccactaacatgctctgaattccattctcactgtatttccatatgagcccccaaacctattcttcacctttaaaattcagaatcaagttacatgatatgcgcataattggtttcactccagactgcatattactttctaggaatactaagtattaacttaaaattacttattacaaaaaaatatatattattgtagaaaggagatcagatagaaaataccttcactaagttagcatcaccaataatcatacaaattgacgtcatgtgccccctgatacaatccagtgagaagtatatatcaacaaccatgtacaattcttggccaaaaatgtttaatctgaatctaatcacagggaaacaaccagagagatctagattatgggacattctataaaacaaatggcctaggctccaaaaatgtcaatgtcataaaaggaaaaaaaaaacaaagaatgcagggaggacactaaagagacatgaaggccgtgcacagtggctcacgcctgtaatcccagcactttgggaggctgagatgggcggatcacaaggtcaggagattgagaccatcctggctaacacagtgaatccccatccctactaaaaatacaaaaaatttagccagacgtggtggcgggtgcctgtagtcccagctactcgggaggctgaggcaggagaatggcatgaacccaggaagcggagcttgcagtgagccgagattgcgccactgcactccagcctgggtgacagagcgagactctgtctcaaaaaaaaaaaaaaaaaaggaaaagaaaagagacatgaaaagacatgataaataccatgcatgatccttcattatatctaaaatgggaaggggaaaaaagctgtaaaggacattcagaggacaactggggaaatgtgactatgaactatacattaagtaataggtttagccaggattaaatttcttgtgtgattaacagtattgtgattatgaagaacgtctttagtcttacaagatagatatgtaagtatttaagagtgaagtgtcatggtagctgaaatttactttcaaattgttcaaggaaaaattatatgtcaatatagagggagcaagaaataaagtaatgtggcaaataaattaacgatcggtgaatctaaaccatacatgagtgtctattacaccactctttccattttttctgtagatttttaattaatcaaaatagagaattgggatttgtcatttgaaattcacaacataaacatacctgtttaaagtgattaaattttcttttattctaattcagtttaaaatatatacctaaaatgtatctttaatactctctctggtttcagaatgatttttcaatgactagctctttttcttcaaattttggtatttaacaaagaactttgccacaaagtaagaaagttcaaaggtttcacatgatatatataatatacataatcttgcatatagctcatatgcttgaaaacagaaatacccacataaatgaccttgagattcctgattgcatcaggaaagcatattaaatttactctgcatgtctccagacctgacctctcctaaacaacaatcacataaatctaactgtctacttggtatttccacaaactcaagaggtaaaaggtcaaacaaaacactgcctcctccactctaccccctccaaatcagttcataccccaaaatgtttaatccattatctcccaatagttcaggttcaaacctcattagtttcgtttatccttgccttcctaaggcttatttaacatctcataactcttcgttgtaatttatattgtcacctccttggtctaaggtttctataaactcagactcagtatacttcatttagctcctatctctaatctttcctgcctcctaatcatccagatgtcaccattttcccaatctcatgagccagacacctttgagaggtcttcccttctctcctgcttgcaattaacaactactgactcaacttaaatgtttttcagacctggcctcctctctttatactaagatatatacatgcaccaatgtctttatactaagatatatacatgcaccaatgatatgtggacaatatcagtatctctcccctaaactaccacaacaccacctgtggtatataagaaatatgtatttggtctccggccctggttcctaacacagagctcccaaaaccttgtaatttccggaaggacaggagaactaggagcatttttgttctaatatttggtctttgatcccaatttctaacacagagctcttaaattccttggaatttcctgggtgataggaaatttttattctaatgagccaactcttggcaggcccctggatagagagctagtctgagggccagtcaccagaaaaactaagccatggttagaaacttcatttttagccccatcccattcctatccaccacggaggaaagaggggctggagactgagttaataatcgatcatgcctatgtgacagagcctccataaatatccctaaaagatagggtacaaaaagcttgcaggctggtgaacacactgaggtgctgcagggtggcacacccagacagggcttggaagctccatttcccttctcacacacttcatcctacgtacttcttttttttttttttccccggagatggagtcttgctctgtcgccaaggttggagtgcatggcacaatctcgtctcattgcaacctccgcctcccaagttcaagtgattctcctacctcagccccccaagtagctggcatcacaggcacaagccaccatgccgggctaatttttgtatttttagtagagacggggtttcactatgttggccaggctggtctcgaactcttgacctcgtgatccacccacctcagcctcccaaagtgctgggattacaggcgtgagccaccacgccggccctcctatgtactctttatctggctgttcacctatatactttagaatatcctttataataaactagtaaatataagtatgtgttcccctgagtcttgtgagctgttttaacaaattatggaacctgagaagagggtgctgagagcccccggtttatagccagttggtcacaagtttagaagacccagatttgtgactgtcatgtgaggtgagagcagtgttgtgggactgagcccttaacctgcagggtctgcactaaccgtgggcagttagtgtcagaatttagttaaatagtaggacatccagtcaatgtatggggacaattgcagaattcgctggcgtggaaaaaaaccccacatatttagtgtcagaaatgaagtgttacagccaggtgtggtggcttatgcctggaatcccagcactttgggaggccaaggtgggaggatcacttgagctcagaagttcgagaccagcctgggcaacacagggagacctcagcactaccacaaatgtaaaaaattatccaggcatggtggtgcgcacctatagtcccagctactgaggaagctgaagcagggggatcccttgagcccaggagatgaacgctgcagtgagctatgactgcacaactgcactccagcctaggcaacacagcaagaccctatctcggaaacaaattttttaatttaaaaaaaagtgggctgggtgcggtggctcacgcctgtaatcccagcactttgggaggccgaggcgggcggatcacgaggtcaggagatcgagaccatcttggctaacacggtgaaaccccatctctactaaaaatacaaaaaaaattagccgggcgtggtagcaggtgcctgtagtcccagctactcgggaggctgaggcaggagaatggcgtgaacccgggaggtggagcttgcagtgagccaagacagcgccactgcagtccagcctgggcgaaagagtgagactccgtctcaaaaaaaaaaaaaaaaaagtgttggaagtatagaaaaaaatttctttttactatcttaaagcagttcccttaatatgaccttcccattcaaactaccattcttaccaccatcgacatgaacattctgtaaaaccatcaacatgaacattctgtaaaatataagtatttccaaggcaatcctatgcttttctacaatctctcttaagattcctactacagtaaaaagtgtagtagttttaagacggaatgctggagacacactgtttatgaatttaagccttggcttcgccatttactatgtacaacactgggaagttaattattctttctaactctcagcttcttacctctttagtgaaatgaggctaataagaacacatggttagttgtgaaaattagaacaaaatggtgtaaacacccccacttgaaagtcagagattgtcaaactagataaaaatgcaaaatcaaactacatgctacctacaaaaactgtacttcaaatataaaagcacatatagttttaaagtaatgagaaaaacatatactgacataaatcaaggagaaattagaatggctatattaatatcagactaagtggattccagagtaaagactattaccagtggtaacgaaggtcatttcatatgaataaagaaagcaattaagaagacattgatatcctaaacatttaggcacctaataacacagcttaaataaatgaagcaaaaactgacaaaacttaaactataaaattgacaattaaagtcagattcaatactccttatcaaaaactgatataacaagcaaaaaaaatcaccaagaatatagtacagttgaacaacactatcagccaacacaatcttatcaacactgttagaatactccaaccaagaaaagcagaatatacacttgctctcaattgttcacaggacatttaccaagacagaccatattctgggccataaaataagtctcaataaatacaaagaattcagaccacacacaaagtatgttcattgggtaaagttacagaagagggtagagtaaaattacagaggagggtagagcaagatggtggaacaaaagcctatatatcattcatcacccccagtggaacaccaaattttaacaactatggacacaaaaaagcaccgttacaagaaacaaaaatcaggtgaacaatcacagtgtctggctttaacttcatattgccaaaagaggcattgaggagggtaggagagtcttgaatcaccaacatcaaccctctcccacactcccagcagcagccatgtggcgtggagagaaaatctgtacactttgagggaggagagcacggctattggaaaacagtacattaaactcagtgctgccctgtcacagcagacaatgaaaatgtgctggactcagccagcacctgcacagggagggaggatttggaccagcactagctggaggggaattgcccatcatagcagttggaacttgaatttcttggcaagacttgccaccacaggctgaagtgctccggggtcctagataaatctgaaaggcagtctaggacacgagactgtgcttcctaggcaactcctagtgtgaggctgggcttagagccagtgaactaggatggcacgcaacctagggagacaccagctggaatggctaagggagtgcttatgccatccctcccctaaccccaggaagtgcaacttgtagcaacgaaagtatctacttccttctgcttaaggagaggagagtgaagaaaaaagagaactttgtcttgcattttggatatcagctaagccaccataggataaggcaccaggcagagccgtgaggcccccattccaggccctagctccaagataacatttgtagacacaccctgggccagaaaggaacccactgccttgaaggtaaggactcaatcctggcaggattcattacctgctgaccaaagaaccaatgggtcctgaataatcaccactgatacccaaggagtatgcagtgggccctgggctctgacatgtactggcttcaggggtgacccagcacattcccagctgtggtggctattgtgaaagactcctgtttaagaaaagcagacagaaaagtaaagggaacattgtcttgtgccctaggtaccagctcagccacagcaggaagagcaaaaagcaggctcttggggtccctgagtccacacctacgctggacagcatttccggatctacttcagggagcccactgccctgaagaatgagcccatggaccagtggtggtgttggtggccacacaaggagaggttcctctgcctgtggaaaggggagggaagagtgggagggattttgtattatggattgagtgccagcttagccacaatagaagaaaacatcaggtaaattgctaaggtttttgactccaatccctggctctcagacagcacctctggacacacctggaacccagggaaaaacccgccaccctgaagggaagggccttgggcaaggccagtgctgtgctggcttcaggtctgacccagagcaatcccagggatgatgaccacagaggtgcctgcatcaccacacccccaattccaagtggcttagcactccatttgtttgggagaaagtaaagaaaaagaacaacaatctctgcctggtaatcctgagaattcttccggatcttatccaaggctgccaaggctgtacctctaacaagtctccaaaagccacagcattgttgggcttggggcccaagtcccttcaaattcctgggaaagccttcccaaggacaggcataaacaaactcagactctgaagactacaataaatacctaactgtttaaagcccagacaccaacaagtatctacaaccatcgacaccattcaggaaaacatgacctaaccaaatgaactaatataaagcacaagggatcaatcctggaaaaacagagatacatgacctttcaggcagagaattcaaaatagctgttttgaggaaactcaaagaaattcaagacaacacagaaagggaatttggaattcttatcagataaatttaaccaagagatcaaaattaaaaagaatcaagctgatattccagagtttaaaaatgcaactgacatgatgaggactacatcaaagtctcttaacaacagaaatgattaagaagaattagtgagcttgaagacaggctatttgaaattacacagttagaaaagacaaaagaaaaaaattaaaaagcaatgaggcacaccaaaaacatctagaaaatagcctcaaaggggcaaatgtaagacttactggccttaaagaaaaggtagaaaaagagataacagtagaaagtttattcaaagggataataacagagaatttcccaaacgagaaagataacattcaaatacaagaaggttatagaacaccaagcagatttaacccaatgatgactacctcaaagcatttaagaatctaattccctaaggtcaaatataaagaaaggatcctaaaaacagccagaaaaaaagaaataaataacatacaatagagctccaatacaactggcagcagacttttgttgttttgttttgttttgttttgttttgaaacagagtctcactctgtcacccaggctggaatgcagtgatgcgatcttgcctcactgcaacctccacctcccaggttcaggcaattatcctgcctcagcctcctgagtagctgagattacaggcgtgcaccaccatacccagctaattggcagcagacttttcagtggaaactttaaaggtgaggagagtgtggcaagacatattttaagtgctgaaggaaaaaaactttcacctagaatagtatatctggtgaaaatatcctttaattatgaaggagagataaagtctttcccagacaaacaaaagccgaaggatttcatcaacaccagacttgttctacaagaaatcctgaagggagttcttcaatctgaaagaaaaggatattaatgaaagaagaaatcatctgaaggtacaaaatgcactggtaacggtaagcatacagaaaaatacagaagagtataacactgtacctgtggtgtataaactactcttaactgaagtagaaagactaaataatgaaccaatcaaaaataatagctacaacaacttttcaagaaatagtgtaataagacataaagagaaacaacaaaaagttaaaaagctggcagcggggacaaagttaaagtgtagagttttaattaactttctttttgcaagtttgtttctgcaattgtgttaagctgtcatcagtttaaaataatgcgttataagtattagtatttgcaccggcgcagtggctcacacttgtaatcccagtactttgggaggccaaggcaggtagactgcttgaggtcagaagtttgagaccagccttgccatcacggtgaaaccccatctctactaaaaatacaaaaattagccaggtgtggtggtgcacacatgtaatcccagctacttgggaggctgaggcatgagaatcgcttgaacctgggaggcagagattgcagtgagccaagatcacgccactgtactccagcctgagagacagagcaatactctgtctcaaaaaaaagaaaattaatttaaaaaagatagtatttgcaagcctcatagtaacctcaaatcaaaaaacatacaacagatacacaaaaaaataaaatgcaagaaattaaagcataccaccacagaaaatcactttcactaaaaggaagacaggaagaaaggaaagaaggaagaaaagactgaaaaccaccagaaaacaaataacaaaatggcaggagaaagttcctatttagcaataataacactgaatgtaaatgaactaaattccccagtcaaaagacatagagtggctgaatggagaaacaaacaagatccaatgatctaaacacaccccacctatgaagacacacacagacagaaaagagagggatggagaaacatattccatggcaacggaaaccaaaaaagagcagacacagctatactcatatcagaaaaagtagtatagatttcaagacaaaaactgtaaggagagacaaaaaaggtcattatataatgataaaggggtcaattcagcaagaggatataataattgtaaatatatatgcaaccaacactggagcactcagatacataaagcaaatattattagacctaaagagaaagacagaccccaatacaataacagctggagacttcaacaccccgctttcagcattgcacagatctcccagaaagaaaatcaacaaagaaacatcagagttattctgcactatagacaaaatggatctagtagatatttacacatttcatccaatggctgcagaatacacatttttctcctcgacacatggatcattctcaaggataaaccatgttaggtcacaaaacgagtcttaaaacattaaaaaaaaaaaaagagagagagagagaaaaagaaaaaagaaagaaaacctaaaataatatcaagcatcttcactgaccacaatggaataaaactacaaatcaataacaagaggaattttggaaactacacaaacacatgagaattaaacaatatgctcctgaatgaccatttcaatgaagaaattaagaagggaattgaaaaattccttgaaacgaatggtaaaccaaagcctatgggatacagcaaaagcagtactcagagggaggcttatagctacacacacctacatcaaaaaagtggaaaaatttcaaacaaacaatctaacaatgcaccttaaagaactagaaaaataagagcaaactaaactcaaaattagtagaagaaaagaaataataaagatcagagcagaaataaatgaatttgaaatgaaaaaattatacgagatcactagaacaaaaagttggtgtttgagaagataaacaaaattgacaaacgatttagccagactaagaaaaaaagaaagaaggcccaagtaaataaaaccagagatgaaaaaggagacattacaatggatacaacagaaattcaaaggatcgttagtgactaccgtgagcaactatatgccaaaaaattgaaaaatcttgaagaaacagacaaattcctagacacatacaccctacaaagattgaacccggaagaaatccaaaacctgagcagaccaataacaagtgaggagatcaaagcagtaatgaaaagcttcccagtaaagaaaaggccaggacccaacagctttactgctgaattctaccaaatatttaaagtggaactaataccaatcctactcaaactattctgaaaaatagaggaggacggaatgcttccaaactcattctgtgaggccagtattaccctgataccaaaaaccaaacacacatcaaaaaaaaaaaaaaaaaaacctacagaccaatacctctgatgaatattgatgcaaaaaccctcaacaaaatactagcaaacctaatccaacaatacatttaaaagatcattcatcatgaccaagtgggatttatcacagtgatgcaaggatggctcaacacacacaaaccaatcaatgtgatacatcacatcaacaaaatgaaggacaaaaaccatacatttcaattggtgccaaaaaagcatctgataaagttcaacatcactttgtgataaaaaccctcaaataactgggcataaaaggaacatgcctgaacataataaaagccatatatgacagatccacaactagtatcataatgaatggggaaaaactgaaagcctttcctcttaggtctgtaacacaacaaagatgcccactttcaccactgttattcaacataatactgaaagtactagctagagcaatcaggcaagagaaagaaagaaagggcatccaaattggaaaagaagaagtcaaattatcattgtttgcagatgatatgatcttatatttaaaaaaacctaaagactccaacaaaaaactattagaacagataaacaaatttagtaaagttgcaggatacaaaataaatatactaaatcagtagcatttctatatgccaacagtaaacaatctgaaaaagaaatcaaaaaagtaatcccatttataatagccttaaataaaatttaatacctaggaattaactcaaccaaggaagtgaacgatctctacaatgaaaactataaaacactgatgaaagaaactgaagaggacatgaaaaaataaattggaagaatcaaagcaacctacagactcaacgcattccctatcaaaatatcaatgacattcttcagagaaataggaaaaacaattctaaaatttatatggaatcacaaaagaaccagaatagccaaagctatcctgagcaaaaagaacataactggagggaccacattatctgacttcaaattatactacagagctatagaaaccaaaacaacagggtactacataaaaataaacacacagaccaatggaacagaagagagaatccagaaacaaatccacacacctacgatgaactcatttttgacaatagtgtcaagaacatacactggggaaaagacagtctcttcaataaatggtactgggaaagctagatatccatatgcagaaaaatgaaactagacccctatctcttgccatacacaaaaaaaatcaaatcaaaatggattaaaggcttaaatctaagacctcaaactatgaaactattacaagacgacattaaggaaaattttcaggatgctggagtgggcaaacatttcttgagtaataccccacaggcagaggcaaccaaagcaacaatggacaaatgggatcacatcaagttaaaaaccttctgcacagcaaaggaaacagtcaacaaagtgaagaaacaacccacagaatgggagagaaatatgtgcaaactatccatctgacaaggtattaataatcaaaatatataagaagctcaaataactctataggaaaaaaatctaataatccaatttaaacaacaaacaggtatatgaaaaggtgctcaacatcactgatcatcagagaaatgcaaatcaaaactacactgagatatcatcttgctcaagttaaaatggcttttatccaaaagtcaggcaataataaatgctggcaaggttgtggagaaaagggtaccctcatacgttgttagcaagaatgtaaattagtacaaccactatggagaacagtttggaggttcctcaaaaaactaaaaatagaactaccatgcaatccagcaatcccgctgctgggtatattcccaaaagaaaagaaatcagtatgttgaaaagatatctacactcccatgttttttaggagtgcttacaatagctaagatttcgaatcaacctaagtgtccatcaatagatgaatggataaagagtggtatttatacacaatggagtactattcagccataaaaaagaatgagatcctgtcatttgcaataacatggatagaactggacgtcactatgttaagtgaaataagccaggtacagagagacaaacatcacatgttgtcacttatttgtgaggtctaaaaatcaaaacaattgaattcacagagatagagaatagaaggatggttactagagattgggaaaggtagcaggaaggttgaggggatgggaagatggttaatgggtaccaaaaaaaaattagttagaaagaatggataagacctagtatttgacagcacatagggggactacagtcaataataatttaattttacactttaaaataactaaaagagtataagtagattgttcgtaacacaaaggataaatgcttgaggctttggatacccaatttccattatgtgattattatgcattgcgtgtctaatctatgtgaaaaaaagattagtagctgcctggggtctcaggtacaaagagagatgattacaacaaggaatgagaaaattttgtgggacaatggaaatgtttgttctttttcttcacatagatattttggtacatgcaacataccaaatacgttgtatgcattgggtataccaaaatatctcatgtacttcataaatatatatacctcataaatatatatacctactatgtacccacaaaaattaaaaataattttttaattaaaaaagagacaaagaatattattattgataaaagggttaattcatcaagaagataaaacaattataaacatatgcaccaaacaacagaataaagaacttctcaaaactgaacaataaaacaaacccaataaaaaataatgggcaaagatctgaacagacacttcactaaaggtatacactgatgacaaacacacaaaaagatagccagcattatcagtcactacggaagtgcaaactgaaaccacaatgagattccaccacatacctattagaatggctaaaattagaaaggctgactatataacctgtaggcaagggggcagaaaaactagaactctcatacaccgctgaggggaatgtaaaatggtacaactatattttgcaaaaaaatttggcaatgtcttaaaaagttaaacatgcacctgctatacattcctgacactcttattaccaaagaaatagagaaaataaaatagagaaagagaaaaggtaatatatgtctgatatggtttggatccgtgtccccacccaaatttcatgttggattgtaatccccaatgttggaggtggggtctggggactggatcatgggggtggatttctcatgaatggtttagcgccatcccttggtactgtcctcacaatagtgagttatcatgagatctggtcatataaaagtgtgtgggacccccccaatccccacattgctcctgcttttaccatatgacatgccttttacttccaccatgattggaagcatcctgaggcccccccaaaagcagatgctgctatgcttcctgtagagcctgcagaaccatgagctaactaaacctcttttcttataaattagccagtctcaactatttatagcaatacaagaatggactaatacaatgtctatatgaagacttgtatatagatgttcaaattagctttattataatagcaaaaagctaaaaacaaccaaaatatccatcaacagatgaatgtccaaaaaacaaagtgtgctatatacacataatggactactcctcaataataaaaaggaagaaatactgacacacacaaaacatgagcaaactcaaaataactatgctaagtgaaaatagtctggtaggagtacataccactatatgattacatttatatagttttagaaactgcaaactcatctatagtcacagaaagcagattagtagctgtgtggggtcccaggtacaaagagagatgattacgacaaggaacgaaaaaatgttgtaggacactggaaatgtttgttctttttttcccacacagatataaagcagaaacaatacttttggcatgggttaaattatgaaagaagtcagtttgcattgcttcaaaaaatgttctcccatctttttagtattttctctctcatgactctttactacatttcccttccactatcctcactctcttatcctatacttccactgcaaatgtacatagaaagaaaatgatgatttcatcatgcctgaaaattatgtattcaagaggcacatcctacagctcaaaatctctgctctagcccaatactcatcaactgatgaaatcccctcatataacaatcactacatacaatcagccaaattcaagatgtagaacattttataggacaaattactctatttctccaacaaatcaatgtcataggaaaagaggggatggggataaaaggagtgttagtattaataaataaaagagaccaaagagacatagccaccaaatgtaatacatgatccttgtttggaccctatttgaacaaaccaaatgtaaaaagacatctctaagtctaattaaaaaaaagatggatacagaccatgtattacataatatttgggcttcttaatctagtcataatgacggtgtagtgcgctatttttttaaaggtccttatcagttacagatgcataccaaagcacttatgaatgaacagacatagttcttttaaaaactttagttcaaaaaagtgggtaggggatggtaaataaatttatcttggcaaaatattcaacgttggtatctatttcaaatttttcataataaattaaaagtaagatttttgtttgttttttgagatggagtctccctctgtcgccaggctggagtgcagtggcgcgatctcagctcacggcaacctccgcctcccaggttcaagcaattctcctgcctcagcctcccgagcagctgggactaaaggctcgtgccaccacgcctggctaatttttgtagttttagtagagacagggtttcgccattttgaccaggatgatctcaatctcctgatctcataatctgcccaccttggcctcccaaagtgctgggattacaggcaaaagtaagatcttaagatgttgtgggtttcataatgaatgttatgagacaaaactcctaacagcatgatatgcaccttatttattttcagtgcaggaacagtgcctgccacatagtaaatactcaacagaccttttactaaggggttgttttagtcctatatatgactaataagcaatgatataattatttgggtacctccatcatcaacacaatgcttaagaacttataaatcgtcactccattataccactttatgaggtattatattactccatttacagataagaaaactgagactttaaattagttgttcaaggtcacataagctcggcaatgaagggcaaagatcaagctgggcaactctagcgaagatttttttttaaagactacttggcttaagggccagtggatgacattgcctccctcagtgatacccattccaaagtaaaccatctcaaagtatcagcactagtacaatttacttgaaacttagccaggcttaccaacaaattatcagaataggaaaataatggaaaagaagaaaataccattttatgttattcatggctctcttcctcatattctaattaaaacagccttctttcgagatttgagcaaaccaaaacaataatctgtagaaaaaataactgtatacaggtacctaggaaataaactaatattacaataactcccattattataaggtatactaacttgtttcagagttcaattaaaaactgagcagaaaaataaaagaagacaaggcaaagactaaaataattattattttaatagtcacatattacaagttgttcagaatttgtgatactcatgggggaaggaggaaatcatgtaaacgtaagataggtcactacctgtcagcatgatataagagaagacaattccataccatactgaagacattaacctctgtcctgtgtttccaaactctggctgtacttttgagtcatttcagagctttaaaaaattcctgatgtgtgtgcttcacccaagaccgattaaattaacgggatgagactcaggcataagtattttttaaagctcctgaaatgattccaattaacagccaaagttgagaaccacttctcacctatgtcagcatatgtgtagtatgtgtgtgaattgccatataattaatgtaccaagaaaaaaaattttttttttgagaccgagtctcactctgtagcccaaactggagtgcagtggtgcaatcttggctcactgcaacctctacctcccaggttcaagcaattctcctgcctcagcctcccgagtaggtgggattatagtcacgcaccaccacaccccggctaatttttgtatttttagtagagaagggtttcaccatgttggccaggctgttctcaaactcctgacctcaagtgatcctcccgcctcggcctcctgaagttctgggattacaggcatgagtcaccatgcccagccccaagaaaattaatgagttgaaactaggtttaaatttttcttaccagagattatcattaatttcattaaaatacattttatgtctcacctaaaggccactgatagacatacatgaatgaaaatgattttgcttttcacaaaaaggatccagacttagccaattaggattaatattaactatattattatgtgaacttatcaatatcatgtttcactcaacaacatgccaattattctagtactctttttaaaaataagcaagctacaggctaaggggggtggtgtatcaccaaagcacctacagcaactggcacaggttggcaaaagggatctccaaatctccttaaaaccaagggaatcctgggactattgagaaataagaagagacccactgtcatctactttcatcacaaccaacctgtttagcctttaaaaccccagcagtgagacaaggagatagataaaaggtcagttcataaacccttccaaaaattacaatggattcctaaagaatcttaatgaaaaccaaatcctcctaagagtcctccagaaacttcccaggtaggctgaccttcctttaccatatatagaggatagggatgatgtcactaactgttaaaggcagtctagctcttcactcttgggagaagaaggcagaagaagcaaaactggagaaatggccttgaagaggtgaaacaggttgggatccaggacacaatggaggagctgggcaagtcagctgagggtacctacataaaaggcacacaacatttaagcaggttaaagagctatgtgaggattggggaaagaaaggaatagtaaaatggtggcagaatcaatggatctgcagtatgaaaggactgtggaagtcaaattactagacggaatgaactagaaagttaagaggcaagtgtcacagaaagatgaaagactgaaattaacattatgcagttattggtaatgataaggtcaagaatgtgattataggcatgagtggctgaaggacagtagagaacaagatcaccggagatgttaaagaaactaaaaggtcaacatgctggaacaatcatctatttaagtgttgaaatcaccaaaaattaaaatggggaatgctaaagagagtgaaagtgagccataagaaatgtgatggaatcacccagatgtaaatgacaatcatgagggaatgtgggaagtgtgtctgctaatatgaaactcaaaactgggggactgtctcaaggaagaatacctggaattggcaatgaggagcaaagagtatatactacagggaccaagaaatgtaaacgagtaaaatacacacccaaaaacaagctcagtctagcacaaaactaatgaccaacatatattactgtactataacacagtaacggctaccacagagaactataggtcccactggaggcccagtagaggaatcagaggtttcacaaacgtgtggaagatgtaacatggagctgagtgctcaacaatgagtaagggcaaaagcaccttcaaggcagaaagacactacaacttaggcaaaggcagagagatgtgaaaagaacataaagcgttctgagaaatgcaaacagttcaacatgattaagggcagaatgagtcagaaagagagtcaggacatatagctggaaaggtagaccaaggctacaactattttttctgttaaagcaagaacaaaagatatgaacaaattaaattgttgcccctaaatccttcataaaaaccattaatagaaaacaaaattgacaaattgtagtttcctcttattttccttagtttgtaggagatgccaggatgcaaataacctaatagccagttgctttaagaagattaatcaacccttagagaacaaatgctgccacattatatacaaattttatgatcattatgataatctccaatagccaagatataaatgtgccatagaaaattatgcacaactaagatattgtaagcaactgaatagagctcaaacataaatgcattagttgtagatttgtaacatgtatatatgcaaacataaatgtatacagctatatataaataaaaattgctttccatttaaaaaaacaatataagtgaatgcagagataataagaacagtggtatatacaacttttataaatgattaatgttagaattaaatatcacattggaaaagatgtctcactaggtaactgttggtatatttactctgtctccatttctactttagcagctgtgatttaatggaaagcacaccatatttgggagccaaagaaaatatattcaagtactggcactggcacttatgaactattaagcaagtcacttaactttcctgtgcctgagtttaaattacaaaatggaaatcaaaaatccatatatcatgtggttttattaagatttatatgaagtactatatctaaaagagctttgtaaaccacagtgagctacaaaatagtttagttacatactttgaaatattattaatgtagaactaaaagccttcaagccatctgctgaacccccactccccaaaataaagcacgattaaaatctgagatgataaatctgttagtctgataagtatgtctcaccacctctcttcataaccttacctttgaatgagcaggccctctttcattcagaagtttatactggggttggactctattgaaacgggctaactcatttaccagacacattgcagttttctcttttgggtttgccattttatcttggagagaagctgtaaataaaaaggctataaagtttttgtgaagaatgactttacaaaatggaagaaaaactagttttgactttgaaggtagattgtatatttaaattattttcatgaattttgtattttaaaaattcaaattacctaatgtcttccattacatgcaacagaaatatgtatcacattttaaacaataaattaaggtaaaatttttcctaagtacctaagttgttctatgtatataacagcatgcttaaagattttaaagtaaaattataataattttttatcttaaaaactttcctttcccctcaaaaaatttactagaaacacatacgtttcctggttcttattactatgaaactaaattttgtctaccttcttgatcgtttcatctcaatttttttccttctcattatgaggcagtgtgttagaaaaagctctagtcttgggaatcaggtcctaagtttaagtactagctcttccaactacaatttttcggtaactctaaacaaattaactcccctttctgtttttttaaataaattttcaaagttgtaaaaagaataatttaacaagtgcccatgtacctaacacccagtgcttattaaccatgttccatgtttaactcttattaaaaaaaaaataagtggtattccattcctgttaagttccttattatcttttacagagtattgatgtatgtggttctagactcacataaatggtattatagcattataataaacattctcacagtttactttcttcactcttcattgtgttctcaagacttttacttatataaatctagcacattaattttaactaccatagaatttcttttacaatattgcaccagtttttttatccactcctctactgagacactgggttgtttccaattcttcactcttaaagagagcatgctgtcaaatagctctcaaaatgactgtaccaaattaccttcccctaccgtttctcctcaagctcaaaaacatggaatataatcaaatattttaatttctgataatttgatatttgacaaacagtatcccattattgttctttgcatatttttctccactactattttatgtttgtttgggttttttcttgttcagagacagtctcactatgttgcccaggctggactctaaccctgggttcaagctattttccctactcagcctcccaagtagctgaattacaggcttctatccttttttttttttttttgtattatagttaccaacttttccttttatggtctgtgctttttacgtcttgtttaggaagtcctctctaactgtcaagatctcaatgattttacttaaactcactaagccttctattctttctataaaatgagagaaataaatctatcccgcttaagtcccaaagttgttgtgagattaagagttgtaaatgtatgatatggttttctaaactatatcgcaaatacaaggtactattatagcttcagaatatttttctaataccacattattttaacctatatttttcctttctctcatttatagacacatttaattacttttttctttcacttcccataaaaaatgccaaaatatattttaaaatctaagcataaaacatgcaagtggattacttcctgctcatttaaactatagtcacaataaatacagttcaattgtagccacaagaatacttaaaatgaatgaaaatggctggctttaggaacttcatctacaaacttcctaggccaaagtttaatattaaaaataatattcttttacatttctaatactcttaacaggcccaataatttgtacaatggcttgattgtgataattatgattaagaaactattttataagaaaactacgtaagcacctggtaagacctaagtaaaaagaaggaatctaagcaaccaattgtagggccaagacagctgacagtagattctacaattaagccattgtaagtggcttgcaaaaaaaaaaaaaaaaaaaaaaaaaactagtaattattacttttgggaaaagtacaaaaaagacaaaagtcaagacagttttgagaaaacctgcattttacctattccattgcatgtcacacaaattttataaaacatcctgttcaatttggaaagtcagtcgttataagaaaatacaaggtaacctgagacgataatcagttttggcctttgcataccattgcatgaattcaagtgcaacagacagcacagccaatttaatatcaaaaagcaaaagcagaataattggttaaaatgagaaaatattaaagtctgataaaaatcagccaattttgcataacacaaatagcatttataccaccactgtgtaattttcataattcagtaatgctgcatattcatctgttacaatgcaaaacatattagaagcatacaaacatagtgtgaaaattttatactatgaaaattgctaatagcataggttctacacatattaaacagcgatttaaatggttcatttataatgaacccgtttggtatgaaaacctaatctaaatcctctaaaggaaaatgttaacaaataacatggtataaaacttatattccattaattctgacttcctgcttcataaaagttaacatgaatccaataacacattttaatgggtgactgaagttttagtgtgagaagggtccaagatcccactttgataaagcttcaaaattaaaatcaaaatgtttaaagttgataacttaggaaataattagtcatagttgttttattttaaaaagggattaaaacaaatagttgttcctttatttaatgagaaatcttaataggattcttacttgacagagagctcagtaatacagcaataacttttaaattacaccaaaatttagatagagcatctataaaaacaaactggtctataaaatctgagacacataaaaaagttatataaatcttttttagagaagtcaatagtgcaaaaaagtgagaaatgcacataatgttacacaggtatgcattttcaaagacctatagatgttatcactgaagatagtttgaaatagtcttcaagtccatttggtggctggaatagtagagacctacttagaagtaaataaaattaataaaaatggattcacaatctcagactctgccactttgaaagaacaactgccacatgatggttaagagcctgttttggatatctctgtcacttactaatatctgtgtgaccttgagaaagtacttaaatctcactttcccacaaagtaaaatagagataatagttgttcttatctcactagataattgcatggattgaatgagataataccaaacactgttaacaatgattaaaaattcattattattctgatttaaacatttgttaaaacaattacactatcatcaaatattaaaacagtgacataaaaagtcatgaaaaaagtttataaaactaagtaaaaatattcttagccaaaatattctgttacgataaattgattttactcatacaaatatacttcttggctgggcatagtggctcacatctgtaatcccagtacattgggaggcagaggcgggaggatcgcttaaggccaggggtttgagaacagcctggacaacatagcgagacctcatctctacaaaaaaataaaaatattagccatatgtcatggcacatgcctgtactccttgacactcagaaggctgagatagaaggattgcttgagcccaggagttccagactgcaatccagcctgggtgacagagtgagatcctctctcaaaacaaaacaaaacaaaaaacaagtatatttctgtagtagtctgtgaaaagcatgtatttgttattattttttccactgacttataaacccataagttcgtttccactgaaaaattctcaaatatgatataaattatattaaaggtttacatgtgctaggaaatattctaccttcactgatacgaaacttggttagatataacttacaactttgataagaaacactggtaaaatacatatttataataacagtatttgcatatccaacaaaaacataaatatactctatttttagattcactctatttttatgtcttcacaaaatgtcctggactctggaatttgaatcttcattttgcctgttcatttgtatgtgtaggaaccagtgaagaaacacagcaactgtgttcaagtcactgaacaagctacaaaataatgtagctcacaggcaaaatgatctgtccccaaaggagttcacagtctgatagaagaaacagacacagacaatagacaaacacaataaatcacaatataagtactataataaggctgttacaaaaactccttagacaaagggtgtatggaaaggcaagttttaagaggtggtgattagataaggaaagcaaaaattcacttaggtaacaagggaacgtgagagacagtccaagcttttcaaggagtatagacacaggagaaagcacataaaacaacataactttctggcaaatgcaagcagaaaactggcagaatacagaacgcatgagaaaaaacagcagaataaaactatgtgaccagaattcactagaacaccaaaagtttcctaaaccagaacttaaagtagcattttttaaagtagctatattccagccagaactgttgctactaaggtcacagactacctcgcttcgcaaggcaaatcattccaaagaatcctttccatccttggtcccagaaatgacttaaacacggtttctttccttttttttttgagacagagtttcactcttgttgcccaggctgtagtgcaagggcgcgatctcggctcactgcaacctccacctcctggattcaggtgattctcctgcctcagcctcccgagtagctggaattacaggcatgcaccaccacgcccagctaattttgtttttttagtagagacggggtttctccatattggtcacgctggtctcgaactcccgacctcaggtgatccgcccacctcagcctcccgaagtggtgggattacaggcgtgagccaccacgcccggccttaaacacagtttctatgtctctttactggttcccctttctctattctctgctattggagggaactcatcctaattcccaagtaaaataagaaagaaaaaagtcaaaagagcaaaggaccctttcatgggctcttgccttctaggagcaatctgacagatatgtccccagctattaactaaaacaaaccctctattttcaaattagaccctaacataaggctgtccaagcaaaattatcgacaaactacccaggcatcaaactgctccatttttaacagtctgtccattaggaaaaaatttaagttcctctctcacataaacacaaagataaatttcagaaatattaaaatgcaaaatacaaaaatttcacaaaaactaacggaaattagctaaatatctgtcatactcctgtaacacagaaggccttcctagatatgaaaaggaacctagaagccataaaggcaaaaactgatagttaacaacataaaaataataaaacttctctaaagcaaaacataccacatatgacactaaagtctaagccattttgagttactttttgtatacagaagaaatacttgcaatatgtgaagaaaggccaggcgtggtggctcacgtctggaatcccagcactttgggaggtcaaggcgggcagatcacctgaggtcaggagttccagaccagcctggccaacatggtgaaaccccgtctctacaaaaatatacaaattagccaggcatgatggcgggtgcctgtaatcccagctactcaggaggctgaggcgagagaatcacttgaacccgggaggtggtggttgcaagtggaaccaagatcgcaccactgcactccaccctaagcaacagagcgagactccgtctcaaaaaaaaaaaaaaaagtgaagacaaactgttaacattcataaaataaaaagatactataaatcaatttttttaaagccaataggaaaaaagggcaaagttacacacaattcacataatttcttgagtaaatatacctgttcaaaagaatgttaaagagcctggccaacatggtgaaagcctggccaacatggtgaaaccctgtctctattaaaaatacaaaaatcagccaggcatggtggcacatgcctgtagtccgagctattcgggaggctgaggcaccagaatcgcttgaacctgggaggtggaagttgcagtgaaccgagatggcaccactacactctagcctgggcaacagagtgagactgtcaaaaaaaaaaaaaaagaaagaaagaaagaaaaattcaaattccagtgatatataattttcccctattagactgataaagattttttttaataatcatttaagtattaacaagtatgtggggaaaatgggtgagaattctgttggtgcaaatacaaattagtacaaaatttctgatgggcaacattgattaaagtttcaattgtacctatctttaaaacagcaattattaatctgaggattcatactacaggaagacatttgcaatgataatctggaaaacaagactataatagcaaaaactataaatgagataaatattattatttaccaaaaattggttaaactacatgaatcatgcagctttgaaaagagaaagaggtacagagcttatgaatcaacatgggaaaactttgcaaactggtgaatgacaaaagttacagcagcttactgtgtgatcgtatatttatcttcttttttttttgagacggagtctcactctgtcacccaggctacagtgcagtggcgcaatctcggctcactgcaagctccgcctcccaagctcaagcgattcttctgcctcagcctcctgagtagctgggattacaggcatgcgccaccatgcccagctaatttttttttcttttttttttttttgagacaagagtctcgctctgtcacccaggctggagtgcagtggtgtgatcttggctcactgcaagctccgcctcccgggttcacgccattctcctgcctcagcctcccaagtagctgggactacaggcgcccgccaccacgcccagctaattttttgtatttttagtagagacggggtttctccatgttggacaggccagtctcgaactcctgaccccaggtgatccacccgcctcggcctcccaaagtgctgggattacaggcgtgagccactgcgcccggccagagtaagttctttctagtcttgacagtgccaccatggtcctgaaaaacagaaaaataatgctcaaggatctgatttaaagcaggccatgttgtgcctccatctccaacttttccagtgaagctatctagagatttaaacaggacaaaaacacagtgtgtccttaccagtatttagtttggtcagtcttcttaacttcagtcattctaaatatgtgtataatgatacctcgtgattttaatttgcatctccctaatgaatactgttaattaacttttttcatttgcttatatgtcatctgtatctcctgtggtgaagtgtctgaatattttacttttgatttttttttcttattgctgaatttgaagagttctttacacatcctacatacaagttactgattagacatatgcttggtaaagattttcttctaggccaggcgcggtggctcacgcctgtaatcccagtactttgggaggccaaggcaggtggatcgttttaggtcaggagttcaaaaccagtctgggcaacatggtaccccgcctctattaaaaatacaaaaagtagctgggcacggtagtgtgcgcctgtgatcccacctactcaggaggctgaggcacaagaatcacttgagcccaagaggtgaggggctgcagtgagccaagaaggtaccactgcactccagcctggggaacagagcaagactctgtctccaaaaaaaataaataaagtagtaggaaaaagatgaattgctaacaaagttggagcaaatggacagtcatcttagaaaataataaagaggaatcactacgaaaaaaataaaaatttttttcccaaactgtggcttttctctttattctcttaccagtgtcttttaaagagcagattttaatagtctaatttatcaatttttatagtttgtacttttaatgtatatctaaaaaattattacctaactgaggtctaaaaatttttttctcctgttttcttccacgaacattatagttttaggttttacatttaagtccagaagccattttgagttagttttcctatacagcgcaaggtatgaatccattttttgtatatcaatatccaattgtttccaactgtggaaaaggctacatttctcccactacattgcctttatgtctttgtcaaaattattagttatctacatataaggagtttatttctggactaccaattctgtttccactgatctatttgtcttttgttgttgttgttgttgttgttgttgttgttgttgttgttttgagacggagtctcgctctgtcgcccaggctggagtgcagtggcgcgatctcagctcactgcaacctccacctcctgggttcaagcgattctgccgcctatttacctatttttacgccaaactattttacagcttttaattcttgaaatcaggtagtgttggctcccacactgttctttttcacagttgtttaaagttctttaaatttccacatgaattttagaatcaccctgtgcagttctataaaaaagcctgcaaagattgaaatataagtctcttaaatctataatttggtgaaaatcaacattttaacaaagttgagtattccaacccatgaaaaggatacacagtcacttctcattattgagataataatatgtcaatgactgttatgtgaatcagcaattatagagccattgctcccaggggaactaacgtattaggttcttgcaagcttctgctgacatttttgtgaactgatcatatgtcatgttttatgtgtttctgtttagagacttcttgtttagtatgtattactaatatatgttactgattcattaacattgaactcatgtccaatagtactgtttaactcctgcctgaataaagcttatctaatgcacatatattctccgtaaggcatatcagagcctcctggtacttagaaacactatatggcacttaaacattacactttaaacattttaaacatcaaaataaccatctttgtaaacatcaaaataaccaacaaaaagcacaaacatgcaaaaaatgcagcactaaataaaccaagaaagggctacttgcttacagtatgaaacccaaaataagaaagcagagcattgtcttgtttgatcccagctgggtatatacatgtgcactgggtgattcaaaatgttttgcccctgcaagtgtctgagaatgaccacaaaagcactgcaagtattggttttggggttacaaataaaaattagtgagtaagccaattcctaggtaaagaatccatgaataatgagaatcaactgtatcttattcaggtatcctttaatttcttgcagcagtattttgtagttctcattttctttaacatattttgttagacttatctctaagtagttcatatttttgatgcttttgaaaatgctactcttttattttcatttatgattgttctctgctaatgtatagaaacacaattggtttttgcatactgctcttctatcctgcaactctgctatagtaatttattagttctagtaggattccatcagattttctacatagacaatcaggtcatctgtgaataaggacagttttattcatttctttccaatctgaacaccatgcatttccttctcttgcatgatggcatgggctagaacctccacggcaacgtcaaacggaactggttaaagtggacatcccgtcttctttttttaaaataagtgtccagttttggccaggtgtggtggctcacgcctgtaatcccagcactttgggaggccgaggcaggtggatcacaaggtcaggagatcgagaccatcttggccaacctggtgaaaccccgtctctactaaaaaatacaaaaaaattagccagacatagtggcgggtgtctgtagtcccagctactacagaggctgaggcaggagaatggcacgaactcacaagggggagctttcagtgagccgagatcgtgccacttcagcctgggcaacagagcgagactgtctcaaaaaaaaaggtgtccagtttttcaccaataagtacaaggtcagctaataaggtttttcatagaagcacattagcaggctgggaaagttcacttccacttctagtttgctgagagtctttatgatactgaatattagattttatcaaatgatttttctgcatctattgagatgatcatgtgatttttgctttttagttcattaatatgttaaattacactactgattttttggaacactaaaccaaccccacattcctgggataaaccccacatggttatgacatattatccttttaataaactgttgaattagatttgctgaaactttgtttagatttttgcaattatatttatgagacatactggtctgtaatttccttaaaatgtatttgtctgattctggtatcccagtaatgctggcatcatgagccttgtaaaaaattccttccacttcaatatttttaaaagcatataaaattgatattattttttccttaacttgtataattcaccagtgaaactatccggacctagagttttctttttaagtagacttttactacaatttttatttctttagcatataaaaagctactcagggctaggcatgatagctcatgtctgtaaccctaccacttcaggccaaagcaagaggatcacttgagcccaggagttggagaccagtcagtacaacatggtgaaaccttatctctacaaacattaaaaataaaaaaattagccaggcatggtagcatgtgcctgaagtcccagctaggaggctgaagtgggaagatcacttgaggtcaaggccacagtgagctatcatcggaccactgctctccagcctgggcgacagagtgagaccctgtctcaaaaaaaaagctattcaggttatccattttcttcttcttcctttgggattaatttgttcttctttttctagtcttttaagatggaagctgaagtcaaatatttgagctatttgagttcattcttctttcaaaatatatacatttggagctataaatttctccctaaatactgttttagcaatatctcctaatgttgtattgctgttgtcatttagtttaaaatactttcttttttttttttttttttttttttgagacggagtctcgctctgtcgcccaggccggactgcggactgcagtggcgcaatctcggctcactgcaagctccgcttcccgggttcacgccattctcctgcctcagcctcccgagtagctgggactacaggcgcccgccaccgcgcccggctaattttttgtatttttagtagagacagggtttcaccttgttaaccaggatggtctcgatctcctgacctcatgatccacccgcctcggcctcccaaagtgctgggattacaggcgtgagccaccgcgcccggcctagtttaaaatactttctaatttacctttccttctttttaaaccatagattacttatattttttaatttccaaatatttagagatttcccaagaatctttctgttaatgattcctaattccactgtaatcagatacaattttttaatgacttgaatccttttgaattcatttaagacttgtttcatggccaggcaccatggctcacgcatgcaatcctaggagtttgggaggcagaggcaggaggatcacctgaacccaggagttctagaccaacctgggcaacacagtaagatcccaacactacaaaaaaaaaaaaaaaaaaagaatattagctgggtgtggcggcacacatttatagtcctagatactcggggagcagaaatgggaggattgtttgagcccaggaggtcaaggctgcagtcagccatggtggtaccacttcactacagcgtgaacaaagcaaaaccccacctccaaaaaaaaaaaaaaaaaaaaaaaaaaaagtcctttatggcccaaaatacagtttatcgttgcaaatgttttggataaacttgtgaacaaatacgtattctactctttttaggtagagtgttctataaatgcaattaggtcaagttgcttaacagttactcaagtctactatatctttgatgattttctgtccacttctatcaattattgacaggggttactaaaatctccaattatgactggatttctcaatttctccttgcatttctatcaggttttgtttcatgtgttttgaagctctgttattaggtgcataaacatgtaacatcattatgtcctcttaactgacctctttaccattataaatgaaatgaccttctttatccctggaaatattccttgctctcaaatatactttaatattaatatagccactccaagttgcttttgactaggttaccatattatatcttttcccattctttcacttttaacctgtttgtttacaaactatttcttgtaggcaagcatatagttggatcttgcttttatatccaatctgacaaattcagcctttaaactggagtgtttagacaatttacatttagtgtgactattcatatggttaggtttgattctatcatcttgctatttattttatatttttcccatttggtgtttgttccttttttcttctttttggacttctgttgaattattttgtgtgactccattttatctcctttttattggcttattagttgtaactctctattttgctattttaggggctagagtttacagtatacatttttaacttaccacagtctatcttccagtgatattatcacctcacacagagcaaaagaatcttataacagtatacctccatttctccctccctgccttttagctattgttatcatgcattttacttttagataagttataaaccccacaacagcttgttaatatttttgctttaagcagtcacttatcttttaaggagatttaactgataagaaaaaaaatctcatgtatttacccaagtagttaccatttctagtgttctttctttcatgtaactccatatttgcatctggtatcattttcctgctgtctgaagaattgcttttaaattttcttccagaggggaaatgttagcaataaattctttctgcttctgtgttgtaaacatctttatctcatctttattttagaaacatatttttgtcagatacagaattatagattgacatttttcatctttcagtactttaaagatgcttccccagtttgcttgcttatatcgtttctgataaatctattaagataatcatctttatctttcttcctctacacacaaaatgaccatatctctttctctgactgcttttcagattttctctttatcatttgctttcaacaatttgattataatgtacagtaagtcctcacttaacatcatcaataggtccttggaagctgcaacttcaagtgaaacaaagtagaacagaacccaatttaccatggtccaatcgacataaacaagtgttaagttcctacagtgtatttctagttacaaaaacatcaccgaacttctaataccaaaacacttctaatattaaacaatgaaatgaatgtgagctacacatacacttaagaaagattaataaaaacaagtaagataattattcacccaatttttctagttcagggtcacaggtggtcagagcgtatcctagccgctcagggcacaaggcagaaaccagccttagacagaatgctattccacactagagtgcgtgcgtgcccacacacccacacacacacacacacatacacacacacacacaacagactaactcatactggaacaatctagagaagccaattaacctaatgctcacatctccctaatgtgggaggaaactgaagtcccaaagaaaacccatgcagacatgggaagaacatgaaaacatcacaccaatactggccccagccaggaatcaattctttttctctcatcaacattatgacaaaatgatgttgaaagaaacattatttgaggacctgctataccttggtgtagttttatgtttcttatacttaaaactcattcaacttctttatctgtagatttatggcttaagtctaaaacatttttggccattatttcttaaaatatattcttctgtatattatgtcccttgagaactacaattattcatctatttggctgcttgagtgtgtcccacagctcactgacttttttttcttctttctctatgcttcattctggatggtttctattgctctgccttcaagttcattcataattttttctgcaatgtctaatttaccattaatctcataccgtatatttttcatctcagttgtagttttcatcactgtaagtctgatatgggtctttttgtctcttctgtatctctaactttttgaatacatggaatacagttataatgttttaatgccctctgctaattctatcatctgtgtcagttctgtgtcaattttgacggaagattctcataattatgggtcatatttcatgcttctttgcatacatggtaatctttaactgaatgacataccttgttaattttaccttgctatatgactcctataaatctttttggactttgtccaggcatacagttgagtaatttggaaatagtttgttcctttcaagtcttgtttttataatttactagttcgctccagagcagcaacatcttctcaactcagagtctgccagactccacatctcagtttctactctctatgtcacatcctggaaaatctctcagtgcagtaggcctggggcaattgtaggactcaccttgtttgtttcttctctctcaagaatcacttgattcttgagattaagacctgaatgtcttaatcattgttgtttctacatattttgtttttttggagaagaggggtaggattgtttcaagaggacagtaaacacgatccttgttacaccacatggaccagaggcaaaagtccccatccgtccttcttatttaatctatctgtatctatttgagtttcttgtaaacatcataaatataccgtccctgacttacgatggttcaccttatgattcaactttaccatagtgacaaagtgatatgcactcagtagaaaccatactgaagtacctatataagcattctatttttcactttcagtatcacattcaataaattataatgagatatttaacactttattataaaatagggtgtatttagatgattttgcccaactgtagtctaacttaagtgttctgagcacatttaaggtaggctaggctaagctatgatgttcagtaggttgtgtgtgtgtgtgtgtgtgtgtatatatatatatatattttttttttttttctgagtcaaggtcccactctgtcacccagactagaatgcaatgaagactataactcactgcagccttgacctcctgggctcaagcaaccctcacacttcagcctcccaagtagctaggactacaggtgcacaccaccacatccagctaatttttgtattttttgtagagatgggttttcaccatgttgtccaggctggtcttgaactcctaggttcaaattatctgccagccttggcctcccaaagtgctgggatacaggcatgagccaccatgcccagttaattatgtgtatgaaatacatttttgactttcaatattttcatcttacaatgggtttatcaggacctaacaccatcataagtcaaggagcatctgtacttgagtcttgctcttctatacaatctgacaatctttgccatttaaattgagcatttaagtcatttacatttagtatagttgtcaatattactagatttatatctactgttttgttatgtttttgtccttttatttgttcctttcttcaactttatcttcttttagactgattatttttagtacccattttatatcctacataggcttactatttttattttgtcgtataggaattgttctaaaacatacacagcctaccttcaaatatcattccacttcatgtttgatatcagcacctaaaaattctatacttccctttcccttatccctttctttatgctactgacatcaattaatttctatgtataagccctcaaggcactgttagtatttttgttttagtcaattatctttttaaaagttaaaaatgggccaggcatggtggctcacacctgtaatcccaacactttgggaggccaaggtgggcggatcactggaggtcaggagttcaagaccagcctggccaacatggcaaaaccccatctctactaaaaataaaaaaattaactgagcatagtggctcatgcctgtaatcccagccctttgggaggccgaggcaggtgaatcacttgagtccaggagttgggagaccaacctgagcaacatggcaaaacaccttctcaacaaaatatataaaaattagccggatatagtggtgcatgcctgtaatcccagctacttgagaggctgaggtgggaggactgcttcagcctgggaggtcgaggctgcagtgagccatcatcgtgccactgcactccagcctgggaaacctgtctcaagacctgtctcaacaacaacaacaacaaaatttttatttcaataccaccaattttcagctatttgattatgatgtgcgtggttaggttttttttttttttaatatttcttctactttaggttgacttcttaccatcatctacaggtttatagtttctactaaacagagaacagaggtttaaagtcattatttcttaatgtcattcgcagcaacctggatggaactggagacttattctaactgaaataactctggaatggaaaaccaaacgtcatatattctcactcataagtgggagctaaatttgtgaggatgtaaaggtgtaagaatgatacaatggactttggggacttggggaaagggtgaaagtggtatgaggtataaaagactacacattgagtacagtgtacactgcttgggtgatgggtgcaccaaagtctcagaaatcaccactaaagaacttattcatgtaaccaaacaccacctgtttcccaaaaactgttgaaataaaaaataaataaaagtcattatttcttataatattttctgttgcccctcccttctcctaggattctaattacacgtcttaggccactcgatatttcccacagctcactgatgctgtttttttctttagtccttccaccctgtgcttcattttggatagtcactattgttatctattcaagcccactgatgtgtgtcttatctgctattaatcccatccaatatatattttatttcagatactgcattcttcatctctatttttatattttctatgtatttccacatcatctttctgttttcccctcgtgtcttgaacatttagagcatattagtaagaactgtttctatatctttgtctgctaaaccatctttatcatttctgggtctctttcttttcagaaaatgtttaaatcctggctatgggtcatattttcattcttctttgtaagcattttaatattttattgaggtagaattgacataatatctaattaatccattcaaagtgaacgttcggctgggcacggtggctcactcctgtaatcccagcactttgggaggccgaggcaggtggatcacttgaggtcaggagttcaagaccagcctggccaacatggtgaaaccccgtctctactaaaaatacaaaatttagctgggcgtggcggcaggtgcctgtaatcccagctactgaggaggctgaggcaggagaatcccttgaacccgggaggcagaggttgcagtgagctgagatcacaccactgcactccagactgagcgacagagggagactacatctcaaaaaaataaataaataaaaaataaactgaatattccagtggtatttagtccactcacagtgttgtacaactaccacctatacctagttccaaaacactgttatgaccccaaaagggaattcaacacccattaggcagttgcttctcattcacccttaatcccaggccctggcaagcaacaatctacattctgtctcatagattacctattgtggatatttcacataaatggaatcatacaatatgtgaccatttgtgtgtgtcttctttcacttaatatgttttctaggttcatctgcatcgtagcatgtatctgtacttcatttctttactgctagacaatttatggaatacagactactgcaatttgtttactcattcatccactgatggacatttgggttgtttccaccatttagctattgcaaatagtaatgctatgaacatgtgtggtcatatatttgtttgagtacctgctttcaattcttcagggtatatacctaggagtggaattgctgggtcatatgacaagtctatgtgttcctttgaggaattgtcaaactcttttttccacagaggctgaaccatttaacattcccaccagcaacatacgagggttccagtttctccacatcgtcctcaaaaccagttactgcccgtcttttgattctggccatcctagtaggtgagaagtggtatcttactgtggttttcatttgcatctccctgatcactaatgatgttgagtattaatgatgtgtttatcttctcagagtaactgtctattccaagtcctttgcccattttttagttgagcttttttttgctgttgagttgtaagttttcgttcttgtattttggccattggtccattatgagttaatttttatacatggcatgaagtaggggtccaactttattgttttgcatgtgcatctccaggggtccccaaaccatttgaagagattattctttccccactgaatcatcctggcatgtttgttaaaaatcaattgcctacatatatattaattctggactctcaattctattagtctatacatctatccttatgccagtaccacactattttgatcattgtagctttgcagtaagtttcttaattgggaaatatgagtcctctggctttattcttcctttttcaagatggttttggctatttggatctgttgcaattccatatgaatatgaggatcagctttccaacttttgcaaaaaaaaaaaaaaaaggccaatggaattttgatagagattgcattgaatctggagattgctttggacagtattgccatcctaacggcaatgtaaagtcttccaattcatgaacacaaaatgtctttccacttatttaggtcttctttatttcaacatgttttatagtttacagtgcacaagtctttcataagcaagtcaactcctttaggcttttggatgctattataaatgcaatcttttaaaatttctttttgtattgttcattccgagtacacagaaacacaaatgctttttgtgtgttaccttgtacctacaactttgctcaagttatttattagctttagtggaggtttttctggattctttgggattttctatatataggaccatgtcatctgcaaacagagacagttttatttcttccttccaaatctgtatgtctttgtttctttttcttgtcacactgctctggctataacttccactacaacttgaataactggtgagaatgggtatccgtgccttgttcctgatcataagggcaaggatttcagtcttttactattgagttggatgttagctgtgggttttttcataaacgctgaatgttgaggaaatgtttaaaaaaaaagttccctactattcctgattttgagcctttctatcaagaacagctgttgaattttgtcaactgcctactgtatcaattgaaacaatcacgtgggggttttccccgcttcattctattaatgtgttgtactacaccacccttgcaatcctgggaataagtcccacttggccatggtgcatattcctttaaatatgctgctagattcagtttgctagtattttgttgaagatttttgcatctttattaataaggaatattggtctgtaattttcgcattacgtctttgtttggctttggtatcagggtaataatactggcctcaaagagtgagttaggaagtattcttactctctcctctccaattttttggaagagtttgagagcgattctcatactctttaaatatttaaatatttggtattcttctttaaatatttggtagaatccaccagagaagcaatatggtactggacttctgattgggagtttttgttttgttttgagatagggtctcactctatcacccaggttggagtgcaatggcataatcatggatcactgcagtctcaacctcccaggctcaagtaatcttagtttgggaggttttttaactaattcaatctgttcacttgtaagtctgttatattttctgtttcttctgagtcagttttagtaatgcgtatttctaaaactgtgtccatttcatgtaggttatctaatctgtgcataaaattgctcacagtattctctttaatcctttttgtttaaggtcagtagtaatgtccccacactcacgtctagttttagttatacctatctgtgttttttctttgtcagtctagcaaaaggtttgtcaatttcattgatcttttcaaagaatcaaacttttggtttcactaattctctatattattttcctattctctatttcatttatctccactctaatctttatttacttccttttttctggtagctttgcattttctagtttctttaaaatgtaaagtaagattatttatttgaggcctttcttattctttaatgtagatgtttattgctaataatttccctctcaggactgttttcactgcatcatttaagtcacatatattgtttccattttaatttatttctaagtattctctaattcccacatatttgtaaatttccatatatttgtaaattttccagtattccttctgttaatgattactaacttcattccactgtgactggagaagatacatagcatgatttcaatctttttaaatttactgaaacttgttttgtggcctaatacagcctggagaatgtttcatgtatactttaaaagaatatatattttggcagggtgcagtggctcacgcctataatccctgcactttgggaggccgaggagggtggatcacctgaggtcaggagtctgagaccagtctggccaacatggcaaaaccccgtctctactaaaaatacaaaaattagctgggtgtggtggtggacacctgtaatcctagctactcaggaggctgaggcaggagaatcacttgaaccccggaggcagaggttgcggtgagccaagatggagacattgcactctgggctgggtaacagagcaagactacgtctttcaaaaaaaaaaaaaaaaaaaagacaaaaaaaaaagaatacatattttgctgttgctgaatgttctgtatatgtctgttaggtctagttgattaatactgttgttgaggtcctctagtcccttactgatattctgtctagatgttctatccattgctaacgtcaaagcaagcattttttgactgaatgacaaaaactaaattttacattgttgggttctgaattttgttgtattcctctaaatagtgttctggtgcagttaagttacttggaatcatttggagccttctgaggactcttcccagtgccccatgtattctacaacatactttactctgcatagtaggaacacgactatttgaagccttattgtgaactctggaaattgtttttcttagtgctttccaagtgttttcttctctggcctcaggtagggcctgtcaagcatctacgaaatcagaactcagcaaaagactccaggagaaccctctggagatctccaaaatgcatgctcacttgttcatgctctcttgctttttagtttatgcctccccaacgccaatcccaacccccttagctcttttttctctggtactctgccctgtaattctaatcgccttgatcttcccaaatttttatctttgtctttttatctcagtaggactgctgggctctgttttggttcctccacaccttgcactgcagccaataaactgcctctaggctctgcagtaagctgttacaattgaagggctttaccttcacttgttcctattctctcagggatcacagtctggtgctgcctgtcatcaatgtctaaaagctattgtttatatattttataaattctcaagttatttaaagaggaagagtagatttttgctacataacaaattacctccaattttgtggctttaaaaatcaagcattggccaggcacggtgactcacgcctgtaattccagcactttgggaggccaaggcaggaggatcacctgaggtcaggaatttgagaccagcctgcccaacatgatgaaaccccatctctactaaaaatacaaaaaattagccaggtgcggtggtgcacgtctgtagtcccagctactcaggaggctgaggcaggagaatcacctgaacctgggagacagaggttgcagtgagctgagatcgtaccactgcactctagcctgggtgacagaccaagacttcaactcaaaaaaagctaaaaaaaatttaaaaacaaacaaaacaagcatttctttttttcacacagtttctgagggttggcaatcagggaacagcttagatgggtagttctggctcaggatctctcatgaggttgcagtcaagatgtcagcaggacagatgtttaggactggaagcttgactaaagctgagacatctgcttccaagaaggctcgttcacatgctgttggctagagaggcctcagttccttgttggctgttggcaggaggcctcagtttcccacagcatgggcctccccatcgggccattcacaacatggcagctaactattctcagagtgagtaatccaaggttgggggtagtgaggggaaggaggtggagccacatttgtattataaataacctatcctaagaaatgatccatcacttctgttacattctattggttccacagataaacctcaatacagtgtgtatggggattacaccatggtgtaaatatcgggatgccgggatcattgggggccatcttggaagctggctacatataaaataaatccagttcccattataccagcataggggaaagtagaagtctttcttacacatttttaacctccttatgtttactatttttcttatcccctaactgtaggctatattctatggctacaagagacatgagcagattacagagctccacacccagtcttggaaagaaaagtaactactactaagtagcagcaacttttaagagaaaagaatagagttcctggtgcttgtggcaagaagcaggaggaccttgaagccaatctgggcttgagaaagtggttcattcccccaaatacttcactcaatgatctacctaaatgtctgccgtctgccctcctttcccaccaatttccagtcaggcagcaatagccaacagcaatattaatagtaaaattaatagcagtagtaccagcaccaatgctaagcattttgcctttgttatctcaattactcctcacaacaaacctctgagatagctgtcattattccttacactctagactttgtttcttggtagtcatactctggtcttacactatccagtgtaataaaaactttttttttttttttaataacacctggctccctcttgccctacacggttctgctactccttcgacacggaaaaattctgtcttgtcctgcctgtcatctcttccacttcagttaggccttaaagcttcctcttagctaccatgttcccaatatctactatcaaacctcactaaaaagaatcaccagattattttgatccctgtaaattcccagttgctaggctctcccaatactacaaccgcctaatatagacttttccaattccttaggacacactgacctgtcaagcctacctcaccagctaatctccaaaacttggccctacttcagctactcatttaaaaatattattcacagcatgtatcttcgtaatttatatttgctgtagcttactgctaaaatgagttccttttcccgggggacctataattaatgatcagggagaaagggccaaaatataccatactggtaaatattatggtaccccagaaaccagtatactcccgttggttatctgttgaataatgactgaaaagtataaagtaatgattataaatactaactcagaaaattatcagagggcataatccaaagaatgttatttacaaataaaaagaaatagatgacagtagacacatataagcaatccacaaaaggcaaaacacgaaagaacaaaaaatatttaaatattatagaaacacaaaataaaataccaccttttgtcagacagataagcaaagactgaaattttgtcaaggaagtaaggaaacaggtagatacacttctggcagatataattttgtctttttgggagctatacaccaaatatctttaaaatccacatacatctttgactagtatttccatttctaataattaattctaagaaaataattggacaaagagatatacatttaaaaaatttactatggcactaactacaatataaaaatctgtccaacaataagggcttggttaaattttagtacatccaaactaagaattattattaaatcacttcaaaacattacatattgtataatcccagtttttaaaaagtaacatatattcacataaaaacatacctgcatagaaaaaaaatctagaagtatacaccccaaaatgttaccagtgattatctctgtaatagaagtggaattttttgtgattttttttgtttgtttttcagggtttgtttttttttttttttgcttatcacacctaattttctacagtaagcataagttgcacatggataataacacacattcttaaaaggcaaaaacaacaactatgatcacaatttaaaggcagaaaagtgctattatcttaacagaacatggaacatccatgttctatgataataataaagttaggcaaagttaatatcaaataacctgatattcaatagcctagtttttaattagttttagtaacacatatggaagaatctgttatgaataaaaaaccatgtaggccgggcacggtggctcacgcctgtaatcccagcactttgaaaggccaaggcaggcagaccacgaggtcagaagttcgagaccagcctgaccaacatggtgaaactccatctctactaagaatacaaaaattagccgggcgtggtggcatgcgcttgtgatcccagctactcaggaggctgaaacagaagaattgcttgaattcggaaggcggaggatgcagtgagccaagatcatgccactgcactccagcatgggcaacagagtgagactccatctcaaaaaataaaaaataaaaaagcatctaattcaggtattttaagaaaacaaaagccttcccaaataaaaatgtagtactaatcctagagacaacgttgaaaatcacgtagtaaaaatctcaactctttcaagctgagaatcaacttaaatcccctttgcatgcctagggtctcattctgttacccaggctggagtgcagtggtatgatcacagttcactgcagcctcaacctcccaggctcaagagatcctccaccccagcctcccaagtagctgagactacaggcatgtgtcaccatatctaactttttttattttttgtagagacagggtcctactatgttgcccaagctggtctcaaaatcctgggctcaagcaatcctcctgcttcagcctcccaaagtgctgggattacaggcatgggccaccacactgggcccctttacacatttaccttgagaaccctcactgttatgagaaagtggttgcccagaaagtaagattcaaaaatcactcatgaatttaagaattcaactctatgtttagctgaagagagtcttcatctcagacttgaacagtttgggggatgacagttatagtcagtaacaagaagggggggtctcttaaattgttctaggaatacacttctgttaagattgagcatcctaaatccaaaaatctgaaatccaaaatctccaagatttcaaacttcttttgtaccaacataatgctcaaaggaaatgctcattggagcattttggattttcgatttttggattagggatgctcaacctgtaggcaaaattccaaaatctaaaaaaatctgaaatccaaaacacttccagtgccaagcattttggataaggaatactcaacctgtacaatttaagtatgtatatctccaggcactgtgtacgatttctagccaacatccagggaattgcttgtggccatgtagagaattgcctaggaactgtttgcaatgcctgattcaacatgacctgcaacatagccagtcagtaaatcctcattaggactaatccataaactataattttcaatgaagttggctagcataaaatggtcatttccaaatgtctgtggcagaagatgaaaaattattttaattgtaaccaaataattaatggcaggtatccatagaaagttatttagtggcaacttcacagctataacagtttgcaaataaggtctcataatgcttccactgggatttgagagcagctgtgaggaaacaggaagcactaagcacaggacagcactacgatttctttaaattattagtaatgtttttgattaaagtaatttttgttgcactagggaagtttctagtacaggagaaaactaaataataactttacatgagggagagttagttgcatttgtgtaacacaagcagcatataacaccaaaactgacaacataattacgtggttattgttgaaaaataaatatctccttgctttagtgacaactctagcaccattcatatattcatacacccaacaaataaatgtatgaaaactatttacattgtttattctaggacctggaaatataagagtaaacaagaaaagtcactgtcttcatgaaacaaactgtctaacaagggagacagatgttacaacaaataattacatatttgactataactacaaatgtcatgttattaaactaaagagcaaggtgctataacagcatatagcaggactgcagtcaagcaagccaaacccaggggtggggaagagaggtccagcagaggaaatctgtgcaaatccctgtagccagaacaaccttacccaatctaggaactgaaacggtccagtaaaactgaagcactgagattatttctagggcacacattaagtctaagatgtataaagacatccaagagatcaaggtggtaaatgctacatgagtttggagctcagaaaaaaaaggtctagaccaggtataaacttagaagtcattagcttagagatggcatgggatgcacaggaactggaaatttctttggcaaggtgagcaggactatatgtcggaaggcagggggtcaagattactttctttttttggaacgcatctcgctctgtagcccaggctggagtgcagtggtgtgatctcagctcactgcaacctccgtctgctgggttcaagcaactcttctgcctcagcctcccaagtagctgggactacaggtgtgcaccaccatgactggctgatttttttgtatttttagtaaagatggggtttcaccatgttggccatgctggtcttgatctcctgatctcaggtgatctacctgccttcgtctcccaaagtgctgggattacaggcgtgagcgaccacgcctggccaagattacttttgttttttttttgagacagtctcactctttttgcccagggtggagtgcaatggcacgatcttggctcaccgcaacctccgcctcccgggttcaagtgattctcctgcctcagcctcccgagtagctgggattacaggcacgcaccaccatgcctggctaattttgtattttttagtagagacggggtttccccatgttggccaggctggtctcggactcccgacctcaggtgatctgcccgccttggcctcccaaagtgctgggattacaggtgtgagccaccgtgcccagtcgattactttcttaatcacaggggaaaagaaaaaaagtttaattacttctctgttgatttgcaatcaaaagaaataaaagtattttgtttctttccttttttttttttttgtttttaagagacagggtcttactacgttacccagtctggctcaaactcctgggctcaagagatcctcccacctcacctcagaaagtgctgggactacaggtttgagccacccagcctggccaaaagtattttctaacactatagttatgatacaatgttctatttgatcgggaaaggtaaaattaaatgtataaagttcttggagaaacgtcaagaactaagaaaagcacttctttcagtgagtctaaagtattaaatgctgtagtttatcagggcacttccttctagtgtttttcagtgccctggaaagtgaactttaaaaaaaaaaaaaaaacagatacaactacttcacaagatttgtcactaaaaatgctttgagtctgcagaactgccacctactgaagctgtatcatgatcataagcattctgaacacattaacaagtcctaaagggatgtgacatcaagaagaacagacaaaccttctgccttgcacaaccagaagttatcaactttcagaagatcattctaatccttaaacaacctgccctacacagcctccaatgatgactatacagtaggtaactgctttaaaaagtgatgagtcaggttacagttatagaaaagaaaagctgagttaaaatgttccacaatttacagccaaagcaccatgtaagcatgaaaaatgccttaacacaaactcacctgatttatttgaagcatgttaagacaatattgaccaaactgctgtatccctcacggctccaaaaactggaaaacgaaaatgaagaaataaagttcaacttagctgataacctcaatgactggtattttaaacacatgcccttgatcaaaatcaaatataaaatgtaatttatccagatctccatagaactttctatgatgataaaaatgttctgtacttgcactgtccaatctggaagtcattagccacatgtggctactgagcacttgaaatgtggctagagcaatcaagaaaataatatttaattttctttcatgttcacttgaataactacgtcactagtagccaccatactggacagtacagatctgaacaaagctccttctgcttctagacttctaagacaatcccaacaaaagtgaagctgttaaaaataaatctgagagtttcaggttaatatttaatgtatacttccctttttgcagtcctgttttaaacagctttgttcccatcttctatacgataaattaatcctaaagaagatgcaacaccacaagtattctcttagatggtatggaaaagagcatatagtacaattatcttgctgaatagtttctttttctctgtcattttgtctgttatcatcagtataaaaatagtatgtatattaaaatttcaggctgggcgtggtaatcccagcattttgggaggccaaggtgggtggatcatttgagttcaggagttcgggaccagcctggccaacatggtgaaaaccctgcctctaccaaaaatacaaaaattagccaggcatggtggcgcgtgcctgtaatctcagctactcaggaggctgaggcaggagaattgcttgaacccaggaggcagaggttgcagtgagccgagattgcgccattgcactccagcctaggcgacagagcgagactccatctcaaaaaaaaaaaaaaaaaaaattttaatttgaaaacagatgccaatgaagggcaggaaagtccaaattacaaataaataaatcatgggatcttgtaatgaaaaaaagtttatataaaatataaattatatacagacctctcccctaaaaattatctaaagcaacaacacaattgtgatacacagcaaaaggcctatatctaatcacctgtatagaaactgttatgctgctaaattttaatattgaactttcccctggaagcaaacgttttgtaagtacacacatacatacacaaacacacacccatatttggctaccattttttcaagatgacaaactagagtccattcaaaatgactttgaaaactttaatatttttcttacaatagtgtcctcagcatctgcatcaatttttatttattttctaattactgtcacatttcctatgagaacgggatgctgtataaagagcacacggcctggatattggtgaatttgagttttagtcaaagttcttcagattaccttctgagccttggttcaaattactttgtgtatctttgagttcttctttttctgtcttcttttttttcttcaatctttaaaaagtaagctaaagtccttgtggtaggcagcctctaacaaatagaatatagcagaaataatgagataccacttccaagattaggttataaaaattcttaggtgtcaccttctctcactcatttgctcagagggaggcagatgccaaactgtggtgccctttggagaggcccatatggcaaagaactgagaaaagcctctggccaacagccagcaacaattgatttcttcagtccaagagccccaggaaactgaaccctgcaagagccacatgaatgagttcagaaacagatcttccaccagtagagcttccagatgtgactgcaaccccaactgacagcttgactaccacctcttttatgagccacaggcacccagctaagctgcacccagatttctaacccacagaaactgtaagataatgtttgttgtcttaagtccttaaattctggtgcaatgtgctatgcaacaataaataagactatcctgtccaactctataattcaatattcccatggtgctttaggtattaattaatatttggataggcaaaaaaataaaataaaatccctgttcaacatgagcaaatgagtaacattagaacttcaaagtggcaaattataaaacttaaacatttatattttcaattcaaaaaatgagattattcacaagtgtagcattagtcacatggtgttaaaatacacccgctttcaataggaatggagtatctcattaaaaaaatacactagctataacttaaaatacaaacacaaccaatcatctttttttttaactgaaaacagttcatttaaaaagtaaagtgtgaataaccactaaagcatctcagtgacttagtgtcccttgctttctagaatttatcattactggtcgggtgtagtggctcacgcttgtaactcagcactccgggaggccgaggtggggggatcacctgaggtcaggagttcaagaccagcctggccaacatggtgaaaccctgtctctactaaaaatacaaaaattagctgggcatagtaacacatgcctgtaatcccagctactcgggaggctgaggcagaagaaataaatgcttgaacccaggaggccaaggttgcagtgagccaagatcatgccactgcactccagtccaggtgacagagcaagacttcatctcagaaaaaaaaaaaaaaaaaggccaggcgcagtggctcacgcctgtaatcccagcactttgggaggcagaggcgggcggatcatgaggtcaggagatcgagaccatcctggctaacacagtgaaaccccgcctctactaaaaatacaaaatattagccgggcgtggtggcgggcgcctgtagtcccagctactcgggaggctgaggcaggagaatggcgtgaacccgggaggcggagcttgcagtgagccaagatcgcgccactgcactccagcctgggcgacagagcaagactccgtctcaaaaaaaaaaaaattaacattattaagcattcaccaactttgaaaaactccactttgtctttattagtatacgttgctaaagttacaaatgcttatctacagatctctatgtatttcttcaatattagaggctgataacactggtggctgattccaagaagcaagcagagtaagatattggggtacctttttgaaagttctaacctttttttttttctttttttttgagacggagtcttgccctgtcacccagagtggagtgcaacagctcaatctcagctcactgcaacctccacctaccaggctcaagtgattctcctgcctcagactccccagtagctggggatacaggtacacaccaccatgcctggctaatttttgtattttttgtagagacggggtttcaccatgttggccaggctggtctcgaactcctggcctcgggtgatccatctgcctcggcctcccaaagtgccaagattacaggcgtgagccaccacgcccggcccgaaacttctagtcttctgacacggaaaagatattccatgaagtaacaaaaaataaaactttatgaacataaaattaaccatacgatttaaatattctgtaagccttttctttacaatataaagagctgtagaaattaaaacacatgaaactaatgtctataacagcactctgtaattggctaacattctgaaaattatacttttttaagcaaaccagttattttagatttacatcaatttaaaaattgtagtttgtaattataccatggacaattcagaatgttcacagtggcacgtctttaagactctgtttctactttaaagacacgcccagtctactgtcacatattttaaacaatttgctaaaatatcaagacatatcaataaaatgcagagcagttttatactacctttggtttcataaaatccacctcctcagctgggtgtggtggctcacgcctgtaatcccagcacttttggagtctgaggcggacggatcacctgaggtcaggagttcgagactagcctggcgaacacggcaaaatcgtctctactaaaaatacaaaaattagccaggcatggaggcacgcacctgtagtccaggtactcaggaggctgaggcaggtgaatcgcttgaacccaggaggcggaggctgcagtgagtggagattgcgccactgcactctagcctgggtgacagagtaagactccatctcaaaaaataaaaataattaaaaaaaaaatccacctcctctatcacaaaagtttccagctacagttgattccaattacaactaagcgcttttagagaaatgtatccatgcgtcccaaaaatgccctatctggtcaggcatatgaagacaggcaattctagattccaaactactaaatgaaaacaagcaggattatagggagacggctggggaagacgtgatgctcatgaagaatggcccaacctgtaactgcaatgtactgctgatataagtcgtactttaattatgaattacattttgcccatctgagaaattaaaagctgcacagaaatctatataatccccaataattaaactgctttataaaacggcactgttactaaatatgtataaattttttatatcagcacccatcctacagttgataggcaattctcacttaaatgtcttatttgacaacatgaaaagcaaaaaaaatttactatctctactcttagactacaaactgctacaaaactatcaattcaatgcttattactctaaaaaagatatacggtcctttaaagagctttttaaaatgtttttcattttgatttttcaaagtgggtacccaaaaacactgcttttatgtaaggaaaacagaagtcttacgccacaaactattctagtggaaaactctaaataacacaggccagaaaaaaaaaaaaggaaactaacatttttcagacaccaattgtatacgctaggtgccacattttgccatttttacatcaactcatttaatcctcatcatcttgggatgtaggcattatctccatttttctagaggttgggttatttgcctacagtcacattgctaggtttagaacggttcattctggcccaaagtcgtcttttcttcactatacaccaaattaaaaaagacttgccttctttttaatttttttttttttttttttttttgagacggagttccactcttgctgcccaggctggagtgcaatgggcaccatgtcggctcaccgcaagatccgcctcctggtttcaaatgattctcctgcctcagcctcctgagtagctgcgattacaggcatgcgccaccacggccggctaattttacatttttagtagagacggggtttctccatgttcgtcaggctggtctcgaacccccaaccctcaggtgattcacccacctcggcctcccaaagtgctgggattacaagcatgagccaccatgcccggacatttttttttttttttgagactgagtctcactctgtcacccaggctggagtgcaatggcgccatctcagctcactgcaacctctgcctcccgggttcaagcgattctcctgcctcagcctcccgagtagctgggattacaggcgcgcaccaccacacccagctaatttttgtatttttagtagagacggggtttcaccatgttggccaggctggtctcgaactcctgacctcctgatccacctgcctcggcctcccaaagtgctgggattacaggcatgagccaccccacctggccaattttttttattttctatgatcagcttggtgaaaaataaaagatttgccttcttataatttttcctggaacaaagtcaagggcttgacctctaggacaacataatggcaaagctcctatatagaacttggggaggattatttaaaatcaaacgatgcacacataaataaaaatgataattattactgattctagacatctagtattttgtgtacctataagaggcacaaatatatctatatgtgaataatcatactgtgcgtgtctcaaactatgcagtctaagagaattcaattttgcagtatctagagttttccctctttattatgatctgtacctataaatgatcagattcccagcactgaacgtgcacaaaacaagataataataggaataaagagaagggtaggcacaaaggaaaaaaaaaaaaaaacctaccatatcttctagaacctaaacaggaaaaccgctctgcctcgatttctggattgtttgtatatttaaaagcttgatgactatcttagattttttttatattcatactatttgttgaaaagcaaaccaagccactcttcctagcacttcattccagacaagccaagtaagctaaaatgtaaaatttgcatggttttccaagctcaagtatttaggagttaaggatcacaatgtatgtaacttacccttaaatggtccaggggaaaaatattttgtgtgtgatagagagcaaataataaatacataaaatgttaacaggtgaatctgaataaaggttacaaagattttctttgtattattcttattcttgccatttgtctgtaagcttgaaattatttccaaataaagttaaaatttaaaaattacacagcattttatttgaaattaacaatacatacttggattacacagcaacattcttacaaatacaaaacactggtttttatggggaaaaatgcagtaatttgtgagcaagtatgtaccatatcctaccaacttatcatcacttaggaataaatttcagactagcctaccatataataaaatatggcaatagtgacttgacttgaaaccatagcaggaaaacacaaacacaccagatagtttggcataactgcttcgcaaatttaatacaggcctgctgcaaaatgcagcaatctacaattaaagtgttatgtgatatctcttgtttgcagtaagatacaaactgaacaatgaaaatctggccatactacaaaacagagatggagagtaagtcttggttttggtagttttattaaataagatttttccaccgcagctgagttcacaacagtgtacttgaatcatctaaagaaagcaaggacggggaagaaatatcctggagaaatgttgaaatcttttctcctccaaggttactatcaccctgcctgtccatcacaattttgatttcaagtattcacgatgctggtctgaaacacaggatgcatcagaagccaagtaatgctcagcaaaagttcaccaaaattgtgaaagcaaacattaaataaaaaacgttttcaattaacagtaaaatatctttaaaggatcatctctagcctttctttctgcaggatccacccactttaaaatcctttggtaaattcccaggtctaccctaattgaatggtccctctctatctgctcaagcagttcttaaccctttggagtggggatgggggtaaggggacatcacagcaaatatggacccttaccaaagaaaattattcacaaatgcaaaattctacacacatttccaaagacttccagaatcccacggccattacccccaccgcctccctaagaatcccagagtggcgtgcttctcaatggcctctgcggagcacccccagcccccaagccacagcccccggctcgaccccgaagagactagagttcctgctctcacacagcggattccgtaactgagctttgtctcctcgcccaactcccttcaccccggcaaggtcactaccgccaactacccctttaagccgagccatcacggtaggagttcgtaacagccacagcagaacttgcctgtcataggatatattttgtcccctcggccccacctaccctccccatttcggcaagttacgtctttaccactagcccattctacagaaatagctgccgccgccaccctccggcgcgccccggccccgccgctccgcctccagcgcccccaggcccatttcccgcagaccctccccgggccgccctcccctgccctactctaggcgctccctctccctcgcagccacaccgtggctgcactcgccgtcctctcttccggccgctaccaccccggccccctagaaccccagcctcccgcgcccgcagccgcgttcctgtctccccgacctccgcacccccacttggcccggcctcctcgccttcctcccggctcctcccctcaggacacctgtgtcgtcccaccccctccaccacacacgcaccccccaccccaattccttcgcctccctgtcctccctcccccgccggtctcccctccccgctgctgccccgagagcccgatgtgggagggaaggcgcgggggaggggaggccgcgaagggggctgcttttctccgggttccccgtgctgcggaactgcagggctccccagcgccctctgccttcttcgccggcggcgcggaagtcggggtctcccggacgcccccgatgagggtatttaccttcttgccggggacactttgcagacggctccaacattggcaaacactacagagaactgaccccgctcggccgccgccggcttccacccctcgggctccccgccccccgcctccgcccgcctccgcccgcctccccggcgctcccgccgcgccctcccgcgctcgcgccgcgcgcccccgcctgcgcagccgctcccgcgccccagcacgcccggccggcgcgcgcgcccggcaccggctctacctccactccgcctcccgccggcccgcgaccaagcgcggccattgttcgcgacgcagctcccgccccctggcggctgccgggccccagcagctgcaggctctgcggggctagcggcggcgagctgggcccctgggcgagggccattcccggggggcttgggcacgcgggcgagcgactgcgcaaggagcgcgcccggtccgcagtctcctcgtccccggcgcgactccccgccccctcgtctgccaagggtgggcctggggcagccccttccacacctgcaactcggcaacttccttccccgcccgactgaccgtctgctctttctggtccgcaccctgtgctctgattccccgctcgtacctttcccaggctctccggctgcccctctgtgctgtgcaggggacgcgcgaccatcccgcgtctgctccggccgccgctgtgcaacgcacggtttagcggatcttgcacctttctagacgggggagggggcggggaggaggttgcttcaccgtctcgcccagcaaacaccagggatccgtgatcacctgctcgccaagacccgcggcgtggccagacctcctcttctaccgaaaatattagtcacatgaaaaagaatccttggagccaaaaatgagaaccattgaaaacaatgccctgaatcctagatttatgaggcaagagt

SEQ ID NO: 2340 - DNA, 197327 bp, Homo sapiens
tttgttttcaatacactcatatatttttactttgtaatacaatatagctgtcacatacaatggctctagtaggcttaaatcaaattgcaatgggcaaggaaagccaaagaagggtttacacaatattcaataagcaacagtatctgttcagtgtgcaataaaataaaaaagttctaacctagaaacacagaaaaagaatttattgtttttaagtttcagaaataaaagtaacagaatagtgtataatctgtaacaagctggtcctgtaatttctaaactacagtccaattaaaacatttaagtaatagaaacaatctacatgtttttctaccaggtaaatatacctgagagggttacctataaagaaataggctttaaaacttttaaccacaaagaaccttctgctgcgacattatgaagatgggctatgcatgtggccagactaagtcatttcccggagattctgctcactgcttagctgcaggtagtggtccatcaatgacagagtattttacatcaataccagctcattcaaccaaagaagcacagtaatattttaaaatcacctgtttatattcattagtatgtaaaaatcacaatacacagatttggaaacatataacgtgtccataaaaaagagtatattatgtaagcataagctttttaaaaaggccttagcaatgcaataatgagggaagcagactctacatgttgactacagtgaagatatgttaaaattataattattgtcattgccaagagcttagaaataaaaacaaatttaaaaaattaagacattctggtagcaaaattacagctactgtaacaacagctccaagcaaaaaatcaattcagagcttgaatgcaatttgtgctttgtttctataagaatgcagtgttactctcagacatttctaaatgattagattcataaataagcagttaatttcttttcatcacaatttatttctaattcatcctacggagattatagatagaactaaaaattacttagcttttttccagtactttatataaattgagatcttttttaaacagtgatttattgtgtttcttaaggtaaaacaacaaaaacaaattctaaaattgtaactttaaattaagtggttaaaatttcagatgacagagccgataactggtaacagcttcttgaagttcatattaagagtccaattagaaacactaacaactacctggcaatagtttgaaagaatcagaagggttcggtgaagtgaaaaaaaaatccgaacatgcaaaataccccccaaaacacatgaccttctttttcattttataatctaaacttgtaaaatatttataaatacatgatcattctacacaatacagatcttctagagcatttctaaaggatattacagtttttggtcttaaggaataaagactaagatggaaaaggagatgaaaacagtgaaatctgaggaagcaatacactctctacacacaagcaaactagttcatccagtcaagttagcggttacagttcagtacatgattttcaaggcaactaagaaatcaagacacagatatttccccttcctagagtttacaattctttcaaaagctccaatgtatccataaaggagtgctgatttttgtggggttttttcccagaaggaaacaaagaataaataggggaaaaaaagtttccatccctaaattcacatacacaacaagttaagttaaactataagctagttttagactacccagtgaaacagaattgttggtactatctgaggcaggtgctaccctccctagtcagttcaaaacatgatccagtaaaacaaatacacattgttatgcctcaaacaactataaagcatttcattattcttcaaatatcatgtttaattaactcctaaggtaatagacttctagaatgttgtatcttaatggtgtacctgaatcaatactagcaatagaatgcaaaattcaaaattgctataaaggtaaaatcatcataaaaagaaactcaatccttatgtaaaaaaagggagaactgagtgtgaaatactaacaccaaatgtctgaaggcagaatttttgtttgtggaagacagagcgaagagatagatgcacctaatcaagaccaaatagaagacagtgaagaatatgaaaaatgcttaaaaaagaagaaggaaaatggagaagagacaggcagcaaaagaattactagatagatcaaaaataagagaaaatgaggcatgtgcatatggcttttttgtctgtcctttgtgttcctaaataacttaaaacgtaagtggcatgtaggccatactagcaggcaagaatgagccttgtgatgtatacagatgaagaatctgaggctaatgaattgttttgttttttgtttttgcttttaattcatacctgaaagccttgaatccttgctaaatattccagttgttttgaaggttgtactggagaacaagggggagtaggagaacttccttttaaacctatggcttcagctgtagaagatgttccattcataaggagttccctggcaattgtagctgaactattcgatgtgggagatatactgaagaaagagcttgaaggttggttcatatctttgggtgacaaatagcctagagtagtgccagagattactttgtggcggctggcttccatctcttgataaacatcaggagacaaatgaagaattccttttggagctataaataaaatgaagaacactgttattacacttaaaataaccgaaatagaaacatagcattattaactcaatggctttacttggtgtagtaacaaagaaatgagaaacactgccaaacaagtatctttgtcatactgtagaggcagttgcagcttctattgaaaggtgaataatgtctatttcaattttcctaaaattagaggtttaaaaacatccaaaaaaagtggtttcaatgggacttatgtgtagtagtgaagctataaagggacaagggaaactgaatgtgtggaagtataatggggcagaaaatcaggaatgtgcagtgtcttcaccctgcaatttaatattttatatctcataaaagaggcatgaaaccccaacacatacagcaattgaggcacatcaggtaaaataaaggctgaatcagtccaaatttctttggaggtacaaacgcatgtattcaacagcctagtgatcctctcacctccacaaggatgtcccacagacaactctaactcacgaacacataaaaaagcaaatgggtatcatctcaaaactagcactgtctctaacttgctttgctcatactaccatgtggctgctcatgacccaacctagactcctggcaaccatctctgatttactcataagcaagtagttatcgtgttgctcaaacatctcaagaatatgaccattgtagggattatctagtgcattaattcaagccaggccatggacaggttctgaaatcaagaggagtgggggctatgtcattagttgatggagcttaaaccatattagagaagcactttcctttgactatcatttgtctcagagaagtttcaaaccacatttcaaactgcttattcttatcttttgatcaggtatcaataactctcaaatgatattatcttttaaaattattggtaagtcaccactcataaagaatgtgctctgagagacacaacttaatttcctgttcttgccccttcctctcctgatgctaaccttctgattcaagctttcaatgtttctctgctgctagtattctcagtgtccatttcccaaaatgtgttctataacatggtccccaaataaaatggttccataaataaaaactgaaaataatgcaaattacataatacaaatgccttttgtgaaattaaaaatacacattagcatagtgaagaatcagaaaactcaaagaacaaaaatctattcgacttggtttaactcaggattcctgagtttactttttgtccaagcctttaacatagcatgaataaaacagctaacactttgggaaatgctggaggctagcccaactctcctctgactcagtcatttccaatgacctgtctttgagattgatgaccttttcttctgcttgacattgtctgctattgaatccctctggtaactttttcagtttatggtattttttagctccatgctttctgcttgctactttttaaagttttctttttgttgaaattctcactttttttcatgcattgttcaccagacctcagtgggaatgtttgtaaggattactttgaattctctgtcaggtaaatcacatatctccatttcattagggtcagtttctggagctttatctcattcctttatttaggaaatgttttcctgtttcttcatttttccttgattctctgtgtttgtgtctgcacaaactggcctcatactggagaagatcctaaccaatcagcctggacagagattctggaggcctctcaaacttttatgctagtctaatccactttctttgttcttggcagtccccaggcatcagtcccttgcttgtctcagtcccatcagagctctgagacaagcaagactgaagccaattcttcaggcaactcccagataagttgggtcattggatacatggtgctcctctttgcctctccaggaaaaagctgaaagctgaagcttttcaacagttagctttgtgctgggctgagcaggggatggttacagtgaccaccaccaccagccacctctttcttcattggccccggggttgctaaaatatgccatgtcctgtcagcactctgagactggccagacagaagccagtcctctgggtagccccagaaaagctaaggcattggatgcgtggtatacatctttccccttctaggcagaaagaagctgggagctgggggtggagggtggttgtcctgattgtatggccctgcactgtgaggagggattatggcatgagggtatcttaaatttccctgccaattaagatctggctggtttcatgctcacccggcatacaggagcctcttaactggtttctggatttctcacaaagaaaaattgcctataaattattgttgaattgctgtgttccagggcttcctattctaccatcttgccaaggctagaacattctcttacttaaaggtctttcaccagtttatcagttacactatagaacccaaactccttaggataacctaggaagcccttaataatctggctcctacttatcgctctatcttcatctacgaaatatttcatgaagatcccatgctccagttacacagatatatccaatactccaggctgtttgatcccaacacatctttatttctattgttcggttacacacatgcacatactctcttagttaagctccaactgctattgtgctagttaagcttcaggcatcgcaccaaccaatactgtcctgacctcaagtcatgctcagtctatcaggagaggaacgaaaatggataatacaatgtgataggggtctcactagagacaggtgtatagagcagtgggaatgggaaaggagaagtgctaaaagctcagggaaggcttgctggagatgacgatgacagtaaatttcaaaggatgaggagaatacagtccaggaggaagaggactgagagcagatggccagcaggagcaagggcagggacctggagggtttgtgttctaggaaacctcaggccatgccttatcacaagagcatacagagtcagaattgcaaatgcaggtggaggcacgcaggggccaaggtccagggaactttatcctgatgccattaagtataaaagagttttgtaagtttttttaaaaacactttaaatagcttaaaataatacagacagtcctccgcatgcatgagtcccatatccctggattcaaccaactgtggatagaaaacatttgcaaagagaaacaacaacaacaaaaacaacaacaaaaaaccccacacacaataaaaaataatgcaacaataaaaaaaaatacaaaatttaaaactaatacaatataataactatttacatagcatttatataatatttgatgttgtgtaatctagagaagatttaagtatactggaatatgtgcataggttatatgcaaatatgatgccattgccattttctatcacggacttgagcatctgtggattttggtatctataaggtgtcctgaaaccaattcttcacggatatcaagggatgactgtatatcaatcctattttatgtattttctttattcctttatgttagctttcaaattctctacattaacatgtgttagtttttttataatcaggaaaaaatttcaataaatttttttacaagaaaacattatgtactgaaaaaagttaagataaatctcatcagccagaggacattactttcaacattttgctttaaagatatgtttttaatcctgttttatctatgcactttttagttgttgtttacttgaaaaaacaagttaaatacataggaataaaatatgatcctgtcactgtttataaaacaatatatttctacaactaatactaaaagtataaaatttcattatatgaactgtttcttaaaacaattccatattatcagacatctaatttatctccagttttttgcaattataaacacagtgatgaacattcttgtaactcaatccttattcacatgaaaatttatttcctcaagttagaagcggaattgctagttgaaaggatattttagagtttttgacacttaacaaattgccctccaaagaagctgtaccaatatcagacgcccacagagatatatgaaagtatcttgtttcctattttggtattggaaattactataaaaaatcttaaggctgggtgctgtggctcatgcctgtaatcccagcactttgggaggccgaagctggcaaatcacgaggtcaggagttcgagaccagcctggccaacatgttgaaaccccgtctctactaaaaatacaaaaaattagctggacgtagtggcaggcgcctgaaatcccagctacttgggaggctgaggcaggagaatcgcttgaacccgggaggtggaggttccagtgagccaagatcacgccactgcactacagcccaggcaactgtctcaaaaaaaaatctttgccagttatcaacagtaacagaaagcaggtcagtggttgtctggggagtggagctggtgggagtgacagattgcaaaagggcatgagaaatcttttggtgagatgaaaatgtcaagactgattaaactgtagacattatgtgcagtttattatacttcaattatacctcaataaagttgtaaaaaaaaattgccaatttgacaaatggagtgtcatattactgatttttgttttttactatctgcataaacattatatatattttagtttaaagaataacttaaatgttataattctaacttctatactcaatttaaaaaatcaagaaacttaacagcattacttcagtattgttattatacaggactaatgggtttgccaatagcaatattataaagcaacaaaaatgctctccacactcaagagaggcattacctcacagcataagaacgtggagttcaggctctcctattctacagtaaagcctaagtggacttttcttcacaaataaagattactttctacagagttcaactaacagactagtcatagaaatagcataaaaacatagatttatgtggtcaagaactgaatgacttttaacttgaacatcagtaacagtatttggatgggtgttaattcacttaggatcttcctgttgtaaatttaagtcgcttttcaatagtataaagatctaaaagtagaatcaaagagtaatttagggtatgcatatttaaggaccttattttgctaattaggtttctcccaaaaaactaccccagttcatacttctattagtaggatgtgactgttttcccacacttctcccacaacacgtttcagttactctaaataatcattgccactctacaataattcattgttaatttatttttgtttggttactgctcaggataaactttttctcatgtagctactttaggtctgtgccttctttgacctcaattttgctcatggacttcaaccactacacttccctcgctcaggcttgtaacatccattatattcattcaccctttatctgaagaggtcctgaacccattctgccatcatctatcttttgtccctggttttgcctttgatgctcccatcttggtacagtctataactacagtacacagttacaatgcagatacaacatgggcactgttctagtactttacttctcatttaattcccataacaaccatatgaaatgggcattattattttcctatattagagatgaaaaaaactgaagcatggagaagatatgaaactctcccaaggtcatatggataataagcagcaatgctagaatttgactccaggcagtctgcctctagagtttgaatacttaaccattaccttaaatagcctcctaaaagaacaggtaggaaactaaatgcaacatctcaccagctccaaacccctaaggcttaaatccagtaagtaaatgcccggggtttgcccagattggttccaaggatgacccatgtcatgatggttgtccctagatgttccagagatgagctcaccaaaatctcactgaagtatacagagtttatacatgattttaaaggtctaaagttgccagggactgtgatatcttaacaccaggctattgtacccacttgacatgtttttgctcagtagatctgtgcttctttcagatgggtatatgaatcctctggcacacaaatcttcctggagcatctttatggagctccagttcttactgaagagttgaagagggacttttgaattggagagctcttaaaaggttttataagcgaacttaggagaaccttgcctttcaatgatcactgatgtcatgattctttcagagatgctgaagaagataagtgtttgtgagtagcaagtggtatcagaggtattaaaacacagcaagccaggcagcaagaaagataatgccactgatccaaatggttactgccactccactggaactcccagtttctctggaagtccttggaatgggcatagctatttcacaacaaataatttcttttcatttttcacagaaaagctttgaaaaaaaaaactttgtttccattgccagcttgaatttacgcctcaacaatgttggactataaatttgtttataaatacccaaatatccaataatactcaggcccactttgctacagtgagtttttcacaataaaaaattataattaaaaattcttaagaactagaaacaggggcttctggttcaaaacaggaaatgtgagaaaattatgaacaacagcatgattatctgtctctagtgatttttaaaaatcatttatatgagaactggtaggctctaagtaaggtctgtagtctagttcattgtattatgacaatttcctagttttgaaaatgtactatagttatataagacatcaccactggaagaagctgagtgacgggtacatgcaacctctttgtaccattcttataacttcttgtgagtctatcattattacacttttaaaagtttttttgaaagcaccgttttatgctgctttgggcctctccctcaacatagagaccccagaacagggtggtgatggggacaccaaagtgggaaggactggtggcagcaccattcctagatatagctctgaggataagcagggctggcactggcaatgcctgctccttgacaactttgctcacggcctttgcctaatgcacaggccctggctccccaggctctgggtgcttgacttttagctacatgaaagcaagggagatcctgatgacagtgtgggcctcatagccgggaccttgttctctcccagggtagcctgaggccacgtattagttaagagtacatgtgacccaagggagcctactggaccaccatggtcatgtccctgaaggtcagggacaggtggaatgcatccttggcatgatctttagctactagactgatgtgagctacagaaatcccccttcctgctgccctgttgttgggatcaaatcgaacaggtagtatttgtaagtgactccacctcttcttttacacacagctcactgcaaatctggtcttccagataaggccctcagacccttagttctgcctaatttttaagccaaatatatactacttatgaaatcaaaaatcaacaatgcaaaatataaactcttgtggaaaactaaaaagagaaaatgttagctaacagcaaaacaatgaaaaaataaaaaaataggtaaataatttgttagaggtttcttcttaagatcagtttcagaatcaccttggaaacgaaaaagacacactaaaaaaagagtcattactgaacagatttttttttttttttttttttttgagacagagtctcgctctgtcccccaggctggagtgcagtggcgccatctcggctcactgcaagctctgcctcccgggttcacgccattctcctgactcagcctcccgagtagctgggactacaggctcccaccaccatgcctggctaattttttatatttttagtagagacggggtttcaccgtgtcagccaggatgttctcgatctcctgacctcgtgatccgcccacctcggcctcccaaagtgctgggattacaggcgtgagccaccacgcctggccaaaatgatgtattttaatgtgctcaaaaagcataacctgaacagtggtgaaaatcaaccttgctcttacccttagagttgaacggaagcactgattttattaatttgtgcattttattggtcctttttttcctgctacatttaacataatgatgtatgtgaagggttcttaatttggtgaatgtttatgaataaaattactgacaaagaacttttcaggaagatgtttgccttttggtgaacacagtaccaacgggaaaatgcacttagtccagtcttgcccccaaaaaggcagaatcccaggtcatgacatagcatccagcacacctccaagaggaagaaggaggaatacaaaatagtaaataatacatattcctcaaaacaccaataatgaacagaaataacagcaataaaggtttttcaaaaatgttttaaagatcaatttatgatgaactgggaaatgcctttggaaagcttgtaccttagtcaaataaaagtgcgagtgagttttcaaattcaggactggctgctattttttctttaaaacaggcaaatggaaagtatttaataacaaagaatataaacctgggtatggtgaataaattcatcattcatcttttttttttaaaccttacacaaatgcagtaacttatacttttgccagaaattttctttaacaagaagattctggagcccaaagtgagtcatgcaaatcaaagaacagtctggcacaggggttattaatagtgatccaagggcccctaaatagtttgaaataggttgacttcacaacaagggcagtgcacattgtatatgactcagagtcagtgtggtgcagggaagtgattggggagttcaggaattccccagaagcgcattcaccactcatcttaataataaggaagatttcacttagttggcttatttagaagaaatttttttcaaggctcagcttttcaataaagacacaactgtgactatttctaccaagtaagacaaaatagttgctgtgaaaatgatgtttgagagcaccttgtgaggataatgagtcatcttcaatttttagtttatttaagtggggttaaaatgttgctcgtaaaataaagatcgttcttcttggttatgattcttctcagaaaaactccattagttatgatttccctacgacagaaaaacaccaaaaaatggattatataagtctgacatatgacaaaagtgacctgatctctcagcaggaagaaacacatactgaaatgtctaccgcagcagcttccaaacactgcaccacaatactcctctgccaggattcctattgcttcctagtcaatacctgcaaacggctcacaatacaataatagtacaatacaataacaataataattctggctaaaactcatagagtccttactagatatcaggcttgttccaaatgctttgcatatattagtttagtaatcctcacaatgaccctcaagaagtagggactatgaatattcccattttacacttgaaggccctaagacacaggtgatatgactggcttaaagtcacagccagtaagtggcaggtgttggggcagtatccaggcatctggctacagtcagcaagtataactacctttcagtagtaaaacaaataaaccaagaactactgttcttatatctatacatttaagaagttctgggcatttagattcttgaaatattctaacaccatgatagagacaagaaactgtcaagatattgaacttcatttcttcatttcagacctattttctaggctcaatgaacctcagtctcccctctcatagtaaaagaaaagatggaggtcagtgcagtggctcacacctgtgatcccaacactttgggaggccaaggcaggaggatcacttgaggccacaagttcaaaaccagcctgggctatacagcaaggtgctgtctccataaaaaattaaaactttagctgggcatggtggcatgcacctgtagtcccagctactcaggaggctgaggtaggaggatcccttgagcagaggagttcaaggctgcagtgagctataatggcaactctgcactccagcctggacacactgtctctttaaaaaagatagagagagagagagactgagatttttctcactgtaaaaccacccattgggaaaaatgtaaaaataatgcacttggctattttcacaattttgtttgtgggaagaaaataaattcaaatattaggttcacacaaagaaaaacttaagcacagccttaggatgaaagaacttaacccacaaaacactttcttacaattctccttatatgatctaattatgatttaacaatttactacacattagtctattattcagtctattatatattattcagaaacttatggaagaatccacaatattattaataaaaacaactaactggaactgtataaatattaagtactgggctgggtgcagtggctcacacctataatcagcactttggaaggctaaggcaaaagggctgcttgagctcaggagtttaagaccagcctgggcaacacagcaaaacctcatctcaaaaactgtatttttaaaataatatatatatataaagtacttatccaatttttaaattttcttgtaaaaataacaaattcactttttagaaccaggaaagaagcagcctagcaagaaataaaatttagacaaaacacaccttagtccagccaaatacacacaaaaaaacctgttctcccacttttatctatgtatcaaaggcagagagggactttcacccttgcaaagctgtaacaactctccccaacttccctgatgtggtagtgtcagaaaaaactgagtaggcagcttggactttcatcctagccccgtggtgtcagtggagatcatgtagggacactaaacttctacccccacctagcagtaataggatgccccccacctccgtgctggagtggtgtcaggagagaataaaggagaatcagaactagtgggaacaaggtcacctcactatggtgtcagtggagaccatatggggaccagaatttccactcaatccagggctgggggtaggggaaagggtatggctataacagcacaacatgaggaactctcatggtgacagaactgttctgtatcatatttatattaataccttagttgtgatattgtactatagttctgcaaggtgttaccagagataaacaaggcaaagggtccataggatctctttgtattaattcttacaactgcatgtgcatctacaattttctcaaaataaaatttttattaattattttaaaatttattgtagagacaggatcttgctatgttgcccaggctggtcttaagctcctggcctcccacttcaacctcccaaagcattgggattacatgcatgagctaccatgcctggccatcaaaataaaaagtttaataaaaaagaagtcttgggtgacaccagcaagatggtagaacaggaagtcccagcccttattcctaactcatacattgatttaacaatgatatacagaccaaaatacctttttgagaattccagaatccagttaagaagttgcagtatcccagatgagcacaaagccaagaatggccacactgaaacatgtaagaacaatttcactttacccacaccacccccctaagtcagcatagcttagtgccacatagcttagtgccgggagagagcattccagatcacaacttctcccttggggtaaaggtgagtggaatgtgcatccaacattttacgttttcagagggcttcccaagggactaatttttgtcttgcttcacttggagtgccgacagagccagcatattttggatacctgggatatttagttttcccggcaccatttgttgaaaatgtggtacacatacagcatggaatactatgcagccataaaaaagaatgagatcatgtcctttgcagggacatggatggagctggaggccattttccttagcaaactaacacaggaacagatattaaatactgcatgttctcacttacaagtaggagctacattatgagaccacatgaacacatagaggggaataacacacactggagcctatcgaagggtgaagggtggagggtggagggtggaaggtggaaggaggtagaggatcaggaaaaataactaacaggtactaggcttcatatctggatgatgaaataatctgtatgacaagcccccatgacacagtttacctacataacaaacctgcatgtgtacccctgaacttaaaaaatgaaagttaaaaaaaaaagaaaatatactcagtgggtcctcaaataatgttgttttgttcaacatcattttgttataatattgatgagaaaaaaaatcaaatcccacctgggccactgtcttatgtggagttctcatgttctgcccatatctgcactggttttctccaggtcctccagtttcatcccacatttaaaagatatgcatattaggttcactggcaggtctaagttgtcccagtatgggtgtcgtgtgtgtgtgtgtgcgcacacgcgtgtgcacatgtgtcctggaatggaatgacatcctgtccagagttggttcttgcctttgctccctaagctgctaggataggctctgaccaacctcaatcctgaactggaataagtgggttagaaaatgaatgactgaatgtatacaaatgaatgtaaaattaaaatctgtaaaatgcacaataatcatataatatggtttggctctgagtctgcacccaaatctcatgtggaattggagtcccagtgttggaggaggggcctggtgggaggtgattgaatcatgggggcagacttcccccttgctgttctcctgatagagtgttcacaagatttgcctgtttgaaagtgtgtagcacctcccctgcttgctctctctctcctgctggccatgtgaagatgtgcttgcttcccctttgccatctgccatgactgtaagcttcctgaggccttcccagaagcaaaatcctgaacagcctgcagaactattatccaattaaacctcttttctttataaattactcagtctcaggtatctctttacagccctgcaaaaacagactaatacattacacaaatgcacaacaataaacaatgcagtataaaagtgttcagtgagcccaccatatttgttattgtttgttttttaattgtgtggtggtaggaagtactgcttacaattttcactttgcaaacatttatactttgatttaacccaccaccaccatgactgctatcactcacttattcaccccacattgagtaaacaattatcttgtttttattaaactttcttaattgtacatgtaagctcatatttatttcaatgtttaatattacaatttgggtctttattgagaagtctggtgatatttctctaaccacaaatatgttgtgagaacttaactcttgtttatatcaatcagcctatgataaaactgatttcgttatatgtcatttcacttaaagtagtagtttccaagaacctatcaatgatgttaagtaagaacttactggatttaatttttttagtggtaaagcaaaaaaaagaagtctaatgttctgtattaacacaaaatgtaataaagtaaaaacaacaatagtacattggtaaatgcaccagactggagcccagctatctgggtttgagttgaggcagcagatattctccttatcatgctttcttcatctgtaagatgaattagtcttaaggaacttttcatttctttcagccctaataatctatgaatcatcttaacacaaaccagaaagcttggaataaaagaacacacttgaataacatcacccaaaaagcctgttgagtgttttttaaatttgactattactaaagtttttttaaatcttaagaaaaatcaagtaatgtagatggctgtgtcactgatgtaataatagttaaaacaaacatttcacatagtttctcagccatttagtgtttttacatgatccacccaaatatcaatctggtatctgaaacaatagtttgaacattttccatgtaataaaacatcttaaatgttttataaaaaaagattctggtacatgatatataaaacattctttcaaaaaaatgcgtacttaattttaatggaatttcttaaaaacactattctctttttttcctttaattatcagcaaatgatatatctagaaataaaggtgctgtctagtggcaactgcagagaccctggagtcagaagacatgagttcaagtcttcactacctttaactaagagtgtctttagacccgttataaaatcaactgagcctcaattttcctgtatgtaaaacatgtgaggttggacattctccaaccttttcacacttaagcctccttatgttgtttttcttctatgtataccatgcttaaaggatctgtctttcagacagactgcatttattaagtaataataaatcatctttcaaagactgccaacctgagattcagaacatcttgaggtctgaattcaaataaaattctaatccaaagcaaagcaatctactaagagtaactgtattacttccattaggttgctgaaatactaattatgccaaccattattatattgaatccaacaataccacgctgagaatctcaggtctggatcacacctaaattcctagaattctaattgttatatgttataaactactcaaaagatcattaatacagtggggaaaaaagtgaaaatgcaattcttgcatttgctcaaatactgagcaccaacaatgccagacactgtgctatgtgatttactttttaagattaaaaaaaaggccgggcgcagtggttcacgcttgtaatcccagcaccttgggaggccgaggcgggcagatcacctcaggttgggagtttgagactagcctgaccaacatggagaaactccatctctactaaaaatacaaaattagccaggtgtggtggcatatgcctgtaatcccagctactcaggaggctgaggcagaagaatcacttgaatccgtgaggtggaggtggcagtgagccaagattacaccactgcactccagcctgggcaacaagaaaacgattaaaaaacgattaaaaaaattgatttttttttcaaataatatttgtctctctctcttttttttttttaagatgaagtctcactcattctgtggtccaggctgcagtggcacaatctgtgctcactgcaacctccacctcccaggttcaagcaattctcccaccttggcctcctgagtaattggaattataggcatgtgccacaccatgcctggcaaatttttgtatttttagcagagatggagtttcaccgtgttggccaggctggtctcaaactcctgacctcaagtgatctacccacctcagcccctgaagtgctgggattacaggcatcccaccttttcttactcgctgggggggaggggggagttgggcaggatggtggtgtttatcttaaatatggactcgtctttcaataagcaatttcatctttaaaaactactgaaatcatcaataataccaaaaagggtacattataataaacaaatactttctaaaaaaatgaaagaatgaatgatgcattaacattatacaaagaagttttagggaaactatctgcactgccttcctgaaccttaatagttttcaaccatacagttagttccctgttgcttattttagtgcttcataattgatgctttgactactctcacatctcttatttctgttgccaaggaaggagatttttgtcttttcaattacttgtactccatgtagtacgtgcaagaagattacagaccaagtacatctttattcacatttgtttaaaacacacattactttaaactgactcatgttaaaacacaagaaagactcaatgattaagctgggtgcagtggctcatgcctataatcctaacactttgggaagccaaggcaggatgacttcaggccaggagtttgagacaagcctgggcaactccacaagaccttgtctctagtcgggggagtgggggcaaagctgggtgtggtgccacgtgcctgtaaaattagctacttgaaaggctgaggcaagaggatcccttgagcccaggagttcaagtctgcaatgagctatgatcatgccactgcacaactgacagaattttgctaacagagtgagaccctatctcaaaaaaaaaaagacaacgattaaaactggcacatagatagttagatgaacagaggagaacagaaagtctggaataataccaaattcataatcttagtatatggtaacagtgaactctcaatgcagtggggaataaagttgggtccatactttcagtataagtaacagatggatcaagacttcaagatttcaaaaaatgaaactataagagttccagaagataacttaaaagaaatgttttgattggaggttccaagatggccagataggaacagctccatgctgcagctcccagtgtgagcgatgcagaagacgggtgatttctgcattccaactgaggtaccaggttcatctcactggggcttgtcggacagtgggtgcagcacacggagcagggtggggcatcatctcacctgggaagcgcaaggggtcggggaattccctttcctagacaagggaagctgtgacagatggtacctggaaaatcaggacaccgccaccctaatactgcgcttttccaacggtcttagcaaacggcacaccaagagattatatcctgcgcctggctcagagggtcccatgcctacagagcctcgctcactgctagcacagcagtctgagatcagactgcaaagtggcagtgaggctgggggagggccgtccgccattgctgaggcttgagtaggtaaacaaagcagccgggaagctcgaactgggtggagcccaccacagctcaaggaggcctgcccgcctctgtagactccacctccgggggcagggcatagctgaacaaaagtcagcagaaacttctgcagacttaaacgtccctgtctgacagctttgaagagagtagtggttctcccagcatggagtctgagatctgagaacagacagactgccacctcaagtgggtccctgacccccgagaagcctaactgggagacaccttccagtaggggctgactgacacctcatacagctgggtgcccctctgagacgacgcttccacaggaacgatcaggcagcaatatttgtcattctgcaatatttgctgttctgcagcctccactggtgatacccaggcaaacaggatctggagtggacctccagcaaactccaacagacctgcagctaagggtcctgactgttggaaggaaaactaacaaacagaaaggacatccacaccaaaaccccatctgtacgtcaccatcatcaaagaccaaaggtagataaaaccacaaagatggggagaaaccagagcaggaaagctgaaaattctaaaaatcagaatgcctcttctcctccaaaggaatacagctcctcgccagcaacggaaaaaagctggatggagaacgacttctacaagttgagagaagaaggcttcagatgattggtaacaacaaacttctccaagctaaaggaggatgttcaaacccattgcaaaggagctaaaaaccttgaaaaaagattcgacaaacggctaactagaataaacagtgtagagaagactttaaatgacctgatggagctgaaaaccatggcacaagaactacgtgacgcatgcacaagcttcagtactgatttgatcaagtggaagtaagggtatcagtgattaaagattaaactaatgaaataaagcgagaagtttagagaaaaaaagagtaaaaagaaatgaacaaagcctccaagaaatatgggactatgtgaaaagaccaaatctacgtctgattggtgtacctgaaagtgacggggggaatggaaccaagttggaaaacactctgcaggatattatccaggagaacttccccaatctagaaagcctccaagaaatagcagactatgtgaatagaccaaatctacgtctgactggtgtacctgaaagtgacgggaagaacggaaccaagttggaaaacactctgcagtatattatcccagagaacttccccaacctagcaaggcaggccaacattcaaattcaggaaatacagagaacgccacaaagatgctcctcaagaagagcaaccccaagacacgtaattgtcagattcaccaaagctgaaatgaaggaaaaaattttaagggcagccagagagaaaggtcatgttacccataaagggaagcccatcagactaacagcggatctctcggcagaaactctacaagccagaagagagtgggggccaatattcaccattcttaaagaaaagaattttcaacccagaatttcatatctagccaaactaagcttcataagtgaaggagaaataaaatcctttacagacaagcaaatgctgagagattttagtaaatgggctaaatgctccaattaaaagacagactggcagtttggataaagagtcaagacccatcagtgtgctgtattcaggagacccatctcacatgcagagacacacataggctcaaaataaagggatggaggaagatctaccaagcaaatgggaaacaaaaaaaagcaggggttgcaatcctagtctctgacaaaacagactttaaaccaacaaagatcaaaagagacaaagaaggccattacataatggtaaagggatcaattcaacaagaagagctaactatcctaaatatatatgcacccaatacaggagcacccagattcataaagcaagaccttagagacctacaaagagacttagactcccacacaataataatgggagactttaaacaccccactgtcaacattagacagatcaacgagacagaaagttaacacggaaatccaggaattgaattcagctctgcaccaagtggacctaatagacatctacagaactctccaccccaaatcaacagaatatacattcttctcagcaccacatcgcacttattccaaaattgatcacagagttggaagtaaagcactcctcagcaaatgtaaaagaacagaaattataacaaactgtctctcagaccacagtgcaatcaaactagaactcaggattaagaaactcactcaaaaccacacaactacatggaaactgaacaacctgctgctgaatgactactgggtacataacgaaatgaaggcagaaataaagatgttctttgaaaccaatgagaacaaagacacaacataccagaatctctgggacatatttaaagcagtgtatagagggaaatttatagcactaaatgcccacaagagaaagcaggaaagatctaaaattgacaccctaacatcacaattaaaagaactagagaagcaagagcaaacacattcaaaagctagcagaaggcaagaaataactaagatcagagcagaactaagggagatagagacacaaaaaacccttcaaaaaaaatcaatgaatccaggaagcggttttttgaaaagatcaacaaaattgatagaccgctagcaagactaataaagatgaaaagacagaagaatcaaatagacgcaataaaaaatgataaaggggatatcaccacccatcccacagaaatacaaactaccatcagagaatactataaacacctctacgcaaataaactagaaaatctagaagaaatggatagatttctggacacatacaccctcctaagactaaaccaggaagaacttgaatccctgaatagaccaataacaggctctgaaattgaggcaataattaacagctaccaatcaaaaaaattccaggaccagatggattcacagctgaattctaccagaggtacaaagagaagctgataccattccttctgaaactattccaatcaatggaaaaagagggaatcctccctaactcattttttgaggccaacatcatcctgataccaaagcctggcagagatacaacaaaaaaagagaattttagaccagtatccctactgaacattgatgcaaaaatcctcaataaaatactggcaaaccgaatccagcaacacatcaaaaagcttatccaccacgatcaagttggcttcatccctgggatgcaaggctggttcaacaaatgcaaatcaataaatgtaatccagcatataaagagaaccaaagacgaaaaccacgattatctcaatagatgcagaaaaggcctttgacaaaattcaacagcccttcatgctaaaaactctgaaaaaactaggtattgatgggatgtatctcaaaataataagagctatttatgacaaacccacagccaatatcatactgaatgggcaaaaactggaagcattccctttgaaaactggctcaagacagggatgccctctctcaccactcctattcaacatagtgttggaagtcctggccatggcaatcaggcaggagagagaaagaaagaaagggtatttcattaggaaaagaggaagtcaaattgtccctgtttgcagatgacatgattgtatatttagaaaacctcattgtctcagcccaaaatccccttaagctgataagcaacttcagcaatgtctcaggatacaaaatcaatgtgcaaaaatcacaagcattcctatacaccagtaacagacaaacagagagccaaatcatgagtgaactcccattcacaattgcttcaaagagaatacaatacctaggaatccaacttataagggatgtgaaggacctcttcaaggagaactacaaaccagtgctcaacaacataaaagaggacacaaacaaatggaaggacattccatgctcatggataggaagaatcaatatcgtgaaaatgggcatactgcccaaggtaatttatagattcaatgccattcccatcaagctaccaatgactttcttcacagaattggaaaaacctacgttaaagttcatatggaaccaaaaaagagcctgcattgccaagtcaatcctaagccaaaagaacaaagctggaggcatcatgctacctgacttcaaactatactaccgagctacagtaaccaaaacagcagcgtactggtaccaaaacagagatatagaccaatggaacagaacagagccctcagaaataataccacacatttataaccatctgatctttgacaaacctgccaaaaacagaaatggggagaggattccctattcaacaaatggtgctgggaaaactggctagccatatgtagaaagctgaaactggatcccttccttacaccttatacaaaaaaattaattcaagatggattaaacactgaaatgttagacctaaaaccacaaaaaccctaaaagaaaacctaggcaataccattcaggacataggcatgggcaaggagttcatgactaaaacaccaaaaacaatggcaacaaaagccaaaattgacaaatgggatctaattaaactaaagagcttctgcacagcaaaagaaactaccatcagagtgaacaggcaacctacagaataggagaaaatttttgcaatctacccatctgacaaagggctgatatccagaatctacaaagaacttaaacaaatttacaagaaaaaaatcaagcaaccccatcaaaaagtgggcaaagaatatgaacagacacttctcaaaagaagacatttatgcagccaaaagacacatgaaaaaatgctcatcatcactggccatcagagaaatgcaaatcaaaaccacaatgagataccatctcataccagttagaatggcgataattaaaaagtcaggaaacaacaggtgctggagaggatgtggagaaacaggaacacttttacactgtaggtgggactgtaaactagttcaaccattgtgcaagacagtgtggccactcgtcaagagtctagaactagaaataccatttgacccagccatcccattactgggtatatacccaaaggattataaatcatgctgctataaagacacatgcacatgtatgcttattgcagcactattcacaatagcaaagacttggaaccaacccaaaagtccatcaatgatagactggattaagaaaatgtggcacatatacaccatggaatactatgcagtcataaaaaaaggatgacttcatgtcctttgtagggacatggataaagctggaaaccatcattctgagcaaactatcgcaaggacagaaaaccaaacactgcatgttctcactcataggtgggaactgaacaatgagaatacttggacacagggtgaggaacatcacacactggggcctgtcatggggtagggggctgagggagggatagcattaggagatatacctaatgtaaatgacgagttaatgggtacagcacaccaacatggcacatgtatacatatgtaacaaacctgcacattgtgcacatgtaccctagaacttaaagtataataaaataaataaataaataaaataaaataaaaataaagaaatgtttttaatttcagagtcggaaaggtattatttattatacccaacttacacatgctataaaagaaaagactattttaaaatgtcattcaaatatattaaaaagaaaaaccaaactttaaaagaaaacagagaagaattttcatgtcataaaggcacacagatgcacacagtcctaccaagtaaaaaaaaaaaaaaagagagaaaaagactaaccaatctaatgtccaaagggacatcagatatggttatgtcattcacagaaaaagtatagaaatggctcatagatctaccaaatacatagtctcattcttaataagagaaatgcaaaataaaactatactgaataccatatttcaactatcaaattggcaaagattcaaaactttgatagcacactgtgttcctgaagctgtagggaaacaggaaatctcctacactgatggtagagacgtaaactgctgtctattgacagtactctggcaacatccatcaaaattaaaaggatacatactctgtaatggagtaattccatttgtaggaatttctccaacaaatatgctaccacatacgtaaaattacttatgtatgaggtttttacatggcagataataggaaaatactataaacaatctaaatatccatctgtgaaaaattgattaaataataataaatccctatacatatcaataggaaaggatcttcaggacatactgttaagctaaaataaaatgggtagaacagcatgttcaaaaggctaggggattgaataatatatatttgaatttgtgtgtgtatatatgtgtgtataaaatgtatatacatttatacatatgtatataaatcatatatataaattctgggacaatacacacacaaaaaaccacaagttacctgcttgaaggtcagggtggccactgcactaatgaggacaaaaaatacggagagctgttttgcatttttaatttttccccatttaaaaaccccagtaaaaatagaaaatgaaaaataaaattaatgaaatagtggaatttgaactaaacttcaactaaattcatcatcaaaaatgaaattgaaggtaaaaaacgataaaagatttctacttgttacagcatggaaaattagatactttgaagggccctcccactatgaaacaactggtatttcttgtaaatttgaacttacacatattatattccactcccagaaactcttatacatgtgcacccatagaaatgttcaaaaatgttcataataatattgtttataatcacaaaatcctgaaaatatcccaactgtggaccaacagatgaatggataaatcattatgggatattcacatagtggatgaaatactttatgtaacaaaacaaaataatcttaaattgcaatcttaagtggggggcgggagagggcagaattccagagggcaatataccatacgacgctatttttctaaagtttaaaaaaaaaagcaaaattaaataagtactgataaggactcatttatttgatgaaattatgaggaataaagggtggggcgactacatataaaattcagagatagtggctacttctgctgggggaggcatagccaatgggggatatgaaagaggagaacaaaggtgaaggtaaatatattggtaatgtctagttcttaaattgggcggtgggttcatgggtgttcattatcttgcttcataagttatataagtgttaaatacgttatgcatcaaatattgcctatttttctttaaaaataatagcagttaatgtttcttcacaaattgtaatacactttaagattttataaaactccatctttctagacaaactgaatgagtaattaggagcattacctttattttctccttatgcttactgtaaagtttctttgctaacagagaaaagcaattaagtagttcttaatacttcaactttgaatttctgcaagatatttatctgtgttatcattacagtctgctcctaattttgaaaagactaattttaaacaccttttgatccccatagacctcttagaatacacagtacatattctaaatttcagcatacatttcagaaattgaaatttcattcagactctagaaaactgtttcttcttctttaccttcagaaaagtttcctcaagacttcagtatacagataattctgcttccctagctgtttaaatataatatttatggccgggtacactggctcacgcctgtaatcccagcactttgggaggccaaggtgggcagatcacaaggtcaggagatcgagaccatcctggctaacacaatgaaaccccgtctctactaaaaatacaaaaaattagccgggcgtggtggcaggcgcctatagtcccagctactgggaaggctgaggcaggagagggcatgaacccgggaggcgaagcttgcagtgagccaagattgcgccactgcactccagcctgggcgacagagcaagactccatctcaaaaaaaaaaaaaattatatatatatatatacacacacatatatataatatttatgtttaaatgcagtcagattgtgtatttcaggccaaagtttgtaaatgtaagtgttttaaatattcatttttttctgattataaaaccagtatatgttcattatggaaaactaatctatttttccgtatgttttagccaagccctacaaagaaatgggcctaagctctgtatacttatggctaattcccttcagaatgacaataagtcagagtcccatcagcagcatgtgacagtctgtttccccaacagttggaagtatcatttttaaatccctgacaatttgcgtggatcagaaatttcataacatttatttttaatccccattttcctgattgctaaacattttttcatgatttcttatctgctctttttaaatgtcttcttaagacctttggccattggggtgtttgcctttttttaaaaaattgacttttatgtgtcctttgcatatattcaatttgttgctatgctgcaatttatactgtcatttgcctttttattttcttatgcggctccttgaacttgtttttagcatttacgtatataaatccatcttttttactttatggtttcatccgttgctcttatgcttagaaaaactatcatactgcaatgaataaatgcatcctaaaaatgctcatattatttccatttttaaaaaaaatgtatctgatatctttttacatgtaaaaatgagccaagcgagtttttaaaatcacaatttaaattcattaaatctttccggagaatattgcagaaaaacatgttatctgtgctaatctgattaaaaacttactctctaatttcagattctttttcctttaaatcaatggatcttcagagacagactcaactggtatgactaaaacagaggcaagcttaacattacctctaatcttccttcctagcttcagtaggcaagaaaggagaattcttgtcaatgtaattttttaaagactatagcttctcaccactcaggtaggtctaatatacagtcatcaatgtaaaagaaggatgatatcattctgaaatatttggatctttcctcctgtgttcagaggagaagcagcaattctacctgcaggctcaaatggacagcaatgagaatatgtatgttcccattgctcccaattgcttcagatagccctctatttacgggacctttgtttgaaaacaaccagatattcagggactgggctgcccagtacaagtaacccaccaatccttctaaataagatcactaaaagctggctacattcttacatttctaacacagtatttatgtctaaagaaataattaagttggatcactcagctttatatttacatccaattggctccaactgttttaactgtctcactacaaagtggtttctactatgggaaccccaaagggaatttgttcagggagctctctcaaaacactattaaagaaagtatatattaatctgtcaccttaaaagtccaacacttatatacctcccttctatctcccacccctacccacccccccaaaaaaaccaaaaaaacactagaggttctaaatatagtacatagcatttgggaaaccagcaggcaatctacccaatgtcatatcactgggacagtgtagcctcctggtttcaggatgttcagtgtttaataatacatgcatatgaaacaaaagtgacaaaaatattggtaagtcaactaagatcctaaagaggtcaataagaatgctatctcattccacaagtatttgtctttggtcatctctaatgaacctacaagtgccagcatatttcacaggggctaaataaaactttttaaaaggttaacggaaaaatatttatgtgaaaaatgcctccgaataatcttttagtgggtggatttggcacataccagtgaatacctttgagcttagtccaatcttgaattaagctacagttcaccttcaagaaactatgaacctgcttttaagtaaaagcctgtattaataagaaacatggaatgtgaatacaaaaagagatgttatcagctgaactgtatctaaatattttacaaagttttccaagagccgtgagctgtcagtagatctttaaaattcatgatctttttttaaaaaagttattcattcatctgtaaaaatctagttttttatgtgtacaccaagcataaaattgccctatgctaaacttaacataaacctcacattacagagttatgtgtttttattcttcaacataactattacagtgattcaaaggataaaaacacacttagaatagtctaccttctgctgcatttcagtacaatgaagaaagcctgagcagcacccaaaaactaggtccatattttaaatctgcaggcaatcaagcaaggaaaataaattgaggaaccaggctatgtaatcacaatcacttgcaaaaccatttaaactattttctagttgtaattgttagcagtttcctatgactgtaatcttttaaaaaatatcttccacttaaaaaattaaatgcacatgtacattaatgttttttgtctacttatagttaggtgctatgccagattaaaattcccctctttcccctttccaattctacattcccttttcatttttgtacattatggttccaagctaatttcgtattatttatccaaataatgggtggctaaaaatttgatctttaaaactacaattttgaagcaatgtagagtttaacaaaacataacaaacaaaaaaccatagtgagttagccatttcatgatgacagtgtttttcacaaagtaatatgttaccttttcagatgttattcaaggatgggtaatcattttataaatgttacataattaaagattctcaacattataaattagtatgcataactcttaacagagaaaattgaataataagatgtaaattgagttgttcaaggtcagacagtatgtcagtgaggcagccagcactggcaatctcaaattcctgtcttcccccacatgtgccatcccacaagatccctgctctaacctttgcctgcaaaatgctaactctggtattcttcacaggacagaaaccatttagaatagaatttcaaacttaagaaactgattaagaagttaacctaaatattaccataatatatgaatttaaattaattttcagctaattggtccatcatctgaatgatcaattcctaagcacagtccaacttcttcctaatgttgtatttaagtgccaatgagctggctcaaggggactcaggtttcacttgtgagaactaacccttggggaatgaaacagctacttttcagagctgggctgcccttatcctctatcgtaatccaaggaagggacaatccagtgttcattcaaagaactcttagagcagctttctcacctccttacagctgggaagagataacagaacattcttatttcaaagccttaatctgaaccattgtagaccatgaattcctaaagcattaaccgtctggttaagatttaagctggcttcaaatagttttctcacttctaactttatgtctcaagcaaacccgttatgcattcttacacatttctgatcacttaaactcactggcctctttgtgatattccttcccatgtctgcacaggacagaagtatcccccacttgtcatcccatgagatgtatcccttagcaagttaaaaaaaaacaaacacataaagctaggggccaaaacatcattgtttaatgatggagcctgcaggttatctataaagtgatttcacgttaaaattgtcaagttaataactatttgatctttatattaaaatacataaagtttatattctttgaaaaaaaagtttagtgcctgaatgtaactattcaataataagctatatattcttggtcaccatatgtatgcacaaaccatctgacagacaaaagtataagaatggaatttctggcacgcctacatagaatagtatcatttttataaaagacaagagggaggaggcatggaaggaaatcaacattcattacgtgcttactaggaaacaggtactgtgctaagtactttacataaaactgcaatcaatttcatgtttattacattccctcaccaaatcattataaaccaatatattcaaacatcaaaggaactgaacacaaactctaggaatcctgaactgattccattttttccttgggctatgtgctaaggccatcatattcatcacccctatttatacaggccaagggctcagaagcacattaatttaaattattcccagaaagcagccccaaaatgccattacctcactgaaataattcttttcaagaggctagttttgataatccaagaattcaattcttatgagcatactttgataagaatttgttactaatttcattatacatcaagagacgagccactaatatcaaagactaaaaccatggattacgataatttacagatttaagctttttcagtgcccagaggttgtaaagaagatagatagggttggaaatgggatagactgggtgtttttactagccaaatgttttgattcactgatttacagtaaaatgttaacttcagtgaaatagatacttttcaggaagtgagggagagtattaaggaaaaatgtctaaacgtccaatgtaaaatatcttgatcatatacatttgaaaaaaattagtaaactgaaattgttttttaagtgtttgacaatactgtaagtggaacaaagcagcaattttattcttacacttctgacatttcacttagtgactttaataaaatattaaaattctaatgactcagcaaaacgcaaaaaatgcttaggcaatgttaagtgaaaacaataaaattttatgtatatcataattatataaaaatttgtgtgcataaaaaataattggaactttgaaagttgatttgacagtataatcagcttatagataattacttctttatttttattataaaaattatttttatattatttaaattattttttatatttttatattttttataatgttgtttcaataaaaatggcaactttaaaaaagcatgtgatcactacatgtattaaatggcagtctgtctgcaatggcttaactgtgttaagtgtatctgtgtcttagttttccagctattctgtcagttccaggaaagcaaacaccaggactcctttgtaccctccaaaatacttaacacagcctctcagacccagacagacccaaccaatcccagtgacagctagtcactgagccactgatgaacaccaagtgcagacaacataaaaatgagaacttactattatttgttggttcaggaaacccaggctttggaccactccatcctttgttttcccctgtctgaaagattaaatcaatcgttcaaatccagagaaacaagcttattcaaaaagaaaaaaaaaaaggtgaccaattaagcaaaggcaaagtcctctcacatggttattctgcatattatctctatctttgaccctgggatgatggctacaaaagaaactaacatgaagggtatcatttattccttttctgcacctaaatctacttatgtccttctacttttgtctgatcatgtaaatttataattcaaggcataaagccaatattcaatatatgtattattagaatgtaagctctagctaggtggtgaaaaaaataaatctttttttttttttttgagacagagtctcattctgtcgcccaggctggaatgtaatggcttggtctcagctcatcgcaacctccacctcctagattcaaggattctcctgcctcagcctcccgagtagctgggattagaagtgcctgccaccacgcccggctaatttttgtatttttagtagagatggggtttcgccatgttagccaggctggtctcaaactactgacctcaaatgatccacccactttggcctcccaaagtgctgggattataagtgtgagccactaagcctggccaaaaagtaaatcttattaaaatagtaaataataatcatcaccacaaatgcttaagtgaccaaaagagcttttgtatgattcccgaggtcaaattaacaacctaacaatcaaacatttctgtagacaaaaatgttactatgtccatctagaaaagtcctatggtaagggtcaccaaatactgctataatgacatatacaaaaaatacaaatataaaaaaaataaaaaaataaaaaaatgacatatacaaaaaaattgaaaactaagtcctaactttaagtcctaactttaagcaaactaagtcctaactttaagcaaaacatgtaatattctgacttttgccaaatgattagtgtttggtataaaatacattctgaaatgtagatgctttgaagtagtaagtattcaaatcaaattaataagtgactttagttatattatctttctgtacagctggtaacttatctcttatgatgatcagcattttatatttatgttaacggtcaaaggtcaaatagataattaagcctagatataaacacaaaatacaattgctgcaaatagtttacccatgttcatttttaaaaaaaagttgttcttattgaattcattcctttttaatcatacatcttagggtgacaaggaaatatatagtggcagacagcagaagcaaaactgaaaataaagaatcctgaagagtaagttgacagtatgttagaaacaaccagcagcttcatatgaactagggagcatctctttctctctctaattagctcttttatctctttaaaacacaaattcctgtcttcatcaacatttaccatcctgagagattgctgctataacctttgactgcaaaatgctaacacaggcatccttcacaagagagaaattactatgtaataaaatagactgatagtagtaatagctaatagctaacactgaagatttaaaagtggggttgctaatgcgctaagtgttttgcataaatatggattatctcattttcatcctcacaaaaatttggtaagataagtgatattaacattcaattttacagacaagcaaacagggttagagttcctgtaattactctaaggtcacacagataatatgcacaggtgccaggacatcaaactacatcttctaactagaggagagtaatcatgctacctttgtactgccattatcaggagagaaaaaagaagctaaagaaaggaatgagcaaaaaagttacagattaagtaaaactgtgccatctaagaatgaaaagaaaaacagtgagatgaagaacagagtttggaactattaagaagaatgctctaaaggtacggccaggatggaaaggactactgcaaaaacaaatgagagaaaacagaagtagaccagttccaagggatgaaagaaatttaaaagattttgaaaagcagctaaaataattattcacatgaaaacctggtgaacagaaagaaacaaagtatgttcaatttttcttttacattcctaccatacttttaattttattcatacctccaaaacatagcctgtacttatcaaagtgctgacaactgtttaggttcttagagaaataattacgtttccagaatcctggagcagttctacaattagccacaggattctagtctttctaaacaagtttttcatttttaataagtggaattaataaaatctgttttatttgactaaactaatttcttctattcttaccttatgttacctcaatactatacaattggctggatgtggtggctcaagcctgtaatcccagcactttgggaggccgaggcgagcggctcacctgaggtcgggagttcaagaccagcctgaccaacatggagaaaccccgtctctactaaaactacaaaattagccaggcatggtggcccatgccggtaatcccagatactcaggaggctgaggcaggagaatcgcttgaacccgggaggcggaggttgcagtgagctgagatcgtgccattgcacaccagcctggacaacgagagtgaaactccgtctcaaaacatgtatatattatacaatttatccagtaggtaacatatgattttcatctgagagctatgcctaacttcaaaatttctttcttttaaagatcattgtttgaagagtaaggggaagaggtcaggagagatgaggtcaaagtaattactacgagaacttctctcttgaaaaggagaaacccagcaagcacaaagtacagttcatctcccaatccttactttctgtatttcttctactgtacccctcagacacaaacgagaaatataaaaggagatgatatggtttggctctgtgtccccaccaaaatctcacctttaattgtaataatccccacgtctcaagggtggaaccaggtagagataactgaatcaagtgggtggttccctcatgttgctctcttgatggtgaatgagtctgacaagatctgatggctttataaggggtttccccttttactcggtattcatttctctttcctgctgccctataaagaggtgccttttggcacaattttaagtttcctgaggcctccccagccagccctgcagaactgtgagtcaattaaacctcttcctttataaattacccaatctctagcagttctttatagcaaacaaatataggaggcaacagcaggaggtaagtcaaagtctggaaagtggaaagcagatgaagaagttgtagctagcttagcagatgtgagtaactgaaacctaacctgcagaggaagaagccaacaaagagctcacagtaaggtgatgtgtcacccagaaccctagaaagcctccagaattaggagtacacctggtacatttaaagatgaatcctggaaggggctgaaacagaaagatttgtctggaagtcttttcaaggtattatgaaatctccctatcaactctttgaccccatgcagtcaggtgcctaccccttcctaataggggtttcctgttgggagaggctaaaacagagaggctctggataccaggcatagttgagggtgaaatccatgtgtcaccctgcaaataaggagatgggagttccaaggtttcatactgaaaaataagattccaagactcttttctcatttgcccctcagaagacacatccagggttccaaaccacaggaacagaaagataatgaggagaacagaagaaaaaaaatgcaaaaaaaaaaaaaaaaaaaaatcctcaggcacataagagaaagactacacccattaaacaagaataggaaggcttaaaaggaatattctgagaatgaggaagaactctgggaaatcaaaaataaaatagctgatgtgaaaatgtcagagagggactagaaaacaaacttgaggaaatcttcctagaaaacagaacaacaacaaaaacagaaagagggggagaaaagaaaaaccacaagaccatccataagattggcatctcagaaataaataacagcaaaaataaaagtaaagaaattattaaagaaataagaaatttctcagtttaaagtatatgaatttctagattaaaactcaaatgtccaacacaatttatcaaatacacatataaaatacacatatctcagaacccctgagaaaatagaaaagcatcgagagggaagagaagggtaaaagtttcatatacaggctgaagaatcaggtgttgaaattttaacagcaatgctgggaggtacaagacaagggtgcgatgccttcccaactccgtgaaaatttacttccaatttagaattacagcttagaaaaaaactatcaagtgtgtggcaaatataaaaaaatttcagaccacaagatctcaaaaaaaaagtttacttcccatgtatccttcacagggaaggccctaaagtatgtactccattaaaacaagaaagtaaaccaagaacaagggaaactgtccagaaaatagtcaactcaacaaaggacagaggccagagaaattttcaggataatggtgaagagaagaaccttaacagcagctctgcagcaggcatatcgatcaatctgcaatacaagaggaggataaagagctctaagggttgggtagggtgtacgttgggaaaggaacgaaaaaaactgcatgatgtgcttgactggtaaagactttggggacagaaagatgtagaaaagtgtatgtgtggagtatgtaccagagttaaaccctcattttccatagcagaaagtacatttaatttttttacttttatattacttctcataatatttaaacatgagaaaccaagagatagcacaaactacccatagtggtaagtaataaaataaatagttacaataggtggtaaagtggttgcctctggcaaaggggaagcagaaatggccagtggcagggaaggagaacaggatattttggtattttaaattataaaccttgagtttttatactattaatcttgtataaattctgcctttttatatatgtattattttgagtatgagtactactttgatgaatataatgatcaaatacaaaaaagagtagtcatgtcttgacttcaacaaactccaagatattaagaaaaactctaagatatctgaatgaagaaaatcaagatgcaagaatggcatataaaaaagaggtgaagagagtattccacttttccttagaatctggaaacataacaatgacaaacagccaatctgaaaaagacaattgcaacttttcttgaaccctttagagacctgagattacaaggtaaacaagcaaaatgaattctagtgagtgataaatccttctgggagagataggactcacaaaaatgttaacagctttggcagggcagggatagcagagatgactgccatgaatgtaagtaagaagaaagtagatgaaatgttaaattcttaaagcctgagtatgagctagcatgatagtttagaaaaactgggagctccagacagcagctcttttccattgtcctgccctggattctcagaaggacaactggggctacagctgcagaccagagagagcccaacttggtgcaggaatgcagctggttaatggctgcactgagggataagcacagaaccttgccacttctctaggccattctccaatacaaaacaaaaaatttaagccaccgggggaagggtagaaacaaatcctatatgccgttggggcaaaggcaggaaattctctggtcctaagagctcagtaaagcttcattgcttctgaagaggattgaaagcaaaagctatatgctcctggggaaaaaaaaagatagaaaacctacttgagagtaagacactacaccagtataaagcagaggtctgcaaatgctgggaaatgtacaggaaactctctcatgcccaaactgcccaaaaatccaagataaaatttggttaccacagagaagacagcaaaaacagaaagatccacctctgacatccaggctcacagaatctgccagaaaatgaagctggacaaaaaaatcaagaactatgacacccaccacaatcccaggattaaataataaatagcagcagtctactacagagcctgaagagagataaccccatgccatgacacagcaaagaagagacctctaaacctgagggctgagcagagaaactgtgaaaaaatcctctcaaaacctcacattacacaaagcatgggtaacagcatatcactattgaaggaatttgtagttaacagtgactatggcaataacaaaacccaaaatgaattcagttaataactagactgatgcaaccctcgatccaaaaagtctgagagagagacatatgctgatttctcaacaaatactatttgacttagcctctactatttttctgttgcaaggtccaacactcattcaaaaattatgagatacccaaaactgcaagaagaaataaaccactgccaaaacacagggaagtcaacaaaacagggcccagggatgaccctgatgctagacctttcagaaaggtattttacaacacctatgattcataggttgaaagaccaactggaaaaagcagataacatacatgagcatatggggaatttcagcacaccaatagaaaccacagaacaaaaacataaggaaatcctaaacgaaaaatattagagatcaaaacattgatgtcattattaataatgcattaattcagactgcacacagctgaagaaatattgttgaacttgtagacaaatcaacagaaattactcaaactgtttaataaagaaaatcctataagacaataccaatggtctaatgaatgtataaatggaaactccaaggaaaagagggagaaaacaaggaataaaatatattttaaaagataatagctaagaacttgtcaaaataactgattccatgacatcaaatcacagatccaaaatgctcagagaaccctataaggacaaggaggatgacaaagatgaggatgaggatgaggaaggaagagaagcaggaggaggaagaggaagaggaggaggataaagaagacaaggaaaaggagaagggaagaagaaagaggagggaggaggagaaggaagagggaagaggagagaagaagaacaatagggaaggaggaagagaagaaagaataaagaggagatagaagaaagaggagaaggaagtagggggagaaggaagtaggaggagaagaaaaaacgagagaagaaatgagaagaaggaaggaagaggataagaaggagaagaagaaaaggtggaggaaaaggagaaggaagaaaaatagaaagaagggaggaagaagggtgggaaaagagtacaggggcagaggagaaaggaagaaacaaaaaaaatcaattagatacatcacaaccaaattgttggaaaataaagaaaagaaatatattaaaggctgagagaggaaaaaaaatacatcaacaagaacaagtaagaattacaacagactttacattgaaaattatgcctatcaggagacaagggagcaagatctttaaagtactaaaagaaacaggaaacccagaatcctatatccagaaaaaaataactttcaaaaatgaaggtgattcattggaggcttaaaaaagaaaaaataacgtgaaattttctgctagagcagtcactgaagagcagcagccatagttctgcattaccccatgcccatgggcctcaaccagggcccaaggtgaacaagaatatgagcaagctgaggcagggctgccaccctggacaccttaccaagcacacaaagcttgtgtaagacatcatctgggaggtgtgtggcttccccctgaaagtggcatgccatgaagctgctcaaagtctccaaggacaagcgggccctcaagttcattaagaaaaggatgaaaacacacatatgcaccaacaggaagcaagaggagctgaggcaatatcctgactgccatgaggaaagcagctgccaagaaggtctgagcccccaccccactttgtgtataataaaacctgcaaagaaaaaaaatgaaagtgaaataaagacttttttggcaaacaaaagctgagagaatgcactgcctacagatctgctaaaataagtaatattaaaggaagtccttcaagcaaggaaggggtataataccagaaagaaatttgaatttacacaaataaatgaaggatattgaaaataatcaaaatgagagtaaatataaaaggcattttctgctgattttaatcacttaaaaagataactgactatataaagcaaaattagtaacagtgaattgtacggtttgaaaaatatagaaaactaaaatgtatagccacaataggaggtcagagaaacttagagaagtaacctatgtgaccacaatagaggtcaaaaaagaaaaaaagtaaacagagtaagtgcggggaaaaaaaaaggcaactaataaaatggtgtgtttaaatacaacaatctcaataacttcagtaagtgcaaatggtctaatcaccctaactaaagggcaaagtttgtcaaattaaattttaaagaacaagacccaattatatgctttctaaaagaaaccaatttaaagataggttaaaagtaagcacagggaaaaaaatatcccatgcaaacaccagtcaaaataaaactggagtagctatattaatatcaaacaaaacagatttcagaacaaggaataaagggaaatatccaatagaagtggtcaagtcaacaaagacacaacactaactgtatacatatataacaacaaagtttcaaaatgcataaaacaaaaactaataaaactgtaagaagtagaagtaggaaaatccaaacttatagttggaaactttaacactggacaaaacaagtaatcataacagatacagggcctgaaagaagaaatcaagagggaaatcagaacatattttgagttgaatgaaagtaaaaacccatacagcgtgtatcccagaggtaaaaaaaaaaaaaaaaaaaaaaaaaaaaaaaacaagagagagacaagaaaaacccaacttgtcaaaatgtgtagggcagagctaaatcagtacttaaagaaaaattcacagcattaaatgcttatattagaaaaaagaaagttctcagatgtatagcctaagcttctacctcacaaaattagaaaagaacaaaaaattaaaaacaaaaacaagtgaaggataaaataaagagcagaaatcaaaaaaactgaaaatagaaaaacagagaaaaatcaatgcaactaaaacctaattgtttgaaaagacttaaaattttataaaccccctagctaaactgaacagaagaaaaagagaaaagaaataaatgatcaatatcagaaatgaaagtgagtatcattacagattctgctactactaaaagagtaaagaaatgttatttagattttgccactattaaaagaaaaagggaatgttataaacaattttatactagtaaattcaacaacttagatgaaatcaactaattctttgaaagactaaaactgccaaagttcattcaagcagaagtaggtaacctaagtaaccctatctatttttaaaatctgagtttgtagttaaaaaaccctttccacagagaaaattctaagcccaaaagccttcactggtaacttctaccaaataattaagaaataccaaccaggtgaggtgcctcacgcctgtaatcccagcaccttgggaagccaaggcaggcggatcatttgaggtcaggagagcaagaccagcccagccaacaaggtgaaaccgcttctttactaaaaatacaaaaaatcagccaggcatggtggtgcacactgtaataccagctactcgggaggctgaggagggagaatcgcttgaacctgagaggcggaggttgcagtaagccaagatcgcaccactgcactccagcctgggtgacagagctagactccgtctcaaaaaaacaacaaaaaaatcctgtttttgctggttttaaatattgcttttgccacactcatcaaaagtcttattgataaatcaatatattcagtcctcttatttgatctctctgcagcatctgactaccacctagcagtcattctctattcctttttgcaggtagtctttcctcctcttttttcctgtaccttgcatgcatcttatctactattcaaatcttacccattacatttgtgaaatatctctggagtctttccattcctcctctctaccttcactgtctcagttcagaccctcaatatctctcacctaaacaactctggttgcctcctgactggcctttctgcctttggtttcactctgctcaaatccatgctccccattacttagagttatcttttgaagaatgcaaaccagatcaattcacattcatgttcaaatcttaaataagcatttcttcaaaccttctacttcgcataataacagtgacctcagcttttcctgactttccaggttcatcctctagttttgttatatggttaaaattcctcactccctgcacttaaagaacgatcagctccttgagtgcagagaccaagtctcagtcatcttattaaaatcagtcattttaagtgtctggcatttagtgagtgtgatgattaactttacatgtcaacttctctgggccacagtgccaaatggtcaaacattattctgagtgtttctgcaagagtgtttttgggtgagatttacatttaaagtggtgaactctgagtaaagcagatcaccctccacaatgtgggtagtcctcatctaatcagctgaagggcctgaacagaacaaaacgctgacctccctgggcaagtgggaattttccagtagactgtttttggactgaaatttcaactctttcctgagtctccatcctgtcaggctgtcccatcagattttacactagccaagcctccacaatcacatgggccaattccttaatatatatacacagacagacacacacatacacacacacacacacacacacacacgttgatggttctttttctttggagaaccctgacttatacagtggttatgcaaaaaatgtttttcaaattaatgaaattaattaatgctggttttttgttgtgtttgctttcacttaatttacaaatacatgtctgtgaggagatttattttgacatatttttatagatcactcaccagttttaagtcaatataaatgtgttaagttaaaacaacatatatacaatataaggactatagaaactggaacacatgttaggtttcacgttacaaatacttttaaaagaagaaaaagtgttgactagccaggttataaaaacagaattgaaatctctagcaataatacacagacaaagattttttaaaatcattcaaaagaattgcctagaaaacaaaaaagtacatctaagtgtctttatatatttttgtttctaattctaaacttttaaaatgtgttcctgtagaaactaaaaaaatctctgaaacagaattcttgtgtgagaagatggcctggtctaaagcatattacttttgataaaagtaattagtaagcctgttttgtgaatgttcacataaataaaatgtttggtagaaataatgtctacatatccacagataacaaaatgatacttaatacaaaatggaaataagccaatttctgccaagttatctgccaagttctgaattcagggttctctgcttcccttgtaacagatgtaggtgttaatgatgtcattaactgttgcagaaaaaataggggaccatgaacacaggtcttggcagaaaataaacaacctatgagttcacctttaaatttaaagtaaatagaaaaattagtttatagagtgtctgtccaatacagttcctgccctaaagggataagtcagaatttttatttccagtgttttcagctgtattccaaaaataaaggctaacaacctgtgttcttaaaaggcacaaattaagactgtgtctatatggcaaaaacaaccagtcaacaagttaaaaatgttaaattggtattacataaaatatgtacaaccatacaacaaactttttgtattttctaatcataagattataaatactcattaatatctcatcttactccatatgttattttgtgcttggatcatctatctttgtattgcctcagaaaagttaaaattgacatttactttaatatcagttaagatcaaaatttattaatcactttgatattatgacagataggatacatacatgtaaacttaactcttaccttctcaagttgatcctgaagattagtggatgctttataaccaagttgtaacagcattgcttctgcagcattttttttggctatctttttattaggtcctgttcctgtagcaacttcattgcctaccttcacctgataagattaaagaaataaattaaagaaatacatttatgataaatttaaacaggaagtccttacatcataaagcaattctactctctagcatttgaaaacataaagttcagtccaaagtaaaaatggcaactaagataacatttatgtaatgttgtatatgtacatgaaaaaatggtccttaaagtatcaatggaggattatctcaggatggtagaattttatagaatttttacttccatatatatttatatgctatttgattttttaaacactaaatttatattatttatataagcagaaaaataaaatttacattttaacagcgttcatgttggttatgactacattttagcattcttatatttcaattaataaactgaaaaggctaaaattcatattggtgccatttaaaataatgttcaaattgcaatattatgtaaacattcaagtttacaaagatttatattaaatagttcctgaagagaattaatatacaagtgttcctacaacattatgattaaaaacaaggcttctggccaggcgcagtggctcacagctgtaatcccactttgggaggccaaggcaggaggatcacaaggtcaggagtttgagaccagcctggccaatatggtgaaaccccgtctctactaaaaatacaaaaattagccaggtgtgatggaacacacctgtagtcctagctactcaggaggctgaggcaagagaatcgcttgaacccagtaagtagaggttgcagtgagccacgattgcgccactgcactccagcctggggccacagagcaatactccatctttaaaaaaaaaaaaaaaggcttccaagtcagattgggatatgaaactcaactctattatttcctagctgtacgaactggtacaaattatttaatatctctaagcctcaggtttttcatcagtaaagccggggtaataccaactactgcacaatgttgctttgaaaattaaacaagataatgtatgtaaaccacagcatttaatccatcacaattgctccaaaaaaaagatttttatcattagaactattctacagttatcttctgtgagcaatttatacatgtacttaaatacacatcaaccatacaactataaaaagtaaagtagatagcaaaaaaggatagaattacaaggagaaatagaaaatacacaactatagttgaatttctttttacacagtggtctcagtaagtgattgaagaagtagttaaatagttaatcacaactttggaaattaaacagtgtaattctggtcaggtgtggtggcttatacctgtaattccaacactaggaggattgtttgaggccaggagtttgagacccgcctgggcaatatagtgagaccccatttttacaaaaaaaattttaattagctaggcatgatggtgcatggctgtagtcccagctacttgggaggctgaggtgggaagactgcttgagcccaggagttcagggctgcagtgaaccgtgatcacatcaccacactgcaccctgggcaacagagtaagaccacatctctaaaaaaattaaaattaaaaattaaaaattttataaacaatgtaattccaaattacctaagggcaaaagaagaaattccagtgaaaactagaaaatattttaaataatccatggacatatatcaaaacttgaaggacacagcaaaaggagggtctagaagaaaatgcatagccgttaacagcttacaggagggcaaaaaagtaatgagctaaacatccacctcaagaagtcccaaacatatcagcaaaacaaacccagagaaaatagaagaataaaaagcaaaaaggaaatacaaaacaaagtacaataaagttagaaaagccaaaagttggttctctaataagactaataaaacaataaaccaaaagtaagactgatcaagaaaaaaaatacgagttcttctctgagatgggtatttttaaaaaagaaaagaagaagagaagacacaaataagaaatgaaataattaaaaagggagattaccatcacttctgtagcattacaaaataataaggattactgaggccgggtggagtagctcactacctgtaatctcagcactttgggaggccaaggcaggtggatcacttgaggtcaggagttggaggccaggttggccaacatggtgaaaccctgtcttactaaaaatacaaaaataaaaaaaaaaaaaaaattagccaggcatgatggcaagtgcctgtaatcccagctacttgaaaggctgatgcaggagaattgcctggacccaggagaaagaggctgcagtgagccgagatcatgctactgcactccagcctgggcgatagagtgagtctctgtctcaaaaaaaaaaaaaaaaaaaaaaaaaggaatactgagagcaatttcatgctaaaatttaaaaacatatttagatacaatggaaaaattcctagacaatacagattaccaaattgccacagaataagcctaaagaatatgactaaaactactaatgaaatcaaaccataattaaaaacttcgcaaaaaggactcttcagatcttctccataaagttctactcaatatttaaggaagaattatgctattcttttcatccaaattcatccataaaacacgaaatgagaaatcagtccccaattattttatgagctctcattttgattccaaatcccaacaagaacagtataagaaaatttacagaacagtttcactcatgaacatagatgcaaaagttttaaacagtataatgaataaagcaatatagaaaaagaaaaagattcatgacaaagttaggtttattgcaggaatgcaagtttggtttaacatttgaaattcaaactagaaatcgacatttattcataatgaaaattattagcaaactaggaaaagaagaaaactttttttttttttttttttgggatggagtctcactctgtcacccaggctggagtgcagtggcacaatctcggctcactgcaacctccaccttccgggttcacgccattctcctgcctcagcctcctgagtagctggaactataggtgcccgccaccatgcccggctaattttttgtatttacagtacagatggggtttcaccgtgttagccaggatggtttcgatctcctgacctcgtgatccgcccacctcggcctcccaaagtgctgggattacaggtgtgagccaccacgcccagtagaagaaaaccttttaaatatgataaagggcattttacaaaacacctacagcaaacctcaggaaacactgtacttaatgttgaacgaaactaattagaaacaagacaaggatgttccctattattactactgtttaacagtttacacaaatcctagacagagaaataaggcaaggaaaagtaaaaaaagaagcagaagggaaaagaactcattatttatagatgtgatttcatatataaggaatctaagaaactccacagatgaattataagaattgattagattgtaataagctcagtatgaaaaagaggactgcatttctacattccatccacattcaagtagaagatgaaaaatattaaaaagataacatttacattaaatgaaaatcaaatacctatgatgtgcaaatcttctacatagaaaacaaagtcttattgagaaactttaagaaaaacctcataaacagagcaaaatgccatgttcatggattgaagacaatactaatgtaatagtatcagttctcttcaaattgacctaaactcaattaattgaactcaatgaaaactcaatcaaaattccatatatctttttacaatacttgaacaagatgattccaaaatttacatggaaatgtgaagtgctaagaacagccaaaatccttttgaggaagagcaaggtgtgggacacttatttgtctggatatctagacttattatgaagttaatataaagaaaaaatttaaatttgactacactaaaaattactcttgttcttctaaaagcattatttagaaaggaaagtcacaacacaagaggaggtatttaaaatgccatataactgcaaagggcttgcatccagaatatacaggaggttcccatatatcagtttttttaaaaaacgagcagaaaaatgagcaagaaaagtgggcaatccatatctgaaaagttgaattgttttaccagttatcattttacttaaaaaaaagttagaaagtttcaataatagtttcatgccactttaatacatttcacaatgacaacaaaattcagttttcagctatacagcatgatactctaaccatacttttcttttttgtctattgtgtaaaatcataatattggctgtttcatctgtcccagaacatacagattcccatttggtatccacacttgagtactgttcatcatttattcttacatccttatttacagtttttatttgtgttattatttccaacagtactttttttttttttgagacggagtctcgctctgtcacccaggttctggagtgcagtggcgcaaactcggctcactgcaagctccgcctcccgggttcatgccattctcctgcctcagcctcccgagtagctaggactacaggtgcccaccaccatgtccggctaatttttttgtatttttagtagagacggggtttcactgtgttagccaggatagtctcgatctcctgacctcgtgatccacctgcctcggcctcccaaagtgctgggattacaggcgtgagccaccacgcccagcctccaacagtacttttaagcttcagtgaaccacccaattttaaggaactgggagaatatacaacaaaatggtaagaaaatacaaacttaaacataaacaatgtacaaatgatataaaaaaggtgctgtactctcttttaacagagtttcagtaaagacaaactaaatgacagttcatacagcacatgaaacgctgaaaacatattcattacagaatttctgtaacaactatcacaaattgcatagtttaaacctgtgaaatattttttaaatatttcattgcctttttttctgaaactggaaaccactatgtcgtgacaaatcagaagcagtctttggacctcactctgagaaggacaaatctagtacagtcagaccaggtactcagagccagatgaatacacaccacctgccgtaacagtgtctgcctcaacatggcaggccctatggataatctactcaaatccctggctagagtacctctgctccctgttattttttccaatgctttgtttgttcccccagcttcatcagtccctatgttgctgctggaatccttgctggtgaaaagattaggccagttatgtcagaagcttcctctactgctctgaggcctggtcttggacttgtcagctgtaatgctgttcccattcctgtattcaccttgtctctccgtctgctagatttccatctggcctattctgataccttcaagacttacttcttctaaaacaagtgcttcccagattcatttacccattcacccagcccttgcctcatgcaaattttaataatcgcatggttgaatagtttgtaagcagttatcctaatttgttaatataaaaagaccacattgccaaaggactttcattccctgctaataaacacaatggtcactcaaaacatcactttattataaaagttaagtaagtttataaatttcacaagtcatcttccttgagaagtcacaaattttataactattgtaaatatggtctctacatttaaatgttaatttctatctgtaaagaagctcaattattttaccatgcagtaaatttaagactgccaaatgtttgtctttaaatttaacagctcattcacatgaatcaaatcctcaaaaacctaagaaactaaaaagttctgaaataggatttaccaaaaacttaatttttatttattttttaacaacctggtgatctcaatcacaggctgaaaagttagtaatacagtgtgctgatatgcaatttggtttagttatcattattttctgtttgaaagattaaaatactcctcaccaaaaaaatgaaaagctttaagaaatctgctctggaataaaatacccaaataatgtcatcggagattttctttcgtttatctagtaatcaacataagtaactgcatccattttttaatatatagactttttctttggtaacagataaaaatgagcatctcatctctagatattttgctgccacattcaattataacaaatgataacattgcctaagtagtttatacaaaggccgttactttgataaaattgctgcaatactgtaatgaatccactggggcttccagaaggggaaaaaacaatatgaattcagtgcgaaaacatttaaaagcacagccaaatgtccccatttgactagaatgtttatgaatacccataaaatggaagctggcctaagatatgctaaattcctctttcaaaaggggtactcaatatactctgtagaaaaggatttgtttaataaagccaaagccagtttatattcccaatacatgtctaaaattcaggcgatttttttcttcaagctttggcattcaaagtatatgttccagaattcttcaaagttaagaatgttaaggaaaaaaatagtgaacatattttaccagtgaaaataatgaaacaatcatgtgctggatcctaataacatcttgacaataatgtgattactaaccagagaattcccctctttttggatatctgggttcccaggagtgacttatctatgactacattataagttaacatctccaaaaaaaaaccatacaggcagaaaggcaggcagcaaatatctatcaaatgtttattaaggtcctactatttacaaaccactgtattgggtactgaaagataaagaaacatggagattataaattgggagggaaggcacaacttagctatacacttaaacttaatcaatatgagacactgtatttgagtgccaaaatgtctaccacatggtcagcacttaatatttgttgattttatctaagttacataaaatgtgagatccttggatttgactaaaaagtttctgtgactaaccaattatttaaaaaacagtttgagactaagcacagtggctcacgcctgtaatcctaacactttgagaggctgaagcaggaggatcacttgaagccaggagtttaagactagcctgggctacatagtaagatcctgttgctataaacaacaacaataaaacaacatttaattagctggccatggtagtgtatgcgtgtaatcctaggctactcaggaggctgaaaagggaggatctcttgagcccaggaaatcaaggctgcagtgagccatgatcatgccaccgtactccagcctggctgacagaacaagaccctgttgccccaccaaaaaaaaaaaaaaacaaaaaattaaaaaacagcttggggaaaataataatttaaatatagactgggtattagatgattctaatgaatcatgtctaatgtaagaaaagctttcatatttcttagaaacatacactgaatatgtaaggctgaaatgacatgtagttagaaattatctttgaaatacttcagtaaaagaagagagaaaggaagaaagagagggagaagagaaaaattaatagctgaatcaagtgtggcaaaaatcttaataactgttgtgtttgagtgatgggcatattaatggtccattattattctctccccacctttggatatgtttgaaattgtaataaaaaagtaaaagaaaaatttcttaagactggagtttgagctggcaaatgaagatgaataggtaggggttgaaaaggagagcattttaggcattctacttcattcctagcccatctgccaatacactagcagccattccttgattttcttggctccacaatgcagcagtcagatctcagcaatcctgagtgcctcagcccccaccatggttagctagcctgcttactctctttttctaactttcctgacagcccacaagctcaggattttggccctgatccatctactacatccatccttctaaattttgtttctaattccatgtgtctccaattcccagtagttaacagactccggctacaaaatgtaacacaaaaagttaaaagataggcattaaatgataaactccatggtaaataacctgtgtgaactcagagtcccttggaaaactcatgttgtctattgtaacatgtccttgacacttgaatgtttccaccaagttggtaggtgagcctggacagaatgaatgctttaactggaaacagttttactttctgctcttaagtcctagtttgcctttcgcccaaatgcctattccatcctggggatttctaaatcttttcaatagttttaaaaggttagaaatacctgcatcacaaattctcgacgtcgaggcattcctctttctgaaagcaaaacataatccggctccttttcctttttggcctgttgaatttgcgccaggcggctaatagggttcatcccttggccatattctggtccggcctaaaaattaatttaagaaaaagttttaaaatatgcttgtgaaacctgttattgaatccttaaagaaacagtgcttcttccctccacccccacaccccaaaactgtgactagaaaagataaatgagtcatttatgaatatttataaaggaaaatcataaaatagacctgtaaccaaggcttctatgggacttggggcttagatgtattaatggcaaggtgtcaactatgctttttaaattgggcacactcttcagtataccagaggtgcttcacaacttctgttcatcaagaaacatcaaaaagaacagaagaagaccaaccatgaactgggaggagatctctgcaacacattatcattttattttattttatttatttttttgagacagagtttcattctgtcgcccaggctggagtgtggtagtgcaatttcagctcaccacaaactccacctgccgggttcaagcgattctcgtgcctcagcctcccaaatagctggaactacaggcgcgcccacaccatgcccagctaatttttatatttttagtagagatggggtttcatcatgttggccaacctgatcttgaactcctgacctcaggtgatcccactggccttggcctcccaaagtgctgggattacaggtgtgagccgcagcacccggccacaacacacataattttaaaaagacgtatccggtatccaaaatatattttttaagacccctaaaaagtactaagaaaaagagaatataaaagggaaatgggcaaaagagataaatacttcacataaggaaaaactcaatatatgaaatgataactaacctctaggacacagaaaatacatattaaaaacctcagtgagttactatttcacatccaccaaattagcaaaaattaagaagtctaacagccccaagtggtgagaatggggagtaacagaaactcttataaaacactgggagtactataaatcggaaaacaacctggcaatgtctagtaaagcctgagatggtacatcctaccccaattagcctattcctaggcacatataaaccctagaaaaccgtaacccatgcacagtagctcatatgtacaggaatatccacagatgcattatttgaaataggaaaaaaaaactagaatattcatcaataaaagaacagataaattacagcatgttcatataatggaatggtatatagcagtgaaaatgaattaattattgctacatgcatcaagatgaatgattttcagaaagaatagtaagtaaaaaaggcaagctacagaataatatatatatagtatattttatgtaaagcctgctaaaactacaaaatactgctgaaattaagatctaaatagtcaatacatcatgttcatcgatcagaagactcaacaataagatgtcaattctcctcaaaatcccagtaggcttttttcctttttttttttttttttttttggcagagtctcactctgttgcccaggctggagtgcagtggcatgatctcagctaacagcaacctctgtatcctgggttcaagcgattctcttgcctaagcttcctgagtagctgggactacaggcgcacgccaccatgcctggttaatctctgtatttttcatagagacagggtttcaccatgttggccaggctggtctcaaactcgtgacctcaagtgatccttccacctcggcctcccaaagtgctcagattacgggcatgagccaccgcacctggcccccagttggctttttaaaatttaatgtgtaagctgatactaaaattcatatggaaatgcaaaggacaaagaaccaaaattttgggggaaaaaaaaagactcagactacctaatttcaagattataaaactatggcattcaagacagtgtgtgtagtattggtataaagacagacaaagggaccaatgaaacagaataagtgcccagacacagatatatatacacacatacacatacacacacacacacacacacacacacacacacacatacacacacacacacacacacacacacacacacacacacacggtcacatgattttcaacaaaggcacaaaaggaattcagtggggtagtcttttcagccaatagtgttgggacaattggctattcatatgtaaaaagaaaaagaaaaagaaaaaaaaatcttcaagccaaacctcataacatttataaaaataattaactcaaaatgcctcacagacgtaaatgtaatttctaaaactataagatttccagaagaaaaatttttgtaacttggttaggtaacaatttcttagatataacaccaaaatcacgttccatgtaaaaaaactaataataataaaatgaaacaatataaataataataaaataaacataataaatcttcaaaattaataacttctgctctttgaaaaagacaagtcacagacttgaagaaaatatttgcaaagtacatatgtaataaagcacctgtatccagagtatataaagacctctaaaaattcaataataaatttattattatttgaaataagcaattaaaatttgttaagctggcaaaaaatttaaataaacacttcatcaggcctcatgtgacagtaaacacataaaaaattcttgatatcatctgccacagaggaaatgtaaattaaaaccaaaatgagatatcaatacccatctacatgaacatctgaaattttaaaaactatgctaggtgttagcaaggatgtgaaacaattggagttatcacacactgctgatgagaatgtaaaagtgcacagctgctacaactttgaaaaactaaagttgactatatacctactaaatgaccaagccattccactttgaaggatttacccaagagaaatgaaagcatatgctcttaagatacacacacaaatattcatagctgctttatgagtaacaatcaaaaattagaaacagcccaaatatccactgacaggtgaatggataaacaagtggtggtatatcaattcaatgaaatattacctgcaaaaaaacagaactaccaattcatgcatgcaacaataaggatgaatctcaaaataattatgctgggttaaagaagccagccaaaaaaaagagtggtttctcggcaaattaaggtagaagattacaaaggggcataaggaaaattctgggaggaatggatgggttcattatcttgatggtggttatagttttacacatgcaaacaaatacgaaaacatatcaaacagtgcactttaaacatgtacaagtcactctatgtcaattatacctcaataaagttgtttaaaggaactaaacaaataactttagaaaaacaaacatagtaaaactataaggtaggaaatggtcatacaaaactagtgatagaggttgcctagggaaggttgcatgaggacgtgatggaagaagagcatacagagagcttcaaagcttattgagaaatgttttatactcaagttgggcagtaggtctttctcacacttacttagtatgctttttaacttatacacaagtttatatatagctttttgtatgtattataacataaaagcaaaaattcaggccgggcgtgatggctcatgcctgtaatctcagcactttgggaggccgaggcgggcagatcacctgaggtcgggagttcgagaccagcctaaccaacacagagaaaccccatctctactaaaaaaaaacatacaaaaaattagccgggcatggtggcacatgtctgtaatcccagctactagggaggctgaggcaggagaatcactttaacctgggaggaggaggttgcggtgagccaagatcacaccattgcactccagcctgggcaacaagagcgaaactccgtctcaaaaaaaaaaaaaaaagcaaaaattcttggaaaccaaattatctttctgcatatgaactttcttcatgtatttttcctagaaataaaagtctgcgtatatcatacggtcaaaactttatttccacctatgaaaatttattcttgtctctactatctgtagagacatggagacatggataatcactctgttacagattacacgttacactaaacttatgtaagagccactatgcagtcttagctcttccggatgattgctgccatttcatcttgacaatctgtagtttggtgctccaggtacagcatccaggcagatccctcatggtctttcaaactatgtttaggattttggactttatccaaagagtaagaaaattactaagaggttttaagcagaggcatgatatgattagacaggtgtctctaaaagatcatactttttaaacgatcatttggtgtcaagagtacttgtagccagttaaaaccttaactgtagtagttcaggttaatagatgtctgtgagttggacaaaagagtggcagaagggatggaaaaaaaggaaccaacttaaaaaacattaggtgacaaggccaagcacagtggctcactcctgtaatcccagcactttgagaggccaaggcagggcggatcacaaggtcaggagttcgagaccagcctgaccaacatggtgaaagcccgtctctactaaaaaaacaaaaattagccacgcgtggtggcgcacgcctgtaatcccagctactcaggaggctgaggaaggcaggagaattgcttgaacccaggaggcggaggttacagtgagccaagatcatgccactgcactccagcttgggtgacagagcaagactccgtcccataaaaaaaaaaaaagaaaaagaaaaaaaagaaatattagctaacagagtaataggacttaatgactgataggacgtaaggggtaagagagaagttaaacgtcgggcgcagtggctcacgcctgtaatcccagcactttgggaggctgaggtgggtggatcacaaggtcaggagttcaagaccagcctggccgacatggtgaaaccccatctctactaaaaatacaaaaattagtcgggcatggtggtgggcacctgtaatcccagctgaggcatgagaatcgcttgaacccaggaggcagaggttgcagtgagccgagacagtgccattgcactccagcctgggcaacaagagcaaaactccatcttcaaaaaaaaagagaagttaaaaatgacccccagcagtttcagcagctggatgtttgtgccagtcactgagataaagaatgctgcaggagaaagaggtttagaagggaaaatgatgaatttgggcccaaaacttgaggcacctgtgaaatactaagtggggatgtctaataggtagtgcagagcatacggtattcaggaatcatctatttaaagatgaaattgaacccccagaagtagaagaacagcttagggaaagaggaggaaaaagactgagaacttcactgttgcaatggttagatgaagggaaaggaaagagcaaaggaaacttttagcttttgataaaatactggtttcaacttccacttatatcctgaaaaaaaaaattaaataaagggccgggcgcggtggctcatgtctgtaattccagcactttgggaggccgaggcaggtggaacatgaggtcaggagatcaagaccagcctggccaacatggttaaacactgtctctactaaaaatacaaaaaaattagctgagcatggtggtgtgcacctgtaatcccagctactcgggaggctgaggcaggagaatcgattgaacccaggaggtggaggttgcagtgagccgagatcatgccattgcactccagcctggcaacagagcgagaccctgtctcaattaaaaaaaaattaaattaattataaggggaatgaagagggactgatgagaaaagacaaatccacataataatttataagtctaagattgaaatcccaatgaaaaggtaaagagaagctctgagtctagcactagaagtagtatgcccagttcatgaagatgttaaataagtaggaatgtgtttccagtggcatactgtctttatttctgtttaatttgactcaaagaatgtctctgagttccaaggaaattattgttgatatagattgcaatgaaaagaatcagatacataaatccaatttagataatgatggagttcagtgtacattaagaattgcttggggctgggcacagtggctcatgcctttaatcgcagcactttgggaggccaaggtaggcagatcacttgagcccaggagtttgagacctgcctgcacaacgttgcaaaaccctgtctctacaaaaaatacaaaaaattagctgtgcatggtggtgttgtgcctgtagtcccaactacttgggaggtgggaggatcactcgagaccagaaaaatcaaagctgcagtgagctgagatcctaccattgcactccagcctgggcaacaagtgagaccctgtttaaaaaaaaaaaaaacaactctgggtggcaaaggcaggcagatcactttaggtcaggagttcaagaccagcctggccaacacagtgaaaccccatctctaccaaaaaataccaaaattagctaggtatggtggcacatgcctagtcccagctactctggaggttgacatgggagaatcgtttgaacccaggaggcagaagttgcagccagccaagatcatggtgccactgcactccagcttgggagacagagttagaccccgtctcaaaaaaaaaaaaaaaaaaaaggcagcgggggaggggatgacttggtttcttgctctgattgaaatgaactaccagcacccttgacaattaagttattccttggacagcaaatcttaaatcatcattctatataccaataaggacagtcttgtaataattgtgtccagaacatttgatctctaagattagaaagccttctttgtagtctcgtcttatagaggagaattacatttaaaaacagaatgtaaacacaaagacattatcagggcagttttacatgttaacaggataaccctatacagtgactctgaaaatccaaaagttcacaattaaccaatatcaaatgggcactggagtcagatgtgacaactggatctgaaagctgattctgctacaggatcttggataggtttcttaaatataaagggcctcatctgtaagatggaaatgaatgctgcatcacagagtgattaagtgatcaaatgagacaatgtgattattttattactttaaataaaaccaaggcaaataatcatagatattttacctgcttccattgagtgtaacaaactatagaccctcaatgtataagccatacaaggaagtgaggaatatgctaaaaatcaggatactattccaagctgatccatttactgacatattataaggtatgaacatacttaaaattatctagattccaactcattatacacatgttgttctctcaaaataatcttacatttcagagggtatctacaagctttattttaacataagacagacatggcaaaagtaactccaagtgtgatgtatatgaggaaaaatgcaggaggctaacctagtctgggagtaggagaggaccagaggagttcctaaaaaagtcaagtttatgctgagatctgaatgatgcataggagggaagttctgggataatattacttatatactggaagcagtagcaaataactgagaattcaaaatgtttctcctgtctcccacctctggggaataacatttaaataataatcttgcttttaatagctatagttaaaacaagagttagatttatatcctactatagaaatgtacagatcttttccagcctaacagtttattatgatgattattattatgattattattattattatcattttgagatggaatctcattctgtcaccaaggctggagtgcagtggcagtgatcttggctcacctcaacctctgcctcctaggttcaagcgattctcatgcctcagcctcctgagctgtagctgggattagagacgcatgccaccacaaccgactaatttttgtatttttagtagagaccaagtttcgccatgttggccatgctggtctcgaactcctagcctcaaatgatccacccgcctcagcctcccaaaagtgctgggattacaggcatgagccaccgtgcccagcctggtttgcctggtttattattcttaatttatcaagataaaacttagtttaatagagcagacagaagttatgtgaccagttttgtgccaccattccaacataaaatgctgttcctccatcacagaaaagccatagattttatatattaatagatttaagaaaacagttcatggatatattcacataaacataaaatgtgaataggtagtattagatacaaaataccaatagttaatatgtgttatttattatagtatttgcattatcattaataacaatgaatacttaataattactaatgcattttgtgcattgtttcagttaatacttataacaatcccatacagcaaggtcagttactattcccactttataaatgaagaaatatttttaaagttaggtaacttgctcaggccacagggattcatactcagaactgactccaaagttcattctcttaatagctatattctactcctgactgtgtaggaggagcatatgaatgaaagtgccagtcctctttggaaccactatgactcatgataagtggatctatttgtatttatttttagtctaccttacatataacatataattccagttcagggaatgcattacctactacatcttctaagtgaagtcatgtcagtattcattaaaaacaaatatttaagtagttatttttgtatatatgtatatatgtattttaaataaaggtacaaaggtataaaacctgtaaaaatacctaaattgtgccattgtgcaatcaaaagaaatccattgagattaaatatatttcttatctgtaatccttcatttgtatagcctgatcagaagaaggctgctaaatcagtgaggctgagccagcaactaaaatgctggcaatttaaggctttctctggaaacacagaactctagctccagacatgtcatacgtgtcaagcattcacaggcactgtcctgtactaaatgctgattcatctcattcctctgatatttaccttgcttctcttattaatgtaaataaattctgacccaataaaagagtcacaatatcttgaaaagctgtgtgctctatattcttctttggcaaggtatacacatctgaacgaatggcaacaaaataacaccatctacttcatatggttgctatgtggattaaatgtgattaaagcatgcaaagtgttgggacaaagtctggcacatagactgctttatgatttccagctgctgtagctatcattgttagtattagtcacatgatttttttgtgtgtatcctgttaccatttcatgatatcctaagaagttactatgcaacagccatgtgtgcagaaagaacactggattagagatcagagcggttcaggaggtttgacatgattgctgaataaaaatgggcaaactctttgaacacgttttgtaaaatcttatttgtaaaatgagggctaacatcatctaccttatacggtcatgagggggattatagtaaaggtgacatgaatggtaaagcactttttaaacaacaaagaaatacataaatacctaaggtattatgattatttgatgtacaaatgcaggtgcacaggtatttaaaaagcaaaatagaattgtcattaatttatagtcacatgtcctgccctcatttcaggactgtatatagtccataagttcagggatctgccttatagaaaaatgcttatctatagctactataatatttatttagtaaaactgactgatgttcacaaatataaacttacctttactattgttttagggcgttttttaaaaaatagttttggcttttccaccacaggaagaggtggaagttttttaagctcctgtaagacggtggtcgcagcgcgcttcttggagagttttttgctatttccttctccttctgcagagaactctcctactgacactcgagtaacaaagcttttcatatgtggtggtccactttctttaataacctattaaatacaagtaaaatattaaataatggataggcacttgagatgtattcttaaagtatgacttaatattcatatcaaaaccaaaattagtattatgccaaaattatagtatttctttaagaaagctattatgaaggtattatactgggactatttatgacacttgatgcttaatgcaattgaaacaaaagaaatctaaataaacacatttgattcatagtcaaaatgatttattactttaaaacagatcattctaattacagtttctccatgtcttatggaacacaaatttaagaacatcaaagataccattagattagataccatattagattggtcatctagaatgataatttgtatataattacatacctaacttcctcctatgtacgagtaagttgctggagaaacgagtagttctataaaccacaaggcactgtgcctgtggaagcctctcaaaaacagtcaatggataaaaataagctgtttttgatagggatgtcaaaagctgttttacagaaagggatatttattcttgtgacacgattttaaaaaggtaagtaggtatgccaaaaaaattcctagctttctagagtaatgagttatggacctgtcaactatgaatgtaatgttcctaaaccttgtttaatctgcaatactaaatatttaacctttaattgttcacattagatcatcattataaacatcagatatcctacatcataatatattgatgttcccaagaacacctaagaataataaaactgtctgttcttactcattgtagcctttaaaaaaaatcccaataattttttagtataagcaattactttttacaggttttccaaattttccgtatcatttcttgctggaccaataggatctcaagtacattctctccctgacttcctcattttgctgcttttaacaagctgtggaccgagaactgagataatgcaacttgtaagaatgtgtccaagagaaagcaaacagtttctcagtccaactcagatgatcctgccaatgagtaagatgtgggagctttctagtaggtgaatgtcatacaatgtgagggaagaatctccacaactctttcagcttatttcctggttcttgtctactttccagacatgagttgtaaaattagtgacctcttaataaaagaagtattataataattatttttttaagttttcttttttgaaatttcatacaattttatgaatatatttgcaatatatttatctagctgttaagtcaagagttgcttcattacatcttacttcttggtgattttgttagttgaggttaaagtgaaacatattttggcctccacacaattgaaaaaaaaattggatattaacatgtatgtcactaaatcttaacttgaataaatttaatttaatcctatttaaaatgccaaatcttataggataccacaaattatctatacccagaaaataacttttataataaaaattgaaataccatgtatacaaaaggcttaatacagaaaagaaaaaaatcagaaggaatctgtgttatcatcatgatttctattttcaccagggcctagatcatttcataatactgggtttgaacatatagaagcacactaactcttgcaggatactaatacaccagttaatttgatttgtttgtttaaaataaccacagcaagggaaaaaatgggaagatctctaccgagtacatacctcaaaactgacaggcatatttcgcttcagagcaatttcaaacactaagctgatctcagacttatttgcatctttgtcatcatccacatcctttcctgattcaccattctaaatcacaaaaaataggataacactgaatcttgacattataacaaactttacttttattctacagtcaagatggcctatttaaattacaagaagaaacaacaaactatatagactgtatctgctgcattctcctgtaaccacagcggtcaagggctttgctgccaggctttttgttactcgatttttagcttgttttccttgaaggaaaagcatttaatgcagactttggaaatcttttactcaaccatacactaatttgagtttagcctacatccctaaacctggcactcttgttttagagttctctacccacccaacccccaacacccaggaattcccccactggtgttctaatgtgatctatgaggatgaagttacagaaagagtacaggatgcaaaccaggagcatcctaattggagatctatgtctggcacaggcattggtttactttattcacttatttaacacatacttctggaaggcctcatatatgctgaacttactataactattagaaagagacagtattccttgctgtcaagaactgggagagaatgatctagtgggaaaacagatcaagaaatagataggagctctcatgaaagagtacaagcagaaaaacacctaagtctgccattaagataaatatcaaaggagaaagaaacaattggtttggggaaaggaaaactgtagaggttgaactgtagggtaagtaagaagctcactatgctgccgggcatggtggctcacgcctgtaatcccagcattttaggaggccgaggcaggcaaatcacgaggtcaagagatcgagaacatcctggttaacacagtgaaaccccatctctgctaaaaatacaaaaaattagctgggcgtggtagcatgagcctatggtcccagctactcaagaggctgaggcaggagaatcgcttgaacccgggaggcagaggttgcagtgagctgagatcctgccactgcattccagcctgggcaacagagcgaggctccatctcaaaaaaaaaaggaagctcactatgctatgtataggacatgcctgagctagagatactattttgaagtcaatcaagaaagtagctgaagccatgagaatgagtgagattacttaagaacagcctcaatgtcatttgtaaaacaaaagaggactgaaaaatccataaaatctcttccactttaaatccttgattctagattcacacaatgtaatctatattcaataaacatagtatgaaatataagccaaatcaatgttatttctcatcctcatatacatccccaaatccccagttgcctgggaagtgaactcaagggaagaaccaaagctctgaaaggtagtcaccctgcaggaacacatgaagcaagactgtcaggtcttcactctagtattcttccctatcagaacagattatttattttaattataaaatgctctgatttgtttcactgggaaagtagaaagaacagactgtcacatgcagcagcaccacacctgaggagatctttctggaataggttcattctgcagtgcttggagggctttcattgcagcattgtgtctagcagcttgtcgagtctttccttccccaaaaaattcattatttcctacagtgagctgaacataaaagatcttaggcactgggcaatgatacctaaaataagaaaataaaaacattaaagttagcttaataaaaccactctataatcattcataagatttgtttaaaatgataccaattatataatgtgctatactcttaataaaactttaacctcaaaaacatacttttttgataaaatgtgagtcaatacatctatagataatagcttatactgatctccatgaaaaacatatatagaatacaacattaaacataaaacaatacagtaaaaattatttaattatatcacaggatacttcctggtgagaagttttcggtcagattttgacagaagtaagagaacagtctgatgaagctacaacagaggctgggtcaggcaagactgttcaggcgacaacatgtagattaccgtgctttttgcagaagataattacgattagaaatatagattagaaatggaccgactacaatgcaaagtaataaggagagcagattcagcataagaataaggagtttaggccagttcttaagcaggaagtgttatattcatacattttacggtgcctgaggtaatgaggctaatgaggtgtgactaaaaagctgcaataatgcagatatgaagagataacagagaatgtaagaagaaacaaaaaaaccaaaagaaattaagcagaaaaaattaagatatgtaataaaatccattaattcaacaattatttatggagcgtcttctatttgacaggggactatgacaatgaacaacaacacttagagtggggaagataaacaataagaaaaatatgtagaatacctagtatgttagatgtagatgtaagaaaaagtaaagaggaaagggttcagaagtgtcagggaggtaggttttagatagggtggccaagagaagtttcattgagaaaatatcaattgtgtaaagacatgaaataagttagggaacaagccatgcagatctctgggacagtgcatctgaagcagagagtataccagcagcaagggcagcgaggcgggagtgtgccacacatgttcaagtaactcggaggaagcctgtctggcaaaagtttagggagacaggaaaagctagatgagaagaggtggcaagattccatagggccttccctacaaattgctgtaggcatttttaacccaagtgaaatgaccagccactggaaggttctgcacagagaagtgacaaaatctgacttatctcttggaataaccatctgactactattttgaggacacactgtaggggaacaatgctggaagcaaggatatctaataggctactgggataatcaaggggaaaggtgacagtggcctgaactagggtgtagcaatggaagtaacgagaagtcattgtttctagatgaattttgaaagtagagatgatgggtttacccaaagactggctatggaatatgagaggggagtcagggatgacatcacggtttcggaactaaacaactggaaaatggagtacccatctattgagacagtgaagattgcaaaagaaatgggtttgctgggggtggatttcaacagctctgttttggggatattcaattattagacctattagatatccaagtgtagatgtcaactggacaactgaatttattagtctggacttcaggaaagaggtccaagatagaaataatatttgggaatcatcagtatataggtggtatttaaaggcataatataatgagaactctgtgggagggtgtgatgggagaaaagccaagcaagcacgatgtccttcctgaaagtcaaacaggaaaaaagtctatcaaggagaagggagggattaactggatctaatgctactaacaggtcaagtaaaatgatgactgagaaatatgaccactgaattgagcaacttagcaaaataaacagaatcgattttgatggaatggtggatttacaactgcaatgctgaaaaaaatgagttaaaaatcactccagtcctaaaaaatgtttgtttccaagcaaaaagaagtccaattgaggtcctactatattttagataattactgcacatccaagtagtgacgctctatgtccaacctgagataaactggatagagcgcatcatgtaagcattcaccaggcagatgggactaatcaatgaaggtttactgaaggtgaagaactagaaatgttgattggtactgaagatgcagatttgtgaggcaataattgaaaccatgcaagtggataagcacctggaaagggtaagtgtaaaggaatcaaaaaagagcctaaggctcggaactgattaatgcctgtgatcaaagtgcaagggaaacaatagacagcagtgaaagagatgaaaaagggtcaaagttagaagaaaaattacaacacaatgtcagggacaggagtaattaacagtgtcaaatgaaggagaggaattcagagtatgaaaaaaaagaaaaagttgctgttttaaatgcttaacctaaaatcaattttcttgaactacagttttctattaatttaagataacgcattttaaatgtttttattataaacaaagattaaaaagcattaaaaaactataatcttttttgctttttggttacaacaattaaatattgtgtactgaagtgcacaatttcctatcatctattttattttaatccctttaatgcagaaatttattttaattccttaatgcagaaatctgacagactaatatgaataacgccggtcatcttcacttcatatttctcaaaattcaattttcccacctccacataactttgtttatttttaactggtggtactataaaactttaaaacagacaacttgaaatcagaaatttactcctgaagtgagatctcatatggcaaactttcaccatagagcaaatgtttacaattaattataaacttctgaaaatagaaggtccacaactgaaatgctaacagacctttaactacagtagagggagtgggcgccactataatcactaaggcctgctgacaattacaaaactcattttggtttgccacagagacaaacaaaatttctgttcattgtaactttactggaatatgatgtcataacacataaccatactgaaacaatctgctgattttctggccaaaatattaattgcacaccaaagagcccttggggcctctccctttttggtcatcaaatatggctcaatgtatgtgtatgtgcatgcatgtggatatatatgtatatataaattatattgtgtaagtatcagaggaaaaattaagtatgttgcatttttaacataaaaggtaaaaattctagcactaacaacaggaaataccaagactggatgcctgacttatttcattctgtttcacttcatcctcttacttaacaatgattcttaataatataccccacatggtttgaataccttatatatcacatctcctcataccatcatgacaatcaagattagccagagcactctcattaattgcatccagattgaattacaggggagatgatgcagaatggtttttgtgtgataggtctggtctcaaaatacttacttcctttggtaaagaaatacccaaagtttattaattataaagatcgatatgttctatttagtggatttccttctactttcacttatttcaagtattaagctcacttttagtaaggtatttgatatggtttggctgtgtccccactcaaaatctcatcttgaattgtaatccaaattgtaatctccatgtgtcgtgggagggacctggttggaggttaagtgaatcatgggggcggtttcccccatggtattctcatgatagggagtgagttctcacaagatctgacggttttataagcgtctggcatttcccctgctggcattcatttcctctcctgctgtcctgtgaagaggtgccttctgccatcctgaggcctccccagccatgcagaactgtcagtcaattaaacctcttttctttataaatcacccagttcagtctcgggtatttcttcacagcaacatgagatcagactaacacagtaggtataataagtgatgtacatatttttacaaattagtatatttacctaagcagacatagctattcttgaatgatttttctcaagtagaattctgtggtcaatgtttagatccccataatgattactgttaaaagatgaaccacgaaaactcccccatccaagttatttaagtttcagggtcaaatggttgcatttcttttaaatcccaaaaaagtcttgggatttgaaagatcctactttcatcagaattatcttccatgcttgttaaaaatgaagattcctgtgatccaagcctgatctgctgcatcagagtttctgaggatggaaccataattttaagctgccctgctgactctctgcacgataaaggtccaggattatcaccacatcccacaatgtggcccatgtgacttggcaattgcttcagagtccattcaaggagaccacacacaatgcttactgcacaatggttaggtctttctctcttttttttttttttttttttcctgagacgaagtctcgctctgctgcccaggctagagtgcagtggctagatctcggctccccgcaagctccgcctcccgggttctcgccattctcctgcctcagcctcccgagtagctgggactacaggcgcccgccaccatgcccagctaattttttttttttttttttttttgagacggagtctcgctgtcgcccaggctggaatgcagtggcgcaatctcggctcactgcaggctccgccccctggggttcacgccattctcctgcctcagcctcccgagtagctgggactacaggcgcccgccacctcgcccggctaattttttgtatttttagtagagacagggtttcactgtgttagccaggatcgtctcaatctccgaccttgtgatccgcccgcctcggcctctcaaagtgctgagattacgggcgtgagccaccacgcctggccaggtctttcatatctctttttcatttaatcctcactacagcctggtgaggcaggagatgtccccaaggtcaccttaagaggtaacaaatgtccccaaaagagttgctgggaaccaaatttaagtctgcctaactgcagagtccaggaaattccgtatggagcttcctaaaaatctgctttatcttcttccatttttgttaatttttgtttattaaattgtctatcttcatggaaggccagagaacctaatgcaagggatctaaagtaaggcccactgatagacttcagagatgttttattgagtgaatggctgctgaaacaaacagacaaccatgatgaaacactgtgtttctgcagcatgtcagatcaaatagacacaagtgcatgacgtaaaatcaaagtgaaacatcaaaatgaacagcgttgtgtgccacattacttaacagactaaatctgacaaatgctgcttgcaaggcctttttatccccatgtctccttgccttctaactgctggaagtcttgcaaaaaataaataaaattgtaaataaaataaaatagaatcttcctttcctttagatcccaaacaagtcttgagattcagcctatcttcaagataccacaagtcaatacaacagtaagaaagaatgtatactggttcctttgatttaatacttgatattccttacagtttttttgagtaaaggaaagattttacattcacttatatctgactgttagttgtagcaactttttataccacatatccttgccaacctccctaaagttacttcatttaatgccctctttatggactcattttgtattatctttctaaacaactaaaatcccgtatgtcctccctaccattctgtgactgttttattctccaacatctccactttcctgagtatcatttttacaaggtgagaaagacatatcccaaataacattaggatttttacaaattgaaaaataattacctcattctatttgatagcattattcataaatctcaacacagcttaaacattcatatctcccctacagacttacatcttaaaatatatgaaaatgctatcttccgatctaataaggagaggctttggatttctgtgtttatttctaacattgactggaaacagaaatgtcacttaacctttctatctcagtttacttatctacaaaatatttgtagaatttatgtttaaaggaccctaaaggccaaaactaagaattcaaatgacatgtcgattattttgactctttgtacactttttggcactgctaagcattctttttcttgctgtagaaaaacagcaggtttttatcatagagctataaaatagtccttggcacattttcaaacttgtatgtatataaaatatctagatagaagacagttctttctctattcatatctacaaattttgaaaaatatatcttttatgagatctaactgttaattcttgaggaatttcaaatattaggactgattagaaaagattcacaggtcagatgaaaatatgctttaaaagaggtgtatggatattctatttgtagaattactgtaagtatgttttaaatgcctagaggaaatatagaaagatatgcactaaaagctaggatagggtgttttgaaatgatagcattataaatgatgttctttcctctcataatttcaagttttaaaaaataatacggtacactagaataaaaatggaaaaaaaaatacttaattgaaggaagtctagtccctatccaaacaaaggtaaatctgtgtttgaaattaaatttgataaactagtggaatgatttatggaatacagaacacaaatcaagagaataagtaacttgtactgtatcactgacagtagtgccataatcaggactatgcaaagcacagcacgttatcaaagagccccattattgtaaacacacaatcaccaccctcaatctcatacttggaaccaacataaacttgttcttgccccttctctaaatggatatatagataaatcattatcacatcaccattatcataattagagctaaaacatacaaagcacttactatgtgccaggcactattccaagcatttagatactaatctcactgaatcctcacaaccccacttcattttacagatgaggaaactgaagaatagagatattcactaaccttcccagggccacccgacttgagctcacatttgagcccaggcagtctcactccagaacccatgctcataactgctataccatgctgcctctgaatgaactggatagatgaacactataaactgcagaagtactaactataaactctgaagaagtcatgctggactgggaatatcaaagcaacttaagtctctctagatgtatgagatctggcagattctgaagatctctgtacgccaaaagtcaggtgcaggatatcagctgccaaaggcaatgatggggacactgtaagtctagaagaccaagttgactgcaaagtcctatttcctctctgctcattttttgtctcctcttaacccacccatctggagcccaggtttaaatgttctcattagggaaatgcaaatccaaaccacaataagacactacttcacacacccactaggatggctatagtttaaaaaaaaaaagtcataaagacatggcaaattggaaccctcatacattctggtgggaatgtaaaatggtgcagttgctatggaaaatagtttaccagttcctcaaaaaattaaaagcagaattaccacttgacccagcagtttcacttctaaatatatacccaagagaaatgaaaactggggttcaaacaaaaactcgtaggtaaatgtttacagcagcattattcctaatagtcagaaagtggaaataacccaaatgtcccgatgaataaataaaatgtggtatgtccccacaatggagtgttttacagtcgtacaaaggaatgaagtataattacatgctacaacataaacgaacttacattatgctaagtgaaagaagctagatacaaaagagtatatactctatgattccatttagacaaaatatccagaataggcaaacccatagagacagaaagtagattagtggttgccaggagctgggaggatggagtttgaggagtaactgttaacaggtatggggtttcttttaggagtgatagatatgttttgaaattagaccacggtgatggctgtacaacactgtgaatgtactaaatgcacaatgaattgtatactttaaaatagttaatcttgtgttacgtaaattttatttcaatacaaatcatttttttaaaaaatgttgatactccctagggttctattttgtttctcactgacaagacagtttttgtaggtgatctcacctactctcattcacattcttggcagactcccacaaactagcctaccaaattttgtaaagggaagtgtaaaagacctcccttttgcactctaggatgttactgacctggtcttcttcctactcttgtctaattgctaggggggtatgtgaattacattaataattcaacatatacttattaaaggcctacttcatgctgggatggagttttagtttctagagatggaggactgccctcaggaaactatcaatcaagtaagtacacatacacacacacacacacacacacacacacagacacatacacatcaacaaatgagatgagctaggaagaaaaataaagcatggtatagaaaaagattaacaggggctcctttaggaggtgacatttgaacacagatttgaataaagtgagaattctaggcatggaaatgccagaaagaaaaagtgctctaagcaaataagacagcaagtgcaaaggccctgcagaaataacatgttggttggtccatttttgagaaagggcaagtgttccttgtacctgacaagccctgagtcaaggaatgattagtaggaaactaggtctgagaagtcaccaggcagcaaatcagaacttaattccacatgatggaagccactggaaagttttaagcaggaaagtggcacaatctgacatgatttaaaaggatcttgttgctatttacccgaggagaggcaagaagagaataggtgacaagccattccatagtgcaggaaaagtcatctctaaaaataggagactgaactgctcaagaaaatataggattgcaggcagtgctacaatttcacttaaggattgtggtcattatatcaaggtggactagtcagcatagatgtttttctgtagcttcctaggagcaactgcagcagagtcagaggagctggaattaaccagttacagttttgccaagcatcgctgctcattccaactgggaggcagtagaacacacaggaattaggtagccataggactagtgaaaaatgggtgatcaactctagtgaaaagcagccacgctgaatctggcaggtgaggaaagggtgcacccagcctggaggttctgctcaaagtcttcaggtgctaaaggacaccaccctatttcttgccctcctggtggtcagacagtgtgtggcagaagcagtaagatgtgcctcccctgtggtggctgacaagcaaagcagtgctggaagtgttcctactttgcaactgtgaagaagggtccctggcaaggcgatctgggggcctcttcttccagtgtgctgccactgtgttcccctgggtgctgcagcaggcctgtctgagaggtaaatggctagcactgtggaaaccagcagaattgtggagtgatgctgcaggaatacggcggggggggggggggaggggggggcaggagggcgggttccctggagtagtatttctcaagtgggtcccacatagaaaacactggagtcttcctaatggggtctagaaacacttgctaaaaagcagattcagggctgaccaaagggattcaggatggagtccaggaatgcgcacattacctaacagcctaggtggtttgcacacatgctacagattgagaagggcctcgtcacaggggccttcttccctgtttgtgaatacaaaggcttctgattcctgaatatcaactttgtactcatctgccttacagagtgctcttcctgtctttaatgggattttagttaattctctcaccatttgtttcataagaaaaaattaggattttcctattatttccagaatttgtttttcctatttatttccacaatttattttgctaattttgttgatccaaacttccaaaagaatactaaatagcagctgataaagaatattcttatttcttacttgaatgggaacacggctagtaaatactcattaaaccttgttaaaaaaaaaaaaaaaacactgacagtgtggacagaggaaaatatttttaggtttagaataagatctactggatttaagttccagctactagatctataaagactttgggcaagaagccttatgttctctaagagccatcagtaataagaacaattttgtctgtatcaactttcagctttattcaagtgacaaaccagttgaaaattattatacttttcatgaaatatagcatatctgtgtactgagggacaattttcaaatagatatatatgttcacacatatactctgcagttcaaaaacatacaattttttttaaaatgtaagttttttttttttgaaacagggtctcgttctgtcacccaggctggagtgcagagcatgattatggttaactgcggcctcaacctgctgggctcaagcaatcctcccatctcagtctctcaagtagctgggaccacaagcatgtgccatcatgcctggctaattttttttttttgtagagacaggcactccctatgttgcctaggctggtcttgaattcctgggctaaagcaatcctcccaactcgggcgcccaaagtgctgagattataggcatgagtcactgtgcccagccacttttaacttttcaatatatattcactaaatactgcatgctagtaatctaatagcagaatcttacgtactaaaaacttatggaaaatatggcttattgtttctttgagttgtaagaatattcctattatttaattccagcagcagatatcatctttggttaagggttctctgagaatgcactttgaaaacaactagtgtagaaaatctctcaagtccttcccaccaacaaaaggattcacgaaacgagctctagaaaatacttataaaacttctatctctccattaagtccacaagcatatgtttttgaaaagtttgttagaagtataaaaagcatgaaagtataaaagatacaaacatactggattttttaaaagagggtttacactctttttcgataaattaattttataatgtctataataaaagattcaaatggatgattacgtttgcactaaaatcttccaagaagtttaaaaactgtttgctttattacaacgtccagcccaggcatctactccagtgcttttgctgatcagaattaactatcaactttggatgtttgcccacttcacatactcccaaaagtaacatggagacattacatcagcggtattgcagaaagattaatgtgctttgtttggagatgcaaactaattatacttactgcatacttctagtattctgtctctttcactcaaatctaaatgaatttagtcatacatttgcatacagtttaatgataacaataatgtatagttaatagatactcactggaacagaaaaaatttacttggcattttcccagctaattgtttttacagcttgacttcactttatacattaggtgcattcataaaaaggtttacataaagcaaatattttcatactaaatcccattttcccactgttgcccaatattaaatcttgagttatatttctacaggaaaatgctggctccaacacatcataaaaattataattaaaaatctaaacatacatgccaaggaataggtatgtttaatacattattttacaaaacactttatcctctcacctgcgataagaattaatctaaaagataatcattttgtttcatagtctcacaatcattagaaggacacgtatgttttaaaaaaattgcagggttttaaagtagcttcgtagaaactaaaagtagaaatataatttattagctggaactgccacatggagatctcctgtcagattttaggcaatgcaaatagtctcagattattgacagtaatcatttaagggtcttagaaatttcttcggctatgagtaacacactttggggggttcattacaatccaaaccagatgatttactggaattatacagatgctctggagccaataccactgtctgactcgaagcccacttttcttttttgaggcagggtctccctctgtcacccaggctgaagtgtagtcgtgcgattatgcctcactgcagcctcaactttcaaggctcaagcaatcctcccaagtaacaggaaccacaggcgtgcactaccacacttggctaatttttttttatttttatgttttatagagatgcttttcaaagaaataggaaaatgaactttgctcaactacctggatcctttcatactgtttaatattaaaagtgtaaaaaaagcaacatttgctaaaatagtacagtacttggaactttaagaaaactcttccacttttaaagtaccttggattaacgttaaacaatttataattttcagtcattttaaattaatttgtaaaatttttcctgcacaaatcctctggggaatgcactatgtggatttcaattacctatgctctccttttcctgcattgctgcagatacgcaaggtatgcttttacatcggttagtcagtgtgaactgtctcttattccaggatgcacactaagctgagaactatccaatcctctttatctttgccatgtaccctgaggtaaaacacagcaacaaataagggagatgatattggtagagacaatattgatatccagtctgactaccacacataggaagaggctgaagtaatacttagagctttgaaaggctaacagttttggcctcgggttatgatggtttactcctgttcacaatacagatacgtgtattttagtcacactaaatacaaagtgtggccaaagacattcttttctgtggacaaaatagtttttgaagatattctgaaataactcagtcatcatgacatcctactattcccaaagagtggatgttgacatgagttagtgtagcatagcagaaaaagcacgagctttgatgacatattactcctgggctggagggccagctcagccctttactagctgtgtcaccctatgcaagatacatgctgtgtcagaacatagtagccccaggaaatcatagttgttggcctctttccctcttgacaactaatccatcagccttctttgatattctacaatgtttctatgaagctgcagcatctctaaagcttttggttattccctgtaaagaatacccttagctgtggttatgctggcagaatctctagactttcatttcacacgctcagtggcacccctagtttcccattagcgcttgtaccatacccgggagaacatcacttcatgcctgtctaggagatctgacatttggttcattggtcactcaagaatgccaatctaggccaggcacagtggctcacacctataatcccagcactttaggaggccaaggcaggaggatcacttgaggccaggagtttgagaccagccttgccaaaatagcaagactgtctctacaaaaaacataaaaaattatctgggcatggtggtacacccttgtagttccagctactcagaagcggaggcaggagcattgcttgagcccaggaattcaagggtacagtgagctcagcatcaaatgtacccttgcggtttgagtaccactgcactccagcctaggcaatagagtgagacctcatctcttaaaaaaaaaaaaaagaggaataaaaaatgaacaccaatgcagttcaaaacaccaagcagtgtgcagaagataagctgataaattcagatactataaaaaccagtagaaatcaactaaataagcctctggaagaatttaatgtaaaataataaataacattactacaatttttaaaaattgtaaaggccatttatttacatgtttggggttctgttctacacagactgttctgtatagactgttctgtgacctgtcagtcaattacagtacaggagtctagtaactcatttatctttaaagaagtgcatcttgaccagagaacatgagaatgtcaacaaatcataaggaaataaataaagcaagttggtcaaggtccttgtaactgaagccaagaaaaagcctgggaaattaatgaataataagctcccaggaaactcaaactgagaaaagcagtaagccatgatgagaataatacctgagatgattaaatatatagtccaaatattactgcctacgatcctaaatcttacccacccgcaaaagagaacagccaaaaagctgaagttgctcatttttatctcaatgagagagaggagggataaggacgaggcaagaaggggggaggagagggagggagggagggaggaagacagagggaggaaaggagagagagacagcacacgaacacgagcaagagaacaagggcaaaaaatacttgctgacagtaggtatgatattaagaatattgtattatattgcattagaaatatagacgattgaaagctgacataaagaactgatttggatttagaaaagatcagaatataagatagttttatttccattttaaaatgagtatgtaaacaactattaagttcagtacattaaaaaaaaaaaaagtcttgctgcctttattgatttggagaaagcctgccacatactcttacaaagacaggatgtcaagcaaaccaataagtcattcaaacccagtgtatataaggttccttaagtatttgaggaatcaacatggagaattctgaaaatctgagacccacatgggagtaaagaaagaatgcatcttaagcaaattttacttattgttctctttgttatcctgaaaaagtcactcaagagaacaaaaaagggtttgcaaataagaccatataatcctatttgcagaggatgacacttcttatgagacttagaaacctgcaatacaatctgagcttataagactgagaactccaaagcaggagagtgatcaagactgacaagagtatgaccatggtgatctctcaggaagctaaaatcaccccagttatgcataagaaattctggccagaaactgaacacttcagagctggtgaactcatgataaaatcaaacagatgaagagctaaacttataatcttagttgtcacttgactcttgtttaatcaaaatgtaattctaatataatcaaaataagtatatcctgttacttctcaaatttagaaaggccagactcccctgcaaatgcttgagaaccctgtattagacctcatagttcctcaacaaagggaaaagtttagagtaaatgatacgcatgctattccaggaatagtgttctaggaaggctacaaaagggacaatttctgcttatacacagggaaaaagggagttgtattcactgcagccctagtgtatggtatccagcatgatacctagcacttaaaaggagtccactacatatctgttaaatgaaggagaggttatagctaacaattactgagtggtttactatatgccggcactgagcatgcagtaactcatctaatcctcacaatagcctgataaggcaaatacatattgttatcatttccattttacagttgaggaaactgaaaaacagagaagataagttgcttggcctaggcggaaccaggtttcaaatgaagatagagtggctccacagcaccccctaacctcaatactacattactatattcctctcaacttaaaagtgaatgattgcaagggagagacaggaccagcaagggccaggttctcagctatgtgggagtaaagcaatcaggactagcagaaggacaagttcaaagtgaaaggatgcatgtgagatctgaatggggaagtgctgggagtgaatgtactttgtgactatagactccaagtacctcttaacattgggcatgatctgaccttgaggcggctacaagatgaggatgggctagatcagtggtttcatctttgcctatataccggaagtacatgaggagctttaaaaaatactgaggacaagtcagtaagaaaaagaccactgaggccaggcacggtggctcatgcttgtaatcccaacactttgggaggccgaggcggctggatcacctgaggccaggagttcaagaccagtctggacaacatggtgaaaccccatttctactaaaaatacaaaaattagccaggcgtggtggtgggtgcctgtaatcccagctactcaggaggctgaggcagaactgcttgatcccaagagacagaagttgcagtgagccgagatcatgccacggaactccagcctgagtgacaaagcgagactccatctcaaaaaaaagaaaaagactactgaatcagcacaaaaactagcacaggttatacacttacagaccacagaaaaggaaatataaatgattttatgcatatgagaagatgtttgacctcattcataatcaaagaaatgcaaattaaaatgccaaagaggtatcattcttcacctaattatattggtaaaaaactccaaaacattcaaaacagcctcgtctctagtctagattattgtaataacctcccaactgctctcttaatcagcaaaacggtttttatttatttatttatttattttttgctcaaaacctgcgttggccggggtgggcggatcacgaggtcaagagattgagaccatcctggtcaacatggtgaaaccccatctccactaaaaatacaaaaattagctgggtgtggtggcacacacctgtaatcccagctccttgggaggctgaggcaggagaatcatttgaacctgggaggcagaagacatagtaagctgagattgcgccactgcactccagcctggcaacagagtgagacaccgtctcaaaaaaacaaaaaataaaaaaacctacattggttttgcatttcattcatagtagccagaatctttacaatggcctacaaggccttacataaatcaggctcccagtcacatctctggcttcttctaccactcacctcttcacttactcttctctagccacactagtctcctttctgctcctcaaactcaccatataagcctccacgttagggcctttacaatggctgatctcctgcttctccctcagacatcctcaaggctcactctctcaccttcttaaagtcttcgctcaaatctcacctctcagcaagacctaattcaaattgtgattcccatccttttactcaaacagggctctattcttcctatataagcacttttcactttctaatctactatacaatgtacttgtatttattttttattttctatctcccccaactagaatgtacacttcatgaggacagaaatgtctgttgatgtactccaagtacccataagaatgtctcaccacgtgtatgtataaagatacattctgcaacactgataacatcagaagattcaaaacaactaaatgtccatgaatacaggactaagaagttaaataaattacagagaaatcacacagtgggatactaaaccgttcttaaataaataaagcagtaaccctatttccagtatggccaagtaaactctcactgaactgattctcctgcaggaaacaataaattctgaacaaactgtaaaaaaacaatcatctaaaggtaccaaaaagtcaatgaaacaggtggacactggaggcaagttaacatctggaaaaaaagaacagcataggatgcatttctctcccttttttttcttttaatagcttgaatttgaaggcaagcccatctattccatgtgaaatagctaaaatgccactggaaaatagtcatactggtttgaagacccagcgataagggctcatattccaaagcccctggaatatggaggaggaaatattagaaataaaaatctgaggccgagggcggtggctcatgcctgtaatcccagcacttttggaggccaaggtgggtggatcatgaggtcaggagtttgagaccagcctggccaatatggtgaaaccccatctctattaaaaatttaaaaattagccaggcatggtggcaggcaactgtaatcccagctactcgggaggctgaggcagaagaattgcttgaacccaggaggcagaggttgcagtgagccgagaccgcgccactgcactccagcttgggcaacagagtaaggctccgtctaaataaataaataaataatctggagagagagggagcttcatattctatgtataaaactgttcgaatctctatctgacccctgaaccacacacacacacacacacacacacacacacacacacacacacccctggaaccaattcaaagaaatttagctacgagattagaatttgaggtgcctgccacccaatgcagaaaagttttgttgagaccccagccaactaactgcctgcctaaaaaatttttttggccaggcatagtggctcacgcctataatcctaacacctttgggaggccaaggcgggaagattgcttgaacccaggagttagagaccaggctgggcaacatagcaaaaccccatatctataaagataagacaacaaaaccccatatctacaaaaaattagctgggcatggcagcatgtgcctatagtcctagctactcaggaggcggaggtggggggatcacctgagcctgggaggtggaggttgcagtgagccaagattgcaccactgcactccagcctgggtgacagagtgagggcctgtctaaaacatacacacacacacatacacacacttcacaggaacataatagaatctaggttctacaacatataattttacaatgtccagaatacaatccaaaattattcaacatatgaaacaggaaaaaatgatccattctcaagagaaaaaaaactgtaagcagaaaactaccctgaaatgaccgagatgttagaattagcagcaaagggccgggtgtggtggctcatgcctgtaatcccagcactttggtaggctggggtgggtgggtcacttgaggctatgagttcgagaccagcctcaccaacatggcaaaatcctgtctctactaaaaatataagaattagccgagtgtggtggcacacagctgtaatcccagctactcaggaggctgaggcatgagaatcgcttgaacctgggaggcagaggttacagtgagccaagatcacaccaccgcactccagcctgggtgacagaggagactctgtattcaaaaaaaaaaaaaaaggaactaacagcaaagttatactatgttcaaagagatcaaagaaaatatgcttttaatgaataaatgtatggagaatttcagcagagaacagtaattataaaaagtagccaaacaaattctagaatatgatattcaaatttaaaattcactggatagacataatagccaaaaggagatgaccaaggaattaagattaatcaacagaaattatactacctaactattagaaaaaaagaagttaaaaaaatgaactgaagcttagggacctgttagacaaaattaaaaataattaaaattaaaaaaaaggtctaacagaaggagaggaggaaaaggggggaacagaaaaatattaaaagacctaagacccaaaaatttcctttggtaaaaggcatatttacatattcaagaagctcagtgaactagattaatataaagaaaaccacacaagatatgttatagtttaactgctaaaagctaaaaagacatattatttatggggagcaacaattcaaatgatggatgacttctcaagagaaaaaatctgaggccaggagacaagtggaacaacatctttaaagtctttataaagtgctgaaagtaaaaaaaaaaaaaaaaaaaaaaaaaaaagaaaagaaaaaaaagaaaaactgtcaactccgaattctatattcaatgaaaatatcttcaaaactgaaggcaaaataaagatgttttcagtaaacaaaaattcagagaaatcattgccagaagacctgcactacaggaaatactaaagggtgttcaaactgaagagaagtaaagccagacagaaatctggatcttcagagaaaacaaaaacaaaaacaaacacaaacacaaaaacaaaacaaaaaaagggaaatgatagatatgtgggcaaataaattcaagacctttttctcttaatttctttaagatatagactaaagcaaaaaatcataacattgtggaagttatgatctatataaatgtaatacaaatgacatctatatatggggtgggagttaaatagacctatatggttgcagggtttctaaaattttcataatcagtttagaaaaaataatgcagcttcttacatactgacatggaatgctgtttaaggtatttttcaaaggaaaaaaaaacagattcggaatactattacagaatgatactttcttaaagtaaatacatatacatatacatatccagagaatatcctgaaaggataatacatgaaactggcaggggcaggggcaaaattgggtaactggaatgcaggggtggcatagtatttacattaatatttgaattttttatattttatactgtataaaataaatacaaaaaattaaatacccacaaaaataaaaaagtaaaggctctgagaacttctacaataagaaaacgtttaaattttccttgatccagcattttacaaacctatatgactataggaaactgactcctctccctttttcaaataatagctatttctatcccaacagtgactgtgtattgcttacaccatattaaaaaacacttatttttttaaatcaattttttactagttgtaccaactaaatctagtaagaatataacccaggtcatttgaaatattcttttttttttttttttttaaaaagagtccatcagagtaacttcaaatataattgcaatttcactggcagtctaataaaattccacccactaaagttctagacttaatattttccaagacattcttaaattcagtcactgtcccatgcttacctgtttttaaaaactcattaggtacctctgttattactgtccaaactgaatgatatcaactatttctgaaaacataaaaaattgcttgttgaacatacaaatgattccataagaagatgccacaatatattttagttgctaaagattaatatgaaatgatcacatgacctgagtcatattcttactagatttagttggtacaagtagtaaaaaattgatttaaaaaaatgtgttttttaatatggtgtaagcaataccagtcagtgttgcaacagaaatagttgattaatatgaaatgatatcaactatttctgaaaacataaaaaactgcttgttgaacatacaaatgattccataagaagatgccacaatatattttagttgctaaagattaatatgaaatataaccattattttgatacaaaaaagaaaaacaaacccacaaattcttgttaaagttcaacagatattatttaaattgtagtatcttgtttttaacaatttaacagtttaatagtgaaaattttttctatgatacattaatttcactggttcgagtttctaaatccacttgaaaattttctttaatagtatattttattcaatttatctttgtacctacactaacaaaggaaaaagaatacaatttgtgaatacccagaaattccttaatcatggagaatgtatacaattgtttctatgctctttgaagggaggacatgatcctagtttcatttgtgctaacaaggagaatttattaccaaaacatctgggagatgaatgagatgctaaaacgaaagacatggaagcctagcaacatattctagtctagctaacccttcctaagaaaaaaagatagtactaatagtaaggtgctaatgagccgtacttggtaccctcatgctcgacaaccttctcagatcactcaggttgaaaataaacttctgtattacaactgaaactaaaaattacactgaaaaggacgtgtttagcaccgtagaggctcctacatatttaaagctacttctttaaaattccatgttttagatgtttgaacaagacatcaataattccattatccttgttctggtttgatattatttttatctctcccaaaccataaaatttgcaaaagaaaaaattcaactgcaaaattattcaatatttggaaacgaaaatttaacaaaccctcttaagaaccaataaaagctatcaaatagaatacaaatagatacataaaattttatacactggtaacagcattcaaatcaaagaggtgaagtattctaagaatatttactccagttgtgttaggaacaaactaaattatgacttcctcgggccaactaaatccagtaagaataacattctgttgctaatatgatcatatgaaataattatttttaaaaagaacttagcctatcaaagtcaacttcaaatataaaaagtgttccccatcaatcaactgtatagaaacaatataaaattattcaagatttattttacaaagatacttctcaaacccaagtgcttcctataataatacacatcatatactgtttactgatcaataggaaaaaagaaaaaaatgaaacaaaattagaataaaatatacaacttctaccagaaaaaaaaagagactagaaccagcagggacaaataagtggaactgattagaagacactgacttaaagaattggttatatataaaacatagcttcctatattggatatacctaaacttataatcccatacactctattattcattaatacagactagaggtccacaaacgttctgaaaagagccaaatagtaaatattttaggctttgcaggccataaggtttctaacacaccttctcaatactgctgttgtattgagaaagcagtcatagacaatacatcaacaaatgagggtggtggtgctccaataaaattttgtttttatggacactgaaatctgaatttcatataatttctacacatcacaaaccaatcttctactaattttttcaatgatttttaaatatacaaccttagatcatgggacatacataaaaagaaagctgtgggctctagactgccaacccctgcctcatctagaaatacatgaaaagtagttactagaaatactttccaaacattctttctaataactgaatatcaataatgttgcatttttactatgccattatttttaccatatgtaagttctaaaacagtataatctgccaaaataatgacggaatcaaagctaagaaagctaaaatgaagtattcttaatatttcaaagccacaaaaaagaagcaataaaaaaaacagaaaagtgttgtttcattacacattcctaggtcataaatttcacgtagacttaaactaactctatataatacttgcccactgagtgatacaaagttattagttatattatgccaaatttagaatttcattaattccaaatgtaatatagtattaaaatgtggccaaaagaatcctggagcctgggtgacatggtgaaacctcgtctctacaaaagacacaaaaattagccaggcatagtggcccttggaccacctggtctatattaacgagctactagggaggctgaggtgggaggatggcttgaccccagaaagtggtggttgcagtgagccaagatggtgccactgcactccagcttgggcaacagaatgagacccctgtcctcctacccttgcaaaaaaaaaaagaatcctggtagtttcatagttaacactgtttcatatggtaatactgaaatgtcttagaaaactcaaaggacaaagttgtgaaaactgtattttaattatagcttaccctttaactagttgttaagatcttcagcaaatcatgtcagccagcatttcctaaagtttgccctgtatccacagatcattcattaatgtaacaggatctatggccaattgagtctgagaaatgctacacattatatacatctctagaagatttataatgtacttaagcagatcataaattctgagaagttccgcagtaaagaaaactgttggtttaatctggtattgtccaaacttaaccactttttgtgtgtcatacttattaacatccaaaaaaacctaaaatttcttaaaacatactttagaaaattttctaatctctagtcgaaatcagataaacatccctttgggttctaaattttagaattctgtgagactaattctaagtggtaattttgtgaaagctgttcaactattaagttcaggtttacaaacctggaacctctggatcaaatgtactcttttatactcccacaacactatgaacttcctctactagagcacttatctttaagtagacatcatttctctaactttctagacttactccttaagtgggagatggaaccatcctagtttcttcaacacttaggagaatgcttggatcactcactaaatgtgtttcggttttggttttgtttctattttattgcaataatctcccacttgatctacccataaccactcttgcctttctcctactgcttctctatgcaaacatggtcaggtctcccccactcaaaaactttcatctttgccaggtgcggtggctcacgcctgtaatcccagcactttatgaggccaaggtgggtggatcatgaggtcaggagatcaagaccatcctggccaacatggtgaaaccccatctctactaaaaatacaaaaattagctgggcgtggtggcatgtgcctgtaatcccagctactcacgaggctgaggtaggagaatctcttgaacccgggaggcggaggtcacagtgagccaagatcgcgccactgcactccagcgtggcgacagagcaagactccgtccaaaaataaaaaaaaaaaactttcatcttccactcttctgaaaatgaagaccaaatttcgtaaaatagccctggaggatctagtctctgcctaccctctcctgctttacctcttttatcactgcttttctttattttatctgctttagccatacaaagctaataaagatgaaactagacggcatagagaaaaaagcaaggcaggggcctggggaatgtcagggtaggacagggtggagtgggttggggtgaaatgaaaggcaagactgaaaaggttacattagaccttggcaaatgagagagaacagaaaataaatacctctaaaatgggagtatacctgacttgtttggaaactgcagccagtgtggctggagtgaagttggaacagcagggagcagcaggtgggttagagaagtaataaaggtctgaaaaagcagggctttgtagggtgatgtatatgcaatcaactcccatagttacctctctcatctagatctctcctgagtccagtctcctacatgaaacacatatttgacaactcctcttggatgtcttacagacatgtctatccccgaagtcttaactgcactccaaatctgtttcttctccattctttcccatctcagtaaatggcagtaacctctatccactggcaaaagcaagaatcctaaaaggttctcccactaaatttagaatagacatgaaattccaattaaacatcctccacactaggcagctatagcctttaattaatatagcaaatatggtaaagaccctaatcccatacatacagtactccgttaagtattaccacccagtcacatattacacacatacaagaaggaaatcacttgcatctgagtcccaatcaaggagttcacattcctatgggggcagagactaggtgaagtgggacagtgaatctgcatatcctctgaaatgcccaatgtccatctaagacaaaatggtacctgtacccagagggttagcccaaatagtataatagcttcgagctaagaggtagccatcatggaggaagaggtccttatggcctctgacaatatcaatttaaaaacaggaggtccagtgagcccatcaagcaagatcaacataccatatacctgtacttttatactctaaaaagagatgggaacacagactaggaactactgccgtgtttgaaaatgcccccatgtttgttttctgtgctactgtctgttacttcatagtgactagaaacaaactctacaacaaaaatgacaatacattatggtgtattactacagcagaatactatgtaaatttattaaatagttgtacacttagttacatggaaactcataacacattctgaagtgaaagcatagtatataatttgcataaatagatacactcatataaaatgctacagctgcacctctggtaagccaaaggtttgtatggacttgtcctagaaagcaggaaagtgaggaactaagaaggcaaaatgaaaaattagaaatagattttgaaaagtaagttttacaaacttacctgacaaatttaagagaagtgaaattatacatagtgtattcactgaccacaatggaatcagactaaacatcaataacaaagataacaggaaaaatctccaaacacttggaaactacacttctaaaataatccaggggtcaatgaattaacaagggaaatttttaaactgaacgaaaataaaatacaatatatcaaaatttgtgagatgcagaagtgagaaaaattcataacactaaatacatagatcagaattagccaggtgtgcacctgtagtcctagccactcaggaggctgaagcagaaggatcacttgagcccaggagtttggggctgcagtgaactatgattatgccactgcactccagcctaggcaacagagtaagatcctgtctcttaaaaaaaaaaaaatgttatgaagaatggtctgagaaaaaaaagaaagaaaagacgaaacgtttcaaataaataatctaagcccacacctcaagaacaaagaacaagaaggggaaagtaaatctaaagaaagcagaaggtagtaaatctaagaagagaaatcaataaaactggaaacagaaaaaaactatacataaaagcaattaaacaaaatcttggttctttgaaaaggataataaaactgacaaacttccagcaacactgacaaagaaaaaagaagacacaaatcatcaatatcagaaaagaatcagggattatcactagagatcctgtagacatcaaaagaataagggaatactaagatcaattctacacacagaaatttgacaattagacaaaatgagccaaatcctcaaaaagcacaagctatcacaacttacccaatatgaagatgacttgaaaagccctataagtattcaataaattgaactcatacatttaaaactcctaaaaaagaaaatctccagttgtgggtgttttcaggaagaattctgccaaacttttaaagatgtaatgtctactctataaaatctcttccagaaaacagaagaggagagaatgtctcccaactctttttatgagtacaatagtatcctgatataaaaatcagaaaaagaatgccaaaggggttatggtggggggaactacagacaaatatcgtccatgactatagagacaaaaaaccttaatagaatattagcaagtagaatttagcaacatacataaagaatcttagaccatgaccaagtatcgtttattgcaagcatacaaggctggttcaatgtttaaaattcaatcaatgtaatctatcacattaacaggtcaaaaatgagaaatcatatgatcagttaattgatgcagcaaaacatttaacaaaattcaacacccattcacgataaaaaaaattctcaaaaaactaggaagaagaacatgtccagttggatttaaaatatttactaaaaatctacacctaaaatcagacttaatggtgaaagactgaatgttttgtacatgaagaatgaggcaaggaggtccactcccactactcttacacaacacagtgcttgaagatctagccagtgcaataaggtaagaaatgaaacacgtattagtccgttctcacattgctataaagaaatacctgagaccaggtaaattataagaagagttttaattggcttatggttctgcaggctgtacagggagcattgaggcttctgcttctgggaggcctcaggaaatgtacaatcatggtggaaggcaaaggggaagcaggcacatcttacatggccaaagcaggaggaagagagaaaggagggaggtgctacaattttaaacaaccagatctcatgataagtcactcattatcacgagaacagcaccaaggggatggtgctaaaccattcatgagaaaccatccccatgatccaatcacctcccaccccacccaacctccaacattggtacaattgaatatgagatttgtgtggggacacagatccaaaccttatcaaaatgaaaggcaagcagatcagaaacaaagaaataaaaatgtccctatttaaagatgaaataattgtctgtgtagaaagaaacatatttttaattacctagaactaataagtgaattagcaagtttataggacacaagatcaaaatacaaaaattgaaatgtaggtctacataccagcaataaatgcatggaaggtgaaagtaaaaatacaagaaaagatttactctaaaatttacatggaaaggcaaagaaagcagagtattcaattttgaaaaagaataaagcataagaaaccactctatattattttaacacttattatgtaacttcagtaataacactgtgaggagttggcagagacacagagttcaacagaacgtaatagagaacccagaaacagacccacactagtgtggccaactgtctttacacaaaggtgaaaaagcaattcaatggaggaaggagagctatccaacaaatggtgctgaacaactggataaccacaggcaaaaaaccgaaacaaaaacctttgacctaaacatgacacctgataaaaagaagctaattcaaaatgtacatttaaatgtaaaccataaaacctttaaaagaaaacctaggagaacacctttggggatctagatttggtgaggagatttagacttgatacccaaagcacactcacaaaaaaaactgataaactggacttcatcaaaataaaaaacttctgctctatgaaaaactatgttaagaggatggaaagacaaactatgaacagggagaaaagatttgcaaaccacatatctaacaaaggatttatatctaaaatatatacaaaactctcaaaactcaacagtaaaaaaaaaacaattttatagaaaatgtgcataagacagagatatttcaccaaagacacacagccagacacacacacacacacacacacacacacacacacacgaaaagatgttcaacatccctaaccattatggaaatgtcaaattaaagccataatgatatataactacacatcagaatgaccaaaataaaaatagtgacaaccacaaatgctgtggaggatgagaagaaactgaatctctcatacattcctgattgtgatgccagacagttcagcaactctggaaaatagtgtagcagtttcctagaacactaaacatatatttactacacaactgaggtatcacactcctgtgtatttatcccaaagaaataaacatttatgtccatacaaaacccatacatagatattcacagcagctttatatgtatagctaaaaactgaagaaaaacaaaacatccctcaataggtgaagggttcaacaaactgtggtacacagaacactactcaaaaacatagaatactattcaaaaagtcacatactatgattccatttatgtaatattcttgaaatgacaaaagcatagagatggagaacacattcatggttgccaagggctagagatagtagggtagcagaggtgaagagaagagtagttaagggacaacataaggaagagctttgtggtgacagaataattctgcatcttttttttttttttttggagacagtctcactctgttgcccaggctggagtgcagtggtgtgatcatggctcgtagtagcctcaaattcctggtatcaagcaaccctcccacctcagcctcccaagtagccaggacaacacacatgtaccaccatgtctggctaatttatttttatttttgtagagataggatctcactatgttgcccaggctggtctcacactcctggtctcaagctatctgtcccacctgggcctttcaaaagagctaagattataggcatgagtcaccatgcctggccgagttctgcatcttgtttgctgcagtgcttgcatgaatctacatgtgacaaaatgaaacagaactacaacacatacatttaccaatgtcagtatactggtttgaaatattgtcctacaagtctgtaaaatgtaaccaatgggggagactgagtgcagagtacatgggcttctgtgtgccatttttacaactttcagtgaatctctaattatttctaaataaaaagatttttcaaaaggaagacagaataactaaatcaatagtaattagcagtatctacattctcaagtttccaaatacgtatcttgaaaatttacatcccacatatactatcattcctagtattttcttgaatgattttatttcatggtgatttttattctagaaaaaatacgttctgaagtgaggcttcgagtgttttacttcacagtatccaaaatacccaataacaaaattattttgtaaaatgggtttgagtcttgcagaaatagatttataatccaattctataacttacttcataaatgatactgagcaaattaaacttgagtctctgtttcttcgtaactaaaacagggataaaatatatataccttggagaaccaccacgtctgtgtataaagaaactggcagtgttctacacacagtagactacataacttttactgttatcatcttatctccctgaaggtaacacacattcctatgggcaggaacaatttcatgtatttcccttgaatcaccttactgctgtcagcatggtgataagtatacaaaaaatacccaacatgcaattttctttgaacttttaacttctgccattaaaattaccctttttctttactgtaaatggttatcctctgattttctgaaaagggttaggtttggagtctttcagttgtgtcttgtttttcaaatgcgagttttcttgtttttgttttttagagacacagtctctctctgttacacaggctggagtacagtggtaccatcatagctcactgcagcctcaaacttgttggctcaggcgatcctcctgcctcagcctccctagtagctgggactacaggcctgcaccacatgcccaacttattttttaattttttgtagagactaagtcttgctatgttgcccaggctggtctcaaactcctggcctcaagcaatcctcccaccttgccctcccaaagtgctgggccaccaggccagcctccaataagagctttttgatgaagctaatatgtagtttctaaaggcatcaagccaagaaagagtagttcaatggtgtaatagttcagagatgcaaaacaaagaccgagatttccaaacattctgcacatcccatattcttgtttctaactcagccagttaaaaatatttttttgatatccaataagtggcatttttccaacgtctcatcacttcatacagatcattattcttgcttaccatttaagtaaagacttctatttgtatttaaattgactaacactgctccccattacccctttctcaacacagaggtccaggttgccgaccctgatctttgcaattttctagaaattatctctaaactcacctattcctcattatatttgttccatcacaatagaaattataaaaaagataataccagcccccactctgtaatttggtatcttctctgaagaatttattctactaattcttctcctagttctaaactcctaaaaggaactgtcaagtaactatcaaataggattaacaaactcaactttaatactgctcactaagcttctttctcttacttataaaagtcatattaaaatgtactatgatggacagggcagtttgtatgatattatcatcaatatatcacaacaaaagttccaaacacaacgctttagatgtctttgagaaggttttagatatctttgagagcacactactcaaagatgctcttctatatttaattttttataagttagtatatatgtcttctatataattttatatatatatatatatatatatatatatatatatatatggtgcaaagatagcacagagttcccacacacccttcatctagctttccctaacattagcaactgacaaaaacacagtaacactggtcaaaactggaaactgaacattgatacaacagtattaagtaaatcgcagattttattcaaagattctgtactttttgagtaactggtgacactggacttccagatatgatggggataactgaatatccagatgtcttgggagaatttctattatcattcctaatttaacatggtcccagctgctctatgatgagctttgattctctatgagagcatagagtcatgctaacatagaatcttatgttggatgaaaccttggaaatcatttaaattttttttaagtataaattatgacccattaacaggtcatgaaataaatttaataaaccacaactataattttttaataaaacaaaatagaaaatattagagtataatacagatgttatcgtatcataaattttttgttttagtgatatatgtaaaaatgtatatgtgtgtggatgtaggtatgtatttatatactgggtcacattatttttaaaaattccttagcaaaggtcagagtcaaaaatgttttaaaagtcactcatctatatcaaaccaaagaaagttctctttaatattcctgacaaatgataacccccatctctaactaaacactattaaaggtagaatatttgctacttatacatcagacggtaatacgtattaggacatttttaatgtggaaccaacatttctctgttgacttttgatctacaactcacaaaaagggtgggttttttccttctaaagaaaaatactgtgcaatcctatttctttttttccatcaaattagtgaacagaagttcttacacctagaaatcaaaagttccaaaagaaagtttccttttcagttcccaagaagagactctgaaaataaagggcaataatagaagaacagaaaaatatatatgtaaggactctaaatgggagaatagaagtaatgccaagcaaaaacgtcaagtcgataaaggaacatctttgaggaaatgatataaatattggatcctgcccctggccagccctgcccggccatgcgtccctcctcctccccaccttgtggcgggcagcagccctctagctttggctccgtggactggctctcccaaagcagctgctcagggccgacccacacccccaggcctgccgaggtctccctggggagcctccctggcccggaccaggcatcgggccccgaggagccccctcaggccgtcagcatcaaggaggctaggtcctcaaatctgcctccgccagagagggctatggctgggttgaggaaagggccaaacgcctggcgggccccactgtgtccacacagccttcaccacggagcaggtccgtggcttggagggcatcttccagcaccaccagtacctgggccctctggagtggaagaggctggccagggaaatgcagctgtcggaggtccagataaaaacctggtttcaaaatcgccgcatgaaacacgaacggcaaatgcaggactcccagctgaacagcctcttctcggagtcactgcacgcacccctggctttccactcaccgtcttctggccttgccaatggcctgcacctgctgtgcccttgggcacccctgcctgggccccagactctgatgctgtcccctggctccttctggggtctctgcaagtggaacaagaggccctggcctctgagtgggcctgctgctgtgggcagcctctggcgtaccaccccccaaagcccaggaagtggcatgcatacgctgggaccagccctgtccacggggccctggggcctggtgtgctctgccggagacgggatgcattttgaggaaatgcctctgactccaggcctcccatacaggtctgtgcagattgcacctggcacctacccagagaactcagctgttctgtttacattgtggaggcacctctcaccctgacccacgcaaaggttctggagatttctggagaatatatttattaaagccacctcttcaccaaaagttaccaaaagggttggtttaggaagtaaatgaagggtcagtgtagagtcaaacgcagaagtgggcttgttatagggagggctttcagcatatgataaaagggtaatttgttttttaaaaagtgttggaaaaactggttttccagttggaaaaagtaaaggttgtaggctttgtgtgtaaaaaagaaaaccatgaaggattggaagggggaaaaaaaagaaattatataaataaaattatcaaactcaggcagataatttcatagaagtatgcattacttactagcaaatcttctcattttggaaaatgtttcactttttaatttttttagacacacaaataagaagaaaaacttccacattcaaaagaaagactaaaccatgcacaaatgaaccctttctgtttcctttaacatacaagaaagtgatttcatgaaatttattaaaactgttatttctggccaggcgcggtggctcacgcctgtaatcccagcactttgggaggccaaggcacacagatcacgagatcaggagttccaagaccagcctggccaacatagtgaaaccccatctctactaaaaatacaaaaaaaaaaattagccaggcgtgctggcgggcatgctggcaggcgcctgcaatcccagctactcgggaggctgcggcaggagaatcacttgaacctgggaggtggaagttgcagtgagcagagatcgcgccattgcactccagcctaggtgacagagcaagactctgtcccaaaaaaaaaaaaaaactgttatttctgtccaattccaagcaaccaaagtacttcatgtcattaaatatgtatgtgtaacacacatacacatacatatatacatatagatattcaccaaaccattattcaactatctggccacttcattctactcaaaatgcagatccttagcaaaatttatgacagaaaaaaataaattctgaagtaaaaaaattcaccaactagataaaactcgatgttttccacagttaaggggacatcttagggcgtaattaaagccctgctactcttactttgccccaaattcaaacaataatatcggttttcaagataatagcaattgaaaagcatcaaagaaaggagcaagcaatatgcaaaggtgcactgacaaaaacaagaaataagatgacaatctgactgacaacaatgatttggaaagtaactaaaagcacacttgggtactctagaaacagatgtctaggattatctggtataaggacaaaccatgtacatatctcatgaggcttgtaatacttattgtttataaggttgataatgagtcaacagcaaggattcttcatgctaagaattgtggcattttctatttaaggatataaaaaatatatgccataacttttagaaatatttctatccaaaattactgaactaagtaaagttttaggttccaaaaaaaagtgaaccctcagcaatgtggggaagctagctgtccagaacaattatccttaaggagtgtggttaactgtaattcttcccttcttctttacttctttcaaaagttctatgactattcaaaccatctcataatctttgatgttaatagagggtaatgtgttttgggttgtggggaccagtatttaaatgactggacatagaattacttggggaagttttaaaaaacagtgcggttcaagctctgcaaccagaaattctgatttaattagtccacataaagtctgggcatcagaatttttaaagctgcccaggaaagcctgatgttcagtcagtgttaggaaccacttaggtaaacagttttcttcatgacacctttaggagtcttcaagagagatacagtatgcagcatttccaaaatttgtcttcaaatcccttttaccatggaacatcttataacactgacttaggtaactcttcatctgaaaatcaaggtaaatattaagtttagaatcaagttgtatagcttttcaaactttgtaaaagttctaatgtggttaggaagagggaaggggagggaaaaaataaaaggatgacttacttttatcttgctaccacattttttatattacaaaaattccaaatgaaatattttaattttaacttaaaatttcatagtttattttaatcatgcttatattaagcctgtgactcaaaagcatttacatgttgtgaaagctaatttcaaagataaaaccgtgctgccctctaatggttcaagataaatatttttacctatacatagtagtaaggtgataaatacaattttattattttataaatgggaggattacattatataccagaaaagaaaaataagatttcaatttttggtataactgagcccaaaaacttaactatgactgctatgttcaagctcaagacccttttaactgtccaggcacactggctgacccctgtaatcccaacactttgggaggccaaggcgggaggattgtttgagcccaggagtttgagaccagcctgagcaacatagtgagaccccatctctacaaaaaataaaaaattagccagacatcatggtgtcccaactactagagagactgaggtggaaggatcacttgagaccagaaggtcatggctgcactgagccgtgatcatgccactgtactccagcctagatgacagaacaagattgtctcaaaaaaaaaaaaaaaaaaaaaaaagaactcttttaattatcaaacctttttttttttttttttttttgagacggagtttcgctctgtcgcccaggctggagtgcagtggcacgatctcgactcactgcaagctccgcctcccgggttcacgccattctcctgcctcagcctcctgtgtagctgggactacaggcgcgcgccaccatgcccggctaatttttgtatttttagtagagacggggtttcaccgtgttagccaggatggtctcgatctcctgacctcgtgatctgcccgtctcggcctcccaaagtgatgggattacaggcgtgagccaccgcgcccggcccaaaccatttcttaaaccaccacatttgcctatgcatgtgtaaatcaggataaaaatgtacacctcttctgcattctgcaatagccatctctaacttagcttctttttcaaataaatctatggcagtagtgttcaaacttgaatgcttgtaccctacaaaaacattttagaaagttacacatattcttgcatatttcttcttacagctaaagttttaattcacatttttaaaatttcattaagtacttgcaaaggatgtagtttctaatttactgtaaatatttacattttaaaataaaattatgtcactcttttaagtgtatccaaaaactgaactatcatagcaagctgacatccacctttatctactcaaaaaatacataaattctgttaaatacaacagaaattttacaccagctgtatcttgtttaacttgcattttactgcactctctccatttcatcctaatttcatattttataactaaaagtcttttattcctcattctaccataattctatgcaacaaaaatagatatattaattaaaattataggagtttgtacttccatgtaagttagaaaatattttgtgcaatgagccattattgaaattattagcagataatgaaacaaatattataattttaatacatcttttttttttttttttttttttttttggagacagagtcttgctctgtcgcccaggctggagtgcagtggcgcgatctcggctcactgcaagctccacctcctgggttcacgccattctcctgcctcagcctcccgagtagctgggactacaggtgcctgccaccacacccggctaattttttgtatttttagtagagacagggtttcaccgtgttagccaggatagtctcaatctcctgacctcgtgattcgcccgcctcggcctcccaaagtgctgggattacaggcatgagccactgcgctgggctaatttttttgtatttttagtagagatggggtttcaccgtgttagccaggatggtctcaatctcctgaccttgtgatccgcccgcctcagtctcccgaagtgctgggattacaggcatgagtcaccgtgccaggccacataatttttaaacaaaaagtaaaatattaatggacatgaaactcactgacatttacagagctttttttctttatattgatgtatctaagaaagaatatttcttactgctaaaatgagataagttctcaattctactcttatttcacttatttcaggtataatcactaagaaatgtaattcacattaaaaactaaatcactctgagttttgttataacaaggtcactcaattttttctatgccaaaacacacactgtgatctaccatcagaaattatttttaatgacgtggcaattgatgttaagtcctctcacaatttgctgaaagcaagtaaccagaaactacctgacttacaaaggatgcattacacatttgctacaattattcagattctccatttctgggaaatattccaaaacagtattactatgacttatcaaatgattatgaattatacctgctattgtttcccttagcagtttaattttatatagtccaaaagggtagaaaacatcaaaatattgttaattccaatatccttttgctgaaataacatttgttttataaaatgttttgatcttatcatacacttcaaatatattttacccaaatggtagagctgcaaacagctcatttaatttatggtaaacacccgctgtcaaccaaatgccaaatcaaaatctgcctttatttctcaactcaaatacatttcaggcttaaacaaaaaagattttaaatttgtctcataaaacaaggcccaaatatacactacatacaagagacaccaaaaacagagaaaagctaaaaagttgtactagcttaatgaaaacggaaagcagtgattgttatgctgatatcagacaaagcagagttcaagcaaaaaggtattaatggcgaacactaggtattaatgctaaaacctgcaattcttcagtgatatataacagttatgaatacctatgcaccaaataatgcagcagccacctgaagccaaaaactacaggagatgcaaggagatataaacagaagcacacaaatactaagagattttaacacatcactctcagtacaacacagatcaagtggacaaaaaaacatataaaagaccaaagcaacaaactcttacagaagatgttatgctgtatatgtgtgtacatatgatcctccatttgatctcaaagaaagcataaggaagtgccacaaggtggagatattacagtctcaaatcaaaatataacaaactagaaattaataacaaaattttaaaaagcaaagggcccttctacttgaaaaataaaccttttattaagtaatttgtacatgaaagggaaaatacaaactagaaaatcaatactgaaagaataataaaaatactacatagcagaaactatagtacaaatgtaaaacaatggtcgaaggagaattcataaccttcaacagttatagcaataaacgtattcaaatgaatgaattaaattcaacataaatttttagaaggtatatattattactaatttcatattagattttatttgctcatttttttcttctatatttatattggtattagactgcaacttccttttctgtactgtctttaccaggtttaggtgtcaatgacaactttatttgctaaaaagaattcagaggccgggtacagtggttcatgcctgtaatcccagcactttgggaggccgaggtaggcagatcacctgaggtcaggagttcaaaaccagccaggccaaaatagtgaaaccttgtctctactaaaaatacaaaaattagctgggtgtggtggcgcacacctgtaatcccagctactagggaagctgaggcacaaggatcgcttgaacccaggaggcggaggttgcagtgaaccaagattgcaccactgcactccagcttggcgacagagcaacactccattaaaaaaaaaaaatatttaaaaggcacaatagtcacactcagtaacacggggttttaagaactatcttgggggactgggcacggtggctcacgcctgtaatcccagcactctgagaggctgaggtgggcgaatcacctgaggtcaggagttcaagaccagcctgaccaacatggtgaaaccccatctctactaaaaaaaaattaaaaaattagccgggcgtggtggcccacgcctgtagtcccagctacttgggagggtgaggcatgagaatctcttgaacccaggtaggggaagttacagtgagcgaagatcgtgctattgcattccagcctgggcaacagagcaacactccatctcaattaaaaaaaaaaattatcttgggaagttcaccaccatttatcacaatgtttctatgagaaaatacattccaagtttccagtaatcaacataaaaacaaagtttggaacaaggcctatttgatgatcacccaaaatcttacccagaatttattagacacaatattacatttccaagaaattatgttattgcagaaacttctataaacatgtaacataaaccctcattaatagtcaaagcaaatttgttttaaaaaccatacttatgccgggcatggtggctcatgcctgtaatcccagcactttgggagcccgaggcgggtgaatcacgaggtcaggagttcaagaccagcctggccaacatggtgaaaccccgtcttcactacaaatacaaaaattagctgggcatggtggcacgtgcctgtagtcccagctactctggaggctgaggcagaagaatcgcttgaacctgggaggcggaggttgcagtgagccaagatcaagccactgtactccagcctgggcgacagagagaaactccgtctcaaaaaacaacaacaacaacaacaaaaacaacaaaaaaaaaaaaccaaccatacttaaattgctttctaaatccaacggacactaaaacttcacaaaaccttcactgaaaatcagtatttgaagaaaatgcataaaaagtgattgagcattaaggagaaacagctggtggataacgttttttgattcataaaggaaccctccaaaacaaagcagaaaaaaaagcttcaaaagtttttcggaatttttagagcaatgactggcaacctatataaacctttcagaattctgaatactgaaagcccacgtatttatatgtcacatgacatattaaaaagagcttcatggcctagcttggtggctcatgcctgtaatcccagcactttgggaggctgaggcgggcagatcacctgaggtcgggagttcgagaccagcctgaccaacatggagaaaacctgtctctactaaaaacacaaaattagcctggcatggtggcacatgcctgttgtcccagctactcaggaggctgaggcaggagaattgcttgaacccgggaggcggaggttgcagtgagctgagatcgcgccattgcactccagcctgggcaacaagagcgaaactctgtctcaaaaaaagaagagcttcataatttaaactgtcattgtacccagatttttttttaaacacaagtaaataaacattgctaagcaagattttgctcaactgaacaaaaaaataaagatattggtgaaagagcattgcttcaaacacaaaataaaccaagtatttttcagagcttgagcaacagattaataaaactagcctcaaataaaagaatagagaatgctatttatttctccctttctagacaaaagttgttaaaatttttaaataactttaggactagaaagatagaccccttgttgtaaaaacattacgaattcagtattaatcagatttaagtcatggctatattttcctaaataatcgcaacaaacttgaggggagaaaaacttacggtaattatctttttgttgccactttgtttatattcacttttgtagagaataatgcttaaacttttagcataaagaactcaaaaaggatttcaatagcattaaaaaaaagtgaccaaatgaaaatcagactaaggtcaacccaaaattatagacattttttaatttaagaattggctctgtttacttatgcttttgtttttgtctaaaggggatatgaaaaatgttaaacttgtgtgacatatcctgtaatcccagcactttgggaggctgaggtgggcggatcacaaggtcaggagttcaagaccagcctgaccaacatggtgaaaccctgtctctactaaaaacacaaaaattagctgggcatggtggtgcatgcctgtaatcccagctactcaggaggctgaggcaggagaatcacttgaacccgaaggcgaaggctgcagtgagctgagatcgcatcattgcactccagcctgggtgacagagcgagacaccggctcaggaccaagattaagtggtgatccctgggcctgcctggctgcctctaaaaacagaacaaaggagcatggagtcctgaagttctatcatggtaaatgtattaccaagttattagtacttgaatactaactctgtggcaagaaaacagaccagatattccttgggaatgaacgctgagaaagctgaaagaccagcttgaatggctatcaagctagacaaggcagaagaggtatgtgtataaaatgctgcatataattacacaaaggccacagattttccaaagctcatgtttaaatcctaacttaataactcctgatatgcgcagttttctaagggagaaatgattctctgggtaacattattccagggtcaagtaaattttaacacgggccaaaaatatccatatgcaatagagaatcagccattcctcctataaagcatacacccagaaataataacagaatcacagcctgatttaatttttttaattaagcagatgtaaattcttttaaatctcccacagtaacaatgtccagtacaaatacactgatatttagattcttttaaaggaactcaaaacactacagtaaagtaaggtaaagggtcatgcatggtcactgaattactttattaaaacctgaaaacaacactgtaaggaagcgttatttattctcctaacttacaggtgaattaaccgagaattagaagtcgaataacctgctcaaatccacataactatgattccaactccagagtttgtacttgtaactaaacaagctaaaatgcaataaaggctaacaattataataacaatcagtgcacaaaggcagaagctaagcaactgaaccagcctatcattctgtcctcaaacaccctataaggtaaatattattttaacctctagaaaaacatttacaatgtttttggccaaatgcttgagaagcaaaaatctggcgctttcttataaatatttttagcctcaaagaaaatggaggattacaaaatgttattttttaaatcaatgttattgaggtaaaatttacatttaatgaaatgtgcctattttaggctcagagtttgatgaattttgacatacactcatattaacaatcaccaaaatgaaaatacagaacatttctatcacccccaaaactttccttgtataggaaattcccagccccaaatctagacaatcaaagaacctctttctgtcactacggattagtttcgcctattctagaattccacaaaaatagaatcttacagtacctacactatgtatctgtcctgtcttcttttgctcagcatattgtttctgagattcatgcatatcattggatgaatcacaagttttgctgttgaatagtatgccaagtcatggttacattacagtgtaaccatttacctagtggtagatatttgggttgtttccaatttggggctattataaagaaaaatgctacaaactttcatgtataagtctttgaatggccatatattttcatttatcttaggtaaataccacatggaattgctgggtggtaagataagtactacatgcttaacttcataagaacatcataaactctgacaaggtgcctgtaccattttatatccccagcagcaatatatgagacttccagttgccccaccatgacactaggtgttgtcagtctttttaaactttagctatggttttaatttgcatttccctgatgactaatcactttgagcatcttttcatgtgtttattagccattcttatctctattgtctattcaaaaatattgtccatttttgccttattaatgagttgtaggtattcctttatatattctgaagtcctctttcaaatatatgtattacgaatgtttccttctaatatatgtcttgctttttcattttgtaaaaagtgtctttctagtaccagaagtttaaattttgatgacttataatttctcaattttttcatgatccatgtttaaattttgatgacatgtaatttctcaattgttgcatgatccgtgctttttgtgttctaagaaatctttgtctatttccaaagtagcaaagtattttcttctggaaattttactttaacttttacatatatgtctatgacccatttctgatttatttttgtctgtggtgtgaagtcaaggttcaggggtttttgttgttgttgttgttgttgttgttgttgtttttgagacagagtttcactcctgttgccaggctggagtgcaatggcacaatctcagctcaccacaacctctgcctcccgggttcaagcaattctcctgcctcagcctcctgagtagctggggttacaggcatgcgccaccatgccaggctaattttgtatttttagtagagacaggttttctccatgttggtcaggctggtctcgaactcctgacctcaggtaatccacctgcctcagcctcccaaagtgctgggattacaggcatgagccaccgcgcccagcccaggttcttttttttttctgtcagaaaggccaattattttactattatttgttggaaagagtatcctttccccattagcaccttcactggaattaattttgaaagaattaaattgttcatatatggattgatctatttcttgcctccatattccagagatcagcaaacttctgtaaagggcccaatataaaatattttgggctttgcaggccatatgatctattacatctattcgactctgctgttgtaacacaaaagcagactataaataagcaagtatatacaacacataagcaagtgactgtggctgtgttccaatgacactttactgacacacactagaatttcaatttcatctaaatgtcatgtgttgtaaaatatcattttatttttgatgtttttccaaccacttgcaaatgtaaaaaacattacttagcttgcaagccatacaaaaacaggcaagccagacgtgacccatgggctatagtttgccaactgctgttttattctgttccactgatccatatatctgtccctatgttaattttctgctgtcttgattattgtagctttatagcaaatcttgaagtcaggtagtgtgggccagccaattttgttcttttcaaaattgctttggctactgcaaaaacaatttgcagtagccaaattgtttttttgcatctccaaatgtcagcactactttattaattttaccaaaaaaaaaaaaactctactatgatttttgttacaactgcattgcatcttcacatcaactttgagagaactgaaatcttaaataatagagtcttctttaatttgagcagtattttatagccttcattatacaggttgtgtacctattttattaaatttatctctgaatatgttttcacgctatttaattccccaactgctcattactatttactagaaataccactgatttttgtatactaaccttgcaacttgtggccttactaaattcacttattcagtagcttttcagtacttttgatttattattttctacatacagaatcatggtgtctatgaagatagttttatatctcctattccaatattcccccatttgtttcttcttattgttgcacttgatagaactcaagtataatgtggggttctttgttgtttttttgaggtggggtctcactgcgttgcctaggctggaatgcagtggcgatcacagctcactgaagccttgacttcccaggcccaggcaatcctcccacctcagtctcccaagtagctgggactagaggcacacgccaacagagatggggtttggtcatgtttcccaggctggcctcaaactcctaagctcaagcaatctgcccacctcgacctcccaaagtgctgggattacaggcatgagccaccgtaccagtccttaagtataatgttgaacagaagtgataacagtgtgtattactgccttgttcctgatcttacaagtattcagtctttcactataaagcataatgttatctggaggttgtttgaagaagccctttatcagattaagaaagttctcttccattcctagtttgctgagtctatatcattagtgagcgctgacttctgtcaaatgttttttctgcacctaatgagatactgatatggttgttctcctttattctattaattgggttaattactttgattactgaatactaaattcatcttgctttcctagaataaacttcatttaatcataatgttatttaaattcggctgaatttaatttgctgatattttgttaagaatttttatctggctgggcatggtggctcatgcctgtaatcccagcactttgggaggacgaggtgggcagatcacttgaggtctgcagatcaagaccagcctgggcaacatgttgaaaccctgtctctaccaaaaatgcaaaaaattagccaggtgtggtggcatgcgcctgtagtcccaggtactcgggaaattgaggcatgagaatcgctcgaacctgggaagcaaaagttgcagtgagccaagatcaggccactatactccagcctgggcaacagagcaagactgtctcaaaaaataataataataatttttatatctgtgaccatgggggatactgatcttaagttcactcttcctcatccttgctttggtaacttgttcaaattttcttctctggtttatgagagttttaaaaagacatttctaatgcgtctttgttatgggtttaggttaatttctcccaaataaaaaaaaatcctaatttaacattaatgttaataatttaacattatttttaacaaaatatttaaaaagttaccttgctgcctatctttcagttctacatctattctataaagtgatatctacatgaagtagaatcagtttaagagttctgacacacattccatgtgtaaagcatatgagaaaagagaaaagaatatattccccaaaccaagggatgtagtatacaaaaggcaaagttctatatctattgaaacaaattgggcttttcaccactttatgcttacttcatttatccaagagaatttaatgttgtatacttggatgactttttcctattgggttgaacatatgaaactgacatatttgtaggtcaaagaaacgtcaaatattggcagtttcatacggtttaacctctaatttaatggccttggaatagtaaccaaagtgagctcacccagtctgtatgttgtttgatcagtatacaagcaccatctggtggcagaaaccaaaactgtaggtttgtaactgttcatatcactgctggtacaaatacagtcatccctaggttatctgtggggaattgtttccaggaccttcacccttaccccctacagataccaaaatccatggctgctcaagcccctgatataaaatgctcaagtccctgatataaaatattaatattttaatatttgcatataacctatgcacatcctcccatatacattaagtcatctctagattacttataatatctaatacaatgtaaatgctatgaaaatagtagttacactgcgttgtttaggaaataatgacaagaaaaaaatgtctgtacatgttcaatacagatgcaaccaccctttttttcctgaatattttcaatccacaattggctggatccatgaatgctgagcccatggatacagaacccagggatacgaggggccaactgaatattcaacatcaactgttgtactttccaatatgctttttaagagggtgttacaaatgagtgaaaaatcttatatgcaaagtttgaacaacctcagaataaatagcacaccaacatcacaatacttagcaacaaatcatcagcctatataacataaactgaaatgtaataaacaagctgttttcataaatcagaatcttggctattattaattttactgataattaacataatgcaatcaagtcaatttggatgtttcaaaaaacttctttcgccctatcaaatttccactgatagccatcactatctgtaaaatgatttccgtgtctcacagatttatttcacaggggtacaatgaaaaaccaagaagccttaagtaagtgtctaattctggccatagaaacaagtaacattcaggcaaaatagtccaaattgttttcttcttgtttaacttgctatgactcaacatatattaaaagaaaataacttgaccaacctagctataagagattgggccaagaactggatacattagctaaaggtaaccttgacataaaatatactaaacacatctaatgagaatgtaggccataaacttgttccaaactgagtgttaacaaataaacaaaccctttggggaagaaaggatacaccttcaatgaacaaagagctgataggtcactcaaacttgggttgaatcctaaactgccattttcttaagatatattacacaaacctattctgaaagctctagatgttatactacctcttgccacgtctacttccaacaagtctttaaagtcaaagataatctttgctacccttcattgtggccataaagagtgataaaatgactcctaaatacttcgtaggcaatttaaatgcaacatagtgcaaattaaactcttcatctttccaaaaacctgctccaactactcttgtggtgaacagtattactagccatccaaatatctgaagttatccttaataccccaaatgcaatcaagtctaccttctaaatatctatagacactgtcccctcctctccatctgcactattccaggcctgcatcacattatgcctgaattacaacaacattgtcgtaattctttatcccttcaagttttaggaatattgccaaagcaatattcctaaaacatatatccaattattttatccctcagcttaaaatccttcaatgactcccaatcaccttcagaataaaatccaaacctcgtggcatggacaattcaggacattcaaatcggggccctgcctagacttcactcttctcattccagacttaccgaactgtttctaagtccatgaatgaactaaacttctcaggattcctagcctttgttgccaaaatctgtattacttttccttgccctcctcacctggctaaatcctagttaaccttgaagattcagttcatccctcctggaaggcttctttggtgccccaatctggatggggtgcttagttccttcctaatgtttccatagcaccatcggggcacatctatcattctgttctttcgttttcctcttctactaaacttaagtctattagactgcctgtctttcctcaaagtctctactcaaacacaacatgtggcaatgagtaggcatgcaataaatgtctgctgaatgaagatgacctcacgaaagtccttcatttgctattactatctctgttttgcaaatgaggaaattaatggaggtccagagccttgtgcaagatcacttaactaaaagcatcagaactaggaactgaaccaaatgttctgactgtaatggaaataattttctctaaaaatctttgcttttgaggaaccgctccataaaataattgtaccctgcggagtagtttggatggggctaacctgtttctccaggttggacatataacccaggcttggctaaagtaaagtatgtccctacccccaaccaagtttgaatgattaattccaggatggacagtttactccaagtgtttgtggggacttttctaatgactatcaaaaaaaaaacttcaccttcttcactacaagtctacagactatacagtgtatgaagtatagcaaatgggaattggcttatttgaaaacaaagtagagaaaaaaagaaacaagagctagaaagagagaaatagaaaatgaggaagaacaacactaaagccctacatccaactatgcctgtacatctccccaagagatatcccagttacatagctcaaaaattcccatttgcacataacctagtttgagttttggccccatggaaatctacaccagcagatcaaggggccatttggtctgctggtctgccattttggccatttgctaagcaataatatttttttatctgtgaatatacaaaattgaaaaactgtctaaattcagccattctatttctctaatgtacataatttttataagaaagatgggagaacaaaagcacgaagtgttctccaagctttaccttgtactttgtcaaatgaatttttatatgctttctgcttcataatatatctgttagtgaaaagtgcctcaaatgataaagaaaaatacataaccggatgtaattattgtcaaacatcttgggcataataaaaggagacaggtacttcagaatccaagttgtatctacagagtttgctcatggataaatgtttttttctccactcatcattaaaaaagaagaaaaattcagttcttcttaggcctttgaataagttcaagtggagaaacatcatcagtagagggtggtaaaacagcataggtaatacctaattttgcttaatattactttaagtagaaaataaaaggaccttttcaaaaatccctctaaatgatacctgtttcttggacttcacctttcattccctgccttaagaagctaatgattaatctgggttctgacaaggaaaagacatctccttggatctttggctccagagtccctgtaatccattcaagtgttgccatctataaattaaaataaatatgagaaatcatggttgtaacagcctactgagtaatggttaggtctgcgcttctgtgagcagaaagagcttttcagttgaaacatggcttggtagcttactagtactttccgatattctttttacctttttgtgatctgcagaatatcataaaataaagacactccaaaaaaggaaaagtccatattatctattcatggaatggcctaaggcacatcctttatttatgactttggagaaatcataaataaaattattgtacccctcacaacaaccataagaattagatcttggaactagaaactgccaacaaagaaaaaatgccgacattcttaacagaaaatttagaaaagaaaaaaagaaaatcaaaatcacatgatccctgtctaatttcacatactaactcctctctcccttggttcactctgatcaagccacattggcctcttgaggccaatgccaggcacacttctactgcggggagtacttgctatttcttgagcctggaattctctctctctctctctctctctctctctctctcaacattcacactgctttttctctctcttcctttgaggtctttatcaaaagcaaccttctcagtgactaaccacttcttattgactgactacctcccctacaagaacatgagctccataaggacagggattagtgtctgacttttcattgctttagcaccagactttttaaaagtaataaatttagaagtaataaaagtagtttatttccatttaaaagtaataaattcactagtcagaactgtagcaaaatttcaataaaggaccacagataccaaaataaaacaaatataaagatgtaatactctcataaatctatttactagagtacattagcaataaaattagtatataataggctaggtgttccttactcaggtgactaaagatatctactgtgttgaagtgggcaactagctttatttatttacattggggaacgtcagattaaacataaaggcaatgcgtatattatacagagaaagagaaaataaaacaactacaagagaaatgtgttgtcccttgtgcctcctatgcggtgtggacaccaagctgagggctgggaagcctgccattgtatgcatcacaattagaagcagagatgttacaggagagaatgaaatataccaaggaagccaagaaaagctgagggtttaggcccattagcaaggggaagatagtagatacactctggaagcattacctaagggagaaaaagacggactagatgccaccaactgcaagtttccacacctcgtggacaaggcacacgaccacaaagaaaagaggaactaaaggacaacacaagatgcctctacagaggtgaggtatatagatgcctctcccttcctagcatagagaaagctcccccaggcatacctgagaggaaaagggaagggcagaagtctaatacagtgtgcaaattcttcttagagaacctaaacaataatatttaaaggaactatttacaattgaatagaactaagttttaaatggatacaattaaagataatttttcccctagcaagcaagaaaccaaaaagtatcagattatttatggactaaataaatatcttccctacacatctaagttatggtatcagtaaatacataaaaccataacaaaagcaccagcaaatatctgatcaaatataggaaagaatttctcaggcataaaagaagtgagagaaataaagaaaaatcaatagataagaccacataaaattttaaaactacaggatattaaaaacaaatacacaattaaaagccaaattttttaaagcaggaaaattacaacaaacaaaatagactgaaggttaacatcctcaacacataaacatttgaaaactggtgaagcaatggaataaaaatcagcaaattaaaatagacaaatcaaaaaggataacaaatatctaaaaaaaaaactgttcagcctcactagtaatcaataaaattgaattttaaaaactactacttgatggccacgtgaggtggctcatgtctgcaatcctaacactttgagaggctgagagaggcggataacttgaggtcaggagtttgagatcagccttgctaacatggtaaaaccctgtttctactaaaaatacaaaaattagccggaaatcgcttgaacccaggaggcggagggtgcagtgagctgagaccacaccatggcactccaacctgggtgacagagtgagacttcatctaaaaaacaaacaaacaaacaaaaaaaaacaaaaaaaacactactttttaactaccaaagaagacaaaaacctttttaactcagtgttctcagaatagaataagcattctcatatactgtaagaaattagtacaaactttagtgcaattgggcaatgctttattctttttaaagaatattccccttatagtaatataaggaaggaaataatcagtgatgtgaacaaagatttacatagtgattatttactgcagcaatcttaacaaaaaagagggcataaacaacctagataaaaaaatagacatacatttatataccttatgaagccatatgaagcattatgtagccatcaaaatcattttgtgccaggcacaggggctaacgcctgtaatcccagcactttgggaggccgaggcggacagatcacttaaggtcagaagttcaagacccccagcctggccaacatagtgaaaccccatctctactaaaatacaaaaattagccaggcatggtggcaggtgcctgtaatcccagctactcaggaggctgacacacaagaatcacttgaacccgggaggctgtgggtgcagtgagacaagatcacaccactgtactccagcctgggtgacagagtgagactgcgtctcaaaaaaaaagaaagaaaagaaaaaaaaattcttaaatatatgacaaatggccactatattaagtgaaaagagagtgcttgttttgcatatacaagatacacaaattatgatatatccatacaaagtacactaaccagcaataaaaaagggcaaaacccagatataagcaacatggatgaatccccaaacaagaaaatcattatacaaagtaaaagaagccagatgcacataaatactgtatgagtctagatataaaaagttcaacaacaggcaaaaactagtctatgataataaaatagtgattatttctgggagaaggatgtgtcaaagacaaagaggtctgaggaaactctcagaggtgattgggaacattctgtatctcgatctgagtggtgatcacgtgaggctatacgtatgtaaaaagtcatcaaataaagtataaatacatatatacatacataaaataaagtcatcaagaggtatacttaagatttgtacattttactgtatgtctatcataccttcataaagtactacaaaaactgcatataaaggacaacttcaacttggttaaatatatttaaatgcaaagaaaaaaagaatgtaaagtacatgaaaatataaaaggtggcaaattctgggattacattatttacattttttcttttttccctataaattacaaacattcatgttcactaatgtatttagacaaatcaagaaaaaaactgagctctgcttggtaaatgaatgagaaagtcaacactataaactgtgaaatgactttaagacttggtcttccctgcaacaaatacagggccctcatgacacaataaaaactagttccttcagatcttttacgtttgtggggtaggggaaaaaaaaaaaaaactagttcctgaaaactgggtttctttaagttattaatttaaatattccttgtgaacctgctttatctaaattccatgcacaatgcccaaggtcaattagatttacaatgaaaatactcttttgagtgtgagaaacttttataacatggataaaataataattaagaacaaaaccaaaaaagacatacaaacctctgattgtacatgccccgaaagttgtaattagctctataatttgggaatggctttggatctaatggcctgtagatggcaggctctccccttttcatagcaagcccattcagttccacagttggagttatactgcctgtttaaaaaaaaaacattaaaggcacacaagtgaaatatcttcacaattaaacatgcaagctatatttatacaacgcttaaataccatggaagaaggtaagaatggatggaccacctgtatgattttctaaggaactgcgaaaacaaagtaaaaaaccaagaaaatagttcctaataaaatcttgggattttgcaatgttttctgtacattaatgacaaaaaatctgagtgtgcaatcattactatcaaaacatagtaaacagatgattcttagattgctaaccgtgaatattattttttaaagtactgcatttcatcattacttaccccagaaagcttgcatgtatttaatcattaaaaacatcatctgtgaatatttttatttatactttggtaattaaataactaagcattggcaagaaagtcatcagtggttcttggacttatctaatgaaaaaagttttttgaattttttctataaccaacaaaacagagtaaatataagcaatgtttcctgaaactaaaatgtcatcgaatatattcctagcaaatattaaagatacgtacaagtagcattatcgataaaaacaaaagactgaaaacaacctaaacaaccatcaatgcagcatcagttatataaatgtccatagcataaaacactgaacagctataaaaggaggaagactactacacaccttgcttcttttattttacttaatatacctcggaggttataccttagcagtgtagggtataatgttaaacgaaaaaaagcaaggtaccaaatagtgtgtgctttatattatcttttgtctaagaaaggtgaaaatgaaaatataaatatatatttgcttactttttttaaagaataaacccaaaactaaaaaaaaaaaaaaaaaacttacttaggaatggaagctgtatgtctctgaatgtacactgtttcatagattttattttgaaaacatgaattttttgcataattacagaaatcaaaatttcatccaaaaggggtgggggagcaatctctaaaatcgaaagaaaactggaactaaatctatctacagtgacttaaccacaaagagaattatttcaaaagacttaaaaaactgtaaaatagccatgagatcctaaagagaaaaaaaaatcttaaattgttttcagtaatcacattgttagtaacaagtaatatgcttttacttaagtcaaacaaaattaaataaaaatggagacaaagtaatctctataaagaaaacaaagcaattaaaacctaattgattggtggccctaatcatacgaagaacagttatttcaaataactttaaaatatagtcaaataaccacatattctaaagatttttttaaaccctgcaaataaatcataaactatttttagtaatcatgctgttagtaatattggcgtccctgtctcactgcaattgctattataaaattattttatatatatataaaatatacataaaatagactaaagaattaatgtcagaaacaaaggtttttagcataaagagacacaaatataaaatcaaacacactacctaaaaccctgtagttttaaatcctaactgaaatcctaactgaaaatatagtcttaaatcctaactgaaaatatcacaatgaattcatgatgtattttctcttaaggaaaaaaaaaagtactaggtatttcctagcttaagtatccacttaagaggcctaaaagccataacccaacaactgcaaaatgcacattgtattcatcaacacatggaacatattccaagacagaccacataagccacaaaacaagtcacagtacatttaagaaaatcaaaattatatcaactactctctcagaccacagtggcataaaattggacatcaactgcaaaaggaacactcaaaaagcatgcaaatacatggaaattaaataacctgctcctgaatgattgttgggtcaacgatgaaatcaaaatggaaatttaagaatttgaactgaatgataatagtgacacaacttatcaaaacctctgggatacagaaaaagtggtgctaagagcaaagtttacagcactgaatgcctgcatgaaaaagtctgaaagagcacaaataagacatacatgtatacacacacacacacacacacacacacacacacaggctcaaaatgtctcctcagaaaatacttattacttactattcaacaacaaaacatacggattaattaactttacagcaaagaagcctggcatactcctcaccgcatgacaaaagtcgtcactgatgggacaagtcaatctcaggcgtctcctcatagaaagcactaaggtaagtccaagtcatttttctggtattcatgctaaaatgcataaatcatgaggaaacaccagacaaactcaattgaggggcattctaaaaactctgtggtcccatactcttcataaatattatggtcataaaaggtaagaaagactgaggaactgtttgttacagattgaagtggaatgaagagaaatgttaagtacatgtaacacatggtcttgattagctcctggagctgtaaaggtttgggatgattagtgaaatctgaaatggagtctgtggattaaatggtaatatggatcaaagttaacttcccgatagaacggtgtccgtgtccttaagaaatatacattgaaatattaaggggtaatgggacatcatgtctacaacttattcccagatggttcagaaatgctatcaatggggaataaaggtgaaggatacatgggaagtctatgtactatttccacaaattgtatataaatctgaaattacttccatagtttaaaaaaaaataaaagggagaaagcaaaacagttctataatatattcccaattactaacagatcaaccatgctgcaaatgaacttaactcctcattaggatataacttctttttaagacccatctacacactgtggagtcaagactggatctttcctccacagacctattacttctcaatactgagttacagtcaccaggtttataacaaaggtgccactacactgcagaggggaatggactatcttttcaataaatggtgctggattaaatgaatgtccatatattttttaaatgaagaaaaatattgaactctacctcacatcatacattaaactcgattcctgacagactgtagatctaaactgtaaagatctaataatactgcttctaaaactaacatgaggttatcttcacaaacttgtaagagacacaggtgtattaaatggcacaccaaaaaagcgctaactataaaggaaaagactaataaattagcttccactaaacaagaattttgtttttgttttgttttgttttttgtttttgagacggagtctcgctctcacccaggctagagtgcagtggtgcaatctcagctcattgcaacctccgcctcccaggttcaagcgattctcctgcttcagcctcctgagtagctgggattacaggtgcacaccatcacgcccagctaatttttgtatttttagtaaagttggggtttcaccatgttggccaggctggtctcaaactcctgacctcaagtgatccacccaccttggcctcccaaagtgctgggattacaggtgtgagctaccgtacctggtctcattgaaaagaatttctattcatcaaaatgtacccttaggagtatagaaagatatttgcaatatacatatctgataaattatatgaatccagaatatgtaagaaccctgtaagccagtaaaaagtagaaaaaattttaaaacagacaatgcagatttttaagtgggaaaaacattccaaccagcactttacaacagagcctagcctaatgccaacaggcatatggaaagatgctcacctgcatttgttattagagaaatgcaaattaaaaacacaatgaattactattatacctctcagcataatagctaaaattttgaaagctggagatatcaaatgttgatgaggatgtggacagctctcataccgctggtgggaaggtaaactgacattctttgacattatgtattaataccaaatacattcataactatgacccaacagttccaatcctagatatattcccaagagaaatgtatgcattttaagaatactgttcacagcagtattatttctaatagctcaaaactggaaacaattcaaatacgtataatagtacaatgaataatatgtaaattatgtatacttatgcaatagaatactacatagcaatgaaatactataccattaaatgcaacatagatgactctcacacacaatattgagaaaaatgagctatcacaagagtctactgtctgattccaacaagaaggcacaactaatctggtagaaatcagaatattggtttcctttagagttgtttaaccaactgaagtgggcatgagggaagcttccatagcactagtaaaacatgtggtgaagtgttcacagcataaaaattcatcaagctctataactgtaatgtgcccttgtctgtatacagtattagactttattttaaaagtttacaccaaataatcgattcattctctcagcttactataacactcaaccatggaaattcttatctccactggggcctttcagacactctcctgtttccttcctctgactcttgctggtttacttcctgctataatcctctaaatatggacttgacccagagctcagcacacaattaactgctcttgctttacattatatgcctttgctttacattatatgccttagacagcttgttctgttccattccaaatgccactctcaacactcctgcagagcgggaggcatacagtactcaatgcacgtgagtctctttctttcttcacccataaactatgacaatggttttttagtgtctcccaccttccctttacatgtcaaactgagcttcctaaaatactcctttaaatgcatcatgcactgctcatgaatattaattcctcccagctacgtataaaacttaatctcgtaaagctggcattcaagtcgtcccaattcactcactaactacatctccagtcttacctcctactagtcatttacctgctctaattaaaaaccatctataaaattttttttttaccaaatccattgtccagattcctacttcaaagcctttcctcatagtattccctctggctaaaatattctttcctctcatctataactgcctacttttcggtcaaggcctgtatcttacttcaactacttcagtccatgtttatcattacctgtaatactgatggctgttattgtctacttggcacttaatctttaccatcaaattacgtgttcatatataagactgtaagacactcactgaaagggacaatgttttatttctcttagatatgtaaaaagcaagtgttaaatatatcatggtggtggtatgctactaatgatcaaccagtattctgaagaggcttttaaaaattaaagaaatggacaatcttttaggaacttcaaaatgaagagaataagttttttttctattgtaataatattttggcttatttaagcttaataaatactgcaatcagttgaacagaagcagagacttgcaatcagaaagccatggattctgcagagtagtccttgaaagagcagagaatgtcaacctagcacagaccacatgagaatgaaacaagtgtctatgtgatttgattatgaatataaccaagtagagaatgattaaatacattttagagttattgttgacaggcacaaaatctttcttaacctccataacaaaaatatctaaggcgaaattaatattgactagaaggtaaccacttgaattaatcagttaacaaatgaatgagtaaatggatatatggctggtactaaagttatagtaattccattaacctaatgttatcaattaatacactatgtccaaaatacaggtttgcctttcccaatagataacgggacatatagattcactgaggtcacccggagaaaatgatggatatcaggcaggactaacttgaggctcccactcaggacaaaacagcatgtggagactcacagtgtaaactctgctccaagaaccaccacaagaacataccaggaaaactgaaagaattcacagaccctttgaaagaagcagcttgccgctgcaaactccatgagacagccaaaacaccgtgagtgcccaaagtgtgagagggggaaagtctgcctccaaacacacatcctcactggggaacctgaaaatccagatcacagaagaatttaaccttacctaggactgaaacaaatttagagagctgagcgaaatataaaagtagaagaagcaggccaggaatggtgggtcatgcctgtaatcccaacactttgggaggccaaggtgagtggatcgcttgagcccagtttgagacaagcctggctaatatggtgaaaccctgtttctactaaaaatacaaaaaaaaaaaaaattagctgggcaaggtggtgcacacctgtaatcccagctacttgggaggctgaggcaggagaattgcttgagcccaggaggcggaggctgcagtaagccaagatcaacgccactgcactccaacctgggtgacagactgagactccacctaaaaaaaaaaacaaaacaaaaacaaaaacaaaaactagaagcagcagcgataagagacccctgtagacactcccagtccctagggaagccattttttttttttttttttttttttttactttcatctcacagtggtccttggggaaggcagtcagtggaactagggaagtaccacagtgagaaagacttctagctgaacgctgtcataattttgactgaatgcaaattttcctgggcagaatctgggtggggggtgggggaggaggtgggaatagggggccggcgggaatagggggccaatggaaagtacagatatgagaacagaagccactgcaggcatggaagggcaaggcctgaaagccctgcttgctttcttagcaggaagacttctagcctagggcaaatgctttttctgcagacactccccaataccagcctggagtccagtagctccactgggtagctagacccagaagaaaaataaccatcgctgcagttcagctctcaggaagccccattcatagggaaacggggagagaaccacatcaagggatcatcccgtgggataaaagaatctgaacagcagattcaagatcttgcctctgacacagtatatccaaatgagaagaaaccagaaaaacaattctggtaatatgacaaaacaaggttctataacaccctcaaaagatcacactagttcaccagcgatggatccaaaccaggaagaaatatctgaattaccagaaaaagaattcagtaggtcggttattaagcagctcaaggaggcactagagaaaggtgaaaggcaacttaaagaaatttttaaaataatacaagacatggatgaaaaaatttccagagaaatagaatcataaataaaaaagagtcacaacttctgaaaatgaaagacacacttagaggcatgcaaaatatactgcaaagtttcaacaatagaatcaaacaagcagaagaaagaacttcagagctcaaagacaaggcctaatcaaattaacccaatctgacacagacaaaggaaaaagaattttaaaaaatgaacaaagcctccaagaagtttgggattatgttaaatgaccaaacctaagaataagtggtgttcctgaggaagaagaaaaatctaaaagtttggaaaacttagagggaataatcaaggaaaacttcctggccttgctggagatctagacatccaaatacaagaaggtcaaggaacacccagggaattcattgcaaaaagatcatcacctaggcacacagtcaatcaggttatctaaagtcaagtcaaaggaaataatcttaagatctgtgaggcaaaagcaccaggtaacctataaagaaaaacctatccgataaatagcagatttctcagcataaaatctacaagccagatggaattgaggtcctatctttagcctccttaaataaaataattatcagtcaagaattttatgtccagtgaaactaagcttcattaatgacggaaagataaaagtctttttcaggcaaacaaatgctgagagaatttgccactatcaagtcagcactaaagaagtaataaaatgaattattaaatcttgaaacaaagcctcagaatacaccaaaacagaacctccttaaagcataaatctcacagggcctataaaacaataacacaatgagaaaaaacagacaaaaggtattggggcaacaactagcacaatggatagaatagtacctcacatcttaatactaatgttgaatgtaaatggcctaaatgctccacttaaaagatacagaatggcagaatggataagaattcaccaaccaagtatctgctgttttcaagggactcacctaacacataaggactcacataaactgaaggtaaaggggtagaaagagatatttcatgcaaacagacaccaaaagccagcaggagtagctattcttacatcagataaaacagactttaaagcaacaacagttaaaaatgacaaagagggacattacataatgataaacggactagtccaacaggaaaatatcacaatcctaaatataaatgcacctaacactggagttcccaatttataaaacaattactactagaccttaataaatgagacagagggcaaaataataatagtgagggacttcaatattccactgacagcactagacaggtcgttaagacagaaagtcaacaaaaaaacaatggacttaaactataccctacaacaaatggatttaacagatatatacagaacattctacccaacaactgcaaaatgcacattgtattcatcaacacatggaacatattccaagacagaccacataagccacaaaacaagtcacagtatatttaagaaaatcaaaattatatcaactactctctcagaccacagtggcataaaattggacatcaactgcaaaaggaacactcaaaaagcatgcaaatacatggaaattaaataacctgctcctgaatgattgttgggtcaacaatgaaatcaaaatggaaatttaagaatttgaactgaatgataatagtgacacaacttatcaaaacctctgggatacagaaaaagtggtgctaagagcaaagtttacagcactgaatgcctgcatgaaaaagtctgaaagagcacaaataagacaatctagggtcacacctcaagaactagagaaacaagaacaaaccaaacccagcagaagaaaagaaataacaaagatgagagcagaactaaatgaaattgaaacaaaagaaatacaaaagataaataaaacaaaaagttggttctttgaaaagataaacaaaattgatagaacattagcaagattaaccaaaaaaagaagacagaagatccaaataagctcaattagaaacaaacaggagatataacaactgataccagagaaatacaaaatatcattcaaggctactatgaacacctttacacacacaaactagaaaacctagaggagctggataaattcctggaaatatacaacccttctaggttaaaccaggaagaaacagaaactctgaactgaccacagcaagactgaaatggtaattttaaaactgacaacaacaataaaaaaagcccaggaccagacggattcacagctgaattctaacagactttcaaaaaaagaactggtattaatcctattggcactattccaaaagacagagaaagagggaatcctccctaaatcattcaatgaagccattatcaccctaataccaaaaacagggaagtacataacaaaaaaagaaagccacagaccaatatccctgatgaacatagatgcaaaaaatcctcaacaaaatataagctaactgaatccaacagcgtatcgaaaaggtaattcaccatgaacaagtgggtttcataccagggatgcagggatagtttaacgtccacaagtcaataaatgtgatacaccacagaaacagaattaaaaacaaaaatcacatgacatctcaacaaagaaaaagcattttacaaaatccagcatccctatatgattaaaaccctcagcaaaatcggcatagaagggacataccttaaggtaataaaagcatctataacaaacccatagccaacgttatactgaacagggaacaagttgaaagcattccccctgagaactggaacaagacaaagatgcccactttcaccacttctattcaacacagtactggaagtcctagccggagcaatcgacaagagaaagaaataaagggcatccaaatcgataaagaggaagtcaaactgttgctgtttgctgatgatatgatcgtatacctagaaaaccctaaagactcaaccaaaaagctcctagatctgataaatgaattcagtaaagtttcaagatacaaaataaacgtacacaagtcagtagctctgctatacaccaacagcgaccaagctgagaatcaaatcaagaactcaaaccctttcacaatagctgcaaaaaaatgaaatacttaggaatgtacctaatgaagaaggtggaaagaactctacgacaaaaactacaaaacactgctgaaagaaatcatagaggatacaaacaaatggaagcacatcccaaactcttggatgggcagaatcaatattgtggaaatagcatactgccaaaagctatctacaaattctatgcaattcgcatcaaaataccatcatcatttttcacactactagaaaaaacaatgctaaaattcatatggaaccaaaaaagagcccacataactaaagcaagactaagcataatgagcaaatctggaggcatcacattacctgacttcatactacattataaggctatagtctccaaaacagcacgatactgctataaaaataggcacatagaccaatggcacagaatagagaacccagaaataaagcccaatacttagagcaaactgattttcatcacagcacacaaaaaatataaagtggggaaaggacatcctattcaacaaatggtgctgggataattggcaagtcacatggagaagaatgaaactggatcctcatctctcacttgatataaaaattaactcaagatggatcaaagacttaaatcaaggcctgaaaccataaaaattctagaagataacattggaaaaactcttctagacattggcttaggcaaaggcttcatgaccaagaacccaaaagcaaatgcaacaaaaacaaagataaacagatgggacttaattaaactaaaaagcttctgcacagttaaataaataatcagcaaagtaaacacacaacccatagagtaggagaaaatcttcacaaactatgtatctgacaaaggactaatatccagaatctacaaggaactcaaatcagcaagaaaaaaataatgccatcaaaaagtcagctaaggacacgaatagataattctcaaaagaaaatatacaaatggccaacaaacatgaaaaaatgttcaacatcatgaattatcagagtaatgcaaatcaaaaccacaatgcaataccaactgatatggtttggctgtgtccccacccaaatctcatcttgaattgtaatccccataatctccatgtgtcaagggagagacaaagtggaggtaatttgaatcatgggggcggtttcccccttgctgttcccatgatagtgactgagttctcacaagatctgatagttttgtaagggtttggcaagttcctccttcagtctttttctctcttgccaccttatgaagaagatgcctgcctcccattcacctttaaccatgactgtaagtttcctgaggcctctcaagccatatagaactgtgagtcaattaaacttcctcctttccttcataaattacccagaatcaggaagttctttatagcagtgtgagaacagactaacacaccaccttactcctgcaagaatggccataatttaaaaataaaaaaataaaggatgttggcgtggatgtggtgaaaagaaacactttttttttcttttttttttttttgagatggagcctcgctctgtcaccaggctggagtgcagtggtgcgatctcagctcactgcaacctccgcctcccgggttcacaccattctcctgcctcagcctcccaagtagctgggactacaggggcccgccactgcccggctaattatttttgtatttttagtagagacagggtttcaccgtgttagccaggatggtctcgatctcctaacctcgtgatctgcccacctcagtctcccaaagtgctgggattacaggcatgagccactgcgcccagccaaaaagaaacacttttacaccactggtgggaatgtcaactagtaaaaccactatggaaaacagtatggagattccttaaagaactaaaagtagaactaccatttgatccagcaatcccactactgggtatctacccagaggaaaataagtcattatatgaaagagacacttgtatacacatgtttatagcagcacaattcacaattgcgaaaacataaaaccagcccaaatgcccaccaatcaacgaacggataaagaaaatgtggtgtacatatataccatagaatactactcagccataaaaaggaatgaaataatggcatttacagctaactggatggagttggagaccattattctaagtaaagtcacacaggaatggaaaaccaaatgtagtatgttctcataaatgggaggtaagctacaaggacacaaaggcattgagaatgatacaatgggccgggcccggtggctcacgcctgtaatcccaacactttgggaggccaaagcagatggatcacgaagtcaggagatggagaccatcctggctaacatggtgaaaccctgtctctactaaaaatacaaaaaaattaggccaggcacagtggctcacacctgtaatcccagcactttgggaggccggggtgggcagatcatgaggtcaggagatcgagaccatcctggctaacacagtgaaaccccgtctctactaaaaatacaaaaaattagtcaggcgtggtggcacatgcctgtagtcccagctacttgggaggctgagggagaagaattgcttgaacccgggaggcagaggttacagtgagccgagattgcaccactgcactccagcctggtgacagagcgagactccccctcaaaaaaaaaaaaaaacaatggattttggggatctgggagaaggttgggaggggaatgaggggtaaagactacacattgggtacagcatacactgcatgggtgatgggtgcaacaaaatctcagaaatcatcacggaagaatttatcaatgtaaccgaataccacctgttccccaaaaactattgaaataaaaaaaaaaagataatgacatataatgttgttcgtattgtatgcaattagaacaactctttaaaattattcttaggagcttaaaattagaacagtaatttacttagcagtattttacatgcaggtggtttgcggaatttgtgatggggtttctttcttttttttttttcttttgagacagagtcttgctctgtcgcccaggctggagtgtagtggcgtgatctcggctcactgaaacctccgcctgccaggttcaagcaattctcctgcctcaacctcctaagtagtggggactacaggcacgcgccaccatgcccagccaatttttgtatttttagtagagacggggtttcaccatgctggccaggctatatataaatatatagttttatatattatataaatttatataaattatatttatataattatgtataattatataatatatacaatatattataaattttttaatttaaatataaacttaaatataaattaatttaaatataaattaatttatatttctattaatttacatttataaaaatttatatttatatttataaatataatttatatttatatttataaatataatttatatttataatttatataatataaatataatttataatttatatttataaaaataatatatttatatttaaattaatttaaatataaatatatatttataatatataaatatataatatataaaataaaatatatataattatataatatataaaatatagttttttatatatataactatatatttaaactatatatttaaaaagagaaattaatcattttttgtaattttttttttgcaggggtagaaacaaggtcttgctatattgcccaggctgctctcaaattcttgggttcaagcaatcctcttacccaggcctcccaaagtgctaggattacaggtgggagccactgcaccaagccactatcatttttgtttgtttgttttttgagacagagtctcgctctgtcgcccaggctggagtgcagtggcacgatcttggctcactgcaacctctgcctcccgggttcacgccattctcctgcctcggcctcctgagtagctgggactacaggcacccgccaccatgtccagctaatttttttgtatttttttagtagagacagggtttcactgtgttagccaggatggtctcaatctcctgacctcgtgatccacctgcctcggcctcccaaagtgctgggatgacaggcgtgagccaccgcgcccggcctactatctttactttaaaaaaaaaaaactcagtcaaattttctgtgctttgtattcaaatatgtttttgccaacattaaaaaagtaaacaatgcacttttatagtatccactaaagcaaattttaaaaacaattacaattactttcttcatcctctcaccttcattttttttttttttttgagatggagtttcgctcttgttgcccaggctggagtgcaatggcgcgatcttggctcactgcaacctccatctcccagattcaagcaattctcccgcctcagcctcctgggtagctgggattataggcacctggctaattttttatatttttagtagagacagggtttcaccatgttggccaggatggtctcgaactaattacctaacatgatccacccgcctcggcctcccaaagtgctgggattacaggcgtgagccaacgcaccaagcctccttcagttatttttatgctaccgtgtgtgtgtgtgtgtgtgtgtgtgtgtgtgtgtgtgtgtgtaggtatgggcatatgtgtactattaatacttgctcactctgttactagcctactataaatgaaacatacaacaagcagaacacacatagcagacaacataacagaaggagtcactgccatacctgggttattgttaacattacttttgggtggcttctgaactggtttgggaagcgtagattcagtcaaagctttattggcaacagcctgctgagccttctttatactgctgccttcggattcccatgtctgctcaccaagactcagctgcactgagaacatcttagaaaaacataaatagacaaagaaaacattaagacttttccaagaaataaaattggctgtctgagagaaaaataaacatcatagaatcagaattttagagctagaggtgaccttacctacagatcatctgcaacaaaatcttactctacctagtgaagaaattttaagagagtaccaaattctgttctatcctatccaaaagcttagtagcagatctaggtgtacattctgggtagaataaatcaagaagcaatctttcctctaaatggaatcacaatgttaatgtcattcaaatggtcctcacaaaagcagaataagtagaaataataagagaaactgtaagagaagccaaaagaccatgtgtctataatactttcataaaatctaattccttgaatgttacatttagcacaatctaggcaatgagtcaggcaattctattaaatattatactaccaaaaaactctgaatctccacaacaaacattgagccaatcactaaattctgtccattttaacatcataaatatttctcaaatcttcttcctctctctgccaactggatccagcctttcatcatctttagcttggacataatattcttccagctgatcactgctaaaactatctttctaaaacacaaatccaacttcatcaccccaatcaacatcaggttaaaacccttcaactgttcctgttttagcatggcacaaaggctctacctgtgcatcctcatctcacacacatccttccactaacatgctctgaattccattctcactgtatttccatatgagcccccaaacctattcttcacctttaaaattcagaatcaagttacatgatatgcgcataattggtttcactccagactgcatattactttctaggaatactaagtattaacttaaaattacttattacaaaaaaatatatattattgtagaaaggagatcagatagaaaataccttcactaagttagcatcaccaataatcatacaaattgacgtcatgtgccccctgatacaatccagtgagaagtatatatcaacaaccatgtacaattcttggccaaaaatgtttaatctgaatctaatcacagggaaacaaccagagagatctagattatgggacattctataaaacaaatggcctaggctccaaaaatgtcaatgtcataaaaggaaaaaaaaaacaaagaatgcagggaggacactaaagagacatgaaggccgtgcacagtggctcacgcctgtaatcccagcactttgggaggctgagatgggcggatcacaaggtcaggagattgagaccatcctggctaacacagtgaatccccatccctactaaaaatacaaaaaatttagccagacgtggtggcgggtgcctgtagtcccagctactcgggaggctgaggcaggagaatggcatgaacccaggaagcggagcttgcagtgagccgagattgcgccactgcactccagcctgggtgacagagcgagactctgtctcaaaaaaaaaaaaaaaaaaggaaaagaaaagagacatgaaaagacatgataaataccatgcatgatccttcattatatctaaaatgggaaggggaaaaaagctgtaaaggacattcagaggacaactggggaaatgtgactatgaactatacattaagtaataggtttagccaggattaaatttcttgtgtgattaacagtattgtgattatgaagaacgtctttagtcttacaagatagatatgtaagtatttaagagtgaagtgtcatggtagctgaaatttactttcaaattgttcaaggaaaaattatatgtcaatatagagggagcaagaaataaagtaatgtggcaaataaattaacgatcggtgaatctaaaccatacatgagtgtctattacaccactctttccattttttctgtagatttttaattaatcaaaatagagaattgggatttgtcatttgaaattcacaacataaacatacctgtttaaagtgattaaattttcttttattctaattcagtttaaaatatatacctaaaatgtatctttaatactctctctggtttcagaatgatttttcaatgactagctctttttcttcaaattttggtatttaacaaagaactttgccacaaagtaagaaagttcaaaggtttcacatgatatatataatatacataatcttgcatatagctcatatgcttgaaaacagaaatacccacataaatgaccttgagattcctgattgcatcaggaaagcatattaaatttactctgcatgtctccagacctgacctctcctaaacaacaatcacataaatctaactgtctacttggtatttccacaaactcaagaggtaaaaggtcaaacaaaacactgcctcctccactctaccccctccaaatcagttcataccccaaaatgtttaatccattatctcccaatagttcaggttcaaacctcattagtttcgtttatccttgccttcctaaggcttatttaacatctcataactcttcgttgtaatttatattgtcacctccttggtctaaggtttctataaactcagactcagtatacttcatttagctcctatctctaatctttcctgcctcctaatcatccagatgtcaccattttcccaatctcatgagccagacacctttgagaggtcttcccttctctcctgcttgcaattaacaactactgactcaacttaaatgtttttcagacctggcctcctctctttatactaagatatatacatgcaccaatgtctttatactaagatatatacatgcaccaatgatatgtggacaatatcagtatctctcccctaaactaccacaacaccacctgtggtatataagaaatatgtatttggtctccggccctggttcctaacacagagctcccaaaaccttgtaatttccggaaggacaggagaactaggagcatttttgttctaatatttggtctttgatcccaatttctaacacagagctcttaaattccttggaatttcctgggtgataggaaatttttattctaatgagccaactcttggcaggcccctggatagagagctagtctgagggccagtcaccagaaaaactaagccatggttagaaacttcatttttagccccatcccattcctatccaccacggaggaaagaggggctggagactgagttaataatcgatcatgcctatgtgacagagcctccataaatatccctaaaagatagggtacaaaaagcttgcaggctggtgaacacactgaggtgctgcagggtggcacacccagacagggcttggaagctccatttcccttctcacacacttcatcctacgtacttcttttttttttttttccccggagatggagtcttgctctgtcgccaaggttggagtgcatggcacaatctcgtctcattgcaacctccgcctcccaagttcaagtgattctcctacctcagccccccaagtagctggcatcacaggcacaagccaccatgccgggctaatttttgtatttttagtagagacggggtttcactatgttggccaggctggtctcgaactcttgacctcgtgatccacccacctcagcctcccaaagtgctgggattacaggcgtgagccaccacgccggccctcctatgtactctttatctggctgttcacctatatactttagaatatcctttataataaactagtaaatataagtatgtgttcccctgagtcttgtgagctgttttaacaaattatggaacctgagaagagggtgctgagagcccccggtttatagccagttggtcacaagtttagaagacccagatttgtgactgtcatgtgaggtgagagcagtgttgtgggactgagcccttaacctgcagggtctgcactaaccgtgggcagttagtgtcagaatttagttaaatagtaggacatccagtcaatgtatggggacaattgcagaattcgctggcgtggaaaaaaaccccacatatttagtgtcagaaatgaagtgttacagccaggtgtggtggcttatgcctggaatcccagcactttgggaggccaaggtgggaggatcacttgagctcagaagttcgagaccagcctgggcaacacagggagacctcagcactaccacaaatgtaaaaaattatccaggcatggtggtgcgcacctatagtcccagctactgaggaagctgaagcagggggatcccttgagcccaggagatgaacgctgcagtgagctatgactgcacaactgcactccagcctaggcaacacagcaagaccctatctcggaaacaaattttttaatttaaaaaaaagtgggctgggtgcggtggctcacgcctgtaatcccagcactttgggaggccgaggcgggcggatcacgaggtcaggagatcgagaccatcttggctaacacggtgaaaccccatctctactaaaaatacaaaaaaaattagccgggcgtggtagcaggtgcctgtagtcccagctactcgggaggctgaggcaggagaatggcgtgaacccgggaggtggagcttgcagtgagccaagacagcgccactgcagtccagcctgggcgaaagagtgagactccgtctcaaaaaaaaaaaaaaaaaagtgttggaagtatagaaaaaaatttctttttactatcttaaagcagttcccttaatatgaccttcccattcaaactaccattcttaccaccatcgacatgaacattctgtaaaaccatcaacatgaacattctgtaaaatataagtatttccaaggcaatcctatgcttttctacaatctctcttaagattcctactacagtaaaaagtgtagtagttttaagacggaatgctggagacacactgtttatgaatttaagccttggcttcgccatttactatgtacaacactgggaagttaattattctttctaactctcagcttcttacctctttagtgaaatgaggctaataagaacacatggttagttgtgaaaattagaacaaaatggtgtaaacacccccacttgaaagtcagagattgtcaaactagataaaaatgcaaaatcaaactacatgctacctacaaaaactgtacttcaaatataaaagcacatatagttttaaagtaatgagaaaaacatatactgacataaatcaaggagaaattagaatggctatattaatatcagactaagtggattccagagtaaagactattaccagtggtaacgaaggtcatttcatatgaataaagaaagcaattaagaagacattgatatcctaaacatttaggcacctaataacacagcttaaataaatgaagcaaaaactgacaaaacttaaactataaaattgacaattaaagtcagattcaatactccttatcaaaaactgatataacaagcaaaaaaaatcaccaagaatatagtacagttgaacaacactatcagccaacacaatcttatcaacactgttagaatactccaaccaagaaaagcagaatatacacttgctctcaattgttcacaggacatttaccaagacagaccatattctgggccataaaataagtctcaataaatacaaagaattcagaccacacacaaagtatgttcattgggtaaagttacagaagagggtagagtaaaattacagaggagggtagagcaagatggtggaacaaaagcctatatatcattcatcacccccagtggaacaccaaattttaacaactatggacacaaaaaagcaccgttacaagaaacaaaaatcaggtgaacaatcacagtgtctggctttaacttcatattgccaaaagaggcattgaggagggtaggagagtcttgaatcaccaacatcaaccctctcccacactcccagcagcagccatgtggcgtggagagaaaatctgtacactttgagggaggagagcacggctattggaaaacagtacattaaactcagtgctgccctgtcacagcagacaatgaaaatgtgctggactcagccagcacctgcacagggagggaggatttggaccagcactagctggaggggaattgcccatcatagcagttggaacttgaatttcttggcaagacttgccaccacaggctgaagtgctccggggtcctagataaatctgaaaggcagtctaggacacgagactgtgcttcctaggcaactcctagtgtgaggctgggcttagagccagtgaactaggatggcacgcaacctagggagacaccagctggaatggctaagggagtgcttatgccatccctcccctaaccccaggaagtgcaacttgtagcaacgaaagtatctacttccttctgcttaaggagaggagagtgaagaaaaaagagaactttgtcttgcattttggatatcagctaagccaccataggataaggcaccaggcagagccgtgaggcccccattccaggccctagctccaagataacatttgtagacacaccctgggccagaaaggaacccactgccttgaaggtaaggactcaatcctggcaggattcattacctgctgaccaaagaaccaatgggtcctgaataatcaccactgatacccaaggagtatgcagtgggccctgggctctgacatgtactggcttcaggggtgacccagcacattcccagctgtggtggctattgtgaaagactcctgtttaagaaaagcagacagaaaagtaaagggaacattgtcttgtgccctaggtaccagctcagccacagcaggaagagcaaaaagcaggctcttggggtccctgagtccacacctacgctggacagcatttccggatctacttcagggagcccactgccctgaagaatgagcccatggaccagtggtggtgttggtggccacacaaggagaggttcctctgcctgtggaaaggggagggaagagtgggagggattttgtattatggattgagtgccagcttagccacaatagaagaaaacatcaggtaaattgctaaggtttttgactccaatccctggctctcagacagcacctctggacacacctggaacccagggaaaaacccgccaccctgaagggaagggccttgggcaaggccagtgctgtgctggcttcaggtctgacccagagcaatcccagggatgatgaccacagaggtgcctgcatcaccacacccccaattccaagtggcttagcactccatttgtttgggagaaagtaaagaaaaagaacaacaatctctgcctggtaatcctgagaattcttccggatcttatccaaggctgccaaggctgtacctctaacaagtctccaaaagccacagcattgttgggcttggggcccaagtcccttcaaattcctgggaaagccttcccaaggacaggcataaacaaactcagactctgaagactacaataaatacctaactgtttaaagcccagacaccaacaagtatctacaaccatcgacaccattcaggaaaacatgacctaaccaaatgaactaatataaagcacaagggatcaatcctggaaaaacagagatacatgacctttcaggcagagaattcaaaatagctgttttgaggaaactcaaagaaattcaagacaacacagaaagggaatttggaattcttatcagataaatttaaccaagagatcaaaattaaaaagaatcaagctgatattccagagtttaaaaatgcaactgacatgatgaggactacatcaaagtctcttaacaacagaaatgattaagaagaattagtgagcttgaagacaggctatttgaaattacacagttagaaaagacaaaagaaaaaaattaaaaagcaatgaggcacaccaaaaacatctagaaaatagcctcaaaggggcaaatgtaagacttactggccttaaagaaaaggtagaaaaagagataacagtagaaagtttattcaaagggataataacagagaatttcccaaacgagaaagataacattcaaatacaagaaggttatagaacaccaagcagatttaacccaatgatgactacctcaaagcatttaagaatctaattccctaaggtcaaatataaagaaaggatcctaaaaacagccagaaaaaaagaaataaataacatacaatagagctccaatacaactggcagcagacttttgttgttttgttttgttttgttttgttttgaaacagagtctcactctgtcacccaggctggaatgcagtgatgcgatcttgcctcactgcaacctccacctcccaggttcaggcaattatcctgcctcagcctcctgagtagctgagattacaggcgtgcaccaccatacccagctaattggcagcagacttttcagtggaaactttaaaggtgaggagagtgtggcaagacatattttaagtgctgaaggaaaaaaactttcacctagaatagtatatctggtgaaaatatcctttaattatgaaggagagataaagtctttcccagacaaacaaaagccgaaggatttcatcaacaccagacttgttctacaagaaatcctgaagggagttcttcaatctgaaagaaaaggatattaatgaaagaagaaatcatctgaaggtacaaaatgcactggtaacggtaagcatacagaaaaatacagaagagtataacactgtacctgtggtgtataaactactcttaactgaagtagaaagactaaataatgaaccaatcaaaaataatagctacaacaacttttcaagaaatagtgtaataagacataaagagaaacaacaaaaagttaaaaagctggcagcggggacaaagttaaagtgtagagttttaattaactttctttttgcaagtttgtttctgcaattgtgttaagctgtcatcagtttaaaataatgcgttataagtattagtatttgcaccggcgcagtggctcacacttgtaatcccagtactttgggaggccaaggcaggtagactgcttgaggtcagaagtttgagaccagccttgccatcacggtgaaaccccatctctactaaaaatacaaaaattagccaggtgtggtggtgcacacatgtaatcccagctacttgggaggctgaggcatgagaatcgcttgaacctgggaggcagagattgcagtgagccaagatcacgccactgtactccagcctgagagacagagcaatactctgtctcaaaaaaaagaaaattaatttaaaaaagatagtatttgcaagcctcatagtaacctcaaatcaaaaaacatacaacagatacacaaaaaaataaaatgcaagaaattaaagcataccaccacagaaaatcactttcactaaaaggaagacaggaagaaaggaaagaaggaagaaaagactgaaaaccaccagaaaacaaataacaaaatggcaggagaaagttcctatttagcaataataacactgaatgtaaatgaactaaattccccagtcaaaagacatagagtggctgaatggagaaacaaacaagatccaatgatctaaacacaccccacctatgaagacacacacagacagaaaagagagggatggagaaacatattccatggcaacggaaaccaaaaaagagcagacacagctatactcatatcagaaaaagtagtatagatttcaagacaaaaactgtaaggagagacaaaaaaggtcattatataatgataaaggggtcaattcagcaagaggatataataattgtaaatatatatgcaaccaacactggagcactcagatacataaagcaaatattattagacctaaagagaaagacagaccccaatacaataacagctggagacttcaacaccccgctttcagcattgcacagatctcccagaaagaaaatcaacaaagaaacatcagagttattctgcactatagacaaaatggatctagtagatatttacacatttcatccaatggctgcagaatacacatttttctcctcgacacatggatcattctcaaggataaaccatgttaggtcacaaaacgagtcttaaaacattaaaaaaaaaaaaagagagagagagagaaaaagaaaaaagaaagaaaacctaaaataatatcaagcatcttcactgaccacaatggaataaaactacaaatcaataacaagaggaattttggaaactacacaaacacatgagaattaaacaatatgctcctgaatgaccatttcaatgaagaaattaagaagggaattgaaaaattccttgaaacgaatggtaaaccaaagcctatgggatacagcaaaagcagtactcagagggaggcttatagctacacacacctacatcaaaaaagtggaaaaatttcaaacaaacaatctaacaatgcaccttaaagaactagaaaaataagagcaaactaaactcaaaattagtagaagaaaagaaataataaagatcagagcagaaataaatgaatttgaaatgaaaaaattatacgagatcactagaacaaaaagttggtgtttgagaagataaacaaaattgacaaacgatttagccagactaagaaaaaaagaaagaaggcccaagtaaataaaaccagagatgaaaaaggagacattacaatggatacaacagaaattcaaaggatcgttagtgactaccgtgagcaactatatgccaaaaaattgaaaaatcttgaagaaacagacaaattcctagacacatacaccctacaaagattgaacccggaagaaatccaaaacctgagcagaccaataacaagtgaggagatcaaagcagtaatgaaaagcttcccagtaaagaaaaggccaggacccaacagctttactgctgaattctaccaaatatttaaagtggaactaataccaatcctactcaaactattctgaaaaatagaggaggacggaatgcttccaaactcattctgtgaggccagtattaccctgataccaaaaaccaaacacacatcaaaaaaaaaaaaaaaaaaacctacagaccaatacctctgatgaatattgatgcaaaaaccctcaacaaaatactagcaaacctaatccaacaatacatttaaaagatcattcatcatgaccaagtgggatttatcacagtgatgcaaggatggctcaacacacacaaaccaatcaatgtgatacatcacatcaacaaaatgaaggacaaaaaccatacatttcaattggtgccaaaaaagcatctgataaagttcaacatcactttgtgataaaaaccctcaaataactgggcataaaaggaacatgcctgaacataataaaagccatatatgacagatccacaactagtatcataatgaatggggaaaaactgaaagcctttcctcttaggtctgtaacacaacaaagatgcccactttcaccactgttattcaacataatactgaaagtactagctagagcaatcaggcaagagaaagaaagaaagggcatccaaattggaaaagaagaagtcaaattatcattgtttgcagatgatatgatcttatatttaaaaaaacctaaagactccaacaaaaaactattagaacagataaacaaatttagtaaagttgcaggatacaaaataaatatactaaatcagtagcatttctatatgccaacagtaaacaatctgaaaaagaaatcaaaaaagtaatcccatttataatagccttaaataaaatttaatacctaggaattaactcaaccaaggaagtgaacgatctctacaatgaaaactataaaacactgatgaaagaaactgaagaggacatgaaaaaataaattggaagaatcaaagcaacctacagactcaacgcattccctatcaaaatatcaatgacattcttcagagaaataggaaaaacaattctaaaatttatatggaatcacaaaagaaccagaatagccaaagctatcctgagcaaaaagaacataactggagggaccacattatctgacttcaaattatactacagagctatagaaaccaaaacaacagggtactacataaaaataaacacacagaccaatggaacagaagagagaatccagaaacaaatccacacacctacgatgaactcatttttgacaatagtgtcaagaacatacactggggaaaagacagtctcttcaataaatggtactgggaaagctagatatccatatgcagaaaaatgaaactagacccctatctcttgccatacacaaaaaaaatcaaatcaaaatggattaaaggcttaaatctaagacctcaaactatgaaactattacaagacgacattaaggaaaattttcaggatgctggagtgggcaaacatttcttgagtaataccccacaggcagaggcaaccaaagcaacaatggacaaatgggatcacatcaagttaaaaaccttctgcacagcaaaggaaacagtcaacaaagtgaagaaacaacccacagaatgggagagaaatatgtgcaaactatccatctgacaaggtattaataatcaaaatatataagaagctcaaataactctataggaaaaaaatctaataatccaatttaaacaacaaacaggtatatgaaaaggtgctcaacatcactgatcatcagagaaatgcaaatcaaaactacactgagatatcatcttgctcaagttaaaatggcttttatccaaaagtcaggcaataataaatgctggcaaggttgtggagaaaagggtaccctcatacgttgttagcaagaatgtaaattagtacaaccactatggagaacagtttggaggttcctcaaaaaactaaaaatagaactaccatgcaatccagcaatcccgctgctgggtatattcccaaaagaaaagaaatcagtatgttgaaaagatatctacactcccatgttttttaggagtgcttacaatagctaagatttcgaatcaacctaagtgtccatcaatagatgaatggataaagagtggtatttatacacaatggagtactattcagccataaaaaagaatgagatcctgtcatttgcaataacatggatagaactggacgtcactatgttaagtgaaataagccaggtacagagagacaaacatcacatgttgtcacttatttgtgaggtctaaaaatcaaaacaattgaattcacagagatagagaatagaaggatggttactagagattgggaaaggtagcaggaaggttgaggggatgggaagatggttaatgggtaccaaaaaaaaattagttagaaagaatggataagacctagtatttgacagcacatagggggactacagtcaataataatttaattttacactttaaaataactaaaagagtataagtagattgttcgtaacacaaaggataaatgcttgaggctttggatacccaatttccattatgtgattattatgcattgcgtgtctaatctatgtgaaaaaaagattagtagctgcctggggtctcaggtacaaagagagatgattacaacaaggaatgagaaaattttgtgggacaatggaaatgtttgttctttttcttcacatagatattttggtacatgcaacataccaaatacgttgtatgcattgggtataccaaaatatctcatgtacttcataaatatatatacctcataaatatatatacctactatgtacccacaaaaattaaaaataattttttaattaaaaaagagacaaagaatattattattgataaaagggttaattcatcaagaagataaaacaattataaacatatgcaccaaacaacagaataaagaacttctcaaaactgaacaataaaacaaacccaataaaaaataatgggcaaagatctgaacagacacttcactaaaggtatacactgatgacaaacacacaaaaagatagccagcattatcagtcactacggaagtgcaaactgaaaccacaatgagattccaccacatacctattagaatggctaaaattagaaaggctgactatataacctgtaggcaagggggcagaaaaactagaactctcatacaccgctgaggggaatgtaaaatggtacaactatattttgcaaaaaaatttggcaatgtcttaaaaagttaaacatgcacctgctatacattcctgacactcttattaccaaagaaatagagaaaataaaatagagaaagagaaaaggtaatatatgtctgatatggtttggatccgtgtccccacccaaatttcatgttggattgtaatccccaatgttggaggtggggtctggggactggatcatgggggtggatttctcatgaatggtttagcgccatcccttggtactgtcctcacaatagtgagttatcatgagatctggtcatataaaagtgtgtgggacccccccaatccccacattgctcctgcttttaccatatgacatgccttttacttccaccatgattggaagcatcctgaggcccccccaaaagcagatgctgctatgcttcctgtagagcctgcagaaccatgagctaactaaacctcttttcttataaattagccagtctcaactatttatagcaatacaagaatggactaatacaatgtctatatgaagacttgtatatagatgttcaaattagctttattataatagcaaaaagctaaaaacaaccaaaatatccatcaacagatgaatgtccaaaaaacaaagtgtgctatatacacataatggactactcctcaataataaaaaggaagaaatactgacacacacaaaacatgagcaaactcaaaataactatgctaagtgaaaatagtctggtaggagtacataccactatatgattacatttatatagttttagaaactgcaaactcatctatagtcacagaaagcagattagtagctgtgtggggtcccaggtacaaagagagatgattacgacaaggaacgaaaaaatgttgtaggacactggaaatgtttgttctttttttcccacacagatataaagcagaaacaatacttttggcatgggttaaattatgaaagaagtcagtttgcattgcttcaaaaaatgttctcccatctttttagtattttctctctcatgactctttactacatttcccttccactatcctcactctcttatcctatacttccactgcaaatgtacatagaaagaaaatgatgatttcatcatgcctgaaaattatgtattcaagaggcacatcctacagctcaaaatctctgctctagcccaatactcatcaactgatgaaatcccctcatataacaatcactacatacaatcagccaaattcaagatgtagaacattttataggacaaattactctatttctccaacaaatcaatgtcataggaaaagaggggatggggataaaaggagtgttagtattaataaataaaagagaccaaagagacatagccaccaaatgtaatacatgatccttgtttggaccctatttgaacaaaccaaatgtaaaaagacatctctaagtctaattaaaaaaaagatggatacagaccatgtattacataatatttgggcttcttaatctagtcataatgacggtgtagtgcgctatttttttaaaggtccttatcagttacagatgcataccaaagcacttatgaatgaacagacatagttcttttaaaaactttagttcaaaaaagtgggtaggggatggtaaataaatttatcttggcaaaatattcaacgttggtatctatttcaaatttttcataataaattaaaagtaagatttttgtttgttttttgagatggagtctccctctgtcgccaggctggagtgcagtggcgcgatctcagctcacggcaacctccgcctcccaggttcaagcaattctcctgcctcagcctcccgagcagctgggactaaaggctcgtgccaccacgcctggctaatttttgtagttttagtagagacagggtttcgccattttgaccaggatgatctcaatctcctgatctcataatctgcccaccttggcctcccaaagtgctgggattacaggcaaaagtaagatcttaagatgttgtgggtttcataatgaatgttatgagacaaaactcctaacagcatgatatgcaccttatttattttcagtgcaggaacagtgcctgccacatagtaaatactcaacagaccttttactaaggggttgttttagtcctatatatgactaataagcaatgatataattatttgggtacctccatcatcaacacaatgcttaagaacttataaatcgtcactccattataccactttatgaggtattatattactccatttacagataagaaaactgagactttaaattagttgttcaaggtcacataagctcggcaatgaagggcaaagatcaagctgggcaactctagcgaagatttttttttaaagactacttggcttaagggccagtggatgacattgcctccctcagtgatacccattccaaagtaaaccatctcaaagtatcagcactagtacaatttacttgaaacttagccaggcttaccaacaaattatcagaataggaaaataatggaaaagaagaaaataccattttatgttattcatggctctcttcctcatattctaattaaaacagccttctttcgagatttgagcaaaccaaaacaataatctgtagaaaaaataactgtatacaggtacctaggaaataaactaatattacaataactcccattattataaggtatactaacttgtttcagagttcaattaaaaactgagcagaaaaataaaagaagacaaggcaaagactaaaataattattattttaatagtcacatattacaagttgttcagaatttgtgatactcatgggggaaggaggaaatcatgtaaacgtaagataggtcactacctgtcagcatgatataagagaagacaattccataccatactgaagacattaacctctgtcctgtgtttccaaactctggctgtacttttgagtcatttcagagctttaaaaaattcctgatgtgtgtgcttcacccaagaccgattaaattaacgggatgagactcaggcataagtattttttaaagctcctgaaatgattccaattaacagccaaagttgagaaccacttctcacctatgtcagcatatgtgtagtatgtgtgtgaattgccatataattaatgtaccaagaaaaaaaattttttttttgagaccgagtctcactctgtagcccaaactggagtgcagtggtgcaatcttggctcactgcaacctctacctcccaggttcaagcaattctcctgcctcagcctcccgagtaggtgggattatagtcacgcaccaccacaccccggctaatttttgtatttttagtagagaagggtttcaccatgttggccaggctgttctcaaactcctgacctcaagtgatcctcccgcctcggcctcctgaagttctgggattacaggcatgagtcaccatgcccagccccaagaaaattaatgagttgaaactaggtttaaatttttcttaccagagattatcattaatttcattaaaatacattttatgtctcacctaaaggccactgatagacatacatgaatgaaaatgattttgcttttcacaaaaaggatccagacttagccaattaggattaatattaactatattattatgtgaacttatcaatatcatgtttcactcaacaacatgccaattattctagtactctttttaaaaataagcaagctacaggctaaggggggtggtgtatcaccaaagcacctacagcaactggcacaggttggcaaaagggatctccaaatctccttaaaaccaagggaatcctgggactattgagaaataagaagagacccactgtcatctactttcatcacaaccaacctgtttagcctttaaaaccccagcagtgagacaaggagatagataaaaggtcagttcataaacccttccaaaaattacaatggattcctaaagaatcttaatgaaaaccaaatcctcctaagagtcctccagaaacttcccaggtaggctgaccttcctttaccatatatagaggatagggatgatgtcactaactgttaaaggcagtctagctcttcactcttgggagaagaaggcagaagaagcaaaactggagaaatggccttgaagaggtgaaacaggttgggatccaggacacaatggaggagctgggcaagtcagctgagggtacctacataaaaggcacacaacatttaagcaggttaaagagctatgtgaggattggggaaagaaaggaatagtaaaatggtggcagaatcaatggatctgcagtatgaaaggactgtggaagtcaaattactagacggaatgaactagaaagttaagaggcaagtgtcacagaaagatgaaagactgaaattaacattatgcagttattggtaatgataaggtcaagaatgtgattataggcatgagtggctgaaggacagtagagaacaagatcaccggagatgttaaagaaactaaaaggtcaacatgctggaacaatcatctatttaagtgttgaaatcaccaaaaattaaaatggggaatgctaaagagagtgaaagtgagccataagaaatgtgatggaatcacccagatgtaaatgacaatcatgagggaatgtgggaagtgtgtctgctaatatgaaactcaaaactgggggactgtctcaaggaagaatacctggaattggcaatgaggagcaaagagtatatactacagggaccaagaaatgtaaacgagtaaaatacacacccaaaaacaagctcagtctagcacaaaactaatgaccaacatatattactgtactataacacagtaacggctaccacagagaactataggtcccactggaggcccagtagaggaatcagaggtttcacaaacgtgtggaagatgtaacatggagctgagtgctcaacaatgagtaagggcaaaagcaccttcaaggcagaaagacactacaacttaggcaaaggcagagagatgtgaaaagaacataaagcgttctgagaaatgcaaacagttcaacatgattaagggcagaatgagtcagaaagagagtcaggacatatagctggaaaggtagaccaaggctacaactattttttctgttaaagcaagaacaaaagatatgaacaaattaaattgttgcccctaaatccttcataaaaaccattaatagaaaacaaaattgacaaattgtagtttcctcttattttccttagtttgtaggagatgccaggatgcaaataacctaatagccagttgctttaagaagattaatcaacccttagagaacaaatgctgccacattatatacaaattttatgatcattatgataatctccaatagccaagatataaatgtgccatagaaaattatgcacaactaagatattgtaagcaactgaatagagctcaaacataaatgcattagttgtagatttgtaacatgtatatatgcaaacataaatgtatacagctatatataaataaaaattgctttccatttaaaaaaacaatataagtgaatgcagagataataagaacagtggtatatacaacttttataaatgattaatgttagaattaaatatcacattggaaaagatgtctcactaggtaactgttggtatatttactctgtctccatttctactttagcagctgtgatttaatggaaagcacaccatatttgggagccaaagaaaatatattcaagtactggcactggcacttatgaactattaagcaagtcacttaactttcctgtgcctgagtttaaattacaaaatggaaatcaaaaatccatatatcatgtggttttattaagatttatatgaagtactatatctaaaagagctttgtaaaccacagtgagctacaaaatagtttagttacatactttgaaatattattaatgtagaactaaaagccttcaagccatctgctgaacccccactccccaaaataaagcacgattaaaatctgagatgataaatctgttagtctgataagtatgtctcaccacctctcttcataaccttacctttgaatgagcaggccctctttcattcagaagtttatactggggttggactctattgaaacgggctaactcatttaccagacacattgcagttttctcttttgggtttgccattttatcttggagagaagctgtaaataaaaaggctataaagtttttgtgaagaatgactttacaaaatggaagaaaaactagttttgactttgaaggtagattgtatatttaaattattttcatgaattttgtattttaaaaattcaaattacctaatgtcttccattacatgcaacagaaatatgtatcacattttaaacaataaattaaggtaaaatttttcctaagtacctaagttgttctatgtatataacagcatgcttaaagattttaaagtaaaattataataattttttatcttaaaaactttcctttcccctcaaaaaatttactagaaacacatacgtttcctggttcttattactatgaaactaaattttgtctaccttcttgatcgtttcatctcaatttttttccttctcattatgaggcagtgtgttagaaaaagctctagtcttgggaatcaggtcctaagtttaagtactagctcttccaactacaatttttcggtaactctaaacaaattaactcccctttctgtttttttaaataaattttcaaagttgtaaaaagaataatttaacaagtgcccatgtacctaacacccagtgcttattaaccatgttccatgtttaactcttattaaaaaaaaaataagtggtattccattcctgttaagttccttattatcttttacagagtattgatgtatgtggttctagactcacataaatggtattatagcattataataaacattctcacagtttactttcttcactcttcattgtgttctcaagacttttacttatataaatctagcacattaattttaactaccatagaatttcttttacaatattgcaccagtttttttatccactcctctactgagacactgggttgtttccaattcttcactcttaaagagagcatgctgtcaaatagctctcaaaatgactgtaccaaattaccttcccctaccgtttctcctcaagctcaaaaacatggaatataatcaaatattttaatttctgataatttgatatttgacaaacagtatcccattattgttctttgcatatttttctccactactattttatgtttgtttgggttttttcttgttcagagacagtctcactatgttgcccaggctggactctaaccctgggttcaagctattttccctactcagcctcccaagtagctgaattacaggcttctatccttttttttttttttttgtattatagttaccaacttttccttttatggtctgtgctttttacgtcttgtttaggaagtcctctctaactgtcaagatctcaatgattttacttaaactcactaagccttctattctttctataaaatgagagaaataaatctatcccgcttaagtcccaaagttgttgtgagattaagagttgtaaatgtatgatatggttttctaaactatatcgcaaatacaaggtactattatagcttcagaatatttttctaataccacattattttaacctatatttttcctttctctcatttatagacacatttaattacttttttctttcacttcccataaaaaatgccaaaatatattttaaaatctaagcataaaacatgcaagtggattacttcctgctcatttaaactatagtcacaataaatacagttcaattgtagccacaagaatacttaaaatgaatgaaaatggctggctttaggaacttcatctacaaacttcctaggccaaagtttaatattaaaaataatattcttttacatttctaatactcttaacaggcccaataatttgtacaatggcttgattgtgataattatgattaagaaactattttataagaaaactacgtaagcacctggtaagacctaagtaaaaagaaggaatctaagcaaccaattgtagggccaagacagctgacagtagattctacaattaagccattgtaagtggcttgcaaaaaaaaaaaaaaaaaaaaaaaaaactagtaattattacttttgggaaaagtacaaaaaagacaaaagtcaagacagttttgagaaaacctgcattttacctattccattgcatgtcacacaaattttataaaacatcctgttcaatttggaaagtcagtcgttataagaaaatacaaggtaacctgagacgataatcagttttggcctttgcataccattgcatgaattcaagtgcaacagacagcacagccaatttaatatcaaaaagcaaaagcagaataattggttaaaatgagaaaatattaaagtctgataaaaatcagccaattttgcataacacaaatagcatttataccaccactgtgtaattttcataattcagtaatgctgcatattcatctgttacaatgcaaaacatattagaagcatacaaacatagtgtgaaaattttatactatgaaaattgctaatagcataggttctacacatattaaacagcgatttaaatggttcatttataatgaacccgtttggtatgaaaacctaatctaaatcctctaaaggaaaatgttaacaaataacatggtataaaacttatattccattaattctgacttcctgcttcataaaagttaacatgaatccaataacacattttaatgggtgactgaagttttagtgtgagaagggtccaagatcccactttgataaagcttcaaaattaaaatcaaaatgtttaaagttgataacttaggaaataattagtcatagttgttttattttaaaaagggattaaaacaaatagttgttcctttatttaatgagaaatcttaataggattcttacttgacagagagctcagtaatacagcaataacttttaaattacaccaaaatttagatagagcatctataaaaacaaactggtctataaaatctgagacacataaaaaagttatataaatcttttttagagaagtcaatagtgcaaaaaagtgagaaatgcacataatgttacacaggtatgcattttcaaagacctatagatgttatcactgaagatagtttgaaatagtcttcaagtccatttggtggctggaatagtagagacctacttagaagtaaataaaattaataaaaatggattcacaatctcagactctgccactttgaaagaacaactgccacatgatggttaagagcctgttttggatatctctgtcacttactaatatctgtgtgaccttgagaaagtacttaaatctcactttcccacaaagtaaaatagagataatagttgttcttatctcactagataattgcatggattgaatgagataataccaaacactgttaacaatgattaaaaattcattattattctgatttaaacatttgttaaaacaattacactatcatcaaatattaaaacagtgacataaaaagtcatgaaaaaagtttataaaactaagtaaaaatattcttagccaaaatattctgttacgataaattgattttactcatacaaatatacttcttggctgggcatagtggctcacatctgtaatcccagtacattgggaggcagaggcgggaggatcgcttaaggccaggggtttgagaacagcctggacaacatagcgagacctcatctctacaaaaaaataaaaatattagccatatgtcatggcacatgcctgtactccttgacactcagaaggctgagatagaaggattgcttgagcccaggagttccagactgcaatccagcctgggtgacagagtgagatcctctctcaaaacaaaacaaaacaaaaaacaagtatatttctgtagtagtctgtgaaaagcatgtatttgttattattttttccactgacttataaacccataagttcgtttccactgaaaaattctcaaatatgatataaattatattaaaggtttacatgtgctaggaaatattctaccttcactgatacgaaacttggttagatataacttacaactttgataagaaacactggtaaaatacatatttataataacagtatttgcatatccaacaaaaacataaatatactctatttttagattcactctatttttatgtcttcacaaaatgtcctggactctggaatttgaatcttcattttgcctgttcatttgtatgtgtaggaaccagtgaagaaacacagcaactgtgttcaagtcactgaacaagctacaaaataatgtagctcacaggcaaaatgatctgtccccaaaggagttcacagtctgatagaagaaacagacacagacaatagacaaacacaataaatcacaatataagtactataataaggctgttacaaaaactccttagacaaagggtgtatggaaaggcaagttttaagaggtggtgattagataaggaaagcaaaaattcacttaggtaacaagggaacgtgagagacagtccaagcttttcaaggagtatagacacaggagaaagcacataaaacaacataactttctggcaaatgcaagcagaaaactggcagaatacagaacgcatgagaaaaaacagcagaataaaactatgtgaccagaattcactagaacaccaaaagtttcctaaaccagaacttaaagtagcattttttaaagtagctatattccagccagaactgttgctactaaggtcacagactacctcgcttcgcaaggcaaatcattccaaagaatcctttccatccttggtcccagaaatgacttaaacacggtttctttccttttttttttgagacagagtttcactcttgttgcccaggctgtagtgcaagggcgcgatctcggctcactgcaacctccacctcctggattcaggtgattctcctgcctcagcctcccgagtagctggaattacaggcatgcaccaccacgcccagctaattttgtttttttagtagagacggggtttctccatattggtcacgctggtctcgaactcccgacctcaggtgatccgcccacctcagcctcccgaagtggtgggattacaggcgtgagccaccacgcccggccttaaacacagtttctatgtctctttactggttcccctttctctattctctgctattggagggaactcatcctaattcccaagtaaaataagaaagaaaaaagtcaaaagagcaaaggaccctttcatgggctcttgccttctaggagcaatctgacagatatgtccccagctattaactaaaacaaaccctctattttcaaattagaccctaacataaggctgtccaagcaaaattatcgacaaactacccaggcatcaaactgctccatttttaacagtctgtccattaggaaaaaatttaagttcctctctcacataaacacaaagataaatttcagaaatattaaaatgcaaaatacaaaaatttcacaaaaactaacggaaattagctaaatatctgtcatactcctgtaacacagaaggccttcctagatatgaaaaggaacctagaagccataaaggcaaaaactgatagttaacaacataaaaataataaaacttctctaaagcaaaacataccacatatgacactaaagtctaagccattttgagttactttttgtatacagaagaaatacttgcaatatgtgaagaaaggccaggcgtggtggctcacgtctggaatcccagcactttgggaggtcaaggcgggcagatcacctgaggtcaggagttccagaccagcctggccaacatggtgaaaccccgtctctacaaaaatatacaaattagccaggcatgatggcgggtgcctgtaatcccagctactcaggaggctgaggcgagagaatcacttgaacccgggaggtggtggttgcaagtggaaccaagatcgcaccactgcactccaccctaagcaacagagcgagactccgtctcaaaaaaaaaaaaaaaagtgaagacaaactgttaacattcataaaataaaaagatactataaatcaatttttttaaagccaataggaaaaaagggcaaagttacacacaattcacataatttcttgagtaaatatacctgttcaaaagaatgttaaagagcctggccaacatggtgaaagcctggccaacatggtgaaaccctgtctctattaaaaatacaaaaatcagccaggcatggtggcacatgcctgtagtccgagctattcgggaggctgaggcaccagaatcgcttgaacctgggaggtggaagttgcagtgaaccgagatggcaccactacactctagcctgggcaacagagtgagactgtcaaaaaaaaaaaaaaagaaagaaagaaagaaaaattcaaattccagtgatatataattttcccctattagactgataaagattttttttaataatcatttaagtattaacaagtatgtggggaaaatgggtgagaattctgttggtgcaaatacaaattagtacaaaatttctgatgggcaacattgattaaagtttcaattgtacctatctttaaaacagcaattattaatctgaggattcatactacaggaagacatttgcaatgataatctggaaaacaagactataatagcaaaaactataaatgagataaatattattatttaccaaaaattggttaaactacatgaatcatgcagctttgaaaagagaaagaggtacagagcttatgaatcaacatgggaaaactttgcaaactggtgaatgacaaaagttacagcagcttactgtgtgatcgtatatttatcttcttttttttttgagacggagtctcactctgtcacccaggctacagtgcagtggcgcaatctcggctcactgcaagctccgcctcccaagctcaagcgattcttctgcctcagcctcctgagtagctgggattacaggcatgcgccaccatgcccagctaatttttttttcttttttttttttttgagacaagagtctcgctctgtcacccaggctggagtgcagtggtgtgatcttggctcactgcaagctccgcctcccgggttcacgccattctcctgcctcagcctcccaagtagctgggactacaggcgcccgccaccacgcccagctaattttttgtatttttagtagagacggggtttctccatgttggacaggccagtctcgaactcctgaccccaggtgatccacccgcctcggcctcccaaagtgctgggattacaggcgtgagccactgcgcccggccagagtaagttctttctagtcttgacagtgccaccatggtcctgaaaaacagaaaaataatgctcaaggatctgatttaaagcaggccatgttgtgcctccatctccaacttttccagtgaagctatctagagatttaaacaggacaaaaacacagtgtgtccttaccagtatttagtttggtcagtcttcttaacttcagtcattctaaatatgtgtataatgatacctcgtgattttaatttgcatctccctaatgaatactgttaattaacttttttcatttgcttatatgtcatctgtatctcctgtggtgaagtgtctgaatattttacttttgatttttttttcttattgctgaatttgaagagttctttacacatcctacatacaagttactgattagacatatgcttggtaaagattttcttctaggccaggcgcggtggctcacgcctgtaatcccagtactttgggaggccaaggcaggtggatcgttttaggtcaggagttcaaaaccagtctgggcaacatggtaccccgcctctattaaaaatacaaaaagtagctgggcacggtagtgtgcgcctgtgatcccacctactcaggaggctgaggcacaagaatcacttgagcccaagaggtgaggggctgcagtgagccaagaaggtaccactgcactccagcctggggaacagagcaagactctgtctccaaaaaaaataaataaagtagtaggaaaaagatgaattgctaacaaagttggagcaaatggacagtcatcttagaaaataataaagaggaatcactacgaaaaaaataaaaatttttttcccaaactgtggcttttctctttattctcttaccagtgtcttttaaagagcagattttaatagtctaatttatcaatttttatagtttgtacttttaatgtatatctaaaaaattattacctaactgaggtctaaaaatttttttctcctgttttcttccacgaacattatagttttaggttttacatttaagtccagaagccattttgagttagttttcctatacagcgcaaggtatgaatccattttttgtatatcaatatccaattgtttccaactgtggaaaaggctacatttctcccactacattgcctttatgtctttgtcaaaattattagttatctacatataaggagtttatttctggactaccaattctgtttccactgatctatttgtcttttgttgttgttgttgttgttgttgttgttgttgttgttgttttgagacggagtctcgctctgtcgcccaggctggagtgcagtggcgcgatctcagctcactgcaacctccacctcctgggttcaagcgattctgccgcctatttacctatttttacgccaaactattttacagcttttaattcttgaaatcaggtagtgttggctcccacactgttctttttcacagttgtttaaagttctttaaatttccacatgaattttagaatcaccctgtgcagttctataaaaaagcctgcaaagattgaaatataagtctcttaaatctataatttggtgaaaatcaacattttaacaaagttgagtattccaacccatgaaaaggatacacagtcacttctcattattgagataataatatgtcaatgactgttatgtgaatcagcaattatagagccattgctcccaggggaactaacgtattaggttcttgcaagcttctgctgacatttttgtgaactgatcatatgtcatgttttatgtgtttctgtttagagacttcttgtttagtatgtattactaatatatgttactgattcattaacattgaactcatgtccaatagtactgtttaactcctgcctgaataaagcttatctaatgcacatatattctccgtaaggcatatcagagcctcctggtacttagaaacactatatggcacttaaacattacactttaaacattttaaacatcaaaataaccatctttgtaaacatcaaaataaccaacaaaaagcacaaacatgcaaaaaatgcagcactaaataaaccaagaaagggctacttgcttacagtatgaaacccaaaataagaaagcagagcattgtcttgtttgatcccagctgggtatatacatgtgcactgggtgattcaaaatgttttgcccctgcaagtgtctgagaatgaccacaaaagcactgcaagtattggttttggggttacaaataaaaattagtgagtaagccaattcctaggtaaagaatccatgaataatgagaatcaactgtatcttattcaggtatcctttaatttcttgcagcagtattttgtagttctcattttctttaacatattttgttagacttatctctaagtagttcatatttttgatgcttttgaaaatgctactcttttattttcatttatgattgttctctgctaatgtatagaaacacaattggtttttgcatactgctcttctatcctgcaactctgctatagtaatttattagttctagtaggattccatcagattttctacatagacaatcaggtcatctgtgaataaggacagttttattcatttctttccaatctgaacaccatgcatttccttctcttgcatgatggcatgggctagaacctccacggcaacgtcaaacggaactggttaaagtggacatcccgtcttctttttttaaaataagtgtccagttttggccaggtgtggtggctcacgcctgtaatcccagcactttgggaggccgaggcaggtggatcacaaggtcaggagatcgagaccatcttggccaacctggtgaaaccccgtctctactaaaaaatacaaaaaaattagccagacatagtggcgggtgtctgtagtcccagctactacagaggctgaggcaggagaatggcacgaactcacaagggggagctttcagtgagccgagatcgtgccacttcagcctgggcaacagagcgagactgtctcaaaaaaaaaggtgtccagtttttcaccaataagtacaaggtcagctaataaggtttttcatagaagcacattagcaggctgggaaagttcacttccacttctagtttgctgagagtctttatgatactgaatattagattttatcaaatgatttttctgcatctattgagatgatcatgtgatttttgctttttagttcattaatatgttaaattacactactgattttttggaacactaaaccaaccccacattcctgggataaaccccacatggttatgacatattatccttttaataaactgttgaattagatttgctgaaactttgtttagatttttgcaattatatttatgagacatactggtctgtaatttccttaaaatgtatttgtctgattctggtatcccagtaatgctggcatcatgagccttgtaaaaaattccttccacttcaatatttttaaaagcatataaaattgatattattttttccttaacttgtataattcaccagtgaaactatccggacctagagttttctttttaagtagacttttactacaatttttatttctttagcatataaaaagctactcagggctaggcatgatagctcatgtctgtaaccctaccacttcaggccaaagcaagaggatcacttgagcccaggagttggagaccagtcagtacaacatggtgaaaccttatctctacaaacattaaaaataaaaaaattagccaggcatggtagcatgtgcctgaagtcccagctaggaggctgaagtgggaagatcacttgaggtcaaggccacagtgagctatcatcggaccactgctctccagcctgggcgacagagtgagaccctgtctcaaaaaaaaagctattcaggttatccattttcttcttcttcctttgggattaatttgttcttctttttctagtcttttaagatggaagctgaagtcaaatatttgagctatttgagttcattcttctttcaaaatatatacatttggagctataaatttctccctaaatactgttttagcaatatctcctaatgttgtattgctgttgtcatttagtttaaaatactttcttttttttttttttttttttttttgagacggagtctcgctctgtcgcccaggccggactgcggactgcagtggcgcaatctcggctcactgcaagctccgcttcccgggttcacgccattctcctgcctcagcctcccgagtagctgggactacaggcgcccgccaccgcgcccggctaattttttgtatttttagtagagacagggtttcaccttgttaaccaggatggtctcgatctcctgacctcatgatccacccgcctcggcctcccaaagtgctgggattacaggcgtgagccaccgcgcccggcctagtttaaaatactttctaatttacctttccttctttttaaaccatagattacttatattttttaatttccaaatatttagagatttcccaagaatctttctgttaatgattcctaattccactgtaatcagatacaattttttaatgacttgaatccttttgaattcatttaagacttgtttcatggccaggcaccatggctcacgcatgcaatcctaggagtttgggaggcagaggcaggaggatcacctgaacccaggagttctagaccaacctgggcaacacagtaagatcccaacactacaaaaaaaaaaaaaaaaaaagaatattagctgggtgtggcggcacacatttatagtcctagatactcggggagcagaaatgggaggattgtttgagcccaggaggtcaaggctgcagtcagccatggtggtaccacttcactacagcgtgaacaaagcaaaaccccacctccaaaaaaaaaaaaaaaaaaaaaaaaaaaagtcctttatggcccaaaatacagtttatcgttgcaaatgttttggataaacttgtgaacaaatacgtattctactctttttaggtagagtgttctataaatgcaattaggtcaagttgcttaacagttactcaagtctactatatctttgatgattttctgtccacttctatcaattattgacaggggttactaaaatctccaattatgactggatttctcaatttctccttgcatttctatcaggttttgtttcatgtgttttgaagctctgttattaggtgcataaacatgtaacatcattatgtcctcttaactgacctctttaccattataaatgaaatgaccttctttatccctggaaatattccttgctctcaaatatactttaatattaatatagccactccaagttgcttttgactaggttaccatattatatcttttcccattctttcacttttaacctgtttgtttacaaactatttcttgtaggcaagcatatagttggatcttgcttttatatccaatctgacaaattcagcctttaaactggagtgtttagacaatttacatttagtgtgactattcatatggttaggtttgattctatcatcttgctatttattttatatttttcccatttggtgtttgttccttttttcttctttttggacttctgttgaattattttgtgtgactccattttatctcctttttattggcttattagttgtaactctctattttgctattttaggggctagagtttacagtatacatttttaacttaccacagtctatcttccagtgatattatcacctcacacagagcaaaagaatcttataacagtatacctccatttctccctccctgccttttagctattgttatcatgcattttacttttagataagttataaaccccacaacagcttgttaatatttttgctttaagcagtcacttatcttttaaggagatttaactgataagaaaaaaaatctcatgtatttacccaagtagttaccatttctagtgttctttctttcatgtaactccatatttgcatctggtatcattttcctgctgtctgaagaattgcttttaaattttcttccagaggggaaatgttagcaataaattctttctgcttctgtgttgtaaacatctttatctcatctttattttagaaacatatttttgtcagatacagaattatagattgacatttttcatctttcagtactttaaagatgcttccccagtttgcttgcttatatcgtttctgataaatctattaagataatcatctttatctttcttcctctacacacaaaatgaccatatctctttctctgactgcttttcagattttctctttatcatttgctttcaacaatttgattataatgtacagtaagtcctcacttaacatcatcaataggtccttggaagctgcaacttcaagtgaaacaaagtagaacagaacccaatttaccatggtccaatcgacataaacaagtgttaagttcctacagtgtatttctagttacaaaaacatcaccgaacttctaataccaaaacacttctaatattaaacaatgaaatgaatgtgagctacacatacacttaagaaagattaataaaaacaagtaagataattattcacccaatttttctagttcagggtcacaggtggtcagagcgtatcctagccgctcagggcacaaggcagaaaccagccttagacagaatgctattccacactagagtgcgtgcgtgcccacacacccacacacacacacacacatacacacacacacacaacagactaactcatactggaacaatctagagaagccaattaacctaatgctcacatctccctaatgtgggaggaaactgaagtcccaaagaaaacccatgcagacatgggaagaacatgaaaacatcacaccaatactggccccagccaggaatcaattctttttctctcatcaacattatgacaaaatgatgttgaaagaaacattatttgaggacctgctataccttggtgtagttttatgtttcttatacttaaaactcattcaacttctttatctgtagatttatggcttaagtctaaaacatttttggccattatttcttaaaatatattcttctgtatattatgtcccttgagaactacaattattcatctatttggctgcttgagtgtgtcccacagctcactgacttttttttcttctttctctatgcttcattctggatggtttctattgctctgccttcaagttcattcataattttttctgcaatgtctaatttaccattaatctcataccgtatatttttcatctcagttgtagttttcatcactgtaagtctgatatgggtctttttgtctcttctgtatctctaactttttgaatacatggaatacagttataatgttttaatgccctctgctaattctatcatctgtgtcagttctgtgtcaattttgacggaagattctcataattatgggtcatatttcatgcttctttgcatacatggtaatctttaactgaatgacataccttgttaattttaccttgctatatgactcctataaatctttttggactttgtccaggcatacagttgagtaatttggaaatagtttgttcctttcaagtcttgtttttataatttactagttcgctccagagcagcaacatcttctcaactcagagtctgccagactccacatctcagtttctactctctatgtcacatcctggaaaatctctcagtgcagtaggcctggggcaattgtaggactcaccttgtttgtttcttctctctcaagaatcacttgattcttgagattaagacctgaatgtcttaatcattgttgtttctacatattttgtttttttggagaagaggggtaggattgtttcaagaggacagtaaacacgatccttgttacaccacatggaccagaggcaaaagtccccatccgtccttcttatttaatctatctgtatctatttgagtttcttgtaaacatcataaatataccgtccctgacttacgatggttcaccttatgattcaactttaccatagtgacaaagtgatatgcactcagtagaaaccatactgaagtacctatataagcattctatttttcactttcagtatcacattcaataaattataatgagatatttaacactttattataaaatagggtgtatttagatgattttgcccaactgtagtctaacttaagtgttctgagcacatttaaggtaggctaggctaagctatgatgttcagtaggttgtgtgtgtgtgtgtgtgtgtgtatatatatatatatattttttttttttttctgagtcaaggtcccactctgtcacccagactagaatgcaatgaagactataactcactgcagccttgacctcctgggctcaagcaaccctcacacttcagcctcccaagtagctaggactacaggtgcacaccaccacatccagctaatttttgtattttttgtagagatgggttttcaccatgttgtccaggctggtcttgaactcctaggttcaaattatctgccagccttggcctcccaaagtgctgggatacaggcatgagccaccatgcccagttaattatgtgtatgaaatacatttttgactttcaatattttcatcttacaatgggtttatcaggacctaacaccatcataagtcaaggagcatctgtacttgagtcttgctcttctatacaatctgacaatctttgccatttaaattgagcatttaagtcatttacatttagtatagttgtcaatattactagatttatatctactgttttgttatgtttttgtccttttatttgttcctttcttcaactttatcttcttttagactgattatttttagtacccattttatatcctacataggcttactatttttattttgtcgtataggaattgttctaaaacatacacagcctaccttcaaatatcattccacttcatgtttgatatcagcacctaaaaattctatacttccctttcccttatccctttctttatgctactgacatcaattaatttctatgtataagccctcaaggcactgttagtatttttgttttagtcaattatctttttaaaagttaaaaatgggccaggcatggtggctcacacctgtaatcccaacactttgggaggccaaggtgggcggatcactggaggtcaggagttcaagaccagcctggccaacatggcaaaaccccatctctactaaaaataaaaaaattaactgagcatagtggctcatgcctgtaatcccagccctttgggaggccgaggcaggtgaatcacttgagtccaggagttgggagaccaacctgagcaacatggcaaaacaccttctcaacaaaatatataaaaattagccggatatagtggtgcatgcctgtaatcccagctacttgagaggctgaggtgggaggactgcttcagcctgggaggtcgaggctgcagtgagccatcatcgtgccactgcactccagcctgggaaacctgtctcaagacctgtctcaacaacaacaacaacaaaatttttatttcaataccaccaattttcagctatttgattatgatgtgcgtggttaggttttttttttttttaatatttcttctactttaggttgacttcttaccatcatctacaggtttatagtttctactaaacagagaacagaggtttaaagtcattatttcttaatgtcattcgcagcaacctggatggaactggagacttattctaactgaaataactctggaatggaaaaccaaacgtcatatattctcactcataagtgggagctaaatttgtgaggatgtaaaggtgtaagaatgatacaatggactttggggacttggggaaagggtgaaagtggtatgaggtataaaagactacacattgagtacagtgtacactgcttgggtgatgggtgcaccaaagtctcagaaatcaccactaaagaacttattcatgtaaccaaacaccacctgtttcccaaaaactgttgaaataaaaaataaataaaagtcattatttcttataatattttctgttgcccctcccttctcctaggattctaattacacgtcttaggccactcgatatttcccacagctcactgatgctgtttttttctttagtccttccaccctgtgcttcattttggatagtcactattgttatctattcaagcccactgatgtgtgtcttatctgctattaatcccatccaatatatattttatttcagatactgcattcttcatctctatttttatattttctatgtatttccacatcatctttctgttttcccctcgtgtcttgaacatttagagcatattagtaagaactgtttctatatctttgtctgctaaaccatctttatcatttctgggtctctttcttttcagaaaatgtttaaatcctggctatgggtcatattttcattcttctttgtaagcattttaatattttattgaggtagaattgacataatatctaattaatccattcaaagtgaacgttcggctgggcacggtggctcactcctgtaatcccagcactttgggaggccgaggcaggtggatcacttgaggtcaggagttcaagaccagcctggccaacatggtgaaaccccgtctctactaaaaatacaaaatttagctgggcgtggcggcaggtgcctgtaatcccagctactgaggaggctgaggcaggagaatcccttgaacccgggaggcagaggttgcagtgagctgagatcacaccactgcactccagactgagcgacagagggagactacatctcaaaaaaataaataaataaaaaataaactgaatattccagtggtatttagtccactcacagtgttgtacaactaccacctatacctagttccaaaacactgttatgaccccaaaagggaattcaacacccattaggcagttgcttctcattcacccttaatcccaggccctggcaagcaacaatctacattctgtctcatagattacctattgtggatatttcacataaatggaatcatacaatatgtgaccatttgtgtgtgtcttctttcacttaatatgttttctaggttcatctgcatcgtagcatgtatctgtacttcatttctttactgctagacaatttatggaatacagactactgcaatttgtttactcattcatccactgatggacatttgggttgtttccaccatttagctattgcaaatagtaatgctatgaacatgtgtggtcatatatttgtttgagtacctgctttcaattcttcagggtatatacctaggagtggaattgctgggtcatatgacaagtctatgtgttcctttgaggaattgtcaaactcttttttccacagaggctgaaccatttaacattcccaccagcaacatacgagggttccagtttctccacatcgtcctcaaaaccagttactgcccgtcttttgattctggccatcctagtaggtgagaagtggtatcttactgtggttttcatttgcatctccctgatcactaatgatgttgagtattaatgatgtgtttatcttctcagagtaactgtctattccaagtcctttgcccattttttagttgagcttttttttgctgttgagttgtaagttttcgttcttgtattttggccattggtccattatgagttaatttttatacatggcatgaagtaggggtccaactttattgttttgcatgtgcatctccaggggtccccaaaccatttgaagagattattctttccccactgaatcatcctggcatgtttgttaaaaatcaattgcctacatatatattaattctggactctcaattctattagtctatacatctatccttatgccagtaccacactattttgatcattgtagctttgcagtaagtttcttaattgggaaatatgagtcctctggctttattcttcctttttcaagatggttttggctatttggatctgttgcaattccatatgaatatgaggatcagctttccaacttttgcaaaaaaaaaaaaaaaaggccaatggaattttgatagagattgcattgaatctggagattgctttggacagtattgccatcctaacggcaatgtaaagtcttccaattcatgaacacaaaatgtctttccacttatttaggtcttctttatttcaacatgttttatagtttacagtgcacaagtctttcataagcaagtcaactcctttaggcttttggatgctattataaatgcaatcttttaaaatttctttttgtattgttcattccgagtacacagaaacacaaatgctttttgtgtgttaccttgtacctacaactttgctcaagttatttattagctttagtggaggtttttctggattctttgggattttctatatataggaccatgtcatctgcaaacagagacagttttatttcttccttccaaatctgtatgtctttgtttctttttcttgtcacactgctctggctataacttccactacaacttgaataactggtgagaatgggtatccgtgccttgttcctgatcataagggcaaggatttcagtcttttactattgagttggatgttagctgtgggttttttcataaacgctgaatgttgaggaaatgtttaaaaaaaaagttccctactattcctgattttgagcctttctatcaagaacagctgttgaattttgtcaactgcctactgtatcaattgaaacaatcacgtgggggttttccccgcttcattctattaatgtgttgtactacaccacccttgcaatcctgggaataagtcccacttggccatggtgcatattcctttaaatatgctgctagattcagtttgctagtattttgttgaagatttttgcatctttattaataaggaatattggtctgtaattttcgcattacgtctttgtttggctttggtatcagggtaataatactggcctcaaagagtgagttaggaagtattcttactctctcctctccaattttttggaagagtttgagagcgattctcatactctttaaatatttaaatatttggtattcttctttaaatatttggtagaatccaccagagaagcaatatggtactggacttctgattgggagtttttgttttgttttgagatagggtctcactctatcacccaggttggagtgcaatggcataatcatggatcactgcagtctcaacctcccaggctcaagtaatcttagtttgggaggttttttaactaattcaatctgttcacttgtaagtctgttatattttctgtttcttctgagtcagttttagtaatgcgtatttctaaaactgtgtccatttcatgtaggttatctaatctgtgcataaaattgctcacagtattctctttaatcctttttgtttaaggtcagtagtaatgtccccacactcacgtctagttttagttatacctatctgtgttttttctttgtcagtctagcaaaaggtttgtcaatttcattgatcttttcaaagaatcaaacttttggtttcactaattctctatattattttcctattctctatttcatttatctccactctaatctttatttacttccttttttctggtagctttgcattttctagtttctttaaaatgtaaagtaagattatttatttgaggcctttcttattctttaatgtagatgtttattgctaataatttccctctcaggactgttttcactgcatcatttaagtcacatatattgtttccattttaatttatttctaagtattctctaattcccacatatttgtaaatttccatatatttgtaaattttccagtattccttctgttaatgattactaacttcattccactgtgactggagaagatacatagcatgatttcaatctttttaaatttactgaaacttgttttgtggcctaatacagcctggagaatgtttcatgtatactttaaaagaatatatattttggcagggtgcagtggctcacgcctataatccctgcactttgggaggccgaggagggtggatcacctgaggtcaggagtctgagaccagtctggccaacatggcaaaaccccgtctctactaaaaatacaaaaattagctgggtgtggtggtggacacctgtaatcctagctactcaggaggctgaggcaggagaatcacttgaaccccggaggcagaggttgcggtgagccaagatggagacattgcactctgggctgggtaacagagcaagactacgtctttcaaaaaaaaaaaaaaaaaaaagacaaaaaaaaaagaatacatattttgctgttgctgaatgttctgtatatgtctgttaggtctagttgattaatactgttgttgaggtcctctagtcccttactgatattctgtctagatgttctatccattgctaacgtcaaagcaagcattttttgactgaatgacaaaaactaaattttacattgttgggttctgaattttgttgtattcctctaaatagtgttctggtgcagttaagttacttggaatcatttggagccttctgaggactcttcccagtgccccatgtattctacaacatactttactctgcatagtaggaacacgactatttgaagccttattgtgaactctggaaattgtttttcttagtgctttccaagtgttttcttctctggcctcaggtagggcctgtcaagcatctacgaaatcagaactcagcaaaagactccaggagaaccctctggagatctccaaaatgcatgctcacttgttcatgctctcttgctttttagtttatgcctccccaacgccaatcccaacccccttagctcttttttctctggtactctgccctgtaattctaatcgccttgatcttcccaaatttttatctttgtctttttatctcagtaggactgctgggctctgttttggttcctccacaccttgcactgcagccaataaactgcctctaggctctgcagtaagctgttacaattgaagggctttaccttcacttgttcctattctctcagggatcacagtctggtgctgcctgtcatcaatgtctaaaagctattgtttatatattttataaattctcaagttatttaaagaggaagagtagatttttgctacataacaaattacctccaattttgtggctttaaaaatcaagcattggccaggcacggtgactcacgcctgtaattccagcactttgggaggccaaggcaggaggatcacctgaggtcaggaatttgagaccagcctgcccaacatgatgaaaccccatctctactaaaaatacaaaaaattagccaggtgcggtggtgcacgtctgtagtcccagctactcaggaggctgaggcaggagaatcacctgaacctgggagacagaggttgcagtgagctgagatcgtaccactgcactctagcctgggtgacagaccaagacttcaactcaaaaaaagctaaaaaaaatttaaaaacaaacaaaacaagcatttctttttttcacacagtttctgagggttggcaatcagggaacagcttagatgggtagttctggctcaggatctctcatgaggttgcagtcaagatgtcagcaggacagatgtttaggactggaagcttgactaaagctgagacatctgcttccaagaaggctcgttcacatgctgttggctagagaggcctcagttccttgttggctgttggcaggaggcctcagtttcccacagcatgggcctccccatcgggccattcacaacatggcagctaactattctcagagtgagtaatccaaggttgggggtagtgaggggaaggaggtggagccacatttgtattataaataacctatcctaagaaatgatccatcacttctgttacattctattggttccacagataaacctcaatacagtgtgtatggggattacaccatggtgtaaatatcgggatgccgggatcattgggggccatcttggaagctggctacatataaaataaatccagttcccattataccagcataggggaaagtagaagtctttcttacacatttttaacctccttatgtttactatttttcttatcccctaactgtaggctatattctatggctacaagagacatgagcagattacagagctccacacccagtcttggaaagaaaagtaactactactaagtagcagcaacttttaagagaaaagaatagagttcctggtgcttgtggcaagaagcaggaggaccttgaagccaatctgggcttgagaaagtggttcattcccccaaatacttcactcaatgatctacctaaatgtctgccgtctgccctcctttcccaccaatttccagtcaggcagcaatagccaacagcaatattaatagtaaaattaatagcagtagtaccagcaccaatgctaagcattttgcctttgttatctcaattactcctcacaacaaacctctgagatagctgtcattattccttacactctagactttgtttcttggtagtcatactctggtcttacactatccagtgtaataaaaactttttttttttttttaataacacctggctccctcttgccctacacggttctgctactccttcgacacggaaaaattctgtcttgtcctgcctgtcatctcttccacttcagttaggccttaaagcttcctcttagctaccatgttcccaatatctactatcaaacctcactaaaaagaatcaccagattattttgatccctgtaaattcccagttgctaggctctcccaatactacaaccgcctaatatagacttttccaattccttaggacacactgacctgtcaagcctacctcaccagctaatctccaaaacttggccctacttcagctactcatttaaaaatattattcacagcatgtatcttcgtaatttatatttgctgtagcttactgctaaaatgagttccttttcccgggggacctataattaatgatcagggagaaagggccaaaatataccatactggtaaatattatggtaccccagaaaccagtatactcccgttggttatctgttgaataatgactgaaaagtataaagtaatgattataaatactaactcagaaaattatcagagggcataatccaaagaatgttatttacaaataaaaagaaatagatgacagtagacacatataagcaatccacaaaaggcaaaacacgaaagaacaaaaaatatttaaatattatagaaacacaaaataaaataccaccttttgtcagacagataagcaaagactgaaattttgtcaaggaagtaaggaaacaggtagatacacttctggcagatataattttgtctttttgggagctatacaccaaatatctttaaaatccacatacatctttgactagtatttccatttctaataattaattctaagaaaataattggacaaagagatatacatttaaaaaatttactatggcactaactacaatataaaaatctgtccaacaataagggcttggttaaattttagtacatccaaactaagaattattattaaatcacttcaaaacattacatattgtataatcccagtttttaaaaagtaacatatattcacataaaaacatacctgcatagaaaaaaaatctagaagtatacaccccaaaatgttaccagtgattatctctgtaatagaagtggaattttttgtgattttttttgtttgtttttcagggtttgtttttttttttttttgcttatcacacctaattttctacagtaagcataagttgcacatggataataacacacattcttaaaaggcaaaaacaacaactatgatcacaatttaaaggcagaaaagtgctattatcttaacagaacatggaacatccatgttctatgataataataaagttaggcaaagttaatatcaaataacctgatattcaatagcctagtttttaattagttttagtaacacatatggaagaatctgttatgaataaaaaaccatgtaggccgggcacggtggctcacgcctgtaatcccagcactttgaaaggccaaggcaggcagaccacgaggtcagaagttcgagaccagcctgaccaacatggtgaaactccatctctactaagaatacaaaaattagccgggcgtggtggcatgcgcttgtgatcccagctactcaggaggctgaaacagaagaattgcttgaattcggaaggcggaggatgcagtgagccaagatcatgccactgcactccagcatgggcaacagagtgagactccatctcaaaaaataaaaaataaaaaagcatctaattcaggtattttaagaaaacaaaagccttcccaaataaaaatgtagtactaatcctagagacaacgttgaaaatcacgtagtaaaaatctcaactctttcaagctgagaatcaacttaaatcccctttgcatgcctagggtctcattctgttacccaggctggagtgcagtggtatgatcacagttcactgcagcctcaacctcccaggctcaagagatcctccaccccagcctcccaagtagctgagactacaggcatgtgtcaccatatctaactttttttattttttgtagagacagggtcctactatgttgcccaagctggtctcaaaatcctgggctcaagcaatcctcctgcttcagcctcccaaagtgctgggattacaggcatgggccaccacactgggcccctttacacatttaccttgagaaccctcactgttatgagaaagtggttgcccagaaagtaagattcaaaaatcactcatgaatttaagaattcaactctatgtttagctgaagagagtcttcatctcagacttgaacagtttgggggatgacagttatagtcagtaacaagaagggggggtctcttaaattgttctaggaatacacttctgttaagattgagcatcctaaatccaaaaatctgaaatccaaaatctccaagatttcaaacttcttttgtaccaacataatgctcaaaggaaatgctcattggagcattttggattttcgatttttggattagggatgctcaacctgtaggcaaaattccaaaatctaaaaaaatctgaaatccaaaacacttccagtgccaagcattttggataaggaatactcaacctgtacaatttaagtatgtatatctccaggcactgtgtacgatttctagccaacatccagggaattgcttgtggccatgtagagaattgcctaggaactgtttgcaatgcctgattcaacatgacctgcaacatagccagtcagtaaatcctcattaggactaatccataaactataattttcaatgaagttggctagcataaaatggtcatttccaaatgtctgtggcagaagatgaaaaattattttaattgtaaccaaataattaatggcaggtatccatagaaagttatttagtggcaacttcacagctataacagtttgcaaataaggtctcataatgcttccactgggatttgagagcagctgtgaggaaacaggaagcactaagcacaggacagcactacgatttctttaaattattagtaatgtttttgattaaagtaatttttgttgcactagggaagtttctagtacaggagaaaactaaataataactttacatgagggagagttagttgcatttgtgtaacacaagcagcatataacaccaaaactgacaacataattacgtggttattgttgaaaaataaatatctccttgctttagtgacaactctagcaccattcatatattcatacacccaacaaataaatgtatgaaaactatttacattgtttattctaggacctggaaatataagagtaaacaagaaaagtcactgtcttcatgaaacaaactgtctaacaagggagacagatgttacaacaaataattacatatttgactataactacaaatgtcatgttattaaactaaagagcaaggtgctataacagcatatagcaggactgcagtcaagcaagccaaacccaggggtggggaagagaggtccagcagaggaaatctgtgcaaatccctgtagccagaacaaccttacccaatctaggaactgaaacggtccagtaaaactgaagcactgagattatttctagggcacacattaagtctaagatgtataaagacatccaagagatcaaggtggtaaatgctacatgagtttggagctcagaaaaaaaaggtctagaccaggtataaacttagaagtcattagcttagagatggcatgggatgcacaggaactggaaatttctttggcaaggtgagcaggactatatgtcggaaggcagggggtcaagattactttctttttttggaacgcatctcgctctgtagcccaggctggagtgcagtggtgtgatctcagctcactgcaacctccgtctgctgggttcaagcaactcttctgcctcagcctcccaagtagctgggactacaggtgtgcaccaccatgactggctgatttttttgtatttttagtaaagatggggtttcaccatgttggccatgctggtcttgatctcctgatctcaggtgatctacctgccttcgtctcccaaagtgctgggattacaggcgtgagcgaccacgcctggccaagattacttttgttttttttttgagacagtctcactctttttgcccagggtggagtgcaatggcacgatcttggctcaccgcaacctccgcctcccgggttcaagtgattctcctgcctcagcctcccgagtagctgggattacaggcacgcaccaccatgcctggctaattttgtattttttagtagagacggggtttccccatgttggccaggctggtctcggactcccgacctcaggtgatctgcccgccttggcctcccaaagtgctgggattacaggtgtgagccaccgtgcccagtcgattactttcttaatcacaggggaaaagaaaaaaagtttaattacttctctgttgatttgcaatcaaaagaaataaaagtattttgtttctttccttttttttttttttgtttttaagagacagggtcttactacgttacccagtctggctcaaactcctgggctcaagagatcctcccacctcacctcagaaagtgctgggactacaggtttgagccacccagcctggccaaaagtattttctaacactatagttatgatacaatgttctatttgatcgggaaaggtaaaattaaatgtataaagttcttggagaaacgtcaagaactaagaaaagcacttctttcagtgagtctaaagtattaaatgctgtagtttatcagggcacttccttctagtgtttttcagtgccctggaaagtgaactttaaaaaaaaaaaaaaaacagatacaactacttcacaagatttgtcactaaaaatgctttgagtctgcagaactgccacctactgaagctgtatcatgatcataagcattctgaacacattaacaagtcctaaagggatgtgacatcaagaagaacagacaaaccttctgccttgcacaaccagaagttatcaactttcagaagatcattctaatccttaaacaacctgccctacacagcctccaatgatgactatacagtaggtaactgctttaaaaagtgatgagtcaggttacagttatagaaaagaaaagctgagttaaaatgttccacaatttacagccaaagcaccatgtaagcatgaaaaatgccttaacacaaactcacctgatttatttgaagcatgttaagacaatattgaccaaactgctgtatccctcacggctccaaaaactggaaaacgaaaatgaagaaataaagttcaacttagctgataacctcaatgactggtattttaaacacatgcccttgatcaaaatcaaatataaaatgtaatttatccagatctccatagaactttctatgatgataaaaatgttctgtacttgcactgtccaatctggaagtcattagccacatgtggctactgagcacttgaaatgtggctagagcaatcaagaaaataatatttaattttctttcatgttcacttgaataactacgtcactagtagccaccatactggacagtacagatctgaacaaagctccttctgcttctagacttctaagacaatcccaacaaaagtgaagctgttaaaaataaatctgagagtttcaggttaatatttaatgtatacttccctttttgcagtcctgttttaaacagctttgttcccatcttctatacgataaattaatcctaaagaagatgcaacaccacaagtattctcttagatggtatggaaaagagcatatagtacaattatcttgctgaatagtttctttttctctgtcattttgtctgttatcatcagtataaaaatagtatgtatattaaaatttcaggctgggcgtggtaatcccagcattttgggaggccaaggtgggtggatcatttgagttcaggagttcgggaccagcctggccaacatggtgaaaaccctgcctctaccaaaaatacaaaaattagccaggcatggtggcgcgtgcctgtaatctcagctactcaggaggctgaggcaggagaattgcttgaacccaggaggcagaggttgcagtgagccgagattgcgccattgcactccagcctaggcgacagagcgagactccatctcaaaaaaaaaaaaaaaaaaaattttaatttgaaaacagatgccaatgaagggcaggaaagtccaaattacaaataaataaatcatgggatcttgtaatgaaaaaaagtttatataaaatataaattatatacagacctctcccctaaaaattatctaaagcaacaacacaattgtgatacacagcaaaaggcctatatctaatcacctgtatagaaactgttatgctgctaaattttaatattgaactttcccctggaagcaaacgttttgtaagtacacacatacatacacaaacacacacccatatttggctaccattttttcaagatgacaaactagagtccattcaaaatgactttgaaaactttaatatttttcttacaatagtgtcctcagcatctgcatcaatttttatttattttctaattactgtcacatttcctatgagaacgggatgctgtataaagagcacacggcctggatattggtgaatttgagttttagtcaaagttcttcagattaccttctgagccttggttcaaattactttgtgtatctttgagttcttctttttctgtcttcttttttttcttcaatctttaaaaagtaagctaaagtccttgtggtaggcagcctctaacaaatagaatatagcagaaataatgagataccacttccaagattaggttataaaaattcttaggtgtcaccttctctcactcatttgctcagagggaggcagatgccaaactgtggtgccctttggagaggcccatatggcaaagaactgagaaaagcctctggccaacagccagcaacaattgatttcttcagtccaagagccccaggaaactgaaccctgcaagagccacatgaatgagttcagaaacagatcttccaccagtagagcttccagatgtgactgcaaccccaactgacagcttgactaccacctcttttatgagccacaggcacccagctaagctgcacccagatttctaacccacagaaactgtaagataatgtttgttgtcttaagtccttaaattctggtgcaatgtgctatgcaacaataaataagactatcctgtccaactctataattcaatattcccatggtgctttaggtattaattaatatttggataggcaaaaaaataaaataaaatccctgttcaacatgagcaaatgagtaacattagaacttcaaagtggcaaattataaaacttaaacatttatattttcaattcaaaaaatgagattattcacaagtgtagcattagtcacatggtgttaaaatacacccgctttcaataggaatggagtatctcattaaaaaaatacactagctataacttaaaatacaaacacaaccaatcatctttttttttaactgaaaacagttcatttaaaaagtaaagtgtgaataaccactaaagcatctcagtgacttagtgtcccttgctttctagaatttatcattactggtcgggtgtagtggctcacgcttgtaactcagcactccgggaggccgaggtggggggatcacctgaggtcaggagttcaagaccagcctggccaacatggtgaaaccctgtctctactaaaaatacaaaaattagctgggcatagtaacacatgcctgtaatcccagctactcgggaggctgaggcagaagaaataaatgcttgaacccaggaggccaaggttgcagtgagccaagatcatgccactgcactccagtccaggtgacagagcaagacttcatctcagaaaaaaaaaaaaaaaaaggccaggcgcagtggctcacgcctgtaatcccagcactttgggaggcagaggcgggcggatcatgaggtcaggagatcgagaccatcctggctaacacagtgaaaccccgcctctactaaaaatacaaaatattagccgggcgtggtggcgggcgcctgtagtcccagctactcgggaggctgaggcaggagaatggcgtgaacccgggaggcggagcttgcagtgagccaagatcgcgccactgcactccagcctgggcgacagagcaagactccgtctcaaaaaaaaaaaaattaacattattaagcattcaccaactttgaaaaactccactttgtctttattagtatacgttgctaaagttacaaatgcttatctacagatctctatgtatttcttcaatattagaggctgataacactggtggctgattccaagaagcaagcagagtaagatattggggtacctttttgaaagttctaacctttttttttttctttttttttgagacggagtcttgccctgtcacccagagtggagtgcaacagctcaatctcagctcactgcaacctccacctaccaggctcaagtgattctcctgcctcagactccccagtagctggggatacaggtacacaccaccatgcctggctaatttttgtattttttgtagagacggggtttcaccatgttggccaggctggtctcgaactcctggcctcgggtgatccatctgcctcggcctcccaaagtgccaagattacaggcgtgagccaccacgcccggcccgaaacttctagtcttctgacacggaaaagatattccatgaagtaacaaaaaataaaactttatgaacataaaattaaccatacgatttaaatattctgtaagccttttctttacaatataaagagctgtagaaattaaaacacatgaaactaatgtctataacagcactctgtaattggctaacattctgaaaattatacttttttaagcaaaccagttattttagatttacatcaatttaaaaattgtagtttgtaattataccatggacaattcagaatgttcacagtggcacgtctttaagactctgtttctactttaaagacacgcccagtctactgtcacatattttaaacaatttgctaaaatatcaagacatatcaataaaatgcagagcagttttatactacctttggtttcataaaatccacctcctcagctgggtgtggtggctcacgcctgtaatcccagcacttttggagtctgaggcggacggatcacctgaggtcaggagttcgagactagcctggcgaacacggcaaaatcgtctctactaaaaatacaaaaattagccaggcatggaggcacgcacctgtagtccaggtactcaggaggctgaggcaggtgaatcgcttgaacccaggaggcggaggctgcagtgagtggagattgcgccactgcactctagcctgggtgacagagtaagactccatctcaaaaaataaaaataattaaaaaaaaaatccacctcctctatcacaaaagtttccagctacagttgattccaattacaactaagcgcttttagagaaatgtatccatgcgtcccaaaaatgccctatctggtcaggcatatgaagacaggcaattctagattccaaactactaaatgaaaacaagcaggattatagggagacggctggggaagacgtgatgctcatgaagaatggcccaacctgtaactgcaatgtactgctgatataagtcgtactttaattatgaattacattttgcccatctgagaaattaaaagctgcacagaaatctatataatccccaataattaaactgctttataaaacggcactgttactaaatatgtataaattttttatatcagcacccatcctacagttgataggcaattctcacttaaatgtcttatttgacaacatgaaaagcaaaaaaaatttactatctctactcttagactacaaactgctacaaaactatcaattcaatgcttattactctaaaaaagatatacggtcctttaaagagctttttaaaatgtttttcattttgatttttcaaagtgggtacccaaaaacactgcttttatgtaaggaaaacagaagtcttacgccacaaactattctagtggaaaactctaaataacacaggccagaaaaaaaaaaaaggaaactaacatttttcagacaccaattgtatacgctaggtgccacattttgccatttttacatcaactcatttaatcctcatcatcttgggatgtaggcattatctccatttttctagaggttgggttatttgcctacagtcacattgctaggtttagaacggttcattctggcccaaagtcgtcttttcttcactatacaccaaattaaaaaagacttgccttctttttaatttttttttttttttttttttttgagacggagttccactcttgctgcccaggctggagtgcaatgggcaccatgtcggctcaccgcaagatccgcctcctggtttcaaatgattctcctgcctcagcctcctgagtagctgcgattacaggcatgcgccaccacggccggctaattttacatttttagtagagacggggtttctccatgttcgtcaggctggtctcgaacccccaaccctcaggtgattcacccacctcggcctcccaaagtgctgggattacaagcatgagccaccatgcccggacatttttttttttttttgagactgagtctcactctgtcacccaggctggagtgcaatggcgccatctcagctcactgcaacctctgcctcccgggttcaagcgattctcctgcctcagcctcccgagtagctgggattacaggcgcgcaccaccacacccagctaatttttgtatttttagtagagacggggtttcaccatgttggccaggctggtctcgaactcctgacctcctgatccacctgcctcggcctcccaaagtgctgggattacaggcatgagccaccccacctggccaattttttttattttctatgatcagcttggtgaaaaataaaagatttgccttcttataatttttcctggaacaaagtcaagggcttgacctctaggacaacataatggcaaagctcctatatagaacttggggaggattatttaaaatcaaacgatgcacacataaataaaaatgataattattactgattctagacatctagtattttgtgtacctataagaggcacaaatatatctatatgtgaataatcatactgtgcgtgtctcaaactatgcagtctaagagaattcaattttgcagtatctagagttttccctctttattatgatctgtacctataaatgatcagattcccagcactgaacgtgcacaaaacaagataataataggaataaagagaagggtaggcacaaaggaaaaaaaaaaaaaaacctaccatatcttctagaacctaaacaggaaaaccgctctgcctcgatttctggattgtttgtatatttaaaagcttgatgactatcttagattttttttatattcatactatttgttgaaaagcaaaccaagccactcttcctagcacttcattccagacaagccaagtaagctaaaatgtaaaatttgcatggttttccaagctcaagtatttaggagttaaggatcacaatgtatgtaacttacccttaaatggtccaggggaaaaatattttgtgtgtgatagagagcaaataataaatacataaaatgttaacaggtgaatctgaataaaggttacaaagattttctttgtattattcttattcttgccatttgtctgtaagcttgaaattatttccaaataaagttaaaatttaaaaattacacagcattttatttgaaattaacaatacatacttggattacacagcaacattcttacaaatacaaaacactggtttttatggggaaaaatgcagtaatttgtgagcaagtatgtaccatatcctaccaacttatcatcacttaggaataaatttcagactagcctaccatataataaaatatggcaatagtgacttgacttgaaaccatagcaggaaaacacaaacacaccagatagtttggcataactgcttcgcaaatttaatacaggcctgctgcaaaatgcagcaatctacaattaaagtgttatgtgatatctcttgtttgcagtaagatacaaactgaacaatgaaaatctggccatactacaaaacagagatggagagtaagtcttggttttggtagttttattaaataagatttttccaccgcagctgagttcacaacagtgtacttgaatcatctaaagaaagcaaggacggggaagaaatatcctggagaaatgttgaaatcttttctcctccaaggttactatcaccctgcctgtccatcacaattttgatttcaagtattcacgatgctggtctgaaacacaggatgcatcagaagccaagtaatgctcagcaaaagttcaccaaaattgtgaaagcaaacattaaataaaaaacgttttcaattaacagtaaaatatctttaaaggatcatctctagcctttctttctgcaggatccacccactttaaaatcctttggtaaattcccaggtctaccctaattgaatggtccctctctatctgctcaagcagttcttaaccctttggagtggggatgggggtaaggggacatcacagcaaatatggacccttaccaaagaaaattattcacaaatgcaaaattctacacacatttccaaagacttccagaatcccacggccattacccccaccgcctccctaagaatcccagagtggcgtgcttctcaatggcctctgcggagcacccccagcccccaagccacagcccccggctcgaccccgaagagactagagttcctgctctcacacagcggattccgtaactgagctttgtctcctcgcccaactcccttcaccccggcaaggtcactaccgccaactacccctttaagccgagccatcacggtaggagttcgtaacagccacagcagaacttgcctgtcataggatatattttgtcccctcggccccacctaccctccccatttcggcaagttacgtctttaccactagcccattctacagaaatagctgccgccgccaccctccggcgcgccccggccccgccgctccgcctccagcgcccccaggcccatttcccgcagaccctccccgggccgccctcccctgccctactctaggcgctccctctccctcgcagccacaccgtggctgcactcgccgtcctctcttccggccgctaccaccccggccccctagaaccccagcctcccgcgcccgcagccgcgttcctgtctccccgacctccgcacccccacttggcccggcctcctcgccttcctcccggctcctcccctcaggacacctgtgtcgtcccaccccctccaccacacacgcaccccccaccccaattccttcgcctccctgtcctccctcccccgccggtctcccctccccgctgctgccccgagagcccgatgtgggagggaaggcgcgggggaggggaggccgcgaagggggctgcttttctccgggttccccgtgctgcggaactgcagggctccccagcgccctctgccttcttcgccggcggcgcggaagtcggggtctcccggacgcccccgatgagggtatttaccttcttgccggggacactttgcagacggctccaacattggcaaacactacagagaactgaccccgctcggccgccgccggcttccacccctcgggctccccgccccccgcctccgcccgcctccgcccgcctccccggcgctccc

SEQ ID NO: 2341 - DNA, 197327 bp, Homo sapiens; identical to SEQ ID NO: 2340

SEQ ID NO: 2342 - DNA, 516281 bp, Homo sapiens
ttgcctctcaagcagcctctggtcatctatctgcctttgagccatcaagatgccgatgtcttctcttccagcagctattttgtctcacatgacagctattaacaatgtgcctcctcctccacttcacagtataccaagtgagtgggaaatactttgatgctcttattcacctaccattgttttcagcggttcttaccccagctatgaaaattgggggtatttcagggttgatagggacattgggaatcttattgacagtgctgaagaatggaaagaacatagatgtgtaaatcctgcttggtctacttgaagtcatttcagtactctaggtcttaagtattttttctctgtaaaatgaggatctttacgaactcttagagcttcagatacattgaaatatttctaaagatgaaagaaaacaaagatttagagaggccacatgttccaccagctatcaggttcctttttctagcagatcttctactccctaccaagagttggtcctactacgcttaatgggataattaatacttaatattctctaggagaattctcatttcaatttgacaaggaaaaaaagataattcctactattctgactgtgaaatttattcctatttaacttttttattttctagtcttacttataagaattaagtatagaactagatatttcaaagtttatataattgacagtattttctcattttatgtaattagtctaaacctataacgttttcttaagattgtaaacacttctcatggccatcgaatttataagatctattatttgaacaccatcattctgactagcaatatgtatgagttccagtgttagttaagatttttaaaaaatatctggataacaaaggtaatacttgtgatccttttcaacttcaataaagcattaactcttattttattattcattgggcagatttatagtattgatttgaagaagctaagccatccatccttttcccttcctgtgaaagttaatttctccaaatacattttaaaaaattaatgctcatagtctccaggttaaaaggtataacaggtggcagttgatactccttgaaggggtacactgatgtcttgaatagtgttagacaaaatccttatgttaaacaaaattaattccatttgtattatagtgaaaataatcttgcatctggtcaaagttttctatttctacttgagtggaaataagaattaagtgcaattttgctgaagaaacacagcttctactattcatgttttatttgtgaaaaagaaaataaaagtcaccataaaataatatttttaaaaagcccaggaaactcggtagctgggagttaaaagatcaaattaatttagaatcaatgagatgagatttgtgctaccctctgtagtgcctcccaaggacacttaacttctgtgaagtgattaaaagacgaaaaatcagcagcaatttagatctcagaactgaatagagcataatggaaagcggtggagctcccagtgttcctttagaggttcgcacttgatgtttctatgtctgcaacttctctttgaggacgtgccctgcttgccttaataactgtgtctttttgctaactgtagcaagacaataattttccttagcaagcactgattgtctcactgctgaaacaatgatctcatggaagccaatgtgtaatgaatgctttcaatttatgaaatgactgaacctgaattacaaaggatatataaatgagttttaaatgcagtgggcataaataggaatgcacatttacatacctaaaaagaaaatccagccattgtatacatccttgatactttgtatttgttgagttaggttggatttagtgactcatattcaccttctctgtaagtatttatttatttatttattcatttttatttatttttgagatgaagtcttgctctgttgcccaggctggagtgcagtggcacgatctcagctcaccacaacctccgcctcctgggttcaagcgattatcctgcctcagcctcttgagtagctgggactacaggtgtgcctggctaatttttgtatttttagtagagatggggtttcactgtgttggccaggctggtctctatctcctcacctcgtgatctgcccccctcagcctcccaaagtgctaggatttacaggcgtgagctaccacgccccggctgtctgtatttatatgtgaatattgttaattgagtgctttctgtagttagtatgtaaacatttagcacgttatgttatttcatgtatttcttacaagaactctatgtcttcggtggacagaattaacggtcccagtgatatccatgccttaattcacaaaacttatgaataggttatactacatgttagggggaattgaggctgcacatgcaattaaagcagctaattggctccacttgagatgggagaatattccggtttgtctgggtaccagccacaattgtgagagcccttataagcaaaagaggaaggcgagagagtcagaatgatatgtgagaaagactcgactggcccttgctggctttgaagatggaggggggacaaaagccaaggaattcaggcagcctctagaagcagggaaaggcaaagaaatggattctcccctagcgtctccagaagaattgcagtcctgctgatgtgattttagcccagtgaaatcaggttcagagttctcatttccagaactgttagataatacgtttttatttttttaagccactaaggcagtggcaatcttttacagcagcaatataaaattaatacgtgttccagtttacacttaaggataataaggcttaggtttcatactaaggttcacacagatgttaagtagcagaggctcctcgtagcgtcatctgtgtaaacaaactctactcacaacaacaacaaagctggcagcattccgggttgccccttacctcctgccctgaatttcttgcccatttggctacttaaatgctattaatatatgggaggcaacatgtcacacatcttcaaaccctcctccactgctatcttgttgactctgaaattcagactcagacacttcaagtagttaagcttcttgagctagtttgctgcttgtggttctttcttctttgaaactttcaagtcttttccttctctggtctctttgacttctgtctcaggattcttcacagtttgctaaccttaagggaggaatgaatgttctcaaaagcagaagagctgttccacttttcattctggatgagaattattttaaaaacatcatagctaacaaactgtacagttttaccacctaagtgaaatggcatctggtttaagtacacacatgacccattatttttataagttgatttcctgaagagatagaaaaaaagaaaaaaaaattcttattttaaaaaatttttaatggaaggcaagaagctgtccttcaccgtttggtttatggtccagttaacttcctttgttgggataaatttgctgctactctattttcttcacactaattaggcttattcttctgaggaagaatgggtttaaaaatatgctttacattttgactactggttgacttgaaaaaaaaatttctgtgcttttccagttccaaaaatgttttaattcaccagacatttctaggtatctttcatttattccaacatatgagttggaaaaaaaaaagcattcaagataagaccagagacacatcaagaaatttagaaacaagatagtactctttttttttttttttctgagacggaatctcgctctgtcgcccaggctggagtgcagtggcgtgatttcatttcactgcaaactctgcctcctgagttcacgccattctcctgcctcagtctcctgaatatctgggactacagtatatgttagtcgcagccacgcctggctaatttttttgtatttttttagtagagacgggctttcaccgtgttggccagaatggtctcgatctcctgacctcgtgatccacccgcctcggcctctcaaagtgctgggattacagatgtgagccaccgcgcctggccaacacgatagtactcttaagcgaatgtttttcttcgctctttttcattttatggctttacatttactgcaaatctgaaaacactgtgtcatcattcctaagcgttcaaaggcgttttctataatttgagagtttttcagttctttggtagccaaggattaaaggtatatatttgaaaaagtgaatattgtaccatttaaaagttttaaaccattcaaatcctaggaatgcaggtaagaaaaaaaggaggcttgtcagtgacgaagaaaaacagggaagtgggttgtataatgtataaagaaaccaagtttaaggaaaagaaagaactaaaataaataagaatgaaaattccaagaaggagtaaaaggtgggaaaaaggttgaatgtttgtgtccatttctgtgtctatataatcaatgatagtcccaatggaatgtgccatcataaaattcagaagtattgaaaaatttttttcctcaccttaattttttaggataaaagtcaaatttttaatcccaaggagaaaagatggatgttttattgtaaagcaaacatttagtatttttttcctactactgttataactattttgatgtactttttgtcaaaccattttgagtggcgtttagaaattaagctatgggaacttaaatgtgagcttgatggtacctgggacttcaggcaggaaacaggaaatggtgaagtaaattgcagtgccttgcaaatcacatctccactagatgtcaggctaggtctcctctgagtctcaggctactgctctatctgcctatatcagagattagtcctgttattagttccatgttaccaatccttcagacaactgaagatgctggtcctccagcatctttcacagaactgatctctggtcttccttccaacatatactgtgaactagatttacttgtctgataggacgattaaactttttgataactttaactctacactcaaaagctgtcagggtcctactctcctttaaaacttacattacaatctattttccacaatctggcatttaaatctttcatgattaagctaaaatctgtctcttgtgttctagatctcattcttccatctatgtaactctccactacagctaaaacactttgttattccttaagcctatctgccaatactgattagaggtacaggaagatttcaaaggttaaacattcagatggacacacttggcaaatatgtaaagttacagctttccataaggacactgttaggggttccccttctgtggaagaagtccccagatgcctaggctgcatcccacacagccagccctctttggccacctatatagtagctcaggttcaaggtagtgagagtcacatagggcagatgctgaattgccctggcttaaaaccctcataaaccatcgtttttaataaaaattccaaaggcacttcttccaagtttcctgtaagaaatctctcaattactagagttaaagtactcagcgtagctcatttcagtgactgctcatcaggtattcgtacatcatctgtagtgctttctagtccaaatgcaagtcatcaatccaagatcattgttatcataagcaatgttgcctagcaacactgttaactctaccttaatctggcctataaggaacagagctggagagttatcatgctgacaggaaaaatattcccttaattacaccatcataatcttcaccatattgtcatgccttagctcatgtttcctgtgtttggggttccctttgctcttcctttatttgttcttatcatttcagttcttcagagttttcctaaattactttaatctccacaaagactctcctggcttttccagtatgaagaaattatatatactattttaatgtatttgtatttattaattataatcacattttatataatcacatttataaaatttttatgtagtcactatagaggcagaagtaggattattggatcatatggtaattctattgttaatattttgaggaactttcatactgctttccaaaatgactatattaatttacattctcaccaacagtatatcagggttccctttcctccactttctctctaacacttatctttagatttttgatagtagccatgttaacaggtacggagtggtatctcgctgtggatttaatttgtatttccctgatgattagagatattgacttttttttgttggccattcatgggtcttattctgaaaaatgtctgttcaggccctttgcccatttttcaagttggactatgtgtttgcttgttactgaattgtttgagttccctatatattttggatattacccccttatcataggtataatttgcaaatatagtctccattctgtgggttgtctcttcactctgttgtttccttttctgtgcagaagctttgtagagtgatgtaatctcatttatctacattgacttttgttccctgtgtatatgagaaagctgaggcaggaggatcgcttgagcccaggaatttgaggtgaatttcagtaagctacgatcatgctactgcactccagcctgagcaacagcacaaggccctgtttttgttgttgttgttgttgttgttttagtttttttttttttttgagatggagtttcactcttgttgcccagactggagtgcagtggcacgatcttggttcaccgtaacttctgcctcccgggttcaagagattcacctgcctcagcctcccaggtagctgggattacaggcatgcgccaccacacccggctaattttgtatttttagtagagacggggtttctccctgttgatcaggcttgtctcaaactcccaacctcgggtgatctgcccgcctcggcctcccaaagtgctaggattacaggtgtgagccaccacacctggccaagaccctgttttttttaaaaaaggattaatttgtggagaattgacatatttataatattgagtcttcctactcaataactggtatctttacaatgctcagtcttcctacttctcaggctgaatggctcacacctgtaatcccagcactttgggaggctgagatgggaggatccctggaggccaggagtttgagactagccttggcaacatagtgagaccctgtttctaccaaaaaacaaatccataagtaaataaatcttccccttgaatttatgtaagtgttcttgcatgccactaaataaaatttattcctgggtattttatcttttttctattatgaatgatatctttttctaactgtaaagtcagtatgtgagaaatattaaatttaaatttttaaaaagcttttgaaataatcataatcttacagatgttggaagttcagattaaaggaacttatttttctagagcaatttgacattccgtcatccccatatttcagtgtgtatttttaaaaaaacattgttacataattacaatacaactatcaagatcaggaaaattaacattgatacattactgtaatctaatccttggaccccattcaaatttggtcagttgttctgataatgtcctttctagtaaaacaatccaattcaaaatctcatgtttttctggtcaatgtgtctgttttatgccagcaccatactgttatgatagctttgtattttgaaatcagacagtgtgatagttttagctttgttcttttttcttcagattgctttgactctttaggatcttgctgtcttgtctcttcaattctttcagtctggaatagtttctcagttttccttgactttcatgaccttgatactgggagacaacaaagcagttattttgtagaatatctttcaatttggtttgtttgatatttcctcatgattagatttgaggtagacatctttgtcagcaatatcacaggagttatttcatgttctccttccatcttatcaggggccatatgatctcagtttgccccactcttgatgatattcactttaataatgattaaggtattacatagagagctttccagttgtaaatgtactcttttctctttttaaattaatatgttttgtgaagatgtattttaaggtgtataaatattccatttctcatgaaatattaaattaaatacattgaccgttctttatttgggttaaaaaataaaaattaaatataggaactctggggtttctattttattcaaagagttttaaggagttatttttattatatattttgatcacattgttcatagtttggacagtgggagccacttcaagttggtttgagcatttctttgcttctgacacaatgggatttttcaagctcttttcatactttctttgtcttatccctggaatcagacattttccctaagagccctgttttgttttaatgaaaatttaagatctgggtgctctgtgcatcattgatcttaggatgccattactcccaggccctctcagtggacagatctagggaatacaaattcacatttatatttgtttgtaaatcaatttatatatatatatatatatatatatatatatatatgtattaaaaattgtgagtttacactgatttctttaatcctaatgcagcaccacaggctcattcttatcttctccctttctgtatttctaactcccatctctgaagtgataaagctttctcctattagctttaacataacacttttgagtagtttccttgtttgtaatctatcttccatattcactgccatccattctgacatttagctctgggacactccctctgtctcacacctcgcagctgtcctccttacctggttgttctgagactctgcacagtcccaccttaatgtggatgccctccacaccctggtcttggatgctgtgataccttacctttcaccctacctactcctggtatagatgtctaccatctgctgctgtcacattggttttaggactcactgttcgaggaaaaaggcaagctattgaattagttacttctggaataagccactttggcaagtactctaatgggtttctggtctatgtactttttttaaatctatataattacaataatagcaaacactgatttgtatctttctttctaatttctaaatcttgtgcatttcttttattaaattgtgtcctttggtactttcagaaatttgtagcactagtatatatctttatctcgttcctgaatttattgctattgcctctggtgtttcaacattaaacatgattctgtcttttggtttgatctacttaccagcttaaaaaaaataaacttttttcaatttaagctgctaagaactatgttgaattttactggatactttttctgtatttagggagattataattttaaaaatttcaacttattgtggaaaattatattgctatattctctaattgaattttctttgattatttggataaatcttactttgttgtatgatctttgttaatatgttgccgggcactataccctcgtatatatttttggaaaatattcatgtgtatttgtgagattaatctctggtttcctttttcatgttttgtcatatttgcatctaattgttttgcttgcttcatcaaataaatttgaaagcttttctatgtttcaatatttaacaagcatatgtattgtctcttccatgaagatttgatggaatccactgtgataatgccttgtttgatacctgtgtgtgtgtgtttgtgtgtgtgtgtgtgtgtgtgtgtgtgtttgtggtggaggaaaactgctttgagattattccccatttttttcaaggcaattaatttacttaggcttttctcttttttctaatgtcaaatataagtaatatacattttccttaaaaaatcatttttgtttagtttcagtttttttgaccttacatctttgtgtaaaaccttcttttctgatttctttttaatgatatatactgttagttagttcccagttttcttatgttgagtacttaagctattctttttgtttagatatgcctgtggtttactttttcctttccaaagaaccagctcttgatttttactttctatattttttctgttttataaatttattcattgcttttctttgttttctcctttccatttttcttatgtattttaattttcttgtactacttgagttaaaagctaattttttattttattctatcttcttgtaatatcagtcatttttttcttcagagaaatacatattttaactatattccataggttcatgaaaggcttcactatttttactttatattttatagttttagttttaatatcctcttttgatttaagaataaaatttggtacatgattaatatatgtaaaatctacatccttagtgattcatttcctatttgatttttgtttgacaacaaagggaagttattggggtttattttgcctccatttatacctgcaatttttgctttatgaattttgatggtatataatctgagaacaaaaatgtttaatagtttgattctatacctaaatcaaatgtctatttcttgatttatcaactttagaaaatgcatatttataacctagtatgaaatgagaaaaatttccctcttcacatgttgattttgttgcaacaaatatttaagtctttggtcagttatattcatatctttaaatgttattaaatattatttttaatatttcttaaactgtaactattaattatctactttgtaagggaatatgtacagatatatattacattttctcctctgctgaaacttcacatttgttactcattatttatactatctccattataatctatgaataagttatttatgttaatgtttacaaaatttgcctacactttattagtacattttgcatcctatttaagtcttagttgtatgggtatgtgatttcttcacccagtgcttactaggcgaaatttgatatccaaataatatctctgaggtttcatatttattagttggggaataaaattcatgagtcacatttttttcttccctgaggttgccctactctttgccaggacattgctgtggagaagtctgtgaccaaagtttttcacacttggagaaggcttcctcttttggcttgctgctaaaataattctttatctttgaaatatggtaacaattagctgctaatcgagtaacacctagaacatctaatctttttgtaaatcatgtatcatgatttctctttgcctttctgggtcatcgtattatatttaattctccagattcaagtgtttatataagaaaagtattattgcattatatctttgagcattttttgtctactcttatttctgtttgcttactcagaaatcatttttacatatagtatctgctccctattttcatttgttattttctcctttctttatgtgtttcctatttatttgaatgtgttagcctctgtgtctatggctatattttcttaaatctttgtcatttttgcagtttcccatgtggattttatttctgtcattattttatcttcctcttatttcctgaatattgcctgcttgtaatttctttctgttttcctatttatggttaatgccatgtaattttgtttttctttcatcaaagctgtgtgtgtgtgtgtgtgtgtgtgtgagagagagagagagagagagagagacggagaagcacagatttttgcttatttcctggcataattattattctagtgcatactgcatactatttgatttttatttgctattataaattaatcatttttaccttttcccttagagcatattgtgcttaggttccaggattattaaatagtggttattttttgaagatagattacttgttagaaaataaatggtggtggagagtgcactagttcagcagacagattgaattttcttgtatgttaatgttgaacacttttcatcaactttgttctgttctcttccctaaacaatatgctcctaatttgtgctgtcatcgtttaaattccaaaggttctgtgtagttatttggccatgatctatttcttttcagtgactgagatcagctgcttctatgttgattgccacttaacattgtcctctgtattatcacaactttattctgaaaaaaaaaaaaaaatgagtgttatgtggaaccgttgtttaaccccgcctttcatgaatgtcactggttcaaggatatccccttagtctgtccatgtctgaacatcttcccatttcaagtaaggtttagtggctgcatccttcagagctgtatcagcttcccctggagaactcttcctatttcctcaaacaagaccagtatgcattttctcttgtacctcttttacagtttattgatgtttcactatttggttgatattattcagaattcatagttagaaaatatggttaatcctcagttttactgaagatcaggcttcttcctctaacttttatgttttactctttatgttatttagtgggctgtttgtcatgatgaatagatttttaatgccaaaaaaatgacattgacttgatgttcaatctcatgtagatgggagataaaataattaaaatatgatcttctgcaagaagcagggtgtttttagatttttgaaagtattcctttaataacatttttacttccacttatctgtctttgttattttttcttgatttgattttcattgcatacaactgattctcacctgacaaattagagtcacattattattatttattcattataatttactaaatattatttaaatccaatcattatgataagttctagtgttttggttcaagatgaatagaaaatggaccctgttctaaggggagcatcataaatctgaagaaacatagatataaattaaaaagtcataaagaaagatattatttgctttagtgcaactattcttgtggtgctgtaagagcacaatggaaaagacatttacctttttctatggaagacgagtttcaaaaagtgtcactggttaatttctgaggtggatctaaaagtatggatgagttttttaagttgagtaatgatccaaagagaatataatatcaaaaagacaagatatgttcatggagcacccagaacatgcgttgttgaaagatggcgagaatgagggcaggtgctgtggctcatgcctgtaattccagcactttgggaggccaaggcgggtggatcatgaggtcaggagatcgagactatcctggctaacatggtgaaaccctctctctattaaaaatacaaaaaaattagctggacatggtggcgggcgcctgtagtcccagctgctcgggagactgaggcaggagaatgacgttaacccaggaggcggaggttgcagtgagccgagattgtgccactgcactccagcctgggcgacagagcgagagtccgtcaaaaaaaaaaggaaaaaagaaagacggagagaatgggggaggaacttagagggtggtgttcaatgaggtcacagaagttaatttaggtacaattataaaaagaatgtattacatacaaagggatttaaagcaagaaagtttaacaatcacattagaattttagaaagtactgtgagagtagactggaggatgtgttggggaggaagaagctgaactcagggacattagttaggccattattgtagtattacagatgagattcaaagagaacctgaaataagatattgagctgtggcaagcatgtgaataatactacttcacaatgtacatgtcacacagccctacttggtgacttctgattaacgatccttattgtcattgggattacaggagacacacagtcagtcttttgtttctgaggtttccctgtgcagactcaaccaacttgggatcgaacatattagaaaaaataaaaaaaaacgtaatactacaataaaaataacataaaatacaaaacaatacagtataacactatttaaataggatttatattgtattaggtattaaaagtgatctagagaagatttatactatatgggaagatgtgcataggttatctgaaaatattatgccattttatatgaaagacttgagcatctatggatttttgtactggaggggtgaaagaggtgtcctagaaccaacaccccatggatattgatggacaactgtattttgaaaatatttaggatatatttcaaaagagatggaattgacagtctttataacactttggtcctgaagaggaaagggtagaataagatctcaagattggttatagatacaacaacaaaaagagaaaacttcaggccaataacctttatgaacagcaatgaaaaaatcctcaacaaaatatcggcaaacccaatccagcagcacatcaaaagcttatccaccatgatcaaggaggcttcatctctgggatgcaaggttggttcaacatatgcaaatcaagaaatatgattcatcacataaacagaactaaagacaaaaaccacatgattatctcaatagatgcagaaaaaggcttttgataaaattcaacatcccttcatgttaaaaactctcaataaactagatgttgaaggaacatacctcaaaatgataagaaccctatatgaaaaacccacagccaacatcatactgaatgggcaaaagctggcagcattcctcttgaataccagcacaagacaaggatgccctctctcaccactcctattcaacacagtattggaagttctggccagggcaatcaggcaagagaaggaaataaagggtattcaaatagtaagagaggaagtaaaactatccctgtttgcagatgacataattctatatctagaaaaccctgttgtctcaatcccaaagcttctcaagcttataagcaaagtctcaggatacagaatcaatgtgcaaaaattgctagcattcctatacgccaacaacaggcaagcagagagccaaatcatgagtgaattcccattaacaattgccacagaaagaataaaatacctaggaatacagctaacaagggaggtaaaagatctctacaaggagaactataaacaactgctcaaataaatcagaaatgacacaaacaaatggaaaaccattccatgctcatagataggacagataaatatcattaaaatggccatctgcccaaagcaatttatagattcaatgctattgccattaaactgccattcgcattcttcacaaaattagaaaaaactatttaaaaattcatatagaatcaaaaaagagcctcaatagccaggcaatcttaagcaaaaagaaaaaagctggagccatcactctacatgacttcaaactatactgcagggctacagtaaccaaaacagcatggtaccagtacaagaacagacacatagaccaatggaacagagtagtgaacccaaaaataagtccacacatctataactatctgatcttcaacaagcctgacaaaaataggtaatgggaaaaagattccctattcaatactgggaatagggaaaactgggtactgggaaaactggctagctataagcagaaaattgaaagtggaccccttttttacactatattcaataattaacttaatatggattaaagatttaaatgtaaaactccaaactataaaaaccctgtaagacaacctaggcaataccattcagaggcatgggcaaagatttcatgatgaagatgccaaaagcaattgcaacaaaagcaaaattgacaaatgagatctaattaaactagagtttcttcacagcaaaagaaactgtcagcagagtaaacacacagcctacagaatgggagaaaaattttgcaaactatgcatctgacaaaggtctaatatctagcatctataaggaacttaaacaaatttacaagaaaaaaacaaccgcattaaaaagtgggcaaaggacatgaacagacatttctcaaaagaagacataaatgtggccaacaatcatatggaaaaaagctcaacatcactggtcattagagaaatgcaaatcaaaccactgagacaccatctcacaccagtcagaatagctgttattaaaaagtaaaaaaataacagatgctggtgaggttgtagagaaaaaagaacacttacaccctgttggtgggactgtaaatcagctcaaccattgtggaagacagtgtggcaattcctcaaagacctaaagacagaaataccactgaacctagcaatcccattatttgggtatatacccaaatgaatataaatcattgtattataaagacacatgcacatatatgttcactgcagcaccattcacaatagcaaagacatggactcaacctaaatgcccatcaatgatagactgggtaaagaaaatgtggtacataaataccatggaatactatgcagccataaaaaagaataagattatgtccttcacagggacatggatggatttcgaggccatcatccttagcaaacaaactcaggaacagaacaccaaataccacgtgttttcacttgtaagtgggagctaagagatgagaacacatggacacatagaggggaacaacatacactgagacttactggagggtggaaggtgggaggaaggataggaccagaaaaaataactaatggatactaggcttaatatctgggtgatgaaataatgcatataacaaaccaccatgatacacgtttacctatataacaaaactgcacaacctgcatgttccctggaacttaaaagttaaaaaaaaaaaatagattggtgacaaagttattataattggtagggattttcttaatccagacaaaattcaggagaggatcatgttttatatggcaaaataaacatgggagaaattttgagtgaagttttggttatcttgagtttgcttttcctgggcaacattcacgtgaatattagtggagcactggttagagatctgggctggagagtttgatttgagaatcttaagatcaatgtgatcattgaagacatgaatgcagataagattatgcaaaaagaggatctaagctgagaagagaagacaagggtaatgagaatggattcttggccaacgtcaatgcttaacggaagaagatagcattcaatggagcagtctaataatgggaaagcaagaaaggagagaatggtgtcacaaaaacccagtaagaagaaacttcagtatcaaacatcacacagggcgtagtaagatgaagactgaaaggaggttatttgactagaatctaaaaggtctctgatgatcttaatgaaaaaaatttcaaaaaatatgaagaagattaattatagtagatggaagagtaaatttgggttggggaaatagaaaagataaacgtagattattttttccaaaaatgctgggtataaagagaagttattttgataatttgttgtaaaacattgcccctttcggctgggcgcggtggctcacgcctgtaatcccagcactttgggaggccgaggtgggcggatcacgaggtcaggagatcgagaccatcccggctaaaacggtgaaaccccgtctctactaaaaaatacaaaaaattagccgggcgtagtggcgggcgcctgtagtcccagctacttgggaggctgaggcaggagaatggcgtgaacccgggaggcggagcttgcagtgagccgagatcccgccactgcactccagcctgggcgacagagcgagactccgtctcaaaacaaaacaaaacaaaacaaaacaaaaaaaccttgcccctttccgtttcatgtgtccccaccactcccccactgcccccattttctcttctcaggtaatacagttctattttaacatcttaacccacccagtcaatgaacagggacaatctaggcccacttgggaattgtctctgtcagtgtgccagcatttattaatagaaaactttgactgggcattattcttttgcctctgaaggtttatttagtcaccctttttgggtgccttatgtctatctaatattatattatttaaagaaaaattacctttgagattttagaaaacaaaaactagttgaaaaatgggtagatacactatgaaccattaacataggtatgtttagtgacctcactagataggtttagacttattttaaaacatactcctccctgtaattaaatcactaatccaagtatataggaagacttagtcatgcttattgtctctgaaggatccttttctttattttctcccatccagcttcttgttcagtacttcagtcctatgctagaattcaccttctgcttattattgtataagggttgctattcttactacaaaagtttgttgccagtatttctgttgctatggctgctgaactgcttctttgtgctctaaaaatcatattaagcaaggttccatttatcattggattaattattagagtatgtactccaactactttgaagccattttacactgtgttttccagctaactctgctctgacatttccgcaggatcattgtgatatttttttctagggctatgctgtccatctctttcttgcctcctagccactcagataagcctggtctctgagtaaattgtggctatgtatttacagaatttctaagccttcacttattctattgcttcctcttagctttttgcaaagggtatttatatacctcttaaaggaaagcttgttggggaaaaatagtttagttacgtttaacacaaaaaacatttctaacttccatcacatgcatacttaatttactatatgcacacatatgaagatatatctaccttaaataatcattaacacatataaatgatcatcaatataacattcaaacaaaacattggaatttagttcttctattccaataatatacagtgggccttatatcaataaagataatcggttttttaatttctcaatgggttcctagttaaagattaattttctaacccctttccagccctctttcaaatatactctagtctaaacccttgattttaaccgtgttatagggttaagtcttttctgcttctgtcaaaagccaggctaaggcaaatccatcaggaaaaacaagactggaaaacaaatgtaaactttatactctttgaacctctttaaactttatccctgtattaaatttgatcacaagaaaagctcaacatctggtctttacaaagttacaatttcatgttgaaacctttggctttttttctttttaatgaaactgctttcaaaggcaagatccattatgttgctcaacaccctccacggaaagagccttgcaacaaatacctctcagaactgaggatcagcaaagagatgttttgatgaattaaagtgttcttctactaggctgtgagtgctatccagcccattctatttttgagtttacttggctgttccaagcctactatgaagccttgacctctactgctatagcttttctcaggcaatgttaatgttagataaaaagcaaagtagtagtttaatccttctattctttgctagcaattcttaatcttatcttctctgttctataagtcttatttttttgtcacctgctttaaatgaaggataaagaatatttacttttttaaagcctctcttttttggtcagaattccttaaaccttgacctttttccaaatctctgtggcaccatctccctttcctgtccctatcattcatcagagctattactgacactcttcttgaacaccattagaaaaacaggctaaatgaatacttcatagaagttccttcctaatctatgtatataaaaatctatgattaagattttatatatcagaaatattactagactaaaaggtagtttagatatatgtaagctgacagcttggttcatttaaaataaattattccatatgacgctaacacacaatttggtaacttttttgtttcttaaggcttacctgagcaatgtgggtaagaaaatgcctaaatcatgtaatcagtatttccaagtttattatgatatgatttatatgatatgatatggatatatatgatatgatatggataacaatcagttgtctgcttaaatttcccttatttcaatttcttatttagaaaagcagtatttgttattggtgattaaaaccaatttgttattggtgattaatctaaaggatcacaaaatttttataccaagtcaaatttaatgattcagaaaactagaagtaaaaacagataagtttggatgtcaaattccaattcttcataattagaatgtggtcaatgaatgcactttttaacgtttgagaaatacattaaaccactgattttctcaataacttttcactaaagaaaggagtaatatgcctaagtgagtatttattatttttttttacaacagttctaatagcactcattcttctgcagtaagcagaagcccatcactgtaaagatgctataatatgcaatgctctatcttcctttccatctaatttgaaggatgtccgcccattctggcactgaagaagaatgacaattagtttgctttttggctatgattactatctttctgctcttaaagactcctttatgatttgcttacatttgatctttagaaggaattgcaaactgaatccagacactagaaggtgctctgaagagggggaacaaaagatggggacctgcgtaggattgaataggccgacataagtaggattgaatcgaagggcaagagtgaaagtgagagaccaaattaagaaaactcttactcgaattgtcatgtctgaagttctggaaccagttcatcttgtaacagtgttggatagggattctgcatggcttgctttaagagaagtgacattatatgaacacagacaaacttcagcatttactggaaataaaaaaaaatgccagaccagatttgacatcaataaaaaacattaaattctttcctcaccttaatcaccctatgcagttctacttgtgtattaaacaaagactgttaatacctcacttccatagtcactgaattctttcactatgatgaatgtttgcaattaaactctatttacacacttgcttaataagattatggaaaattactcaaatttttaattgattttttttcagacttgaaaaagtctaagcacattaattatggccagttgaatgcattatgccacattagaggacaacacaggtaagctattcatgcatttctttttctgtcattcaaatgaatatgagtatttttgttttagggataaagtatagtaataaaccattgctggctctcagaggtacctgatttatcacacagataaaaacagttgaaaacctgggggttatttcttcagattgaaggggcagaatatatatgtcacatcttaaggaaacaatttagtgtgaaacaaacataactcattcctagctggctctttgtagtacttaaaaagcagtcataaggggaaaaagccttaagtggttgaaaacacacatactgaatgaaataagtacctgagcagtgaatagggaatgcctcattgaaatatactggaaccagagaactaggaaatatcactgttcaaagctcaggattcctaagatgtgtaatacttgaagatttaattttaagagatctatttccttgacaactcctttctccaagttgggtttttggaattataaaactggttatttccttccatatgcatcagtgtccatccaccctcttaccttccttcactcatccttcatgggactgttgaggaaggccttaggtttacagagttttctctctctactttaaaacatctccaagtcacatccttgtactttgcaatccatttcaaattatttttatactgttgtctattttctcatttcttctgtctcagagagagagaagaaggcatgcaactttgatattgcttggatttctgtcaagagggatcattttcccctgtgcattgctgcctcctccttgcacccagtgcctttcgacatggagtaaagaatgaagtccacacactcccgagacctattgcctgatgtgaatcctgtctcagccacttaccctctgtgtgactttagactgcttactacatttctctgccttggttttttcattggtaaaatggagataacagtactcactttaaagggttactaggatgattaaatgagcctaatatatgtaaatagcgtctggcacatagtaagggttccagaagtgttagttatttttattatttttgttatgcaaaaaagctcatccaatattttaagtgtcttgaaaaattttaacatccaagctttgaatctatcttatatgttggtcccttttctaatgcatgagatgctaatcaaggctttgaatgtcctttttgctttcattttcgttttgctttctggcccagacgcatttcatttttcaaaatacttctagtttttttttctctttggggggtcataataagagagcttgaatcatctagagctagttctctcaaagtatcccctctaaataaatgtgatcagccttactcttcctggattgaatcattcctcttgggtggtgtcgtcttgtgagacaattatctcattcaggtccaatctggctgtactgcctgactccctctagtaagtcttatgtttactatgtcttttgttagaaacccaaatcctgaaattgttggatgtgttcttttggagcactggtacacaccaggggcctgggggaacaggttttaaggtatgtgtatataggttttgcatcattctgttagaaatacaatatatagttacaaatacaaaatcagataggaagataaatatttatttggaatgaggataaaattacaacaaattaataaaagcttggaagttcaggtcccttttctcacttgacatttctttagacaatttaccagaaatacattcacaggaattatttaaaaacttcagaattcaagtgatgtcaacaaattgagaggcaatttaggaaaaatgtatttctccatattattagttctttatgtattatagatgaaaagtgaccaataaattacacttttcccctataataaaaatagaaaggctgagaattaaatgattcaaggttttaaatttttgtacatagaactcacaaagggcattagttttgattctaaaaagtttcttctgttagaataaaggcagtaggttggtatattatcctgggattttttattgaagataaaataaaaaattaataacaaaggggggatgatatcactttggatttctaaatttttgagtgcaaatttttcatcctagtagactacaagctccatgaaggcagatttattttatttattttagtgcttcctactccttgacatttggcatagagttcaatgttttgcactggattttattttgatgttcagtagaaataaatatcttctgatgattcaaaaaaatgtacaagagttttctgtgttgattataaataagttaggatagatatggatttatagtgtttttttaactattgtctggagagcggattatttttaaatattttaatcgggaagtcttaattatatacatttttgtgataaaatatgtttttgtatatgtatacaatgtggaataattaaatcaatatgtttaatatatccatcacttctcttacttttttgtgatgagacatttgaaatttgctcttctggctattatataaacaatacatttttattaactttagtcaccctgttgtgcaatagatcttaaaatctttttactcctgtttaattgaatctttataccctttcgtcaacatctccacattcctccccagcaacctggctcctagtaaccaccattctactctctgcttccacgactttcatgttttcagattccacctctatgtgagatcatatggtatatgtctttcggtgcctgctctatcttacttagcataatgtccttgatgttattcatgttgttgcagaagaattttcttctttttaagaccgaacagtattccactgtgcataagtaccacatttttttagccgtttattcactgatggacatttaggttgatttcacattttggctattgtgaacagtgctgccataaacatgggaatgcagatatctcttccacatattgatttcagtttctttggatacatacccagaagtgagattcctgcatcatatgttaattctatttttagtctttctgaggaaactccatactgttttccataatggctgtactattttacattcccactaacaatgtacctgtatgagggttcctttcagttcaggtcctcatcagcacttacctttctttttgataacagccattctaacagatatgaggtaatatctcactgtggctttagttttcatttccccattgattagtgctatcaagcatttgttattttttttttcatgaacacattggctatacatatgtcttctttggtaaagtaggtgttcaaaaactctgtccatttttaattgtttttttttcccttgctactgagttgagttccttgtatatttggatattaattccttatttgatatatagtttgcaaatattttctctcattctgtaggttgtttcttcacttcgttgattgtttccttggttgtgcagaagcttttagtttgatgtaatctcatttgattgtttttgcttttgttgcctgtgctttcaggtcatactcaaaaaatcgttgcttagaccaatgtcatggaacttttcccctatgttttatcctagcagttctatgtttaagttttagatcttttgtatttaatcattttgagtttatttttgtatatggtgagagataagggtctaatttcattcttctgctgtggatatccagttttttaaagcaccacttattagacagactgtcctttttccattgtgtgttcttggcaattttgtcaaaaatcaatttattataactgtgggtttatttctgggttttctatcctgttccattgatcagtatgtctgtttttataccagcatcatactcttttgattatactagctgtataatatattttgaattcagggagtgagatgcctttggctttgctctttttgcttgagactcttttggctgtttggggtctttagtagttccatgcaaatttcagaattgttttttctatttttgtgaagatgacattggaattgtgatacagtttgccttgaatctgtagatcacttttggtagtatggacattttaacaatattaattcttctaatcagtgaacatggatatccttctatttacgttttcaatttctttcattagtgtttcagtatacagatctttaaacttttttggttaaattcacacctaagtaatctatttttgttgttgctatagtaaatagaattatttttctaggatttttttgggtggtttgtatatagaagcatgactaatttttgtacgttgattttgtatatcctgcaactttactgaatttatttattctaatagcttttggtggagtctctaggcttttatacttataagatccatattgtctgcaaatagagagtttccctgcttccttccctattgggctgtattttttttctttattttgcctaattgctctggctaaaactttcaatactgtgttgaaaagaagtagtgaaagtgggcatacttgtcttgttcttgatcttagatgaaaaattttcaacttttcacctttgagtatagtgttaactgtaggcttatcatatatggcctttattgtgtttaggttcattccttctgttgagggtttttattattaacaaaggtcaaatacttataaaaactataacccatgaacagttggatacttataaaaactatcacctgtgaacagcttttagcccaaagtccatttataaattaattgtcaagcattcagaattttccaaagacacaatatgatagaatcatagaattgtagaacaggaagtcaactcaatcatctagtggaaactctttaacctaaatatgattgttaatcatcgttatttaaaacaaaagaactaactgacaaagtcatagagtacccaattttccctcatttgctcaaaatatatctgaaatgttatgcttttataataaagaagaaaataacattttaagatttatagtaaatctttaatgaaaaaattaaaaattgagtagtttctcattgtttcagtacatttaattagaaaagtattaagagttcgatagagacaattatgatgattttaaggaggttcctggaaaaccctttacagtatattcgttattaatttttgtttcaaaatatcttactttcctttttcttcccttttttcactcacaggatgttggtgagaacctttctttttcttaatgagaatgttttgataattctgttggctttccggacataattagacatgtatttttgtcttaagaaataaagaaatgaagagataggggacttttatttttatggatataaagtttggaagagaaaggaaagggaggagagctttaaaaggatggtttatgtacacataaaagaaatgatctgagcttcgagccattaaacattgctttgtctggaatgaagccattttttattttgaggtttcctctgatgaccactagctggcactctcaatccagaacagccctgtcttttgggatggcagaaaatgtgggcagagataggtgggatcttacatttattcaataggttgttaacaagttggaggcttataattcaaggcatgcctattcataatgttttacctaacgtgtacactcttatagccaattgtttaggcgggattttctacctagggcagtaccttcactagggagcatttgaaatgtatacacatttatagttattaccacgactagaaggaagtgggggattttaaacctttagtgatgtgaagtaaaatcttgcacactgtcccaaccaaaatgtcaataatcctccttctcccatcttcccttccccttaaggaacactggtctagatgatattatcttaaacttactcaaattagaggagttgctatagataatcgctaggatttcattaaccttcagatttccctagatcttgatttcagaaacaaatcattctttcctgaaaacttgctttctttctctatttctatccatatcactacagttagcctgtaaactcctggaaaaaaaagcaaccctattagtttggtgctcttgagagtttttattgcttatttcagtgcatgatacatagctgacattcaaaaaatacttgtggaatgcctgcatttacccagtaattaaagtatgaaaatcttgcaggcatgttttgttaccttttctctttatttctccatgtgttataattagattctgctgttccattgtatctctattgtttatcactcattttttaatctactactccactctagcttttattacctgaatccaggactaccaaacttataagtggaattacattctcaaatctcttctcatcttaattccacattatgtactacaagttaaatctattttattcatatattttaatagattaatttttttttttttttttttttttttttttttttttttgagacggagtctcgctctgtcgcccaggccggactgcggactgcagtggcgcaatctcggctcactgcaagctccgcttcccgggttcacgccattctcctgcctcagcctcccgagtagctgggactacaggcgcccgccaccgcgcccggctaattttttgtatttttagtagagacggggtttcaccttgttagccaggatggtctcgatctcctgacctcatgatccacccgcctcggcctcccgaagtgctgggattacaggcgtgagccaccgcgcccggccaatagattaatttttgaataattttggctttacaaaaaaattgagtagaaagtataatttccatacataccttgacccctccttcctagtttcccatatgatcaatatcttgcagaagcatggtatatatgttgcaatttttagccgatgttgttatttactattaactaaagcccatttacattaggaattactgtttgtgttgaacattgcagggcttttgacaagtatataatgacatggaacaaccattccatgtaatgacgtgtgttcaatgttacagaataattttactactctaaaaatcttctgctccatctcttctccctcccttctccctatcctcaacccctgacaaccactgatttttttcctctgtttccataattttgccttttttagaatgtcatatagttggaataatactgtatatattattttcagattgccttctgtcttagtctgttttctattgctataaaagaatatcagagattagataatttataaagaaaataaatttatttctcacacttctggaggctgggaagtcaaagggcatgagactcgcatctggcaagggtgatctaatggtataagagtggaaggcgaaagcaagcttttgaaagatagagaagatagagaaagacaccaaggactagacttgctttatatcaatctcatgataattaaccttctaatgtgataatggcattaattcataagtcataccctcatgactcaatcacctttattaagccccaccttacaacactgtggcactggggattaagtttcaaaagcatgaattttggggggcacatttaaaccacagcagcttccttcactaaacaatatgtatttaaatttttttctctgtgtgtgtgtgcatggtgtgtgtgtgtgtgtgtgtgtgtgtgtttggcttgatagctcattccttttattgctgaataatatttattgtatggatataccacagtgtttttatccattcacttattgaagcacatcttggttgctttcaagttttagcaattacaaataaagctgctatgaacatttatgtgcaggtttttgtgtgaacatgggtttttgggaaaataccaaggagcatgcttgctgaatcatatgataagcttatgcttagctttataagaaactagcaaaccgttccaacgtggctgtaccattttgtattcccacccaaaatgagtgagtttcttttgctccataacctcatcatcatttgtgttgttggtgttttgaatattaggcattctagtaaatgtgtagtggtatcttgttgctttagtttgtaattccctaatgacatatgatgtttatcatcttttcataagctaatttccacctgtatgtcttcttggatgaggatctgttcagattctgtctgttttaaaattggtttctttgttttcttattgttgagttttaagagttctttgtagattttggatgccagctatttatcaaatatgtgttttgcaaatagtttctactatttctatgtcatttctgtgtcttctttggagaaatgtttattcatgtcctttgcacattttttaattgtgttgtttggttttctattgagttgtatgagttctttatacattttaaatattaatcccttatcagatatattttggttttcaaatatttttcccaagtagaggctactattgagtttatttttgtgtatggcataagataggggtacaatttcattcttttcccattttaaaattcataaggaaacataaaggaccccaaatagtaaaaacaattctgagaaaggaaaacaacgttggaggcattctatttctaattttaattattttttaaaaattatttttatgtattgtttttaaattggtatataataactgtacatgtttgggggtacatgtgatacccccaatctttataaaagtaccaatggcattcttcacagagtaccaatagtacttcgttaaagattgcattgaatctgtatattggtttggataatatgaacattctaacaatattaatttttctgatccagggatgtctttggggcagtgtatatctttctatttatttgtgtcatctgaaatttcatcactgttttataattttcagtgtacagatctttcaccttcttggtttaatttattactaaattgggtttttttgatactatcataaaggggattgctttcttgattcctttttcatttgtgttgttatttgtgtataaaaatctactaattttttattgactttgtatcctgtaaatttactgaattccttcattagttaaaaaatcataattattaaaattaaaaactcaagaccactctttgcagcttcctgtcagctagatttggccataagacagtgagtgttcttgccaacagaatgggaaaagtagttgtagaaattctgcaacatgagttaatcacaaaagaagattgatacctaaagtatgtaaataattgctacaaataacccaatagaaaaatgggaaattgctatgaatagaaaatcatcaaaaaaaattaaaatggccaataaattcatggaatacaaattaaacaagacacaaatttcatccataaaatatcaactactataaaagtttgataacttcaagtcttggtgagaatgtgggaaaagatctgctctcatatgctgctggaaaagtggcagatgtatagggagaatcaccagaaccaatttcgtgggcatgtgacttatgctccaaagggcctcatgctctgctgtcatcatcttgaaatgcttagtaatttttgaacaagctgctcacattttcattttgcactgggccccgcaaattatatagctggtcttgaaactcaccaaatcagccatgatgcaatgaaaaaacaaaaagtacctcaatatttgaaacatatgggtgtttaatacagaaatctagttaccaaagagttaaaagatccaaaagaggagggtgagttaacacaaataagtaactgcgcaaagtggctactaccctaagacgggggccttgaaagagcagacatggtatggagtatgaaaagaggctctgggattgtctaggaggaaccacccagataggctagaactgctaagaagggaccagaaagcagatagtgagtctacccaagaatggctaaagatagtgggtctacccaagaatgcagatagtgagtctacccatgaatggctgaaggcagaggaacacagccaattccagaaatgtcaccagtaacaggataaagagaaagcaaaaatataatgtttttttcctcttctgatttctagtctactacctgcgccttctattggcaaaatctaataggataagacagttggcaaggaagcctatgaagtgcagtttgctaattcccagactcaacattccagaacggatagagagtgcattatgtgtttataattaactattacatgcccagtaccctaaaagtacctcttagtattttaccccagagaagcacccacacataaataggaaggcatttacaagggtgttcactgcagcattttttttgagatagaaaaaaatgaaacaactttagtgttcatcattaggggaatagttaaataaagtatggcatattaataccatgaaatattatgaagaagttaaaaagaatgacatatctatttgttcaaatatgggcaggtctctaagtcatgttgtggatgggaaaaaagtaagttgcagatagattttataatatggtatatcttttgtatacaaagaccacacacgtaaacataaatctgtaaatatctactggttcactgaaatgtatataaagacacaaaaaagattaaaagaatattcactgatttaacatgggttttctctgagggtggtgaaaaagttcaatgttaagtgatggtcagaatagtggtcaaaataaaattcaaagtaacttacattgttttcaattttacaagagatttttctcttgcttgtatactctttgaattactaatttaaaaagaaatgaatactcagattcaagacttactataaagctacagcaatcaagacagtgtggtattagcaaaatagacaagtggatcaattaaacagaatacagagctcatgaatagacccacacaaatatgtcaactgatctttaacaaaggagcaagccaattgaatggagaaagtttggattttcaataaatgatactgaaacaactggatatccatatccaataaatatatgtgtctaggcagagaccttacattattcacaaaattaactcaaaatggatcatagacctaaatttaaaatgcaaaagtataaaaccatataagataacaaagaaaaattctaggtaacgttgggtttggtgatgacttcttaggtaatacaccaaaagcatgactgatgaaagataaaatgattaagctgaacttccttaaaatttaaatcttctgctctgtcaaagacactgttagaagaataaaaaggcaatgcaatttacctgtgtaacaaacctgcacgtgtacccctgaacctgaaataaaagtaaaaaaatagaaataaaaaatgtggtttatatacccaatggaatactattcagccctaaagaagaatgagatcttgccatttgctacaacatagatgaacccagaggcccttatgttaagttaaataagccagacacagaaagtaaaatactacatcatcccacttatatgtgaaatttaaaaaaacgcaaatacagagatagagaacagtggttactaggggcaagggtgaagggaggaaatggggagatgtaggtcagaggatacaaagtagaatatatgtaggatgaacaagtgaagagatctaatatacgatatgaggattataggtaataacattgcactgtatttggaattcatgctaaatgagtagattttagctgttcttgccacaaaaaaaaaatgggtaactatatgaaatgatggatatgttaatttgcttccctatagaaatctttttattatctgtatgtattctagaacatcatgttgtacacttaaatatatacagtaaaaataaaatttaaagatactaaaaatatatgtaattttcaatttgagaattttcacttagttcttcaagtttgactggctattcctgatattctcttgttattaatcatcattgtgattccctcctttattttcataaagattttatatataacttttatattttatatctaacatagagtaatttataggcttagggatataaatctgatgttgttgctgctggcttgcgcttatggcagcttgtctttccaggtgatctttctgtgaaagatttgcttattaacatgtaatagtaacatgtggcctaaattatgaaaaattcttcaacagagaatttatatctatctcttcctagggtcagtgtgcaccatcaagctaagctactccattctccttcaagagtccttccacaaagatggctgggctcccctccttgttccttggtcatggctcaattcctcccacccatgctccttcgtatcagtgactgccttcagcacaccctacccctcctctctgcccattggtcacatctcaagtatccactcactttcccccctcttttcttgcaatgtggtgggcctttgagacctaggtcacctttcataagaccaataatgcaccagaaatttgttatgcaggatatgtgcaacaacagggctctttagagaattaagactgccatgctgcaaaaaccttgaagattttttttctttttttgcattttggcatgtgtgcgtataaggtatgttctaaggtataaggtatgttcttctaaggtataagatacgttctacactacaggaatatgagtgccagatatttcctttttaatagttctgttctcatgataaaagtttttcctgagtctgtgtctaggtagtttttaataaagaaatctttctcataactagattttttcagtcttaatcgcatttaacatgacaggcattgcatttgtatgtattgctacaggaagatttgatcgtgactcacattcttgtccttttttccattaaaagtgaggcttctagccctgtgattttaataaaatttttaaactgtctgatatctaaatgctgtacattctgtacctggatttacattaacaattaacatttttacttgcctaatagactataaacagtgggcctgaagttttacttttattatttctagctactataacaatcctaaagataggaagtccttttctaaagataaaaaaaaatgaaaggtttaaatacttcatataaggttacaggacttcagttttatatgcaaatcagatattgattctcaaagtagggagaacttaagttagttatttcaggggaagtaaaccttttatgactgatcaatatctctctaagaggtttacattcaatcttgcagttaactttgtcaaacagatctttaaattttccttcagaactttatgaaaatgaaaagtttgagattaatcttaatatttaattgcaatggcatgtggaacttctttgaaaaaatataattttgaaggcataaaatcattggctaatgagctttgtccatgaataaggctagaaactcacatttccaaaaaatttttaaataagaacagaagagactgaatagcatgaaactttgtagtggcctaatgttaaatacactgacatttttatggaatgtttatttttcaactcattgtaataaaaggatgacatacattatgaaaatgtgtttatatatgcaatatgcatattgtatatataaaatatagagtcagcttaattcataccaaattgtacctgcctcctttatcaggatatcacttatatttcttttaattttcatcaaatacatgtgtagatgctatgatatttgtaagacaaattcaggaggaaacaatatataagtgaatgaatatattcaacttttatgatttgccttagttaacttaaaataaaaaatgtgaattgcctcgggcaaacacataaatataattaatcaataaatatcttattaaaagcttattatgttttcagacctgtgagcaaaactgaatgagatgcagaagaaatattgtattagggtatttcgggctgctatagataaacactaaatctcagtagctttgcacaatataattttatttctttcccacataatgctataaaggggtgcttttcattgacagtttgttcttttagtttaggaactcaggcctctaccaaacatttgctcttcagtctttattgtgtggcttccagggccaccttggtcctctgcatcaagctggatgggaaaaggacattgagaatcttatgtggaaggatcttttttggcacatccttctgccttctctttcatattccactgggtagaactcagccatgagaacatcgagtagactagcctagaccaggggaagggtgatcacttaaagcctttggtagtattccctgactgtatgacgtgttacttcctgccttctctaatagattttgcctctgatgagaaatggaagacccttaatcttagagcaagacaattggaatgtgttcactcatttttctactttatataagcgtaggcaggtaatttaaactttatatgcatcatttccttatccataaaatgacaaatacatttctaaataataatacatccaaatctaatatagtcagtgattttatatctaccttaaagtcttctgtatgctcctccaaactttatctactttttgggtacacagctagactacatttaccaacctcccttgtagttagagagactgcatttatcttcaaatatagtcacattgggtgtcagagctttaatatatacctttttgggagttggggggggagccatacaatccatagcagttattaacatttaaaaataagtcatttttacatgagagtacagatctctgacttctgtagaaaactacaggatctgaatacactgaacttcttttaatacatgagaaaaatggtcttaagggtgaggtcacaggtccctccatgtgggcatgctcttttcagcttaccacagttcccaccttatgacacttgcttggacacgataagcatttaattttataatccctgtatatagagaatcctgaaagtgttctagagttctgctgtgtaaacctatatattttgaatgtatttccctttcatctgcttgaggaagttggagttattttcttatagatgagtttattgcaggtaagcttcaatgaagtggcaacttctttgtccatgggtaggatttactcatagcctggtaaatcacgaaaaacatcttcaggacagaattgaagggtcagataggtatttaggtccatgatctactctccaactctaccataatgctaaacatttctttgtccctagcatgctaattattttatgtttcccctcagctacttctatattccatatttagatacatttatttacagatttcacatggttttagacaataatacttttctactgaacacacagacatatgttgttgtttcaatgagaccctcagaagtaggaatatgttccacattacatttttgggacatagaatataaattatagcattacaggccatttaggggctcaatctgaaaaatcatgtcatctctagctctagcatttgactcttccatttcaaccttccacgtatttcacttcttggacacactacttttggagacccagatcatagacactgaatccatgtacattacccaccacatcttggaaattcttgagaattaggtgaaggaggcagctaactaaggttatacacataaagtgtataagtgtaactaaggttatacacataaaaaatgacttgggtaaaagtcttagtatttggaaataaattttttatccactccaaagatgatctatccagagcacaaattggaataggattccaaattttgtagtataggctgcatatgtctacacttttgtacttctttggacctcagtatcttttcaggaacaaaatgggtaggagtatctagttaatacagttatgtaagatgcatatacattacttagaagagtgcctggcacatagcaagaactaatgtgttttattaaatgggggacagaatatcccagaggttaaaataatgggttttggagtcaatttagttttcatttgtaccgtatatcctccacttcttagttatatgaattaggcaaattattaaggttgcagtttctttttgtgcagaagggtcaataaagtatctcaaataaagtatattgtcaggttatataaatgtgcaataatacaaaacagtgtaaaagatcttagtacaatgattcgaatataacaagtatccagtgaaaaacaggtagatgtgtaaaacagatgattgtagaatgtgagttacaaacagaatttttttttttttcctgggaagcctctaataaatcagtggtcagattttaaaaagattcgatgcttggtgaatgtatctatacactgtgagaaagtgaataaaaatgcctaatatagaaaattacatcatattgtgttgtttgaatcaattatgttacatgaaataagatttttaaagtctatagaatttgtcttgtgtaaagcatcaatatggtgttttaggaacattatccaagagaagaaaaagctgttataaatatttcagaatgtgttgttattatttacaatgaaaatgaaaaagactttttaaaaaagccttctcttgaggattttgttgttcattgtcatgcggcaactattggctaagatgtttgtcagtgttcaatttgaagtatgataattttttataattattgaaataagctctcaagatgaatgtttagcattttttaaaaaattgaccaacttttcatggtgttgtcaattgaaaattgaattaggtggattttccagaaacaaatatcattacctaacatttaatgacaatgctattctctgaatcttgcttattggcatttttggtatttgccatgaatcaaggtgtagctacatataagagtcatcctgaggaatagatttaaaaaagagaagcccacccagggctctactgttggagtttatgattatcaataaatggatcagaaatttttacttacaaaaagcatcgtaggtaatttcagtgatctgaatttggaaaatgctcatcttttgttcttgtaacatatctttattctagacctaaaaaatactgcctgcgattttaacacatgatggcaaagattcaaataaatactctctctagtaatgtagatgtaaactattttaaataatttcagggggattttaattctgtagtacattatataaaactttaatcaattatagaaatatgagttttaaaaagactgaacttcaaaaattaaatttttgacattgacattatcatacattatcatacattttgtatttcttaaaatgtttctcactgagatttggatatttttaaagcacaaaatatttatattttatatttttgttagttgcttcttagactaaatagtatagaattgatacgtatatattgagttaaaaatctttctcttggaagctgttatcctatgacacttacaatttaatttctctcttctttttaagccggagtatgagcaatatcttatcagctcacgatacatttatgaagcaatatcctaaagtattcctgcaccaaaaacccagacttcctaaacttttcaaacaggaggaacaaaggtaatgataccttcttttgaaagcaaggttgatgggtgtgtatgagtgtgcttgtgctcacacaagttgaactcaaaactgaaaatatttgaccagtttcagtcaaatatttagtgtggagggctagggagcagccaaggaaacagaaattagttggtaagggtaaattcaatttttgttcagcaaaaatacgtgtccactgctaaagatcatatttatttaaactttttatcaaagaattgttgccttttactaatgaacggcagtgtttatgaaagggattaaaatattctacagggtttcatgagaaacttcccaatggaaatgattagagtgtttgtgggtggaggatatttggaggtgtgtcatgtatcaaggtataaatcacaaagtcatggggcactgaaaggcatttgtgaagccttttttactgggctcctgcttctaggtggacctacatttagatgtgctttatgtatttttaaagtcaaagaatgagattacttaagggtgttgcggaaggtgtaactgccctctcagtaaaggatgaaggtagattgccagatcacattgtgatgcagctcctctcaaattgtccctggctccagtggaactgtaagtgtcttatatcagtgcagtaccagatctagaaaggcattttcacttcctggatatagttgtctttgttgttccttaagtatcttatagtggatatggaaacctcctactccatactattcaagtagagttgatctgttcacatccttggctaccccactgccatactccctaataacttctattgccatatctgtaagactgtattttgcttgtgtgtttgctagtcagtatttttatttctgacatttagcagagggactgacctgtaattgtgaatagtagatgtgtgttgccccatgggcaaactgcttactggctgtgtaagggagctgatcaagaatatgttttcatttatttatatcaatgatacaaatgtaaaaattcaaacaaaattattgtaacaaatatgtctccaggggttggaagatatcagcatgagagacatagatctatttcattatcctatacctttcttttctttatagccatagggcagtattatgtaaaacataccatattagttgactgggaaaaatctctgggagatggagttgctctgccttttcaagaacaattctgttaaattaataaaatcttttgaaaacagagattcaaatataactttttccaagactgtatctatcatgtagatcaaactacatccctagatgtacatacatctggaatgatcatacaatgcttatactgtgatttatcaagttaacatcactctaaaaatatctgataaaaatactttgtactttttgattccaagtatactcaatttctattctaatcttgttgattagaaagagacctgtaaatgtagctctgtctatagaataagggaccaagagcttttatggatagctgatatgatcatcttgccctcatatttattcattaatctaccagcagtggtctgcttctttagttaagacattaaactttgagaggacttcagggaggcacccagtggctgtcaacatacttggtaatgaaataccatcttcatatttttaagaaaagagacagatcccaaatgtgttttaacagtaaaactgtggtttaaatgtgaaaataaagagtggactgccaaatacacaagaactaggacgatacactatactaattaagatttgtttaagtgtctgaaaagccaataaaattagcttaagaatcaaggggaattttaagaatcacattttagaaatgttttgctgtagagctaacttcaccattaaatgatggcattgggactcagtttcctctgtatctctgcctcctctttgctgggttggtttcatcgtcacacatcatgtaataggtctgggaagaccacattcatttattttactgttcaggtgagaatggaggtgttctgaaacaggcccagcaggagattcactgaaatctctaaattatatcatatccctgtattgtcactgttgtgaatttgccaatcttgaaccacatgcccacctgaagagtggggaatattgttgacactatatgaagcacatgggataagattagaagagagaaagtggaagctcagaagaaaattaggggccgggcgtggtggctcacacctgtaatcccagcactttggtaggccaaggcgggcagatcacctgaagttgggagtttgagaccatcctggccaacatggtgaaaccctgcctctactaaaatacaaaaaattagccgggcatggtggtgggcacctgtaatcccagctacttgggaggctgaggcaggggaatcacttgaacccaggaggcggaggttgcagtgagccaagattgcgccactgcactccagcctggagacagagcatgactctatctaaaaaaaaaacaaaaacaaaaaaacaaaaaaaaaccccttaaactgaattaaatagaatttcctaaagtatattaagaaaattgtgaattttcttctaagcttagtatacatagttcccacattcagtgtgatatatctatagataccctgatgattgaaactcagcttatgtaaatccaagaaatttttaaaggaataaaactgatgaggaaactttcatgttagcagacatgaaatacctacactgttaacatttacactattacagttattgatcaacaatatttacctgttatcattgtcatatatttaacactgtaattcatttaacacaaatattatgtgacagctacaacagcaagtaaggcacctgcctggttgtgggcagctggtgatgccaggtcatttgataaatattgaaggaagacagtcatgttcaaggagagtaggagaaatgctacatagaaatgttaagtccatgtggagcaaggcacacagatgaaaataagcagaagacctggctgagacgttgagaaacaattctatatgggcaaaaattgaagaataggataagaagatgaagtattgcttgggactttgatcattatttaaaatttattttattcatggattgataagaaggtaaaattttggtatattcatatatgtaggaaatcaaatagaaaagaatctgtgttgttttaaaaagaacactcagtgttgacccagaagacttggttttgtgtttttgtttcactcaatagcagaaacatgactttgaagaaagaagtctgttaactcacactcaggttttactcagaaaagggcagacaatattaatcccctacttcagagttatgcattgaaaaaacttttaaattgtgctagttttcattattatcatgcactataaatggcaatgatgttttatgtacattataccatctgtcaagaaattgaccttttttcaaacagattaaacaaccgcaacaaaaagaggcaaacttcaccttatataaagtaccagtatgtttaaagggggctgtgaaatgaaatgatttccatattccaatggccagatgaaattaacaatgttgtgattatcatcataagaattctttttttttttttttttgtgctgagggcaggagtgcagtggcctgatctcggctcactgcaacctccgcctcccaggttcaagtgattctccagcctcagcctcctgggactacaggcacccgccactacgcccagctaatttttgtatttttagtagcgacgaggtttcaccatgttggctaggatggtctggatctcttgacctcgtgatctgcccgccttggcctctcaaagtgctgggattacaggcgtgagccactgcgcggggccaagaattctttttgatgatactgtacaataattgacttacctgttcccaataaacataatggtcattttttttaaaacaacaacaacaaaatgtgattgccattttgagccatcttaactcattacagaaagatgggccataatccagatttacatctatatcttatatttagaatacataattgtaaaggtactaatttaaacaaaatgctagtttttatgtaaatagggagcccttttgctttccacatattctatgcttattttagaactttctttttcacaaaaattataacttcactaacttttgatattttcatttactttttaatgacagtcttggaagtatcgtaaagctagatggtttcctgagaatagtgcagttaaagggaatttggtaaatagtttacattttttaaatgtaattgtaactttctacacttgaaaaattcctaaataaacattgcagtgtggttttttttttattatactttcagttctagggtacatgtgcacaacgtgcaggtttgttacatatgtatacatgtgccatgttggtgtgcaacattgcagtgatttttactcagaatatgtaaactgcagctcaatctgtttgcctttgaacatttactcaaatttatactctccaaactttattgtcagtactatgatgagaaatatttttaaaatctgagaaccctggcttaagatagaaagttatgatgcttgtagtttaaatacatagaagagaaacattctgccgtcaagaaatcttccgattttgtgttaaattggacagtataaccacccttttctatattgacatccaactgtttcttttattaattaatccaattacttaccaagtagctattatatagcaggcactgtgctagtgtagagtaagatgaatgtggtccttgctcctctagagtttatgagtcagatcttctcaagggagacagccttaagcaataatcctgctaataataatttaagcacgatttgtcttcatgaattcatctttcagtttttagatcggatcatgaattagtccaggcttttagttgtaatcgaaattggactcaaaggaacataagttcctctgaggaacattaaaaaaaagttgcctattgattcgcctaacctactggaggatgggaaaagccagccttagagaaaagggatacaagatctggagtgcttgtcggactctctacttctcatccctgctcatatttgtagattatcccaattccctcttggtgattgtgacctttctccgtgtggcagggaacatggttaccaggaactttgaacttgtaacacctgtaacactggagagaaaaaggaatttttttcaaccagaataatcctgaaaaaggattgagattggctgcccagtggcatagaacctgttagcaaaagaaatgggggagggggagcatcctgcacaaagaagatagccactgtaaacaatgagtgctttcctaggtgtaagataaattaatacatatagtcacagtaaaattgctacattgtttacttcaatacatttaatatctaccctttaagcaataagaaaagacatagatttttaatcaatgtgtgtttaggtcagtttatgtcaggagtgaaaaagaaatgaagtggagtcattgtctggggtaatacccaaggtttgttccatgaccacggaaaactaggacgtggacacaacagagtgaggttaagagcagaggtttaatagacaaaagaaagggaaaagttctctcctgcagagagacggggtcccaagtgggtcttctggtccccagtgaagtgcaggaggttttatagatgagcttgaggaggtggtgtttgatttacacagggcacaaaaaattggtcggatcaggtatgctatttacataacacgaagaactggttaggattagttgtgctgtttgcatatcccacgaagaagctggctacctcaccctaatcttttattatgcaaaaggattctctacctcaccatgttgcctgcttttctactgtacatgtggtgacaaagaaaagggaagatggagcctccatgttgaacatacctggtttccaggtagcccttttctattggcacagctgttggcattcacccatgcaagcttttagcttgcttatctatgtttgcagctggattactttcaggctgctctttgttagaaaagaaattatttgggggctgctttttgttaaaaggcaagccttgctgaggactccttcaccctcactatctgcctaaataatttctttttagctcccatatcaaaagtttaaggaaatgttagtaattgaggaaacaaatagtaagcatccaaagaattatggaaacctttgttaaaaatgtatttattcaaaatgtggctttttattgatacatagtagatgtatgtatttttggacatgtgatattttgataaatttatattgtgtataataatcaaatcatggtagttgaaatatttattaccttaaacatttatctatgctgggaacatttgaattattctctactagctattttgaaatatacagtagattattgcttactgtagtcacaaagaaagaagtgatattatccttgttcataaatgacatgagcttatatttagaaaaccttaaagattccatcaaaaactgttagaaatgataaaataattcaataaaattgcaggatacaagagcaacgtaaaaaatcagtagcatttatatatgccaacagcaaacaatctgaaaaagaaatcaagaaagcaatcccatttacaatagacacaaaaattgtaaaatgcctaggaaaatatttaaccaaagaagttaaagatctctactaggaaaactataaattttaatgctgatgaaaaaaattaaagaggacacaaaaaagtaagaagatattccatgccccggactgcaagaataatattattaaaatgtcagtattacgcaaaatgtgacatttttatgggggtggaaattgaagtatttacaaagaaggctgcttacttgttataattttatttgacttttataaaaatgttatcagattttgaccattttagttccagaaggggttagtcagcattaaaatatcaaaaaaattttaaaaaattcagattaactttaacaatgtatagtatttgtactagattggtagatattaggcaaaatgtttatcaatgaggggtacatttttctaaagggtgcagaccaaaaataatgtggcagaagctaaggggaaaccaatgatgtatttgaattattagctataatacttcttccaatatgcagtcatgcactgcataacaacatttcagccaacagtggatcacatataccatggtggtcccataaaattaaaatggggctgaaaaattacctatcactcagggacttcatagctgcctgtaatgtcatactttaacatattacttatgtttttatgatgatgtcaatgtaaacaaatctattgtgctgccagttatataaaaatatagcacacacaattatgtatagtacataatacttgataatgatgactaaagactatattatttatgtatttactataacttttattgttattttagagtgtatttattctatttatattttaaaaaaaaggttaattgtaaaacaacctcagacagtcccttcaggagggattccagaagaaggcattgttatcataggaaatgacagctctgtgtgtgttattgtccctgaagaccttccagggggacaagacatgggtgtggaagacagtgatatcaatgatcctgaccctgtataggcctaggctaatgtttgtaattgtgtatgtgtaacaacaacaaaaagagcttaaaaagtaaaaataaaaataaaaaattttaaaaatagaaaaatgcttataggataaagatagaaacaaagagcatatttttgtacagctgtacaatgtgtgttttaagctaagtgtttttgcaagagtaaagacattaaacacaatgaaaaatcttataaagtcaaaatgttacaataagcaaagggtaatttgttattgaagaaagaaaaatattttacaaataaatctagtgtagcctaagtgtacagtgtttttaaattctgtattcacatacagtaatgtcctactcactcactgactcacccagagcaacttccactactgcaggctccatttaagggaagtgccctttacagatataccattttacattgttaatcctgtattttaatttagctctaccttttttgtgtttagatatgcttagatacgtaaatacttaccattgttatcgggggaacctgcccccgataattcttcattatttcacataggttattttctattttccctaagtgttggctggtctgagaaataaagggaaaaagcacaaaagagagaaattttaaagctgggtgtctgggggagacatcacatgtcggcgggttctgtgatgccccctgagccataaaacaagcaagtttttattagcaattttcaaaggggagggaatgcacaaatagggtgttgttcacagagatcacatgcttcaagggcaacaaaagatcacaaggcagaaggtcagagcgaaactagcatcactaatgaagtagacttgtcccgctgtgcacgcattgtcagggttcaagagcagagaacctgtctgagtagaattcgccaggctggaatttcctaatcctagcaagcgtgggggtgctgcaggagactagggtgtgtttcatccctatctacatctgcataaggcagaacctcccagggcagccattttagaggccccgccctgggaatgcattcttttcccagggttgttaattattaatattccttactggggaaataattcagtgatatttctcttacccgttttcagtcataagagaaatatggctctgtcccacccagcccacaggcagccagactttaagattatttcccttgttccctgaaaatcgctgttatcctgttcttaaggtgcccagatttgttattgttcaaacacacatgctttacaatttgttcagttaacgcaatcatcacagggtcctgaggcgacatacatcctcctcagtttatgcagatgacaggattaagagattaaaataaagacagacataggaaatcacaagagtattgattggggaagtgatgaatgtccatgaaatcttcacaatttatgttcttctgccatggcttcagccagtccctccgttcagggtccctgacttcccgcaacacattgtgttgcaattgcttataatatttggtacagtaacatgctgtacaggtttgtcgcctagaagccataggctataccatattagcttaggtgtatagcaggctataccatttatgtttgtgtaagcacgctctatgatgtttacccaatgacagaatttccaaatgatgcatttctcagaaagtatccctatcattagtcaacatatgactgtattcagattactcaattaatcaaaatgaaagttggttaattttgaagaaaatgttaaattaaaagtcagatatataatattaagtgaagaagtttctttttgtaaagagttaaaagcaaaaatgaaaaaaatcttgaatgatatctacctaatctacacttcccttaagctatatacttaacaaaatcaatattattttatctaaagtgcactctcagaaagaaaaaagagcagaatagttgattaatatgaattgaatgcttgagcaaatgtatcaaatggaatagtaaagaagaaacatgcttaactcaaaatggcacatgtctagcatagaaaaaagattgtaattataaccgcccaatgggttcttcttgcctgttgcccagatagagccaatttatcaaggcagggaaattgcagtagagagtttaatacacgcagagccacctgaacagggaaccacagttgtattattactcaaatcagtttctcagagaatttgggggctagggtttctcaaaggtagtttgggggaagggttgtgggtggttaggaaatgagtgcttgctactgattgattgtggatgcaaccataggaatgtgggaaatggtcctcctgtgtgctgagtagcttctgggtggggccacaggagcagttggtgggtcctggtagagccataggtcactggacatgcaaaaagcctgaaaagacatatcaaaaggccaattttagattctacaatagtgatgttaccttcaggtataattggagaagttgcacgtcttgtgacctccagcatagtggctgggaattgcttatgtctacaccttagctgaattcagtctcctctatcctcctaggtttgtggtctcccattagctttacaaatgcagttgagttttggggaagggctattatcatttaaactataaactaaatatctcccaaagttagctcggcccatgcccaggaacaattaagggcagcttgaaggccaaaggcaagatgagtgttgcccagatcaaacttccttcagtgccataattttctgttataatttttgcaatggtggtttcataatgatatattcatatacaattaactttccagacaagatgtgtaagaactctttggaaattcagatgagtactggaatccagctaataattaagagtgcattagagtgaatgtgcattgccttgacatatagtgtctattttgccactcagtaactatatgactttggagaagtcaatctatctgggcattagttaccttatatcaaaaataaaatgctcgggtagatgacagtcaattctccttttagctctattaatctaaggttccattttctagttgatgttacagatactgtagggagagaaatatatgtaatgaagataatatttttgtattaacttttgatgtatcttcccttatgagtatttccttccctgtatcccatgtgccatcatggtctcagagaaaagagcaggaaaaatattactttaagtaggaggaagatataaaatggaggtgttactggtggcaaatctgttcgggtctgcagcaacctcaatgcttgtctcctcaggagagagaatttgactaaggggcatgaggcagaaggagagactgaggcaagttttagagcaggagtgaaagtgtattaaaaagtttcagagcaggaatgaaaagacgtaaagtacacctggaagagggccaagtgggcaacaggagagatcaagtgcactgtttgacctttgacttggggttttatacgctggcatacttctggggtcttgcattccttctcccctggttcttcccttggggtgggctgtctgcatccacactggcctgctagcacttgggaggtgagcatgcacagtgtgtttactagagttgtatgcgtgctctcttgaggcattcttcccttaccacttgagtgtccctagaaagtcatatacctgttaaactctgccattttacctcattatgtgtacgtgtaagtctacttcacccaattcctgggatcttattggaaaactgctgattactagtttcaggtttttttctatcttttgggagcctgcctttctctggtgctggctgcaacattattattttattttttattttttttttgaaatagaatctcactctgtcacccaagctggagtgcagtggtgcaaacttggctcactgcaacctctgtcttctgggttcaagccattctcctgcctcatcctcctgagtagctgggattacaggtacccaccaccatgcccagctaactttttttttttttttttgagacaagatctcactctgtcacccagactggagtgcagtggcacaatcttggctcactgcaccctccacctcctgggttctagtgattctcatgccccagcctgtcaagtagctgggactacaggcaagcaccaccgtgcccagctaatttatgtattttttagtagagatggggtttcaccatgttggccaggctggtcttggtctcttgacattgtgatccagcctggtgacagagcgagactctgtctcaaaaaagaaaaaaaaagaatatctagatagttattgaggaagctgcaccttctaggacaatgataatcaacttgaactacatattagaatcaccttaggagttttgaaaaatactaatgccagatctgtgtccactgacattatgtaaattggagtccttggcttcaggctaggaccttagtaattaaaaaataacttttaggtgattattgaaaattactgctgtacaggaagacctaaattgggctcaacagaacattcaacatgaagagagaatagtacagaactggtggagacagatgtcttgtgatctacctcgagttagtgccattagatccacttggtctgtgtctagcttgcactgagggggtctagaatttcccatgaacactggtaagggtagagtgagttgccagtaggactgatgggtggtaggactctggggaggggaagaccaagctgctgagtcaggaatctgatgacgtgaggagaagagagttaagagtggatgcagaagcagaaaaatccattcattcctaagtagataccaatccagagccaacctgctggccactctgcaacaggaacatgatgatgatcagctgatagcttcctctctccaactacaatcatgtaagcaatccagccctcccccaacacacacccaaaccaagtccagaaaaagatatgaaatttacagaaaattgttaaaacagcctttatttacctgacagaaacaaagttattctaaattatactttttcaaattagtgagactgagataccataaaatggtattggaggaagaggatctgtgagctcatgagaaagttttagtttctttatagaaagtaaactattttctttgtacatcttagcatttaagtaaattttcaataccactaatctatttagctattaaaatacttatttaaactatatccttttaaaggggaatagagtaaaatgccttttaaatatgagaagctgcagaggatactgtctctttaaaacatgcaatcctaattgcccacctctcaggatgcataatggttgtagcatagttagcacggattctgtcatgacttaaaaaaaaatttgtaaacatgctttcttaaagatgcatcatacactcttcttttagtgaatggaagtgtttgacagaaaaacacctgtgtaagcaaactttgagaatatgttattagaacatgtttctttcctcactggttcatattacacaggtttacatctgctgctacaaaaggtaagtgtaagcatgctgatatgatttggttctgtccccacccaagtctcatcctgaattgtagctcccacaattcccatgtgttgtggggaggacctggtgggagattattgaatcatgggagccgtttcccccatactgttctcatggtaatgaataagtctcatgagatctgatggttttataaggggtttccccttctgcttggctctaattctgtcttctgtgctgccacataagacatgccttttgccttctgccatgattgtgaggcctccccagccagatggaactgtgagtccatcaaatctctttttatttataaattacccagtcttgggtatgtctttatctgcagtgtgaaaacaaactaatacacatgctatctttctttaaaaaaaaaaaaaaaaagatttagggagtaaaagtgcaattttgtgtaggcatcacccacatagtgtacactgtacccattacatagtttctttttcctagccccgcctttctgagtctccaatgactattatttcactctatgttcatgtgaacacattatttagcttctacttgtaagaacatgtggtatttgattttctgtttctgaaaatatcatgcttttttttttaaaaaaaaagagaaaggcaattggaactttaattttgcccctataaaaatgaaatgtcatgtatcaacaagactgaaaaataaacaatcctctcatgccctcagcagttaaccctaactatagaagacaaaacgatgtaaacaaagaaatacacataggattcattcatattgggatccagaaatacatattgtggatgacagtggcatacacactccttttggtgttaagaggaaacctttagacaaattaaatatgtaacagtttatttgagcaaagaatgattcatgaatcaggcagtactcaaaactagaagaggtttggagagccccaaccagccatgtgagcagtgagttcttataggccaaacaagggagcaaagtgtagaaattacctgattgaccagtaaggtatctgccttatttgcaaatggtgtgataaaacatctgcctttatagcacgattcaatcagttgactccctgtgattggctgaagcttagctgtttgtgattggctaaaatccagctgtttgttacaaaacgtatactcctgagttaggtttctgtttgtttacacacaaagttaagttgtggtttgttgattaggaactcaaagtactgagacagcctcaggctagtggcctcctgcttgtttaatttaacaatgggaatttattattaaaaggtaattattaactatttagaggtagaattactaggcagtcaatgacagaaagctgactttgctgtcaaagtgactttcaataaacttcagattagtgtttttcaaactttaatatgtgcacagatctcctggggagcttattaaaatgcagattccaattcagagggtcttgagtgtggcctgagattctgtgtttctaacaagctaccagctgatcctaatgatactggttcatggaccacaatttgaacagcaagtttactgtttgatatgtttctttttctttcagaatgtgaaaaaaaaaagtcaccaaactgtaacttttctattgggaaaagtttctactgggagaatttagcccacattttaaagcattaattcattcatctaagggcttatttcaatgagataaactacaaagctgtgtatgatctttggtcataatatacttgatttattaaatttagcaaccaatcgcatgttgcacttaatgtgcatagcatgtctgtttgaaatttttttggtatattttaatttaggatcttttaaagaagtccaaccagtagttattatcttaaaaagttccattttaattaggtactaaatcagataagaaaaagagagaaagaggtagcttgctaagtttaggagtttccaggcttgtaacttaaccaggtaatggtagtattttgtaaaatcattttctcttagtttgtgttatataacttacaataatttggaaggcagctatggccaccactataccaccaacacagaacttaataatttgaacagaggagaacaaaagaattttggcaatgtgcatattgtatgctccctctcccactagccccagaactccactggctactctctaatatgccaaaggcagcctgacccaaggaagtctgttgggaatgtttctcatgggctcagaagtctgtatgctcagtcacccaaattgccagtcataccaaaagctgtcaaagtacgttttaggcaaaaaattgatacataagtttggattttagattctaaagaggctaggacatcccaattgctcgaattaaagaattttactgagaattttacttctggatctaaaagcagtaaacatgtagctttgatctgggttaaaatgatgaagggcttctctgtaatactcatttttttttcccaaacacattttaagacaatcattggtatagtgtatgcatagtctagatggcctataaattctctctaaatgtgtgagagcagaaaatgttcaaaagtaaagatgaatatttggagatgaagcaactgaaaacctagagcaaatggattctgatagacttaaaaaaaatctctgcaaaattgcattttgaacttgtgagtcccttttgagtttttgcacttaatttctttctctagcatagctgaaattacccatatgatacagctacatctaagtgtacttatttcatgctagtgtggatctggcctcaggataaataataaatgtttgaaccataggctctttgaaaatatgtatttaacattagaataaatgaaattattcttgttatgactataaaacccatattttctctgagctccaaggtctgttgaatgagatgctccttgtgtttttttttaagtcagccctatagttattgttttaccaatttattctaaaaaataaaaataaaacttacactatctgaaaagaaacctcacaataatactgtattagtctgttctcacactgctaataaagacacaactgagacttggtaatttttaaagcaaagagttttcattgactcacagttccacatggctgaggaggcctcatgatcatggtggaagatcaagggacatcttacattgtgggaggcaagacagaatgagagcaaagtaaaaggggaaatgctttataaaaccatcagatctcctgacacttattcactaccacaagaacagtatgggggaaactacctccatgattcaattatctcccaccaggtctctcctacaacacatgggaattatgggaactacaattcaagatgagagttgggtggggattcagccaaactatgtcaaataacctgtcatttgtttattcagtaagacaatatacactgagcaccaactgtgtgctaagtgcaagtcagagagggcctctgtgctcagagcttggtggtgctgacagggtctgagtaagaggtggtaagtgcagtgtagggggtgtcagaggaagacttcagggcaggggtagttgcattgagagtgcttacattgagggcagatggtgtactggaagatcagagaagcagaggaggctttcttgaggaaggaatgtttaagttgaaggataagagttgtccagaagaagagaaagattatctgaggcaaaaagaaccatatctgataattcttcatgttgttgattatctaaatgctgtcaaagccaccttagctgatactctaattgcccaagttggtagttgtcaccagaaacttgttgaaaaaatttttttcaaaacctttaaatgatctcccccatgggtgtcaagatgggagtgatggcttgaggtgggagaggagacaaaaaggaagaaaggaagagaaagagaagaaagagaaataaaaaaggcaaggcgagggagaagtggacatgccaggtcataggagcaatatttggaccttttggaagttttatgaaggaaggaagaagaaagtttgtattaatagaaatctaacattgtctctgccatgctttggtcttgtcctttgtaccccaaattaacccctctaccatgacataaaaaggaaagcctggatggcttggggtattattgtagccaagtgatgacaatttgtacaaattggctacaggcataagatttgcttgcagtaaagtggaaagttacaagaaagtttcaagtctgagttaaaaaaaaatccacttatgatgataactgccactgagtaatggtagattatgctaaaaggaaggtactttcgttttatgcttccttcctgattgctttggtttgaagcatctgggtataggtgctgagaaggggtgaattgctctgcctggtagagatgttctaatttagagtcacggagcaaccaggagtgaagaaattcagagaaaaagaggacaggaaggaagcaagaggagccaggaaatgattgaagaaaggtatgcactaagtaaggagaaactacaatgttggggatgggggtgagaacattttaaaaaagaactgttaatggatttcaagtatgttgtaatatgtgatactgttaccagaaggagggccttgagagtgagttctccaggtccttggcgtttttaacaaagaattggacaaaacacacaaataaggtaacaaaggaacaaaacagcgaaggcagtgatttaataaagcgagaaagcactccacagggtgggagtggacccgagcaggcggctcaagggcccagttacaaagttttctaagtttgaagtactccttttgaagtccctatcagttatccttgtctcgatgaaggtcttgtctgtggctaattaaaggctgaggtgaattggagtcctatgcagatgaagggatggtccccgcttggcccacagccattccagggcaccttccctttctatctgagacatggtggaagggagggttgtagggagagtagcctttgatccttgctacttgggcatggggagatacggtttttccttttagtttaacttttggaagctggtgttaattggtcttagggtccctgcccctagacccaggtgttttccttttgacccagctttgggaaatcagcacagattggactcagattccccgcccccagcctttggtgttttctcttttaagaagtcagcacaaattggccttagattccttgcctccagaccccattctcctgcctcaatgcaacatctcttcaggatatcctcagtatttggtaaattctaatttcaagtgctctgcatggttgctttcatttagttcagttttgttgagaaaatattaggaaaagttggattcatttctgggtaaacaagccatagaataaagagagcatttaaagaagaatcatagaaggacaggtgacatcagaacagaatattctggggaactgctgaaagggagagctttacactttcatggatttccatgggactgtatcaagaccctaagggaccaatgagtcccagctggcatgaccatatgcaatgaagggagaaaagcccatctttgatttaaaagtagtaagttccattcaattcaattcaaaatgatatcgttcaaagtttgtaaatttcaggttttgttactattggtggcaggaaatgtacctccctatgtccttaaattggagcttctattgtcccaattagatgccccattcattacttagcactatgggactaaaatctacttgagaagtttgcaatgaaaggaaaaagaaattctgaaaattcacaggccatattttctgtaagtcttgcttgagtgaccatatacctgaatggctagaacgatgttttttcattatttctcaacaattagtaataattgtaggtagagagcatttgaaccaaggcaaattgtctacagaatgtggaaatggggttgaaaaaggagctagatgagagtcatcaagatgagggtgtaggaactccacgaatagctaatttaggaatgctaaacaaaatcaaagatccgttaaaattagataatgtagatttgtaattatccaggtgtgtcactaattcagcaatgttctgtgggtggaaaaagtagagtggttaaagtggaaaatggaaattattcattcctgggagctgagacagtgaagacaatgaatatttttttgcctgacaggagttcaacaaatgtttctgaattgaattataaatagaaggaatttaggctataagtgaaaatggaacatgatatttgatgattattttataaatacttattaatatattgctatatattaaagcttgtcttaagattatcccaactctttaatttgcttctttaatttgaatttgtacttaggaagtaaatctgtatcgtaataatcatctctgaacaagttgactttcttgcatgtttctatagcttgtcatatattctggaaaatgtattgctactttagcctaaagaatacatgtaagtccaactgttgatttttagctgtatatttttctattgcatttttggaaatgtaaagagaagaccttgagtttggcacagacattaatttagtagaaaccggggaaatattgcttacctctctctaaccttaaaatattctttcttatattataagagatgacaggatttcaatattgactgtcaagagtttatgatggaacttgtcttggactcctcaattttaaccttggatgtgtttgggaatgtgtgggacaaagtcagcactcttggttagcaaaagacaaagcctggaatttgccaacttatatcctggagcgagaatttacccatagttatttccctcgtttggtactagtgataattaagctaagcttaacagatggagttaacttagtgtacttagtgtgactgaatttaattagtatttttatgagtgaggctcacttcagtttttatttttaaaaatgatggaagaatcttacagcaaacatctttagaaagagtctgtatattactctggttctaattactacctagtaaaatatatacgggcttaccaaaaagtgtgtgtgtgtgtgtgtgtgtgtgtgtgtgtgtgtgtgtgtgtccctgtctgtatgtgatggtgggattgggggtaaaggcagtaaagaaagattttgggaactgataaaggaaaaaagtttgtaagagctataatacaggaatatatgcactttgggaggccaaggtgggtggatcactcgaggtcatgagtttgtgatcagccttgctaacatggtgaaacaccctctctactgaaaaaaataccaaaaaaaaaaaaaaaaaagaattagccaggtgtggtagagggcacctgtaatcctgtgtctggagttggttcctgctggtgggttcgtagtctcgctgacttcaagaatggagccacggaacttggcagtgagtgttacagctcttaaagatggcaggaacccaaagagggagtggtagcaaggtttattgcgaagagtgaaaggacaaagcttccacagggtaaaaggaacccaagttgtttgctgctgctggctggggtgaccagcttttattcccttattgtcccctcccatgttccatttctgtcctatcagagtgcgcttttttcaatcctccccatgattggctacttttagaatcctgctgattggtgagttttacagagcgctgattggtgcattttacaatcctctcataagacaggaaagttctccaagtccccacttgacccaggaagtccagctggcctcacctctcaatctcccctctcaactgctgttgagaactgggcaatgactgctctagctacttcctgctggataggggtgaagaaggggccctgcagttgtagtgtcctccagaggggaactctttagaccagtcaaagggccagtgggtcggtccaggtgtcctcagtagaagttttgagttgagctcatttggggttccagttgtaagaccatctgtagcttgatggccttgatcctgggggaaacaaatttgacaaggaggttaaaaatacagggcctaaaggcaagtaataccaagatggctgtcatgggacctagaaaggggagacgccatgtcacccaactccagaggttggtgtcagagtttgaaaggcattgtctgatttcagaagccttttcctgtaaacaccaggtgggtctcatactatccctgactggttggtgtaaaaacaacactctttcccctaagaaggtgcagagtactcccctctcagcagtgaggaggtccaggccccagcagtcttggagagtcaccgctgccaaagactccacctgggattgcagagtaaggacagaccctgtcatttcccataaactgtatgagaaatcctttgagagtgtgtggtagtaggataatgaagtagataaactggctattctggcttctgtagcagtagccattcctaactgtgtaagtaggggtattagttttatggccctctactgatagacttgagctttgaggggcactgatagggtctgatttcctggggcaatgtcaatgttgggacttaggaagactaaggttcaggtgcctgtgcagttggtggggaggaagatataggctgaagttccacataagaatatgccttggctgggtagacagaactggttgtatatgttaaagaggtgtgtgagtttgttgttttcattttcccatactcctagagtacttgccaaggtagctctggtgagcagctggaaaggggtgttgggagcaaactgagtggctctgtattctattttcccattggagaaaaaaccattttgtatttactaggaaccattcaagagagtaactgaaagaggggataagaaggcattcattagtgggggaggcgctgctgcagggggtccaggggtgaatggtcatgcagggagtatgcttgccattacaaaacccagactgtttgttaaacagggagaaggtgatgatttttgggggccctgagaagcagacaagctgtttgagtggacctgtttaggtgactctgaagttactatgatcagttggggcttgaagttgtagggtgtaattacattgatgggatagtaggtgccccaggggcaggcctggtaacaggttgtgttggatgcataaaggggcttggaaagttaagacagtaaacatggttgatgtgattaggattttcgtcctggcaggagctacagtatatagtcctactgcaaagagtatggttagtatactgcttaataatgtaatgatacaataaaatgattccatcaaagggacaaggagaggtgttaaagattacataggttttcacttatattttttaagtaggaaggggtttttcctcaggataagctgtaggagccttttgagtctgggatatttccttctgaaataggagacgtaagtcctccaataattcacaggtgtatcgaggctggtctggctgattttgggactcctgagctgatggtcttgcaggttcctcagggggtgtccaaagtttaactcgggtgtggtgaatccaagattccactcttgccaccttaactgcagtggaagtagagaggattactgagtatggtccttcccacaagtaatccatagatggggaggtagagggaagggacttgaccaatactagatctcctggttggaacagctctgttcccttgtctctgtgacatccttcatttagggttttaaggttttgttgatatcttgccaaagaagttatatccttgaccaagttggccgtttcctgatcaagtaggaagtcatttgtgagaaaatgtcatccatacagcatttcatatggacttacccccattttgtgaagagaatttcggattctcgacaaggccatgggcaagagaataggacatgggagatgagtttcttgtgttagtttccttaagtgcctcttgagtatttcatttacctccttgaccttccctgaggattgtggtctccaggcacagtgaaggttatattgtatccctagcgccctggaaattccctgagttaccatgactttaaaagccagaccattgtcactttgtaagctttgggggagcccaaatctaggaattatttcatgaattaggactttaactacttcctgagccttctctgtttgcaggcttctatccaatttgtgaaggtatcaacgcagaccaacaagtattgaaatccccttgacttaggcatatgggtgaagtctcactgccagttgtctccgggatagtgccctattttttgttcccctagaggggccttatgagggaccaagggattattgttttggcacacatcacaggctttgacaacttgtcagatggtctgtaggagatttggccctgtaaatagggatttggccatttgatgagtgttctcaatacccatatgaaaagtttggtggagagtcttaagtattttccactggctggctttgggtatgagtaccttactctcttctgtcattaaccaccctgaggggagaaaactatccccctgtgaaagtccccattctttttcagtcgggaaatactggggcttaatctcttggagagggttgttccataccaagggtccttccataggtatttctaatgggaagttctgcctggcagcaattttggcgtcagcgtctgcccaatggttttcttctgccttttctccttcaccattttgatggctttggcagtgtaagactgccacctctttgggtttttgcactgcatgcaataactccatgatttctttgtagtatttaatgggggttccctcagaggtaaggaactccctttctttccatattgtaccatgggcatgtaggattagagaagcatacttgctatctgtagacacatttattcttttttcccttctcagttctaaggttcaggtaagcaccagtagttctgctaactgggcgctggtccctgggggaagaggcttactttcaagtactgttacatcactaactatggcataacctgcccttcatatcccactctccacaaatgaacttccattggtatataggttaaggtcaggattagctaaagggacttctaagagattctctcaggcagcataagtctgggcaacagtttgttggtagtcatgctcgattggttccccatcctctgggagaaaaatagcagggttgaaggctgcacacatgcgaatttgaagcatcagtccctcaaggagtagtgcttggtatctaagcaggcagttgtctgatagtcataaatttcctttggcaactagtatgccatttacatcatgagtagtctagatggtgagatcctttccttgtattattttgatagcctttgatactaagatggccattcctgcaactatccgtaaacagtgaggccagccgtttgctactacatcaatttccttacttaggtatgcaactggctgtgaggttgtcacacaagtctgagtaaggactccaagagctattcccactctctctgtgacatataaagagaagttttgtcctgtgggaaggcttaaggctggagcttgtactagggcctactttaaggttttgaaggctgtttccatctctggttcccattctcctagatgagtatttgccctctgggtctccttgattagagtatagagtggcctggccatctcgctgtatccagggatccatagttggcaaaagccagtgatcccaaagaacccccgcaactgttttaatgtcttacagcaaggacaagccagtataggctgtatttgttctttgctgaggtctctgcttcctctggctaagattaggcctagatatttgacttgttgtaggcagagctgggtgtttaatttagatgccttgtacccttgattagctagaaaggtcaagagatctagagtagcctgctggcaggaggcttccgaactgggagccaaaagtaattcatccacatactgaaggaccagagtgcctggacttgagaaatggcctagatcttgggccagtgcatgaccaaacagatgagggctatccctaaatccttgggacaagactgtccacataagttgggacatgtggtctgtgggatcctcaaaggcaaagagaaactgggagtcagagtgcagaggaatgcagaagaaggcatccttgaggtccagaacagtgaaccattctgcttcctctggtatttgagagagcggggtatagaggttggttacagctggatatagcggaattactccctcattgatgagtctaagattttgcactagtctccattgactgttcagtttttgttctcctagaattggggtgttgcagggactcctgcattttcttactaagccttgaacttttaaatgtttaacaatatcctgtaatcctttacaaacttcagggcttaggggatattgcctttgtaaggaaaagcggtggggtcttttagtctgatttggattgggtgggcattttttgcccttctgaattgtccttccaagtcctagacttcagggttgtttccctcctcaagtaggggacaacaaatgggtaacttattccccatattcatgtagataatagctccagctttggctaatatgtccctccctaataagggtgtgggactttcaggcataacaagaaaggcatgtgaaaagagcaaagtctccttacaactgaggaggtgggagaaatacctggttacaggctgtcccgggattcctcagatggtaatggaccttgaggacaaggtccagggcaggagattaacactgataaggccacgccagtgtccaggaagaagtcaatttcctggccctcagtggttaaacttacctggggctcagtgagggtgatgacatgagctggcacttgccctgaggaccctcagtcctgttgttggatcatctggttgggggcttctggcccagagaacctttgtcctcttgggctgtgcaccttccagtgattgcctcggcatagtggacatgggcaagggggtggcttatttctcattgcacatttttttttaagtgtccttgcaagccacactgataacaagccctactaggtgattggcctactccgttttctgtcttttctgaaccacaaaggtttgtttgtctgagggccatgactaaggctgtggcctttctcttatcttgcttttccttttcagcctgttccttcctctttgtccctattatagaacaccaaggttgccaggtttaataatgcctccaaattttgttcagggcccaggactagctttcggaggtttctcctggtacctgtggctgattcggtaataagcttatcttttaggatcaattgaccctcaagggagtcaggttacaggggagtatattttcttaaggcctcccctagctgcttgaggaaagcagtaagattttcttcctttccctgagttatggtggacatcattgaataattcatgggctttttactaattctacttagtccttctagaacacaggtcaacagatgtttgagactccagtctccatgatctgagtctaggtcccaatggggatcaatactggggacagcttgctgaccagtagggagtttgtccctttctttggctgtcattctgtcatttacttaagataccaggtatctccaaagtctcgggctgcagctaaagccacattcttttcattaaaggccagggtttgatctaataatagcatgacacctctccaagtgaggtcgaaggtttgccctagaccctgtaggacatctatatccctatcaggattatctgaaaacttccccaggtctaccttgatctgctttaagtcagagagggagaaagggacacgtatccatgttgggccaaattcccctccccctacagcttgaaggggacataaccgatagcccagggggttttttggtcccttggagatttctttgcttgtctccttctgggtgggggagattagaggaggcttatcactaacaggaaggggagctgtagggaggctaggatatgaaggtaaactgagaggtcctcctgtgggatgtagattgcaaactttgcatagttgtggattatccttcaatgaaaggaaagcttggacataaggtatttcactccatttgccttccctcttacagaaaaggtcaagctgcaggaaagctgtaatttatacttcccttaggtggccattttttttccatcagagagagaatattggggccaggccatagtgcagaaaaaaaataagcagcttctttttcagggcttgagggtcaaattgttcccaatggattcatttcaagggtgagcttcttgatgcctgagtgtttcccatctgaaagaaaaaaaactgcctatggttttgttctgttttttttttcttccccgcccaataacctgcaatggtccctggaccctgctgtttggaatagttgcgctcactgaagcagcagcggaaacacttgttttcctcctagatcacaaagaggaccaaggaaggtcgtatttagtggcccttaccgacacattctcgaaaacctgcacccttgcctttcctcttagaccacaaagaggacggagaaaggtcggagtggagggccataccctgagggagggaagggatctccagcattggaagagtgatgccttttgtcctcacttcttatcatatggataggaaggatataccccccaattttggagtctataatttctgaggctctccatatcctagcttcgggaataaccttttactcttaagcatctcttggagaagtcttacttatataagactggtcatagtagccaagtttgtatacaaaacaaaaaaccgaacaaacttaacaaaaatccaattcactacagactagaaaaatgaaaaaacaaaacacacaaactccccccaaagtctttgtggtacatacatataatgaaatctcataaagcagtaaaatgaatgaattagtcattaaatctcatgtacacaatgttgaatacaacaagaaaagcaagttacagaatccataagaatcacttcatttctataaagtttaaaatataaaaaactaaaatggtctttgtaaatgaatacatatatctttgataaatctgtaatgaaaaccaagagaatactagcaacaaaattcaggataatggttacttatcttggaatgagggacatgtcacctagagaaatagttgtacagtagctggtaaggttccatttttaaaaacctgggtgggtacattaagattcatttttgttactctttaacttgcaatatattatgaatattcttttttatttgtttaataattaatataaacaataccaaaaaccttaaaatgtcaacatcagagaaaggaaaaattgcctttttaattactagttctatagtgtaacaatccaattgagtacattattttatgtatctctattatttatctggaataaaaattaatccataaataattggatgttatgccaaaatgcatgaacagattcatagtctattcatatattgtacagtggctacttgataggataaaaacatttttaaacaaaaatttagtatctatagaagtttattttacaggagaatgcctgataccttctccctggaatattctttgtctagctccttttcatttttttatgtctcagcttaaatccttctgtccctgacatataacatcttttcctggcaagcaaagtaggtcccccatttttatattgtaatggtacctatgattatttttcacaacacatataaattttcatattatttttaacagctttaaattacatatttatggaactgattattctatcagtgccttcgtgcattcatatgtaaggaacataacgacagaagtatggctgatttttgtatattgaacttttataccaattttattgtcagttataatatctgtggattcttttggatattccatatataagatcacgtcatctgcaaaaaataacagctttacttgtcctttccaattcttacattttgtagttattttaattttaatgcttaggaccttcactagaatgttgaatcaattaaagcaatatccatgacgtttctgattccaggggcaaagttttcaaaatttcaccttcagtataatatttgctgtattttgtgtaaataattttgtcatattaagtttcatttctctttctagtttgctaacagtttgtattacaaatagatattgaaccatatgaggtgtttttttagatacccattattttttccttacgtattttgttaatgggttaaataacaatcctggaatagtattcctgatatattcccaaatagcgtaggctttgttatcttctaaaattatccctggatttagtgttaatattttgtttagaaattttgcatctataatcagtgacactggcttgtaatcttcctttctggtaatttccttacctgctattgatatcaaggctaggctggcctcataaaacttgctggaaactacatatgacttttgtatttttctggaagcatttgggtttgtttgtttgtttatttatttatttatttatttatttatttattttgagacagagtcttgctttgttgcccaggctggagtgcaatggcgtgatctcagctcactgcaagctccacctcctgggttcacaccactcacctgcctcagtgtcccgagtagctgggactacaggcacccaccaccatgcctggctaatttttttgtatttttagtagagacagggtttcactgtgttagctaggatggtctcgatctcctgacctcgtaatccacctgcctggtcctcccaaagtgctgggattacaggcatgagccgacatgcctggctgggtttatttattaagagtttgttagaattcaccaataggaccattttgacaaggagttttctttgtaggaaggttcttagttgtattctttaaaatatttgaacaattaaaatgttatatttctacttgtgtcagtttggtaatttgtagttttgtaagtatttgttcatctaaattttcaaatttattggcatgaagttttcataatataatctttctatctttttctatctgtgggatctgtgttgaagtcttcttttccatttctgatgtaatttatgtctgccttttctgtttttgttctcaaaaattttttgccaaatttattatacattatttttgcaagattattagatttctaaataactaaattttggttttattactctaacaatttttatcctttattatatatttccttatacttattttgagtataacttactctttctttttctcattttttgagatctgatcttagctcatgaattatcagcttttcttttttaaaaaacatgcatttggggctgagcatagtgactcatgcctgtaatcctagcactttgggaggtggaggcaggagtggatcactttgagctcaggagtttgagactaacctggccaacatggcaaaaaccatctcttaaaaaaaattagctgggcattggtgttttgcacctgtagtaccagctacttgggagggtgaggtgggaggattgcatgagctgggaggcagaggttgcagtgagctgagatcatgccattgcactccatcctgggtgacaaagatcccttctcaaaaaaaaatgcatttaaagcaatatatttctttctaatttgttttatctgtgcctctttattactaactgaaaaatccttaagatagccaactgaaaagggagagctacgtaatatagcttattactaaagaaaaagggaaaaaatttttctatgcaaccacagtgatcattcaaattataaaattaaaaactcctaattacattagatacagaaatattatcacacatacaagtaacatgacaatacaaatgttatgtattttggaaaaatcttatcatggaacatgtagaatttgtttggaaaaaaatctatatggattgaggccaggcatggtggctaacacctgtaatcccagcactttgagaggcagaggtgggtggatcacgaggtcaggagaacaagaccatcctggctaacactgtgaaaccccatctctactaaaaatgcaaaaaacaattagccaggtgtggtggtaggcgcctgtagtcccagctactcaggaggctgaggcaggagaatggtgtgaacccaggaggcagagcttgcagtgagctgagatcgtaccactgcactccagcctaggtgacagagcaagactccatctcaaaaaaaaaaaaaaaaaaatctatagggattaagaataatctaaagaattaggttaccaaattagacttacaggaatcagattttacccagtatcaagttttattaaaaattcaaaggtacaggtaattgtgaaaagcagaaggatgcaaaaagtttttccagctctactagctgtgagagtttagaaaatttatataaactcttttagttacaatttccttattttataaactgaggataatattgcctactcacatggtgtattgtgtattcatctgttctcacactgctaataaagatatacctgagactgagtaatttataaaggaaagaggtttagttgactaacagttccacatggctgaggtaggactcacaatcatggtagaaggtggaggaggggcaaagtcacatcttacatggcagcaggcaaagacagaacttgtgtaggagaactgtcctttataaaaccatcagatctcatgagacttactatcatgagaacagcatgggaaagacctgcccccatgattcagatacctcccactgggtccctcccacaacacgtgggaattaaggagctacaattcaagatgggatttgggtggggacacagctaaaccatatcattctgactctggcccctccaaaatctcatgtcctcccatttcaaaaccaattgtaccttcccaacagtcccccaaagtcttaactcatttcagcattaactcagaagtccagagtccaaagtctcatctgagacaaggcaggtcccttctgcctatgagactctgaaatctaggcagaggttcccaaacctcaatttttgacttctgtgcacctgcaggctcaacaccatgtgtaaacttgcaccctctgaagcaacggtttgacctctacgttggccccttttggccatggctgggacacagggcaccaagtcctgagactgcacaaagcagcaaggctctgggcgagacccatgaaaccattttttcctcctaggccctgtggcttgtgatggtgggggctgccatgaagatctctgacatggcctggagacattttccccattgtcttggagagtaacatttggcaccttgttacttatgcaaatttctgcagccaccttgaatttctcctcagaaaataggtttttcttttctactgcattttcaggctgcaaattttctgaacttttatgctctgcttcccttttaaacataagttccaattccaaaccatatctttgtgaatacataaagctgaatgcatttaatagcacccaaatcagctcttgaacactttgcagcatagaaatttcttctgctagatactctaaatcatctccctcaagttcaaagtgctatagatctctagggaagatgcaaaatgctgccagtctctgctaaaacatagcaagagtcacctttatttaagtttctgacaagttcctcatctccatctgagaccaactcagcctagacttttttgcccatatcactatcagcattttgctcaaagccatttgacaagtctctaggaagttacaaaatttcccacatcctcttgtcttcttctgagccttccaaactgttgcaaactctgcctgttacccagttccgaagtcacttccacactttactggtaccaatttactgtattcatctgttcttacactgctaataaagacatacccaaaactgggaaatttataaaggaaagaggtttaatagactcacagttccacatggctggggaggcctcacaatcatgttcaaaggcaaatgagcaaagtcatgtcttacataggagcaggcaaatagagaccttgtgtaggcgaactctcctttataaaaccatcagatcttgtgagacttactcactatcatgagaacagtccaggaaagatctgcccccatgattcctttatctcccactgggtccctcttgtgatacatgggaattatgggagctacaattcaagatgagatttgggtggggacacagccaaaccatatcacatggttagtgttaacaggatgatgtgcatataaggttaccagagtagccagcacatttaagaatgcaacaagttatatattaatgtgataatttagtattgctgttatgattccacatatcttatatttaattttaatcttcctatgtatataattaaaggtctattatcaagatgtaatccagattcatttctgcaacctgccttactatttttttcttaaacacagacagcacttgttgtatttctcgcctatgagttttcaatgaccttttaatagaaatgcttaattctagaaatatgaatggaaaatggtcatttatttgtacatctcttagggatttaggtgtataacataccatagcacaagaataagatatggtggctatcttccaagatgtttatagattaccagtggtaaataaaagttaaataatataattttatccttggtgctaaaaaaaaacactgaaaaacaaatgtgtgagtataaatgatgttagccattgacttgaaatattttcctaaataacataagcctaatatattatgaaaggtgtttcaattgctcaggacagttataatacatataatcaaattctatacattgaaaatatttcatatattccaagttctacatgtaacagaatgacatatataactgtactatggagattgaaacattctaatgcatttaaaaagaatatgttctgaaaatgacaaattttctcaaaacagtgcatttatactcctgcaatatagtaaaagtccctgtaaataatttttatgcagtatacaacagcataaaatactatattttcttgttcagggaactcaatgaaggcaaagaggaaagtcaacatcaacaacctgatgattctaacaatatagctgtccatgttcagagagcacatggtggccatattttatatagaccaaaaagagccacagagaaatttgaagaattcctagctatcttaaagaaattgtaagtatttaaaatatattccttcttctaattgagtaattcttttgaatggctttattttttaaagtttattgtttgtgggtaagtgtactttagttatgatacagcactcatggttgattcaggagagatggacacactggagactttgtttctatataaatacagtcttcatgaattcagtcttcaatggtgtatcacggatataatgctaaacttgtgacccattattttaaaattaaactgcaagcaaaatatatattatttactgatatttcaaaattctgttaaagatgtccttagcttgggttatcggaaggctcttcacaaactgtcttcctcatccaggagtctttaaataaacttaccacatgttactttttttttttttttttttgagactgttgctcttgtgccccaggctggagtgcaatggcacagtttcggctcactgcaacctctgcttcaatggcgcaatctcaactcactgcaacctccgcctcctgggttcaagtgattctcctgcctcagccccccaagtagctgggattacaggcacctgccaccacgcctggctaatttttgtatttttagtagggacagggtttcaccatgttggccagggtggtctcgaactcctgacctcaggtgatctgcctgcctcggcctccctcggcctgggattacaggtgtgagcttccgcacccggccccattccttttaattttctagaatactttgtgctctgatagggacacaactgcctgaagaaggaggggtgtggaggagaaaattaaatctgagtgtaggctgattaccaaagatggtattggatttgtgaataaaattaaacgagtaccatgaaaattatagaagaaaatcttaaccacctgtcataggggagtaaaattaaacttgtaagctgaaaaaataggaaattcaactagaatatgtgatattagaattgagattgataacaggaacaaaaccaaaagtgtcaagactaggaatgttttcagaaaaaaatcaatagcagggaatgagtaattaaaaatttgacatttatgttctgaagaatgaactttttctttgtttagatacaaaaataccattgtggtataactgcctacagtatacagtacagtaacatgttttgcaggtttgtagcctaggaacaacaggctataccagctggcctaggtgtgtagtagactacacgatccaggtttaagtgtactctatgatgtttacagaatgacaaaatcgcatgatgacagatttctcagaatgtatccccgttgttaagtgacacatgactatgattgcaaatttgaggaaatatgatcagagcttccagaaaatttgagaatggtcagatttttatactcttaacttataataacaaaaaggaaacaatgaatactaatcactttttagtaaagcaggtatgagggaattatagaaggaaatcttaaccacctgtcatagaagagtaaaattaaacttgtaagctgaaaaaattaggaaattcaactagaatatgctcactaaattcgttaaaaatattctttaagtggtagaaaatcgctaaaacactgaaagtgatctaaggcatactatgctacaatcactttaattccattaaactctaatgttgattaatattgcatcagattccaaaattttagtttccagaaacccatgaatcactctgctgatttcaggttgtgctgggctgtaagagttttaatggcagtggtaattcctgtcttttttactatagtgagatagcagtttccagataacaaagtttctgatctgagatgtgggaggtcagtaacagggacttccaagcagctatgattctgcactgcaatgtcaaaataccaggaggtaaatctaggtcaatgtcaggatggaaactacaaatgggtaagaagcctagtaccttcttaacagtggactaccgcgaaaagcaggagccatggtagaaggtggtccaagcacagtgaataatagacaagttactttactttgctacattcttttgtggacctccatggatgctatttaatggcctgtttccaaacacccaggacaatagatgttgggtcagtatcagtttccagaacccacttcctcactcatgtgtgagaaaatggatgagtagagaagatcctgatgtactatacgtcccccctttcagtggctcagaattgggcagccaggactttgacatggcaaaactcactgctgtcaatgggtgggctgtgacagccaccaaattacagtaggagagtaaatgagaaggaaattcatttttatgagatgtttaatattaacagaaagccttaagctctctataaaaaatttgtgatttaatcctcacatcaatgctttgaggtagctatgacaaactattaatagtaagtaaaagatcaatgtatgcactaaatccacaatctatgtttgttctatagcacatgccttttctctcctcttctccttgggacactaatgtattagcttcttattgttctgtaattaattaacataaacttagtggcttacaacaacataatttagtatctctcagggtgaggtttatctggtcctctgctcagtgtctcacagatcatcagagtgtccactgggctgtgaccatttctggagcataggatcctcttccaagctcaaatggttgttggcaggattcagttccttgtggttgtaggactgacatccccactttcatgatggctttcagcagggggcccctctttctactagagactccctagatccttgccatgtggcactttctcaagctctgttagcaacacaaaagcttaaattttcaaagctagcaagggagagtctgtttctctctctgttattctgactaggtgaagtgtgatataacctaatcaggggcctatatatcccatcgggttttgcagtattcccaaatcatagattctgcccccactcccaacatttaaggaaaggggattgggtgttcccttagtcacatttagtaacatcatcagtctatttctgactctgttaattgcattagcaatggggttgtatgctttataaacacaacactaaagtaattcaattaaaatctatttattgatggataagttgtcaggtctgtggccttttgtttatctctgactaattaaaccatgatcagattgacgggctgtttaagtgatgttatctaatgaacttttgaaaatgttaccttctatactttaaaacttttcactttgtcaccctgactaaaattaaaaaaaaaaaaacattttgagtcacagtaactttttaaataaatgcaggctgggcgcagtggctcacacctgtaatcccagcactttgggaagccaaggagtgtggatcatgaggtcaagagatggaaaccatcctggccaacctggtgaaactccatctctattaaaaatacaaaaattagctgggtgtggtggcatgtgcctatagtcccagctactcgggaggctgaggcaggaattgcttgaacgcgggaggcgagccgagattgggccactgcactccagcctggtgacagagcaagactccatctcaaaaaaaaaaaaaaaaaaaaaaaaagaaatgcaaagatatctgataagattaagatactattacctattgataacttggtgtgctatagcttaatcatgttaattacatcttaacttccacttcatgtcagcagctctgagtaaatactgatagatgggaaaaataataaataattttgaaacattaaaatcattgggagaggcattaaaatcatgggggtggtgccaccataaaggagagatttgagcaaccagaggattactaaacagacagtgggagggagagaggagacagagtgagaaaaagagagttgggaggcccctttttaaaattttgttttttaaggcatatcagattgaatataagcttatcatgtgtattagttaggattttggatcataagcaacagaaactgactctggttcattaaaacaatcacaataaacaaaaagggaaggggggacagatggaagaatatcaggtagctctcagaatagaagaacaacaactagatgctggagatacaaactctaaggcaactctggaagtctcttcaaggtacaacactggaatcaatcagttacaactacttgcatttgggagttactaggctcacagcttaatttcagggatagggagtcagattgttgtagtttatttttatacccacccttgaataaatgctgagggagaagtgccctttgacaggcagttttactgagtttacatgcaattggcaaaggggcagcatttcaaaagagaaaatatttcagaagaagggggaaatgatgataagtaaagaatattaaaatctaggaactgaaacatgacttagaattttagtttctaaataattttgactcattttatttttcatccattaattaatgaatccaacatacacttttgaactcctctatgtttctgtcagtattcctggtattgggactgtgggaacacacaatatctttgccctcatggagcttacattctaatgtaagagatactaaacacatatgtattctgtcagttagtgataagtgctaggaagaaaagctaatgcagaataaggggatagagaatgatggaaatgatcagagaagtcagattttatgaaacaggagaaagaggagagagagacaattaaataccttgaagaagtgcattctagggaaagaaaacacaagtgcaagagcccaggtattgcaacatggtctgcaaatagaaaaacaaattacaaaaaataaaaaccataataattgggaagaaagtcattgttgtgaaagtgcatgagtcaaatgggagacctggtggaaatagtgcttcagaggtagccagggaccagattatcatttagggtctcatagcccatgaagggattttaaccttggtgtgactggcatgttatgatttacatggcaaaaggtcatgtgtggatgccaaaaggagtttcagagtgacctgttagagtgctgtgaaatttgtctaggtgaaagatgacagtggcccatattctgtgttagggatttagatttgacatgaagaatttgattttctctctctttttaagacatgagcaggactgaacagacagtccttgaagcaaatcaggttcattgctcagtttgaccactaacatgatggagaatcctgggcaaatcatctgatgctctcacatgttggtatttgattgcagtgcttataacaacactggcttttaaaatgcaattataaaatactatggtaaaaataattggtttcttcataaatgactaatttctggggaaaaaaagttatgtttgtatgtatttgtgggagctgtggaaagggtaggagaagagagggacttataaatgagctgtgaaatgcagattaagatcctctgagaaaacttggcccgattgttttttcttctactttctccaattaacgatgtttcctttgagcgaatgaggcatctgaagatcattatgtttcagtagagcagtgatgcaaagccacttctcaggaatgactcagaggaattgctccctggaagaacatcagggtttttgccttttagattcaggctgtttaaaatccaaatgcaatatggttcttatgctgtcgtcctctggtgaaatggcacataagatggggaattgcagtctcaaactatatttaagggctgcatgctgatcaaagaaaaacactttgtggggctattaatttgtgaaaaatacagtattttggaggaaaaccgcacttcaatggagtggaagggggattcatatctagaaaagaaagtttccatttgaacttaaaagggaacataggttaataaagaacggtgtggatactgaaagtaatttatatttctgacacaaatggtgatcatttatgacagaagaatgggaaataaaggaagagaattatttgtgttaaaatgagttagcaaaggacagaaattaaaaactcattgacagtagactggtattctaaaagcgtgtcacgctgaatcttcttgttctgtctgcggcagctagattgaaagttacatttgggatgtacatgttgcaaaatgcctggcctgcagagtcagaaagaactgtgttctcaactggactcctctaatcattagttgtatgatcttgggcaaatttctacctccaaaaattttattcacaaagttagaatgtaaagccccaaacatattacttcgtccattttaggccctatgtgaatgtcaatctcccctctcccaaagaatgttacatactgtgattgctttttaacaaaagactttgctatgttcttgctatagttgaattataaaggggttccttgtgtctctgaataataatgtgtttcatttttaatatattcaagaaagaatattcaaatttctcctacaacttatgaataaataacagctattacttctttatcatatatttgcattagtttacaaagttgcccggaaaattttcatacagcagtttaagaaactactatttgatcatatattaagtagtattcaaaaacaattgtatcttgatacctttgttctattgtttagacataagcaaacatctattataatatttcttataaaaattattttttcactgtatagatgtattatttcagcatagatgtgactattaaagctgaggcttcttgttttcggtgacatagttttgcctcttatttttccatagaaatgtcttagtaagtatttagtgtaagttctttcttattaatactaggtttataagtgtaacagaacgtacttgtcatgcagtgagacttgagaatcttatgactctattgggaatttttatcatgtgttgtattacagatttaataacaatggaacacaaagtcttttaagaatatttcttgtaacaactatctgttgaactatcacaaaaatccatgatttcattaaaagatttaatgtctgactgtacaaaaatattacttgccttcctcatgcagttattcttatagagtattaaagtcatcttgaatggtagtgctacatttatcaaaatgacttagtttcacatacatgcaattgtgttttatatgtatgagcagaatgcttttgtactcgaggatttacctcatgatatgaagaaccattttagagaaacatagataattaagtccaggctcaagtcatacaatatctagaaaattttggcaagatttggttgtttctagtagagtgtgggtctgcatggtcactgttctcagtcaaaccctgggtctatctgcagagaagtaataaacaacttggcagtctttaaaaacctggaacataattccttatttgtctctcctctttcatccactgaacatttagtctaagaaaatggtggtttagttggtttaatattcaaaggtgatattataataggcttggtttggctaaagagatgaaaatgtggtcagatgtccttagtacgtttgcagtatccatttgtggttctgaggaaatgtgtgtgtgactctacctatttgatggcttacataaaatttggtttccaaatgagccactaaattgggctcattgtacagcaaggtccatcagtgtatggttaaatgttctttcttcttcattagatatttgtcaactagactgatgtgaaatctacgttggacaaaaattcttccctggagcattcatgctcaatttcatttttttgtaaactgataatattaccatattcttgttaaaagtttccaaacactacttttcactttttatttttttatttttgtgggtacatagtagatgtatatatttatggggcacatgagatgttttgatacaggcatacaatgaataataatgacatcatggagaatggggtgttcgtgccctcaggcatttatcctttgtgttacaaacattccaattatactcttttagttattttaaaattacaattaaattattgactatagtcatcctgttatgctatcaaatagtgggtcttatttattctatttttttggtatcttttagccatccctacctcctcccaaccaccctgctacccttcccagactctggtaaccatacttctacactctatgttcatgagttcaattgttttgatttttatatcccacaaataagtgagaccatgtgatgtttgtctttctgtgcctggcttatttcatttaatataatgacctccagttccatccatgttgttgcaaataacaggatctcattattacgtatggatgaatggtactccattgtgtatatgtaccacattttctttatccattcttctgttgatggacacttaggctgcttccaaatcttggctactgtgaacagtgctgcaataaatgtgggaatagagatatctcttcaatatactgatttcctttctttggggtatatacacagcagtgggattgctggatcatatacctctaattttagttttttgaggaacctcaatactgttattcacagttcttgtactaatttagattcccaccaacagtatacaagggttcccttttctccgcatcctcaccagcatttgttattgcctatcttttggatataaaccatttaaactagagtgagatgacacctcattgtagttttgatttgcatttatcttatgatcaatgattttgaacatcttttcatatgcctatttgccatttgcatgtcatttttttgagaaacacctattcatatcttttgcccaattttaaatcagattattaaattctttcttacagagttttttgagcttcttatctattctggttattaatcccttgtcagaggggtagtttgcaaatattttcccccattctgttgattgtctcttcactttgttgattgtttccctcactgtgcgtaaactttacaacttgatgtgatctcatttgtccatttttgctttggttgcctgtgcttgcgggttattactgaagaaaatttttgcccaaaccaacgtcctggagttttccaatgtttcatagtagtttcatagtttgtgttcttagatttaagactctaatccattttgatttgatttttgtatatggggagaaataggggtctagttgttctgcatgtgaatatctagttttcccagcacattttgttgaagagattgtcctttcctcagtgtatttcttggtaccgttgtcaaaaatgagctcactgtatatatatggatttatttgtgggttctctgttctgtttctttggtctgtgtttctgtttttatgccagtaacatgccattttgtttactatagctctgtagtataatttaaagtcaagtaatgtgattcttctggttttgttccttttgcttaggataacttcagctatgcaggatcttttgtggttccatataaattttaggattattttttctctttctgtgaagaatgccattggtattttgatagagattgcattgaatctgtagattgctttgggtagtaaggacatcttaacaatattgattctgctaatacatgaacatggaatatctttccatttttggtgtcctcttcaatttctttcatcagtgttatatagttttctttatagatatatttcacatattagttaattcctgggtatttaattgtattcgtggctatagtaaatgggattacttttttgatttgtttttcaaattgttgatttttgtattttgattttgtatcttgcagttttactgaatttgttcatcagttctaatcattttaggggggagtctttaggtttttccaaatataagatcatattgtctacaaataaaaataatttgactttttcttttgcaggttagatgccctttattttttttcttttgtgtgattgctcttgctaggacttccagtactgtgttaacagtggtgaaagtggagatctttgtcatgttccagatcttagagaaaaagcttcactttttatcccattcagtatgtaccagcatgggtctgtcatatatagcttatattatgttgagatgtattccttttatacccagttttttgagggttttttattatgaagagatgttatacttcatcaaatgctttttttttttttttttttttttttttgagatggagtctcgctctgtcccccaggctggagtgcagtggtgtgatctcagctcactgcaacctctgcctcccgggtttttttttttttttttttttttttttgagatggagtctcgctctgtcccccaggctggagtgcagtggtgtgatctcagctcactgcaacctctgcctcccgggtttaagcaattctctgcctcagcttccagagtagctgggattacaggtgcgtgccaccacgcctggcaaatttttgtatttttagtagagacagtttcaccattggtttcaccatttggccaggctggtcttgaactcctcacctcatgatccacctgtctcagcctcccaaagtgctggaattacaggcatgagccactgtgcccagcctatcaactgctttttaggtatcaattaaaacaattatatgatttttgcccttcattctgttgatatgatgtatcacattgattgatttgcatatgttgaactacccttgcatccctgggataagtctcacttggtcatgatgaatgatatttttaatgcattgttgtgtttagtttgctagtattttgttgaggattttcacagcagtgttcatcagagatgttggcctgtagtttctttttttaatgtgtctttgtctggttttggtatcagagtaatactggctttgagaatgagtttggaagtgtgccattgtcccctgtttttcagaatagtttgagtaggattggtactagtgcttctttaaatgtttgatataattcagcagtgaagtcaggtcctgggcttttctttactgggagactttttattacagatttgatctttttacttattattgatctgttcagtttttggatttcttcctgtttcaatcttagtaagttttatgtgtctaggagtgtgttcatttctcctagattttccaatgtattttatgtgttcatttattctgtgttcatttattctatatattccaaaggatcatagtgactactaatgatcctttgaatttctgcagtatcagatgcaatgttccctttttcatccctgattaaacattacttttctactgtttgctttttgatatcacaaatttaataactttacagtaaattcttgtttttaagttttcagcacttaggattcttatttgaaagcaacagaagctgattcttaagctaaaagaaaaattattaaattcgtagttatttacaatgattttcttaaaatagatttaatatcaggtaaaagtacagataatgcaactattcttgatctttttagctacattcagttttggcaagaatataatagataggctgggcacggtggctcatgcttgtaatcccagcactttgggaggccgaggcaggcagatcacctgaggttaggagcttaagaccagcctggcccacgtggtgaaactccatctctactaaaagtagctgggtgtggtggtgggcacctgtaatcccagctattctggaggctgagacaggagaatcacttgaacctgggaggcagaggtttcagtgagccgagatcatgccactgcactccagcctgggtgacagagcgaggctccgtctcacaaaaaaaaaaaaaaaaaaaaaaaaaaaaaaaaaaaaaagatattgcccctaccagtaaatattagcttttaaattattttatttttaattttatagaacaacaaaagacatcttgtttaatttacagttattttaatttgcctttctttgtttccttgttaagctaaattttctttaatcatttattagctatttgtatttattcacgttgctgttgtgaaaagaaaaaaaaatcttgggattcccaaatcactaagccaaagggaaaaatcaagctgggaagtacttagggcaaacctgctccactgtattcctaaaaaagatagctactaagattaaaaagctgcatacctccctcacaattggtccacaaggaaattccttgcagacaaaggacaaacagaactcagcagaaaccctttgctcactgagataaatgcatatctaattgcttcctttggaaaggaatcagaaattcaaaataatataaccatttgtcttccatctacctatgacctggaagccccctccccactttgagttgtcctacttttctgcgccaaaccaatgtccattttaacacatattgattgatgtctcatatctccctataacatacaaaacccaagctgttccctgaccactttgggcacatgttgtcaagacttcctgaggctgtgccacaggtgcatccttaaccttggcaaaataaactttctaaattgactgagacctgtctcagttatttcgggttcacagtgtgaattatctgatagtggattttgcctatattttctactgtgctttaattatgtactgctgatatacagagctatctatattttatatagatatattacagtatagacatagtaccatttatggaatggagaataaaatttttcagaaaaatattttacctaatatatttatccaatatatatttgctggtcatgtgaaaatttaacaaatatcaaatgaaaaagaaagaatatatatgtgtgtgtacctatatatcatatataacatgttattaaatgtataagcatttttattaaagtataatttatatataataaaaatgtatattttaaactgtgcagtttgataacttttgatacatgtataaaggtgtgatataaaccatttgtgatataaactgtgcgatgtgataacttttgacacgtgtaaatctgtggtataaaccatcaccgcaatttagataatgaacataatcaaattgctcccaagagtttccttgcaacttttgtcattctttcctcttgtgtgtccttgtgcccaccctctgttccaagcaaccacttatctgctttctgtcagtaaactttattttatattttgggagggaattaaatagcattaattaatacatggaattaaatagtattattattttttagtctagcgtttttcactcggcataattatttggatcttgatccatgttgtgttgcataacaatagttattcctttttctttctgaatagcaatccactgtatgaatataccatagtttatctaagtatatgttgatgaacatttgtggctattatgaatgaagctgccatgaacatttatttataagtcttagtgtgagcatgtgccttcatctctcttgagtaaatacttagaaaagaaacaacttaataattgggtaggaaaaacttaatcatatgttaaacttctgaagcaactgccaaactgtttttcaaaatggttgtatcattaggtatagataataattgtctatgaatgtcaaaatgtcctatggtagtcacagtgaaaaacacaattaacaaagaaatttggtcacctctgtgatttacaatgacctaacacaataaccctaattatgattgataacacaacctcagacatcagaactctagaaatcccgtacaattttggaacacattttaacatttttcactaaaatatggcctgaagatcaaacaccaccttactccaacaatcctatgcaggccgagcacggtggctcatgcctgtaatcccagcactttgggaggccgaggtgggtggatcgcctgagatcaggagttcaagactagcctggccaacatagtgtgacccctgtctctacaacaatacaaaaattagccaggcatgatggtgggtgcctgtaatcccagctactcaggaggctgaggcggaaaaatcacttgaacccaggaggtggaggttgcagtgagccaagatcgtgctactgcactccagcctaggtgacagagcgagactctgtctcaaaaaaataaaaaaatcctatgtaactaaacatgttaaataatcctgtttatcactcctttggacactccaggggctctctttagcattgaaatgctagggattaggaaagacaatttcgaagctttataggcttaacacacttaataggatttcaggttattataagtcatccatttaaatcatgactcaaagtgaaaaactttattcactaaaagggaagacttagtcttccaaacaatttatctcatgtccttcccttcttttgtcagtattttattcacaaagcaaacaaaaatctttcattgcatgaaaatcttgacaaagagaaagcaacatttcacccttgcattagtctattaatgtcaaccccaattctttaaaaaataaaaccttacagacaaatccatttaatcttaatcagtttgaccatgagctgagattcttataaatcttttataacacttcataagtttttgttaaagagcatattagttcctaaggaaaaccttgttgtgtttttattttaatgttcaatttacagaaaaaccaaataatactcttttgaatttagtcaatatgttcacacacagattttctctttaaaagatcaatttttacaaaccttgcataacttgttttagccattagctttatcttatctaatttaaaacaatcctttaatcctctgaacgagatgaaaatttacattccgtgttcttatattcttttactaaagacacattttactctccttacacactttgtatgtaaatctattttcagtagactccactacatgttataatggtagctcttagcaatttttaattttgaaatacctggtaagttattttagttacatacttagatgcagataaggtctgactattttcagcatagctaggagcatggcatatgtccccaggccttaccaaactgtaaagcaggaaagttgaacaattttcttctttttctttaattatactttaagttatagggtacatgtgcacaacgtgcaggtttgttacatatgtatatatgtgccatgttggtgtgctgcacccattaacttgtcatttacattaggtatatctcctaatgcaatccctcccccctccccccactccatgacaggccccagtgtgtgatgttccccaccctgtgtccaagtgttctcattgttcatttcccaccgatgagtgagaacatgcggtgtttggtgttctgtccttgcaatagtttgctgagaatgatggtttccagcttcatccacgtccctacaaaggacatgaactcatcattttttatggctgcatagtattcatggtgtatatgtgctacattttcttaatccagtatatcattgatggacatttgggatggttccaagtctttgctattgtgaatagtgccccaaaaaacatacgtgtgcatgtgtctttatagcagcatgattgataatcctttgggtatatacccagtaatgggatgcctgggtcaaatggtatttctagttctagatccctgaggaatagccacactgtcttccaccatggttgaactagtttacagtcccaccaacagtgtaaaagtgttcctatttctccacatcctctccagcacctgttgtttcctgacttgttaatgattgccattctaactgatgtgagatggtatctcattgtggttttgatttgcatttctctaatggccagtgatgatgagcagtttttcatatgtctgttggctgcataaatatcttcttttgagaagtgtctcttcatatcctttgcccactttttgatggggttgtttgatttttccttgtaaattcaaagttctatgtagattctgcatgttaaccctttgtcagatgggtagtttgtaaaaattgtctcttgttctgtaggttgcctgttcgcactgatggtagtttcttttgctgtgcagaagctctttagtttaattggatcccatttgtcagttttggcttttgttgccattgcttttggtgttttagtcatgaagtccttgcccatgcctatatcctgaatggtattgcctaggttttcttctagggtttttatggttttaggtctaacatgtaagtctttaatccatcttgaattaatttttgtataaggtgtaaggaagggatccagtttcagctttctacatatggctagccggttttcccagcaccatttattaaatagggaatcctttccccattgcttgtttttctcaggttcgtcaaagatcagatagttgtagatatgcggagttatttctgagggctctgttctgttccattgatctatatctctgttttggtaccagtaccatgctgttttggttactgtagccttgtagtatagtttgaagtcaggtagcatgatgcctccagctttgttcttttggcttaggattgtcttggctatgtgtgctcttttttggttccatatcaactttaaagtagttttttccaattctgtgaagaaagtcattggtagcttgatggggatggcattgaatctataaattaccttgggcagtatgaccattttcacgacattgattctttctatccatgagcatggaatgttcttctatttgtttgtgtccttttttatttcactgagcagtggtttgtagttctccttgaagatgtccttcatatcccttgtaagttggattcctaggtattttattccctttgaagcaattgtgaatgggagttcattcatgatttggctctgtttttctgttattggtgtataggaatgcttgtgatttttgcacattgatttggtatcctgagactttgctgaagtgacttatcagcttaaggagattttgggctgagatgatgggtttttataaatatacaatcatgtcatctgcaaacagggacaatttgacttcctcttttcctaattgaataccctctatttctttctcctgcctgattgccctagccagaacttccaacactctgttgaacaggagtggcgaaagagggcatccctgtcttgtgccagttttcaaaggcaatgcttccagtttttgcccattcagtatgatattggctgtgggtctgtcataaatagctcttattattttgagatatgtcccatcaatacctagtttattgagagtttttagcatgaagggctgttgaatttcaccaaaggctttttctgcatctgttgaaataatcgtgtgttttgtctttggttctgtttatatgatggattacgtttattgattgctgtatgttgaactagccttgcatcccagggatgaagccaacttgattgtggtggataagctttttgatgagctgctggattcagtttgccagtattttactgaagatttttgcatcgatgttcatcagggatattgatctaaaattatgttttttttgttgtgtctctgccaggctttggtatcaggatgatgctggcctcataaaatgagttagggaggattccctctttttctattgattggaagcatttcagaaggaatggtaccagctcctctttgtacctctggtagaattcggctgtgaatccagctggtcctggactttttttggttggtaggctattaattattgcctcaatttcagatcctgttattggtctattcagggattcaacttcttcctggtttagtcttgggagggtgtatgtgtccagaaatttatccatttcttctagattttctagtttatttgcatggaggtgtttatagtattctctgatggtagtttgtatttctgtgggattggtggtgatatcccctttatcattttttattgcagctatttgattcttctctcttttcttctttattagtttttctagcagtctatcaattttgttgatcttttcaaaaaaccagctctgggttcatcgattttttgtaggatttttttgtgtctctatctccttcagttttgctctgatcttagttatttcttaccttctgctagcttttgaatgtgtttgcccttgcttctctagttcttttaattgtgaagttagggtgtcaattttagatctttcctgctttctcttgtgcgcatttagtgctataaatttccctctacacactgctttaaatgtgtcctagagattctggtatttgtgtctttgttcacattagtttcaaagaatatctttatttctgccttcatttcattatgtacccagtagtcattcaggagcaggttgttcagtttccaggtagttaagtggttttgagtgagtttcttaatcctgagttctagtttgattgcattgtggtctgagagacagtttgttataatttctgttcttttacatttgctgaggagtgctttacttcctactatgtggtcaattttggaataggtcagatgtgctgctgagaaaagagtgtatattctgttgatttggcatggagagttctgtaggtgtctattaggtcctcattgcagagctgagttcaattcctggatatccacattaacttcctgtcttgttgtctgtttaatgttgacagttgggtgttaaagtctcccattattattgtgtgggagtctaagtctctttgttggtctctagggacttgctttatgaatctgggtgctcctgtattgggtgcatatatatttagggtagttagctcttcttgttgaattgatctctttaccattaggtaacggccttctttgtctcttttggtctttattggtttaaagtctgttttatcagagactaggattgcaacccctgcttttttttgttttccatttccttggtaaatcttcccccatccctttattttcagcctatgtgtgtctctgcacatgagatgggtctcctgaatacagcacactgataggtcttgactctttatccaatttgtcagtatgtgtcttttatttggagcatttagcccatttacatttaagattaatattgttatgtgtgaatttgatcctgtcattatgatattagctggttactttactcattagttggttattttactcattagttgatgcagtttgttcctagtgtcaatggtctttacaatttggcatgtttttgcagtggctggtaccggttgttcttttccatgtttagttcttcctccaggagttcttgtaaagcaggcctggtggtgacagaatctctctgcatttgtttgtctctaaaggattttatttctccttcacttatgaagcttattttgactggatatgaaattctgggttgaaaattcttttctttaagaatgttgaatattggcctccactctcttatggcttgtacagtttctgccaagagatccactgttagtctgatgggcttccctttgtgggtaacccaacctttctctctggctgcccttaacattttttccttcatttcaattttggtgaatctgacaattatatgtcttggagttgttcttcttagtgaatatcttcatggcgttctctgtatttcctgaatttgattgttggcctgccttgctaggttgaggaagttctcctcaataatatcctgaagagtgttttccagcttggttccattctccccgtcactttcaggtacaccaatgagatgtagatttggtcttttcacatagtcccatatttcttggaggctttcttcatttctttttattctcttttctctaaagttcccttctcacttcatttcattgatttgatcttcagtcactgataccctttcttccacttgattgaatcggctactaaagcttgtgcatgcatcacatagttcttgtgccatggttttcagctccatcaggtcatttaaggtcttctctatgctgtttattctagttagccattcatctaatcttttttcaaggtttttagcttccttgcgatgggctcaaacatcctcctttagctcagagaagtttgttattactgatcatctgaagccttcttctctccactcgtcaaagtcattctccatctagctgtgttccgttgttggcgaggagctttgttcctttggagagaagaggggctctgattttcagaattttcagcttttcttctctggtttctccccatcgttgttgttttatctacctttggtctttgatgatggtgacctaccgatgtggccaaatgggaacagctccagtctacagctcccagtgtaagcaatgcacaagatgggtgatttgtgcatttccaactgaggtaccaggttcatctcactggagcttgtcggatagtgggtgcagcccacagagtgtgagccaaagcagggtggggcatcgcctcacccaggaagcacaaggggtcagggaattccctttactagccaagggaagccatgacagatagtacctggaaaatcaggacactcccactctaatactgcacttttccaagagtcttagcaaacggcacaccaggagattatatcccgctcctggctcagagggtcccacacccacagagcctcactcactgctagcacagcagtctgagatcgaactgcaaggtggcagtgaggctgggggaggggcgtccactgtcactgaggcttgagtaggtaaacaaagtggccgggaagcttgaactgggtggagcccacctcagctcaaggaagcctgcctacctctgtagactccacctctcggggcagtgcatagctgaacaaaagacagcagaaacttctgcagacttaaacgtccctgtctgacagctttgaacagagtagtggttctcccagcacggagctggagatctgagaatggacagactgcctcctcaagtgggtccctgatccctgagtagcctaactgggagacatctcccagtgggggccaagtgacacctcatacagctggatgcccctctgagacgaagcttccagaggaaggatcaggcagcaacatcttccattctgcaatatttgctgttctgcagtctccgctggtgatacccaggcaaacaggttgtggagtggacctccagcaaactccaacagacctgcagctcagggtcctgactgttagaaggaaaactaacaaacagaacaattttcaaaagccaaagcagtttatgaccttaaagcctttcaccaacctagtttctgacttgcataatttagaccatgtctacattttgaagacatttctacttttattttaccaataattttaaagctagcctgtttatatatagcaatatatgttgttataacatatgacagtaagtgtacaaataaacacatctagacatgtatacatacacaaatgaagatccaatagcttggaaccctagccataagatagcactacaagcttaccagttttactttgtttgccccaatagacaatccaatgaaggctgtgaaccaaaatttcaggtaaattggtttctatgacagtttgatttttaaaagccaaacttccccagactccaaagaacactggggccaaacagcaccaaaggagaacatcacaagttaaaacaggccccctgcttagaacagcagcacaaaaccctggatacatgcaatgcaatcttactttcctattcaacagtaaactccagattccatacaatattggggccaaacagtattgtaactgtgagagaaaattctaaggagggtttagtactagacctcagaacctctgccaagggcatcccgtttggagaggtggaggtccagaggatcccctgggatgtccccctgtgggatccaaccttagagtgtcagatgtctctgaccttaggtaggcactagtgctgctttgtcttctccctccagaggcaatggcctaccacgatctttgtaaggccatgctttctcaggcttcctgttccaccagagtgacagccatgaagtaaaaggcattgcagctttatttttctttcaaaatagttgatctaagcacttgattttctttaagccaatcagagctcttttatataaacatcatacacataacacatgtgtaactacacagactgaaggagattcagtacttgtaagatttttcatgtgccaatctcctatttgcattgctaaccctaggggtggagcacttcaagaaccaggtctaggaaaacatgcaggcaggttctatggcctaataagtaggaatagctggaagacaagaacagattttgagagggatacatccacttgtaatccctggcactccatgaggaaaacagaggtttttttcaaaaatgaatcaatgatgcctcctttgttttcccaagaagtcccaggacttcagaggttatcttggggcccttcatgtgtgcaataagaatggtaagacaaaaatggagactaattcagtcgactgataaaacctttttccagaaaaagaagatccatgagaaaagacatacaggccttttaaatatacctatagctttgataaccatggacatctacttttaaataagctaacttttaactatagcacccctttttaaagtcattttaaatctcttatttcctgactttagccatgccaaatggccatttgaattcttggaggggcagagaatacagtgatttttatccttcctgctaccagtttgcacagagaaagagaagtcagaggccgggcacagtggcttacacctgtaatcccagcactttgggaggctgaggcgggcacatcacgaggtcaggagatcaagaccatcctggctaacacggtgaaacaccgtctctactaaaaatacaaaaaacttagctgggtgtgatggcaggtgcctgtagtcccagctattcgagaggctgaggcaggagaatggcatgaacctgggaggaagagcttgcagtgagctgagatggtgccacgacactccagcctgggcaacagagcaagactccatctcaaaaaaaacacaaaaaacaaaaaacaaaacagaagctagaaatctgactggcaagaacctttacccttttgctggcatgtcaggcttctgggttcccttcccctgagacatggagtgctttgaccctggagtcctgtgaaggggaaaaagctattttctttctccagcctgagggtcaaaggagtccagtgatttaggatacacttgaggagtgcaggctgaaaatgattcactggttacccatctggaaagaggagtaaaaggcttccctttgttcctctctcttcctagcgaatacccggggtatgtgacagggagaaaaggcatccctcttaattatttcgaccttatatccctgagttccggtgacctgtgcaggtgctgaccatgggtgcaagtgcaaccttcacccatgaagttggaggcatagctgacaggcatgcacctgagcagagcctaagcctcccactctccgtcacatttgagttccctagaccctatctatgccatgtatgtaagcatgatattcccatccatgaagcaggaggcctaattgtcaggaattagtcatgctcacctgcactgtgcccttcgactcccgctgtcatctgcctcaggtctattgttccattccagggcttcaaactgaagcttcggagaaaaaggtgcctcaggggggtgtatgaacccattaaattggtcccagatagcccttgccaaattgcagctagcaactggcaggggctgctctaccattgcctccctatcacaagtaggtgaagctgtggggccaagtcctcctcaaacaagggagagagaaagggagtcccagtaactggggacctggcctacgaaggtgacaactaagagattgggtttttcctgagatgcccttcacggtcatgctaagagaggaggcggacctaggttggagaagagaactgaaaggcctgctcaagtccaggaggaggtccaacctcctttccttgatccctagaatcaccctagctcctggatggcaatgacagtctgaaccaccagagtcaacgaaaggaaccctgggaccagtcagtcctgctgcaccatttgggagatggcaatctggaccttgccacccatgtctcagggacagtctgccctccaatgatctacatttgcagcagttgacaggtgcattgtgaggactctgaggtttgtgagcctgcaagttggttattagagcctctgtctttttcttgtgtctccttccctctcttgggcctcccaatcctattttaaaaggccaaggtggccacttccagaggtcctctatagtactctctggtcgtatggcctgtttctgtagcttcctcctgatatcaggggctgaagtcccctcttagatttctgaggaaggcagtgggactctcatccaatccctggtctaccatggatagcccagtgcaatcaagaggtctagtcccagtcccttgcaagccatccaatatgcacacctgtaagggcttccttttccattctcccgtttcatcattggggtcccatttagtgttctccaatggtactgctattcttccaactagataaggctcatccccttccctggtcctatataagatgtaaagcttatcctaaaaattctctgccacttgcagggtggcctgcttttcagcagtggtcagggtttgatgcaaaagtaacatgacatccttccatgagagttcaaatagttaggttaagttctggaaggccaatatatgcctgtcagggccatctgaaaacctgcttggatcccccttaatttgctgtaagccctgaagagaaaaggggacccgaatctaaatgggaccgtgtttaccacacatctgttgtaggagcaggagtgagactgggacctgcctaaaatgacttctaagatgaggcaagcttggaagagaacctggatagggaggagtgaagggagctgattcccctgctgaaggtaccactggggtttgtttccccagttccctgggattgacccttgcagcctctcctgagatggtcactaggaaggctgaatcaatcccacaacgttggcaaagatctgggttacactacaaggcaaagaaaaatagtccaaggtcccttcacataagggacgttggactatttgccctcgtgtttatggaaaagctttcttcttgaggcaatgcttcttttctgtgcctcaaggtgcttagacctaagttgtcaaccaagtaaattacaagaacatttttaccacaagtttacatacagataccaagacatacttttctttgtctgtgctactcttaaccttatattatatactttcaatgactaagccaaatgctcattctacacagtagtatctttgtttggcaacattcttaacattttaatattgtatataaaagaagaaccatgacagcatgagaaaaaagaaagaaacaataataggaaagactaaggtcctagcgcggacaccctaatgggcagtcagggattggaattagtccaggggcctttggataacaccaaggtgtagcctcagccagatactctcagttgctccaggacctccatccagtcccaagtgactgctagacctccatgaagtgaaactgggttggaacaaaaccaacattcccaacaccagagagtgatgggggattaacagtgtcctccccagcaagcctgtcctccttaagtctggcaaccatgctagtcatttttaactggctaagagtccagtgttttttcttcattttggctattatggagtttagagactccaaaaaaaaaggacagaaagcaaattcacttttactcacccttcctgcagatgagccctcaaaatgttacgggatctttggggggtggattttctggccggaaacctctgtggctgcgggtggctttgcctgacttcttgttctgtatgcaggaagaaagaggtatgaagacaagcgaagggtgaacaagatgaagatgagctttattgagtgttccaacagctcagaggagacctgcagcaggtagctcctctcataggcagatcatccgtggagccttcagttctcaacagagaggaggccctggagagggtggcttctctctgcttgtggtcatcccattgtctccagctatcagcagagagggtacctcctctctgcagctggtcctcctgtcctgtctctgccttcttcatcctctggttgtcctctgcccttctctggctgagcccagggcttttatggacctcaaaggggaggaagtgcctgctgattggtccatggttggccatgggtgggcccagaagagccataatgagtccccactctggtctgcaggaccagcagtctggcccccagccttcgggacctccttggcctgaaggtgggggttcactgggaacctgcccccttctacccaggaatcaatctgcctccaggggccaggccaggaattaatcagcctcctggtgccagtcatggcccaggggctcttccccaactcccactccaagactggagcgggtgctggtgtgtccggaattggttgcttccggtcggttcttggtctcactgacttcaagaatgaagccgtggacccttgtggtgagtgttacagttcttaaagatggtgtatccggagtttattccttcagatgttcagatgtgtctggactttcttccttctggtgggttcttgctgacttcagaggtgaagccgcagacctttgcagtgagtgttacagctcttaaaggtggcacatccagagttgttcattcctcccggtgggttcatcgtctcactggcttcaggactgaagctgcagacctttgcggtgagtgttacagctcttaaaggtggcgcgtctggagttgttagttcctccggataggtttgtggtcttgctagcttcaggagtgaagctgcagacgtttgtggtgagtgttacagctcataaaggtagtgcagaccgaaagagtgagcagcagcaagagtttttgagaagagcaaaagaacaaagcttccacagcatggaagaggaccctagggggttgctgttgctggcttgtgtggtctgcttttattcccttatttggccccacgcacatcttgctgattggtccatcttacagagagctgatcagtccattttacagagtgctgattggtccgttttacagagtgctgattggtgtatttacaaacctttagctagacacagagcactgattggtgcatttacaatccttagctagacagaaaagttctccaagtccccacctgacccagaagcccacccggcttcacctctcaccaggagtggagagaggccaggcagccagaccagacacccttgagcctgcagaaaaagtgcgtgtggggggtccttcctggggcttccaagggtataagctgcagagacacctggtcctgtgcctaggagggtggctgaagccacacccaggaaggcagatcttgcttgctgcgggccctacccaaagagcacaagaaggctcggatacacagctgcagtttggatggctatagtcctgcccaggagggccaggctcctgtctgctctgtaaagcaggagacttgggtttgcagctgtggtttgggtgcaacccgggagctctggtcccaactcagaaggggcggggctcccactggcttcatggagtgtgcagcaccaactgagcctcccttctgcagccagtgtcatgtcttctgccatcaatgtcttctatctcagagattctttcctcagctgtctgctaatgagaccatcaaaagcattctttcttttacagtgtttatttctaacattttttaaattctttctcagaattttatcacttcttatattttccatctgttcttgcatgttgcctactctttttaataaggccattagcatagtaatcatagtttaaaaagattcctggtctggtaattccaacattcctgtcatatctcactctgaatccgttgcttgttcagttttttttttttttttaacctgcagttttgttgttgttgtttttgcctgctagtagctctgtaattttttgttgaaaggtagatattgagatactgggtaaaagaaactgcagtaaataggcctttgataatagcggtaaggtgtagggagaaagaaagtgttttatagccctgtgattaagtctcagtttttggtgagcttgtgggcctggactgggaatgttacatgtgcttctgagtatttttccccctccccttaggtgggacagaatggctagagtgggttgaagttgagcatttgccttcctcctggtggatttggctcgtctgacaaaaccctattctgttaggcttttgtaaaatagtttattttgaggacacaccttgttaagaaaaccgtattgctctgggttatttcaaaccatttttttgttttgttttgttttttaccactcacccggttggaagcttgaaaggatttttctcctatactcatcatgagggcctgataaggttctgggggtaaaattcacaaaaatgtgaattgcccccacccttgctcaagcatgagtgggtcctctggagtttctaatacctaaagaaagagtaaacactgaataaaaatgtattttctcttttagagacaagacaatcaaaatctgaattttactttgtaaatcaaagagaacgactaaggcaactctcaatcattttaggaggtttatccgccaaagttaaggacgtgcaccagggaggcaggtctatgcctttctccaaagatgattttgaaggcctcagtattcaaaggagaagggcagatatttggggaagagaaatattttttaaaagattcagtagataaaaggacagaatggttgcatccttttgagtctttgatcagcctttcacttaatatacagttttcctgtgagagggtggtagaggaaatagttactcataacttagtgtggcttagtgaatctgcattttttgtaagacaacatagacaatagggcagaggaagcaatcagatacgcatttatctcaggtgagtggaggaatgactttgagttctatcttttgtcctgcacctgtgaagataagctatcaatttacattgacaaggtgaaattcagcagaactgtttgagggtagagatcttggagcccacaaggaattttcttgtgggcaaattgtgagggaagtatgtagctttttatttttgtagccatcttatttaggaacaaaatgggagacagttttgtgtgatccagttcccagctcgaattttcctttggtttaagtgagtttggggtcccaagatttattttcctttcacaacttatttactgttttttttctctgcattttctcattttcttttaaatgttatgtttgctttatgttaactgtatttattgagtcttattgtgttttttaaaatctaactataaagctcatttaaaaacaacttttccacagataaataatacattaaacaaataagaacgcagatattttgattgaagagatgaaatttgtaaacttttctattctgttatttccccattttttgcagtgtctttataaacactccttcagaaccttctttgaaaaccactaccagtggcaaatccatcaatccttttctttgtgattttgtcccatgttttaatgtttaggaaattttacttaacagtgaactaattggtactactgttaagcttttccttataccactgaatgtttgatactttgaatctctgaaataaactgagaatggacagattaccagtagaaaaggcatacaaatttattatgtgcatacacatggagtctcacaaactataaggctcaatattatattataatattacctattacaatatgtatttttgagttattgtctaatacaaattaataatgtggaatacagtcatctaaatttttttctcctattcaactaaggactagtgttttatatatatatatacacacacacacacacacacacacacacatatatatagtgtgtgtgcgtgcatgtgtataaatcctaaaatcaatatcactagtactttaaacaatcatttttaacttagatttactcctatttttaaacttgcatttcttttcattttttttctgcctgaaatatattaatattttcattattgtggtctgctgatggcaaattctttcagattttatttgttcagaaaatgcctttattttcttttcattcttgaatgtttttgctgaatatagaattctagtttggcagtcatttttatttacaactatatggctttgtttcaactacaaactcagttatcagtctttctgttattccattgaaaataataagactctttaacctagctcatttttaacccagttgttttgaaaaattcttaaccatttacttactaaatatccctctaataagctatctttccctactccttctggaatttcacttagtaatatgttagcacttctaattatgtcctatgtgtcttatttttttctgttcttatgattttgtctcatcatgcttcagtttatgttttcttttgctcttatttcttgctcaccaattccccttttagctaggacttatctggtgtgttaatctcattcacggagttctttttttcaatttttattttagatttaggggtaaatgtgcaagtttgttacatgggtatattgtatagtgctgaagtttcaggtatgaatgatctgtcacccagttttactaagcatagtaatcaataggttttcaacccttcccctcttctctccctcccacctgtagtagtccacagtgtccattgttgccatctttaagttcctatgtatgtagtgtttagcttcctcttataattgagaacatgcagcatttcattttctattcctgccttaattcacttagaatttatgacctccagctgcatccatgttgttgcaaaggacatggtttcattcttttttatggctgtgtggcatttcattgtttacacataccaccttttctttatccaatccaccactgaagggcacctaggttgattccatgtcttggctgttgttgttcacagaattattaatttcagttatacgtttatcatttctcaaggctttcaatggattcttttttacagattacagttctttgccaaaaatcttcatgttatctttaatgtccttggacatttcaattataattattaatttgtgatgcagttttatcacattttaaatatatactttattctgtgtattagtttgttttcatactgctataaagaactatctgagactgggcaacttataaagaaaataggtttaattgtctcatacttccacatggctggggaggcctcaggaaacttatactcatggcagaaggcaaaggggaaggaaggcacatattacatggcggtgggtaaggggccagggagtggactgccaaacatttttataccatcagatcttgtgagaactcactcactattatgagaagagcatggggaaaccatgctcatgattcaattgcctcccaccaggtacctcaacaaatggggattgcaatttgagatgagatttgggtggagatgaaaagccaaatcatatcattctgtttcactgaaatttgtttagtcttatgctgatttcatattgatttaaaaatagctttagttttatgttatctttggataactgatgagacaatttattactattccgaaaatgtattatatatttaaaatagaaacttcctcactcaagaacatggtgtatattttgcatttattttagtcttttttactcaatacagttccatagagtttctatactttttttgaggtaattcctagtttttatatcgttttgtgaatattttgtgaataggattattttcttattatattttctaactaagcattgttaggatatgtaaaagctatttcactagctctctctatatttgtaaccaactgcctcaatgaacacatattaattctaaacatttcaattgtttttcttttatttatttttaagtaaacaatgcaatctgggaataattatcattttatctctcacatagatatattttattttcatttattatcttaatgcattaaatagaactttttttttttgagacagggtctcattctgttgcccaggctggagtgcagtggcatgatctcggctcactgcaacctctgcctcctgggttcaagcagttctctgcctcagcctcccaagtagctgggattacaggtgcccgccaccatgcctggctaatttttgaatttttagtagagacggggtttcaccatcttggccaggctgatcttgaactcctgacctcgtgatccacccacctcggcctcccaaagtgctgggattacaggcttgagccaccgtgcctggcctaaatagaacatttttaaacatagtattaaataattatgacaatagtgagcagttttttaatgtattttgttttaatagtatgcttctagtgatttaccatattgtgtgatgtaggctcttggtttaagggaagaaaaatgtaagagtagaagcatacttgtcaaaaagtcttgagttgaaaatctaaaatctaacttgcaactttgtagatataacatcatgaataatttatctaacctgagtctcttcatttttaaaaaggtgaagcatttagctagttcttaggatgcttatgaaacttaaggagatagtgcatatgaagtacttaaatgtacaaaattatgcacataataggtaagatacacagacacacacacacacatcttcaccatttttcactctgctttatgcctcaaccatgtgacttttacaaactgcatcagctgtactttctgaccatctagtttctggttggatttaatacaatggaagacaccagaacatattacaggtgaaaagagggtgaggtctgagttattattccctggttcctttcttgcctgttagacgaggttggctgttatcctattgccaaatgccatagtagtccctcttctgcaactgtagccctctcaggacatcaaggacccatattttccgttgtactttcaggcttacagacaacttcttgctgtcccctcatcccctcgttgacttccctcaccacttcctatttacttttgtaaataatttcttcattaaaaatccacttaagtgtcccttctgagggtgtaatcatcttgtttgatgaatctatgtaagcatatataacatttccaaacaaccctagagtgctaaaccagatccatactgtttggctcctacctactctagaattgtattctgaccactggccttgacaagtcatctgtagttttctgattgggctgctatttcatgtgcctgtgctaatgctctttcctctgctttgaatgtctcttctatccacttttcaatttcttctctgaagtcttttctgatacactaggtaaaaatttacagttatcttttaaacatctatctatacatggaattttatatagaattttctcatagtaatgcagtaataatttattttatttgcatgatcaaaagttgtacttttgttattaaactggaatctctgtaaaggatgtggccttgtcttttcatcattgtttttgccatggcttacatataattcatggcacagtaggtactgaagaaatgtttacataataaatgactctagctattattattaggagttagctcatacaatttatgttagaattgaaatattgtgagaaaggttgtaagcttcatcatgcagaagttgtgtttagtgtgaaagtagggcttatgtattttcaatgccctgacatgtttttgtagcaagttgacacattgcttttgtactaccaggtggaattccacagagcttaaaccagacagggattaacaacagtttgagctgtctgagagcactattgactctttttccagtagcattgaaacaggaaaaggaggggataaaagaaaatttaattattgcactattttaaaagcagtaatttgctgatttcggagagtgacttgatactgtggaattttgattttctccagtgctcacatagaaaagagtaaggcattaataaatatttattgactattgtacaaataaaaatttaatcttctaataaaaatttaatcttctaggaggattttttttacaatggaaaatataccccaaacggttactaagaggatggggaatgttttgtcctgtaattataatgataaatgttcaaaaatgtaattacagttttattttataattatgacaaatgtacatatgaagaaatattcagcttcataagtagtcaaggaaatacaaattaaaactatcaggaaatatgattatatgcccaacaagttgaaaaaaaattcagaagtgggaaaataaaaatttttgttaaggatatgatgctatagctgttacatgctaattttgggagtataaatccatacaattactttgagaaacaacattacctaatgtagataaacattcccatagttataattcacccttatgcctgtagtaccacagagcaactatgtatgtagttgcatatgtgtgctatacaatacttgtgcatatatgtaccaagagacacaagattattcacaatagcattgtttatgataaattgctattcacaatagaatggttgtaaattgtagcctatccacacaatagaatgctatattatggtgaatggactaagacaataatacatgcctatcatcatatttgaacctcagaatgttacatgttaaatttaaaggtgagaagcaaattatggttaataatgtgcaacatgattccatttgtatcaaatttgaaaataagtaataccaaatataatattatttaggaatataaatacacatgatgaattataaagaaaatcaaatttcttggaaatgttctattcttaagctggataatgtatgtttatgttcggtttctttttagtttattatttcaaatttacatgtgcattatgtttcatccatatcttttacatatcatataggatttttaaaaattatgtaaataaccttaaaataagtctattcccatttacaaatgcaaacactaaaaatccattaaaggcagggctaatgtgtttggaaaaaatctattgggaaactcctttaggcacagataaaatgaaaatattctctgtgttcaacaaaattaccttagtgtatacagcagattttcttgtttacattttaaaaaatattttatttttaattgacaaataatagttgtattttgtatggcttacagtgtgatgttttgaagcatgtatacgttgtggaatgattgaattaggtaaattaatatatctgtcatctcacatagttatcatttctttgtggtagaacatttaaaaccactctttttagcaatttaaaatgtacaatacattattattaactgtgcaatagacaaccagaaccttcctgtctaatgaaattttgtaccctttgatcaacatctcttcctgtctaccactgtccccatccccaccttcagcttccagtgaccaccattctactgtctacttatatgtttgacttttttagattttgcatataggtgagatcattgagtatttaactttttgtgcctggtttatttcacttagcacaatgcactctacattcacctatgttgttataaatgacagaattttcttctttttttaaggcataatagtgttccatttcgtgtatataccacttaaaaaattcatttatccattgatgagcacttcagttgtttctatatcttgactattgtgaataatgctgcaatgaatgtgggagtgcagttatctctttgacgtgctgatttccattccgttggagatatactcaaaagtgggattgctgggtcaaataataattctatttttagttttttggagaaccctcatctgttttccaaaatgtctgtcataatttatattaccaccagcaacgtacaaggagttctcttttctccccattcttaccaacacttggttatcttttttctttttgataataaccattttaacaggtgtgaggtgatatttcattttggttttaatttatatttttctgatggttagtaatgctgaatatttttttcatacctgttgaccacgcatattttttttgaaaaatgtctatcccagtcctttgcctatgttttttaaatagggatacttgttttctcattgagtaatttgagtttcttatatatttgaatattagcaccttacctgatttatgatttgcaaatattttctctcagtctgtgggttgtgcattgacctttttttttttttttttttttgctgtggataagctttttagtttgatgcaagctcatttgtctatttttgcttttgtcgtctagactttttgggtaacattaaggaaatcactatccagaccaatgtcacggagctttcccctatattttcttcttgtggttttatagtcttagttcttacatttaagtctttaatccattttgagttgattttcatataagggatgagataagggttcaactttattattctgcatgtggatatccagttttctaaacaccatttattaaagagaccttcctttctccaagattgctttggctgttggagatcttttgtaattccacataaatattagaatagtttttttctatttctgtgaagaatggctttgtaattttgatagggattgaatttaatccctagattgttttgggtagtatggatactctcacaatattaattcttcccattcatgaacatagaatatctttccatttatttgtgttttctttcaccagtgtcctgtagttttcagtatatagatctttcatgtccttagttaaatttacttctaaatatttcattttattttctgatgcttttataaatgctattgctttcttaagttcttttataaatagtttttagaaagtagaaatgatactgattgctttatgttggttttgtgacctactaatttactaagtttgcttatgagttttaacaacttttttttggaatccttaggattatcaataagatcattctatcggcaaacagaaacaattttactttttcctttcctatttcaatgtcttttatttctttctcttgcaaaattgctctgtctagaatttccattactatgctgaacagaagtggtgagagtggatattcttgttttattcctgatcttaggggaaaagtcttcaatttttcacccttgagaataatattagctgttgccttgtcacctatggcctttatagtgttggggaacatttctttaaaaattccaacaaattctttgggtttcctggatctggatttctatttcctttctcaggctatgccattatttctttcaatataatttttgtgtcatccaatctttcttctcattctgatacactaattattcatatgtcatccacttgatggtgtcccataagtctctttcctgttttcactctttattctttttctcttctttgctcctcagattggaagatttccagtgatctatctttgagttgactgattatttcttctgcaactgacaaacatttaactaggttagctaagaagcaatgagagaagactcaagtaaaatcagaaatcaaagaggagacattacaactgctaacacagaagtaaagagaattaatttaattatgagactagtataaaaattatacaacaaaaaattggataacctagaacaaaattcatcagataaattcctggaaaaataaaacctttgaagactgaatcatgaataaatcagaaaactgaacagaccaataatgagtaagtagattgaaacaggaataaaaggtctgctatcaaagaaaaacttaggaccaggtggcttcatggctgaattttaccaaacatttgaagaactaataccaatcattctcacactctttcaaaaactaaagagaagtgaatacttccaaaccattttaagagatgagtattatcatgataccaaatccagacaaaaacacaacaataaaaggaagctacaggcaaatatccctgatgaacataggtgcaaaaatactcaacaatatactagtaaactaaactcaacagtacattaaagagataatttactatgtcctctttatattaaagtaatctgtatggcttatgaattacattttaatgtctactttcaaaagattggaatgtactgtatcactctccttattttcttgccatttgacctatgcttatcacttatgtgctttttcttatattttagtaaataatttataggaaaaaaatccactttttactaaaatcaacttcaaaccattaatctcgtttacagaaagccaatttctatgttgacttttatgtgtcagtgtgggtgagctttccattgagaaaacaacaacaatattattcagaataaggaacactctttaatcttaccctctaaaaacaaagataaatgagatagcagataatttagacagtctgaaaaaatttttgtctctaatttaaagttaagattgaccacagcttttatgtgaaatttgatttataaaatattgtggatttgatactcctaataatgctttttacatttgtaaaggacatgcttttatctttttttttttttttttttttttttgaggcgaagtttcgctcttgttgcccaggctggagtgcaatggcgcgatcttggctcactgcaacctccgcatcccgggttcaagcaattctcctgcctcagccttcagagtagctgggataacaggcatgctccaacacgcctggctaatttttgtatttttagtagagatggggtttctccatgttggtctcgaactcccgacctcaggcgatccacctgcctcagcctcccaaagtgctgggattatgggcgtgacccaccatctccagctggacatgctttatattttaataactgattataacactcaatgtagcaaattaatgatttttttctggaaaaaagtataatctatgccacagtctaggcatattttaaagttgactgtatatagctgaacattccaagtaatgagttatacaatgtaacttttcatggtagtaatgttaagattatgtcgtaatgttaagattatgacttgtaatgttaagactagtaatgttaagattatgacttaaaaaatttacattttgagtcaatcagggagttattcacaaaatcaaaattttcaaaaagtttatattttccctttgtagtctccatttttcttattagtcactgaagaacaagagtatttgtcttcttgtgtagttttattatgggcaatatattttccttttttaaaattaaaagaataaagactataataaataacactgagggctggatgtggtggctcatgcttgtaatcctggctctttgggaggccaaaattggcagatcacttgagcccaagagtttgagaccagtctgggcaacatggagaaaaatcatctctacaaaaaaaaaaaaaaaaaaaaaaaaaaggcaaaaacaatttagcctgccatggtggcactcaccagttaataccagctacttcacaggctgaggtgggactttgcttagcctagcaaagtcgagactgtagtgagccgtgatctacttcagcctgggtggcagaataagaccccatttccaaaaaataaaaaaaattaaaattcacactgagtatgtaattccaaatgatttctctcaaagaaatatttctggataaataaatattacagacaaattagctgttcagtataaaaaacagatttttatttagaaataatatgtccccatataagaagtcccataaggtatgttcttctacaaacattatgtcaaaggctacctgtgatctcaaagcatcagcttgaccacctgtcatttatttctcaggttaaatgctgttttatgaagaaatgatgatataagagcaatatgataacatcgtagatcctttcaatgttgttgaaaaatgtgacagaaaaaatattttagattgaattactttacttataataaagaattgagcttctacaaatgcatattaatcagtttttgctaatttaagtgattttgttacttttaagttttaaaaggcagatttatcaacagctctcaaatacttgcttttttctgttatgactactttcttttggtcatcttcatgcatgcttgaagttttaggattcataacatttggaaatgtatcactttaaagaatgagggaagtcacacagtgtaccataattctttttggtgcttcagtgactaatatggtgagtgtttcccagacctccaaggtgcttatttccttgactgggagaagtattgcttgctgctggctttcagccaccagctctgagcaagagtactatccagccaagcttatgccctctctgacatctaatgactgggtcacagggtgagtggtattttatgccatatttactgtacacatttatccacttccttagtgcatatctggctcactgctctgtatttacacctcaatgtgactttatttccagatttaaaacatatttcgagaaagcatacaaaattcaccaactcaggtgaatacacagtttgatagagtttattttagagataaagtttattctaatagctttgaaaatgacttcactcatgtattgtagaatcattaagagtcaaagggattgcttactttttttggttacactttgccgtgttttaggaagcaaattatttgctgtactggtattaagggatttgcaaaaatctcaggatgtagactaataataaaagctgacatttattgagctttacatttattgcatttaatattcataatcatgtaattaggtagacattattatttttaccattttaacagatgggtaaacccgagtttgctaatatttacttgggacttagatctggagcacaaacttaggatattctggtagcaaagactcttctctcaaccactgcttcttaaataatagtgatctgcagaacttaatacacatatgcccataacctcccacatacccacacatggagacagactttcacagtgtgtgtacaagaggggtgtggttatagcaatttggttggaaaattgggcaagctttggaagctttttacagaaagttaagaaacatcaacattctatttaaaagtagagaatataatttggatatgacacagactatggaaagactctggcattattctttgtgtgtgtgtgtgtctgtgtgcgtgcgcgcgcgcattgtgtactcacacacattcaagaatgcccaagtattatggcagagattccaagttacatgggttttagataccactgaactgtaacatcactatatttttcttatgaagtcctctatggccttcatttgctatattttccccaaatttctggtttttccctctctctaatttctagagtttttagtttcctttttaccatgttctcttggtaacatcacaattctcttattacccagattctggtctttaacctaagaattactgagctataatttatataaagtgaaatccccctttaaagtgtccagtttgatggattttggcaatgtgtacaattatataaccatcaccgcaatcaagagacagagttttatgcccctttgcagtacatcttcctgaaaccttggccctttttgtcatcagagtttgaccttcactagaatttcatttaaacagaatcatatagtgtgaagttgtatgtgctagacttcattttaatcataatatttaaatttattcctgttgttgcatgcctcaatatttcattcctttttattgcttagtagcattccatagtatggatatactgtaatttgttcatccattagacaagttatggtcatttgaactgtttctagtatctgactattgtgaataatgattttatgaacattcttggacaattttatgtggacatctgttgtctgttcacagttgtactctgggttaacacacagaagtgggattcccgggtcatactatgttatgttttacttaataagaaactgacttaccattttctaacggaggtgtaccaagtttcactactgttggcaatgtgtgagaattccagttgctccacatcctgaccaaaacagaattgccagtccattaaattttacccattcctgtgaatggatatgttattttactatggatttaattttcatttctttaataattaatgatgttgaacatgttttatgggcttatttgccacttatatgtcttttgtgcccattaaaacttctttgtatatcttcttcttattgacttttatgaattttttatgtactctggaaacaagcaattagtcatgcattttctgcaaatattttctatcagtttgtggcttgtctttttacttccttgtgtctttcaaagagcaaaaggttttaatatgtcacaaaattttctcttatatttcattctagagattttagggttttagctcttcatgtaagcctgtgatccattttaattggctatttaacttttgtgtatggtgtggataagtgttgaggttcctttatttccatgcaaataggcagtatgatttgttgcaaagtctatttctccccattgaattatctttgtaagtttgtcaaaaattgattcataaaagaactatgagtctatttctgaattatattttatgttatgtaaatccaaatgttgattcctatgccagcataacattttgtcatgattacaatggcttttattaagctttaaaatcagggagtgtgagttatcccatcttaccttcttttcaaaattgttttgccttttctaagtcccctctgtctatgtaagtattagaatcctcttgatgattagtacacaacaagcctgctgaggttttgattgggattatgtaaaactgggattaatttttggagaattgacattctaacaaagctaatccattagcatattatctttctccacttatttagatattatttaattttgtgttttataactttaaaagtatgagtttcttaaaaaaagtaattttgacatttattttagattcagggagcacatgttcaggtttgttacatgggcatattgtatgatgctgagtgatatggtttgggtgtgtcctcacccaaatctcatcttgaattctcacatgttatgagagggaccccatggggaggtaattgtatcatgggggcaggcttttcctgtgctgttctcatgatagtgaataagtctcacaagatctgatggttttaaaaaggggagtttccctgcacaatctctcttctcttgtctgctgccatgtcagacatgcctttcaccttctgccatgattgaggccgtgtggaactttaagtccattaaacctctttcttttgtaaattgcccagtctcagatatgtctttatcagcagcatgatgcagtaaattggtaccagtagagtggggcactgctgaaaatatacccaaaaaagtgaaagcaactttggaactgggtaacaggcagaggttgaaacagtttggagggctcagaagaagacagaaaaatgtgagaaagtttggaacttcctaaagacttgtagaatggcttttcccaaaatgctgatagtgatatggacaataaagtccagactaaggtggtcttagacagaaaggaggaactttttgggaactagagcaaagacaactcttgttatgttttagcaaagagactggtgatattttgtacctgctctagagatctgtggaactttgaactcaagagagatgattttgggtatctggcagaagaaatttctaagcagcaaagcattcaagaggtgaattgggtgctgttaaaagcattcagttttataagggaagaagagtataaaagtttgaaaaatttgcagcctgacaatttgatagaaaagaaaatcccattttctgaggagaaattcaagccaattgcagaaatgtgcctagtaatgagaggtttagcatttgttcatcaccaaaacaatggagagaatgtctccagggcatgtcagagacttttgtgtcagcctctcccatcacaggctcagaggactaggagaaaaaaacggtttcatgggctgggcccagggtccctctgctgtgttcagtttagggacttggcaccctgcatcccagcctctccagccatgactaaaagtggcaaacatagagcttgggctgtggcttcagagggtaaaagccccaggccttggcagcttccacatgatattgagtctgtgagtgcacagaagtcaagacccaaggtttggaaacctccacctatatttcacaggatgtgtagaaacacctagatacccaggcagaagtttgccacaggggtggggcccttatggagaatctctcttagggcagaggaagggaaatgtggggttggagccccaacacagagtccctactggggcgcaatctagtggagctgtgagaagagggccatcatcctgcagaccccagaaaggtagatccaccaacatcttgcactgtgtgtctggaaaagctgcagacactcaatgccagcctgtgaaagcagccaagagggggcttataccctgcaaagccatagggacagagctgctcaaggctgtgggagcccacctcttgcatcagtgtgacctgtatgtgagacatggagtcaaaggagatcattttaaagctttaggatttgactgccccactggactttggacttgcatgaggcctgcagcacctttgttttggccaatttctcccatttggaatgggtatatttacccaaggcccatacccccattgtatctaggaagtaactaactagattttgattttacaggctcataggcagaagggacttcccttgtctcaagtgagactttagactgtgaacttttgagttaatggtgaaatgagttaagactttgggggactgttgggaaggcatgattggctttgaaattggtgaggacatgagatttgggaggggtcggggtggaatgacatggtttggctgtgtccccatccaaatctcatcttgaattcccacatgttgtgggagggatccagtgggaggtaattgaatcatgggggcaggtctttcgtgtgctttacttgtgatagtgaataagtctcataagatctgatagttttaaaaaggagattttcccttcccaagctgtcttctcttgtctgctgccaagtgagacatgcctttcaccttctgccatgattatgaggcctccccagccatgtggaactttaagtccattaaacctttcttttgtaaactgcccggtcttgggtatgtctttgtcagcagtgtgaaagcaggctaatacattaaggtttgggttattgatctcattacccaggtagtgagcatattacccactagccagtttttcaacccatggtgccttcccttcctcctgcctagtagctgatagttgtttccatctttacatccatgtatactcaatgtgtagtttccatttataagtgagaaacatgcaatattttattttctgttcttgcatcaattcacttaggattatgggctcaagctgcatccatgttgctacaaatgacatggttttattatttctttatggatgcatagtattccatgatgtgggtgtgtactacatttcctttaaccagtacaccattgaataacactgcaatgaacatgtaagtgcatgtgtctttttggtagaataatttgttttctttgggtatatactcagaaatgggtttgctagattgaatggtagctctcctttaagttctttgagatatctccaaactacattcaacagtgagtgaactaacttgcattcccaccaacaatggttaagccttcccctttttccacagcctcaccagtacctgttattttggtacttttataatagctattatgactggtgtaatatatcacctcattgtttttttgttattgttgcttgttttttcctgagatgggagtcttgctatgttgcccaggctggagtgctgtggtgcaatatcggctcaccgcaacctctacctcctgagttcaagcaattctcctgcctcagcctcccaagtacctgagattacagtgcacaccatcacgtccatctaattttcctatttttagtagagatagggtttcaccatgttggctagcctggtctcgaactcctgacttcgtgatctgcctgcctcagcctcccaaagtgctgcgattacaggcatgatccaccatgcccagccctcactgtggttttgatttgtatttctctgacaattagtgatgatgagcagttttatatgtttattggccatttgtatgtcttcttttaagaagtatctgttcatgttctctgcccatttttctaatggggtttttcttttttgcttgttgaattgtttaaattccttatagattctggatattagaactttgatggatgcatagttcacaaatatttttttcccattctgtaggttctgtttactcttttagtagtttcttacgctgtgcagaagctctttaatttaattaggttccagttgacaatttttgtttttgttgtaattgcttttggggacttattcaaaaactctttgccaaagctagcattgaaaaggatatttcctaaattttctggtaggatttttatagtttgaggtattacatttaaatctttaatccatcttgagtttatttttgtatatgatgattggtaggggtccaactttgttcttctgcttatggatagcgagttattccagcaccatatgttgaacaggatgttcttacctattgcttatttttgtccactctgttgaagatcacctggttgtagatgtacagctatttctgagttctctattctgttccattggttgatgtgtctgtttttgtgtagtaccatgctgttttggttgctttagccttatagtatagtttgaagttgggtagtaggatacctccagctttgttcttcttgcttaggattgctttggctattccacttcatttttggttgcatataaattctagaatagtgtttttctatttctatgaaaaaatgacataggtagtttgacaggaatagcattgaatctgtaaattattttgggtagtgtggccattttaataacattgatttttctaatccatgaacatggaatgtttttccatttatttgtctcatctctgatttctttcatcagtgtttaattctccttgtagagatcttttacatccttggttagctgcattcctaggtatttcattttctttgtggtaactataaatgaggttgtgtttcttattttgactctcagcttgaaccttattggacatagaaatgctactaatttttgtagactgattttgtatcctgagactactgaagttgtttatcagttctaggggccttttggcagtctttagcattttgtaggtatagaatcataatgtcaataaagagagacagttgggcttcctttcctgtttaggtgcatattatttctttctcttgtccaattgctttggctaggacttccagtactatgttgaataggagtggtgagagtgggcttccttgtcttgttccagttctcaagagaaatggtttcagtttttgccaattctgtatgatgttggctgtgggtttgtcatagatggctcttattattttgaagtgtgtgccttcaattcctcgtctgttgggagtttgtatcataatggagaattggattttatccaaagcttttctgtgtctattgagaataattttttcttttaattctgtttatgttgtgaatcacatttattgatttgtgtatgttaaaccagcattgtatcccagaaataaagcctacttacttgatcatggtgtattaactttctcatttactgctggatttggtttgctagtattttgttcagaacttttgtgtctatgttcatcagagatattgacctgaagtttccatttgtgttgtcagtcttcccgattttggtatcaggctgacgctagcttaatataatgagcaggaaggaaactctccttcattttttgtaacagtctcaggaggattggtaccatttcttctttgtacatatggtagaatttggctgtgaatcaatctggtccagggcatttttggttgataggttttttttttttttttttattactgattcaattttgaaattcactattggtctatttaggttttcactttcttcctgattcaatttccagaggttgtatgtttccaggaacttatctatttccactaggttttctaatttgcgtgcattcagttggtcataatagtctctgaggatcttttgtgttttttgggatcagttataatgtcacttttgtcatttctattaaaaattatttttattttttgtgggtacatggtgtatatatttatggagtacatgagatattttaatataggcacaaaatacataataatcatatcagaggtatccatcaggtggggtatgcatcacctcaagtatttattctttctctgtgttacaaaccatccaatccaattatactgttttaattattttaaaatgtacaataaattattgttgactgtggccaccctgttgtgctatgaaagactagattttattcattctatctaactatattttcgtatcctttaaccatcccacatccccccctttcccagcctatgatattcattattctcttctctacctccattgatgcaattgtcttaatttttagcttccacaaataagtgagaacatgtgaagtttgtttttctgtgcctggcttatttcacttaatataatgacttccagttccatccaagttgaaaacgacaggatctcatccttttttatggctgaatagtactccattgtgtccaggtatcacattttctttatccatttttttgttgatggataattagattgcttcaaaatcttgactgttgtgaatagtgctgcaaaaaacatgagatcacagggaatgatggctcatacctgtaaccccagcactttgggaggctaaggtggttaggattgtttgaactttggagtttgagacaagcacaggcaacatagtgagattgtgactctactaaacattaaaaaaatcagccaggcatggtgacgtgtgcctgtagtgccaactactcaggaagctgaggtgagaggatcatttgagcctgggagatcaaagctgcagtgatctcagatcaaggctgcagtgagctgcgatcatgccactgcagcccagcctgggagacaaagcaagacagcatctcaaaacaaataaatacatacatacatacatacatacatacatacataggtatgcagatatctctttgatatgctgacttcctttcttttgggtatatacctaggtgtgggactgctagaaatagaatggtagtttctagttttagtttttattttattttattttttaatttttttcagatggagtctcgctctgttgcccaggctagagtgcagtggcacgatcctggctcactgcaacctctgcctcccaggttcaagtgattctcctgtctcagcctcccaagtagctgggattacaggcacatgccaccatgcccagctaattttttgtattttagtagagatggggtttcaccatgttgcccaggctggtctctaactcctgagctcaggcaatccacccacctcggcctcccaaagtgttaggattacaggcatgagccaccatgcctggctagttttagtttttatactgttctttatagtgcttgtactaatttacaattcccatcaacagtgtacgagggttcccttttctccacatccttgccagcattcagcatttattattgcctctcctttgaataaaagccattttaactgggaaggtaggacagcccattgtagttttgatttgcatttttctgatgaccaatcatgttgagcattttttcatacacctatttgccatgtgtgtatcttcttatgataaatgtctaatccgatcttttgccagttttaaaatcagattattagattctttgctatagaattgttcaagtttcttatatattttggttattaatcccatgtcagatgggtagtttgcaaatattttattccattctgtgggttgtcttttcactttgctgattgtttcctttgctgtgcagaagctttataacttgacattatttcatttgtccattttgcttcggttgtctgtgtttgtggaatattacttgagatctttgcctagaccagcgtcctagatagtttctccaatgctttcctgtagtagttccatggtttatgttcttagatttaaatctttaattcattttgattggtttttgtttatagtgagaagagttcagtttcatttttctgcatatggacatacagttttcccaataccttttattgaagagattgtcctttcccaatgtatgtttttggcatctttataaaaaatgagttcagtgtaggtgtgtgaatttgtttctgggttgtctattctgtttcattggtctatgtgtctgcttttatgccagtaccaggctgttttggttactatagctctgtagtataatttgaagtcaggtaatgtgattccttcaattttgttcttttcactcaggatatctttcactattctgggtcttttgttgtttcatataaattttctgattgctttttctatttttgtgaagaatttaatatgtgttttgatagaaatcacattgaatctatagattgctttaggtagtgtgacattttaacaataatgattcttcccatccatgaacatggaatatctttttcatttttggtgtcctcttaaatttctttcaacaatgttttatagttttcattttagaggtctttcactctttggtaaatttctatgtatttagttttatgtgtggctattgtacatgggattacttttttgatttctgtttcagattgtttactgtcattatatagaaatactacaaaattttgttcattttgcatcctgaaactttactgaatttatcagttctgataatttgggtggtggtagtctttaggtgtttccaaatataagattatatcatctgcaaacaatgataatttgacttcttcctttggaaattggatgccctttatttctttatcttatgtgattgctctgtctacgattcctagtattatgttgaatgacagtggtgaaagtgggcatcctttcatattccagatcttaaaggaaaggatttcagtttttcctcatttaatgtgataccagctgtgtgtctgtcatatatggtttttatttttgtcatttatgattgtacttattcagatattctctctctgacacacactctctctgtctctctctctctctctcttttgttaatctagttagtgctctgccaatcttattcattctgttgaagaaccacccttggtttcattgatatttgtgtggaattttgtgtctcaatattgttcagttcttttccagttttagttatttcttttcttctgctagctttggaattggtctactattttccccctccagttcttctaggtgcattaagttagattgttactttgcaatctttctaacttcttgatgaaggtgtttagttctgtaaacttctcttaacattacttgagctgtgtcccaaagatttggtaagttgtgccctactttcattaatttcaatgaattttttgatttctgccttaattttgttgttcagccagaagttattcaggagcaaatgttcaagttccatgtatttgtgtagttttgagagatcttcttgatattgattctatttttattgcactgttgtaaagagtgtgcttagtatgagttcaattttcttgaatttattgagacttgctttatgactgagcatgtagttgatcttagaatgtgttctgtgtgcagatgagaagaatgtatattatgtgattgttgctgaattattctgtagatatccattttgtccagttgactgagtgtaaattttgagtctagatgttctttcttagttttctgcctcagtgttctgtgtaacactcaggggagtgttgaagtctcccactattattgtgtagctgtctaagtcttttcataggtcaaggataacttgttttattactctgggtgttccaatgttgggtgcatatatgtttagtatagttaagtctttttttttaaaattatacgccttatcgttaggtaatgcccttttttgttctttttaatttttgttggttttaaatctcttttatctgatataataataccaactcctgctatttttgttttagcctgtgagtatcattaaatataacatgggccttttgaagatagcagacagttgggtcttatctttttattcaggttgccactctatgtcttaaatgaagcatttagaccattttcattcagagttagtattgatatacgaaattttgatcctatcatcatgttgttagttggttgttttgtaaatttgattgtgtagtttttttttaagtgtctgtggcctgcgcttaagtgtgtccttgtggtagcaagtgtcattcttctgaatccatgcttaacattcccttaagagcctctcatgaggctgatctagttgttaggaattctcttagactctacttgtctgagaaggattatctctccttcacttatgaaacttactttggcaggatatgaaattcctatttggaatttcttttctttaaggatgctgaaaatagggtcacaatttctggcttgtaaggtctgctgctagtctgattgggtccccttcgtatgtgccttgacccttctctctagatgcctttaagatttttattttcacatttactttggcgaaatctgaaaggcactatatgccttggtgatagtcatcttatatagtacctaccagaggttctctgtatttcttgaatttgcatgtcaacctctttattgaaattatggaaattttcatggaccatgtcttcaaatatattttccaagttgcttactctctctccttctctcttaggaatgccaatgtgttgtaggtttggtctctttatataatccaatatttcttggagattttattcattttttaaaattgttttttctttatttttgtctgagtgcactgacttgaagaaccagtcttcaagctctcagatttttttttttcagcttggtctatttttctgttaatactgctgaatacattatgaacatttttattgaatttttttcaattccagaagagcaatgttgttcttccttaaaatggctttctttcatctcttttatctcatggattgttttactagagtcctgggattgggtttcaactttctcttgaatctcaatgggcttccttttcttcctgattctgaattctatttttgtcatttcagtcatttcagtctggttaagaacaatcgctgggcagctagtgggctcatttggaggtaaggggacattgtagctttttaaattgctagagtttttgtgctgcttatagctcatctgagaaggctggtgttctttactgtggtgtaatttgagtagactcaattgcttcatttctggatgctttcagagggacaaggctctgtatgggatctttatttgtggctggattctagcctttggtatcacaggggtgtgtattaaaagaatatttttggtgttgcagcttgggctgtgatccagtagatgctgttttagagtagtgaccagcagataggctgttattcagccacatggctcttttatatttccttgcattaacagccatgctctttggtggaggaagagagagatgacctcatcactatgtctgctcctgggccttgagggatccctctctgatcactggtgctgtacctgtgcacttcctttgttagatgttctggactacagggctctattgggtagaggtcgtggcagggaggtaggccacaccttttccagcccagcccagtacagggaggcccatcctgctcctgcaccagtcaatgatcctgcatgtttcatccctctcagtactctgacagtggaggctcctccccaactctggtgccatccacaaatctttgctcagcattcccaagatgcctgtcacagccctggggcaatgggatcaggccatagctccatccttcagacccttggagttgagctgcaactgtgctgaggaatctgaagtgatactaggtcactgggaaactactcggggagcaaatcacccaggctggacagcaaagtctgtgatgtgcacaaaaggccctggtagggactggtgggcaggagggcctatagaacagatgtgccacagtccttgggtaagccagccccactgtctcctggccaggtggacagctggggctagagctaattggagagagatgtggaatcctgggggatagggtgcctatgggcacaaaggcctctggctccatctgtctctgcctactctctgggaagattagcctgctatttcaaatgtccatgagggacactggttcccttgtagctagcatccccatggtccacagcaagagtgggttctttctctgtcccttgacccactcttttcccagaatccattcagggctggaaactagctctaacatttgagtaccccagcagggtccccagcttcctttctcttcagcctcaatgtgtgtgtcgcttctccgtcaactctcggtgttttctgtctgaagatctgctcaaagtaggttggttttgttgatattttggtcactctcagtgggagtggcacttcctgccttttgttaagtgccatgaataaaataagccacatgctttgataaagaataataataggagtggaggatataggttgtgtgctacgtatgggtcaaggaagaggcctttttggggctgtgataattaagctggaatctgaagggggacaaagagccctcttcatgaatagcaaaatgaaggaacaacttgtatgaggatctttagatgagaatgcttttagaggcatcaaataactgagaggaggcttataaagcttggtggggatgcaggtggaacaaaataagtttgaagaactaggcaggatttaggtcaagtagggatttgtggacaattgtaggaaacacaatttctggcttaatggatgaggagataagaatacataaatatttatgaaacagaatgggaagttctacagtggaggcagaaaccatgaaccaggggcaggcatgcttttaatttaaacgttaagatagtaaatgtctgttgcaactactcgattctgcattatactgcagaaacagacatggtaaatcaacaagtgagagtggctgtgttcccaacaaactagttacaaaaacagtgagtggctggatatggcccataggccatagattcctgacccctgacataaaccaagagttcttgcctctaattctgactcaggataaaaatcacagagttggaaattcaggtagagttttgaagggtaagaagtgttttagtaaaaagaaaaataaggggattatataccagatagagcaaagcacaaggacattaaagggaatatactattattgctggggtagcaaaactggggcatatttggacagcagtgtgtgtatgggtggtgtgtgtgtgtgtgtgtgtgtgagagagagagagagacagagagtcaaaaacacaatggaatgataaaaatgaaactggtcaggctggcgttctgaaaaacatacaaagacattggacttaactgaaaggcagattcctaaaatatttcattaccatgcttacatttaaatgttgagtgacattcatgtgaaagatgaattggaattggacaacagtagaagtatttttcttgtcaaaaatccccaatggctttctgtttcttgccaaataagtctaaatccctatcgatattaagacctgccatgatttccacttatacccccagtctaattttatttgctctcattttcccaagagagaaagcccctccctaagactgatttccacctggtaatttggcttctgttatctaaaggatcagcttctcctgtttattattttattttttttaataaattcagaaagcatttctagatgtttcctaaggctattttctcccaccctggatctcttccgttgactgtgattcatgttttgggcacctagctatgcaaggtcttatttgtgcttctgttgtatgtttcatatgtctcaccaggattgtaaacttcttgagcagagaaatcattgcttcctataaaaagggcttgttttaatgctgaggatgctgagaattctcaataaacattaattgatgtaaacatcaataacattgaaaattctatctgagcacaaactaatgcaaaactagtttataaacctgatcaatgttttcattaggatttctaaaacattcctcacattgctgtttaatatttatacatcaattatttgtaccttacaatattatagtagcaggctgaatattaagttttacactttctgtttccagtttttaaaatcgacatattttttacctttgggcagaaagaagtgttctgtcttaaatagtgatgaagttatagtgggagaggatattaagcagaatagcaagtgtcacaaagttggtacaatgaaagcacaatgagttcagagtttaaacaactatgtatttactactttagcccatttgggctgctataacaaagtactatagactgggttgcagataaacaatgacaatgtatttattactacagttctggaagctgggaagtccaagactaaagcactggcagatttggtgtctggtgaggaccagctttataattcatagatggtacctttttggttgtgtccttacatgatagaaaaggcaagacatttcttctgtaaggacattaatcccatttataaagattttgccctctgacctaatcatctctagaaagccctaccttctaatcccatcatcttgaagattaggttttagattatttatttggaggggatcacaaacattcagaccatagcaaaatttacagctgaaatacttgttctaggaccctaagttacttgctacctttagaatggagtacatactgtgtaattaacagacatgaacagtgttgtttctttttacctttgtggggattgcagtgccatatttagagaagacagatttaagcagaaaattatgaagactccttttggaacacttaaaaaatttccaaaaatacaagttgaacctcttgagcatcattgctgttttcatcttgctcttcagtcctctagggtgtacactaggaggaagttgtcttctatcattgccttggaaaggtaattagacatgataaatttgtcagtattcacaatcctttgatttggtatttcagacttttagtcctccttgaaaaagattaagccattaatcgccaatggttcctcatttatctgagaaatagtgttcagagaaatatcacctctgaggctgtttacctactggacatgaaatagggcctgtaaaagtggggcacattcactgacttgattacctttcccatggcccaatgtagcagggcttgtaaaaaccacaggagacagcagatgtcttctgatatgacctttattgcagtagccttcaggttcctaaggagttaccactgggaggattaacagtattttccctgcttatttgacttcctgagtcacaaatttccttcagacccagcgggtggctgttcttttagtagggcctaatttttcttggtggaaaggttatgctttccttatagtatgaattctcccctataagaagctcccactatgtgcagctcagagtaaactgggacaatttagtttaacgttccttgttaaacacatttctgtcctttaagtgctgagagtgagcccataatgtactcgggattcctttcttacatgcccatgttatagcacaaaggcaaatacatttcataaaatactggtttgttgcagttgattcttgttacttgcaaccattctggtctacaaagtcattggtgatactaaccattgcccttaaggaaaattcagggttaggtcccttgcagtcacaatgttctcataactacataacctagttttgtgtgtgtttctgttttttttttttaatatatattgctgatttattaacattgaactcacagctggcaacaccataattcatgcctgaattaagtttatgtaatgcatgtactttctccataaggcacatcacggtcttcttgtgctgaggaacactaggtaggacttcagcactatgctagggccatttttacacggtgaaatcaccagcaaaaagcacaaaaaatgcaaaaaaactggcagcaaatagatcttgaaaaggacacttgtttatgagagctgaagaagaaggcacaatgttgtttttttcagcttcagctggggtcctgtgcattgggcaattcaaggtctttcccttctacctatatccacaaatcactgtgaaaacaccttgtgtattgattatggggctacaaataaattttagaaagtaggtgaattcatgaatacagaatctgaaaataatgaggacaactgtatatcactggccccatgtttgattttaaatttatagcactctacatcttttgaatgatttggaaatacatgtttttcgaattgctcaaccctgaaacagatcaaccagatcaaccagtgggtgtgtcccatctagtttttatgcccttccatccacattttacaggtagatttatgtctacaaatgagtcttgccttatgctggaccctcaaagcatcccacaatccacctctgtgtaactgtgttttattggaatgtgattcaatgaactcattataaaatggaaaacgaattcctcatcccatttttgacctttttgcccactatctatgtggactttggtcaattgtaatcacaagagctatctgctatcaatatttaaatgtccatgccattgatatcatcaactttctgaacattctgagttaatgtcagctttcggaagagtgaccgaagggcagggaaggttgacattcacggcttctttttgctttgattttctagctcttttgcctcttctctctcacccaatagctaaggttcttcccctcttggggtccagaaggagagtggattaagagaaaaggcagccttgggctggtaggatctagtgacctggacttgtcctctggttatggtgacttcctatgttacttgttttcttctagggcttctgtgggtttctcagatatttccctactgggaacctccatgcacagttacaataatgtgagcaatgcatctactagctgcagttgttgcttttaaacttcagtcagattttcctaccttgcccatccattccagatagttctcttggctcctggctgattttttcctgaaagaacacccactctgtggtatttaaaaaaaaaaaaaaagtcttttatttcaaagggcagtacttcccaaagtagtttaatctctttccttctgcccttcccccggttgagatcccaccattttgcctttagatttcttaagcacatagcagacactaatcccttatttcctcaaacttcagaggatacatataaaactctaaagtttatcttttgaattccttttcacttggcttgagataaaattggatatttctttcctttttctgcagtggggagaaagctgaaaatagttcagtgatgctcttcaaagcatcagtgttattcctttattaattatagatggacattggcccatggggcagaaccaggggcacagttgcttagcgtgttgcgcccacatattctgcaacattgcaaagcattattttgctggccttagactgaattttatcaatattattttttattttttttcctaggaaaaggtcatgggttctgtatttatcagatattctttaagttcttaatttttggttttccataagtaaagtaataaggcattgatatggttcggctctgtgtccccatccaaatcttgtcttgaattgtaatcctaataatcaccatatgctgagagagggacccaggttggaggtgattggatcatgggggcatttttccccatgatgttctcatgatagtgagttcttaggagatctgatggttttttaaggcaattttccctgttcttgtacactctctgtaggctgtcaccatgtaagatgtgcctcttccccttctgccatgattatgttacttgaggcctccccagccatgtgggactgtgaattaattaaacctattttctttataaattacctagtcttggatgttactttatagcagtgtgagaacagactctaatacaagtatggtctctggaaccagatagcctacatgcaaatgagacttagagcaaattatataatctcattttaccttagttttctcatatgtagttaagtgaataacagaaccttgcttatattattgttgtgaagataacactaaaaaaagcacttagaacaggtttggcccatgataacattaaatgttagatattatgcctgggaatatattctggttgtttgcataattgaatagcatcttagctagatctaagttaattattggatctcactttcattcttttagaactttttaatgttgttccatcatcttatggcatttattgttacattacagatttgatgtcaccctagctatttctctcctttgtaggtaatttgcttttgctacctatatatttgaagaatttttttctttgaagtttatccatataagtagactaggtctcaatattgagcattataaatcaaattttcctgctacctgctgttttttatctattgttttcaatcttcataattaacccttcactttagaaacatttttctacattttatctttgaatatttttcctcttccatttattgaattctcccattgtgaacaaacaattatcattatattggacagtccttgctttctattattctctatcttatgtcttcattctttttttcttaagcctttcatgtgtcattattcattttttacttatgtctgttctgttattgcttttattttatttacatagagatgctgattaggtgattaatttgttttcttaggtctgcagtgtctccatctcattctcttttttatggaatctggtgtcttaggttgtattatagtgtaagttaataagtaggactcttctccagttttttgtgttatattttcttcctggttgaattattcatatttatttaagttttgctttattttttggaagaggatatgtgcctctacactctctagataagttactgtttcttttccttttgaccatgtatgtgcatatcagataaagtagtgtatttgtgctctaatggagcctatgtgactttttggtctttttacgctgtatttgaggccagctgttctttctaatgagctaaagttgaatgagctaaacttcagctaatgagctaaagttgaatatgtgtttatttaattaattcaatcattcatttctgtaatcactcattttttcactttttcaatagcctgggatcatgcataattaaggatgaactcagcagagggaatgctcagtttttttctttgaatatttcaaagtgttttaccttctgagattctttattaatgtctttaactggggttcatttcaattcagttgggaagatatttcccattgtgacatatcacagattttttccctctctgtgtgtttcaatctaatgagtatcaatgaagtgttcactactttaggaagtcacctttgtctttcacttctctgtttaaacttattgttctcagtagtgttttcaaaatgttctttctttcattttttcatttgttgataccactcttggaggctgaagtcagaggtaggaacctcctaaatgtgccattgtacttttctatagaaatgttatttactttaatggaaattcacatacaaatggtttaggctccaagtccttgcctcttttctctcataccttatatctaatctaataggaatcccagctgggaagaccttcaaaacagtgtgtccagaatctaatccaatcacttctttttacctccactgacaaaaatttgggcagggtcaccagcatctctctcatacttcattttcataggcttctaattggtcctggcttttatcctttatcccctatagattgttcttcgcatagtggccagggtggttttttacaacaattaatcagattatatctgtcttctgttccaaagcctaggagagtaaaagccagagtcctttcgatatcccacagtgtggtacatgtttttccctcccacatgacttcacacgtaatactctggcaataacccagcccttcattctattccaggcatgtggtcttcttgctgtttctcaaaaatgcaaaatgtaccatctcctttgcacttactcttactcatgctgaaacctttttttttttttcaaatatcccatgctaagttctcattcaaggttttaatcaaacatcatatgttcagtaaggcctattcttgtcagttgacttaaactttcaacctgttctcccaactctgccttcttcatccctcttacccttatttttttctttttccttatcacttattactaacatacttatgtaatttatttgattatgtttcttgtttatctgtctcctctttctaaaatgtaaattctgtgagctcaagtctctatgtctttcttgttgactgtggtattccaggtgactagaaaagtttctggcatgtattatgtttgtaaaaaaatatttattgactattttaggtaattagtcatttcttccctagaaaagatgataagaaaattatactcgaacaccttttcccttgaagcaatgaccaccagttcatgtccatgaaacttggcagagggcacagttctctttctcttattttcattttggaagaagtccagatctgttggaatgcttgaaaataaaaggaatacttttacagcagagatctgaaaaacaatattaaaaatctcattggttaatattatcttttgtagatatgaagggatatatttaaaacattttgtgattgttccatgttgtatggttcttggtattttaaaatatttgtctcacaggttttaaaaatgaatgataataaattgattaaaaggacagaatgattcctgattttgcaatatcctaaaatacctagattattagaatatgtgattacttgttatttcatcatgatgataataaaagggaggcaggggagcatggaaggaacagtttaagacttgggtaggtcttagcaaaaaatgtcatctgctacttaatcactatatgtgttacccttggcatgttacttaaatattgtgaattttgtcagtccttctttgtcaagtaggagataacaaaactttatcagtcaaatagaaaagcagaaaccactttatcaagaaaagataaatccctttattttattttattttttttaaagagggcgtttaacctagggcattgagaacacaggtactagaggatatgagaagccaaataacaaaaagttagccaacccaaaaattacaacaagaaggacaaagggagaaggaggaaatagcagtctgtgaactagggtcacctgctggctgtggtaacagtgggctggatcacatgggacaaatgtcaactgggagactaaccactgcaggagattgtacctaaggaaaagtgtgggcagaaatactctggattctcctttctcttgtactctagtctcctaccaggacctttgaaaatccagtcctcaccagaagtctgctgacagcaagaaccatagggaaagaacaaggaatgaatctagtaacacacaggtcaagaatcagcaaaaaaaccttcagaattaaacgtgacataccgtatatatatatgaagtgtattactgtgcttttcacatagtgaatatcaatgaactattggtgcaatgatttataaattgctggagaccgcataatttataaacaaaagaggtttaattggctcatagttctgcacagaaaacagagtgccagcatctgctcagcttctggggaggcctcaggaagctttcattcatgggagaaggtgaagtgggagcaggcacttctcatggtgaaggcaggagtaagatgcactcaaagttatagtttgttgatcccctactatatgaaaaccacagtaatgtgcattgtcttttcctttgtgtttgcatggatcaattttaaacacaattttaacctttaaaaacgtgtaacttatttgtaaaatttctcatatgtgtaaatataaacattttatattactcattattgcactcacacccttactttgtcctagtcaattctatttttgcaaattagtatttatctaaaaaaaaaaaaccctgtaattttactctgaaatcacagagcacaaaaatctaagtgcttattttaccaaatataattaaagacaatactgagaatcaatccatatactctaccaacacaagcacaggatagatacgctatctaggagttgtttctggcagaaaaatatcatatgctacaggaaggggtaagaaggaacctaaaactaggttttaggttttaattcgaacaatataatgaattgtcttacatgttatttaagcaagggtgctctttgtaattcataccactctcaagactgagccttttgaaattcaaaccattcattgttgaactttgatactttaaaataccactgaagttaaaaaaatgggtggtgataaaataaaaatctgtttcatttgggcaggcatcacaaaaattgtcttggataattcaaacccaagacacattccaaaatgcaatagtttgctgcatgatttaattcatgtaatataagatacttgaagatttttttttttttaatcgttaagtcttaaatattgaaaaagaaagtctcagcagggcacggtggctcacgcttgtaatcccagcactttgggaggccgaggcgggtggatcatgaggtcaggagatcgagaccatggtgaaacccggtctctactaaaaatataaaaattagccgggcacggtggcgggcgcctgtagtcccagctactctggaggctgaggcaggagaatggcgtgaacccaggaggcagagcttgcggtgagctgagatcacgccactgcactccagcctgggcaacagagcgagactccgtctcaaaaaaaaaaaagtctcaggtcaccaaatctatattttgtgataaggagaagcaaaatttgaaataatttaacttaatatttctcctagttaaaacacagtagaagtcatggttgatagtgtattgactgctgtcactcacatcagaaatgaaacattaattccataattcgtatccatgtttttgcacttctgcttgcctatttattaagaaatatatatatttcttttgacctaggaattcagtaggattatcatgtgaaaaattgtgccagacatgttaaacaggcaaggaagactttattaaagattattgcaacaaaggaaagaaattgaactcaagtctattgaaacaaaaagtaggagagtttttaagttctgaggtgagctactggaaaaggactaaaggtcattagggatgagggcctgtgtgattacgctatctgtgtttgctaattggtgcttatggaagagcctgggagatggggtgctctatctttcctgatgaatgtaattcaaagggatcactcccaggtgtttgaaaaatacatttctgggttgtaaaactgaaagaggctgggagaagatttgtatctcagggggcagagaaaggatttatggttgcaagttttctagagtaaatgctctaagaaaagggaggaaacatgtctaaaattcagtcatgctgaggaacattgaggccatcttggtcaacagattctacaggcaccattttggagttgagatgtacattaaaggaaagatggagcaagcatctcttttccctaaattctgctggtttctgattgaccatttttactttttcactctaaatcgggggaaaaaagtgtcctcctctcctaaggtctctctcttctctgtcccttcagcccttactttagttctaggtgacctttatggaaggtgataatatttccaaaacagaaggcatcacttgccccaatttcctataattataacaagtataaaataaattaaccaagaaaaggatgtattaggccatttttgcattactataaagaagtacctgagactgggtaatttataaagaaaagaggtttaattggcttatagttctgcaggctatacaggaaacatagtgccagcatctgctcagcttttggggaggcctcatgaagcttttatttatgaaggaaggtgaagtgggagtaggcactcctcatggtcaaagcaggagtgagagagtagggggtaagagaggtaggtgccacacactttaaagaccagatctcacaagaactcaccaggtatcatgaagcagcaccataccaggcctcacttccggcattagagattacaattcaacatgagatctgggcagggacagatactcaaaccatatcagatgacaactcctcctctttaatctcctcctcttcctgccttgaatgtttctctccataatgtaagttaatatttatctaaggtaagataaagctatttaaacattatgactttcttatgttagtacgtaattgaacattgtacaataaaacttcttattggccgggtgccgcggctcacgcctgtaatcccaggactttgggaggccaagataggtggatcacctgaggtcaggatttcaagaccagcctggccaacatggcaaaactctgtctctactaaaaatacaaaaattagccaggcgtggtggtgggcgcctgtaatcctagctacttgggaggctgaggcaggagaatctcttgaacccaggaggcggaggttgcagtgaaccaagatcacgccattgcattccagcctgggtgacaagagtgaaactccatctcagaaaaaaaaaaaaaaaatttaaaacttattactgattttcctaaatgtattttccccatttattttcaccttttcatactgtagagaatgccaaaatattaatctcattggagatttgatcctcaacaaactataagatatttacagtacttaaaaaatccataagctcttatttttattttttttaacttgtgcatacctttgtattatgtgatccattttccattggtttatattttatctttcagatgtaaaaagtatattttgagccctcagtgctatgttttagcagctgaagtatgaactttgccctttttgaactggtaattctattttttttcccactaagataagttttctttgtttctttcctatgttactgatggtatttcatcacctgaataaatgcttcccatcttgattttaattttctttcagcagatgaaattaagtcacttactatacttcagtggaattagaacacttttattacagacaaatgtattttagataacattcttaaagttttccttaaaaatttacaaaagaatgtttagatttctgttgagatgtttgtcatacattaatatttgtttttactaaatttactatgtatttattaaattttcaaacatctagataagaagttgagcagattgatttactgttttttgtcctttataggacattgctcacaagatcattaaatgactccaaaaacgtaattcatgtatgggtaattataagtgatacttgaggtgagggataaaaaaagaactagtcctaacaaattaatatttttgtctgcatgctcatattgttttcatacggattttaaaattactctggtttgacattttacattgaagttttggaattttatctatactgactacttctatgaaattgagatatttctcttaccaaatactggtttgcaatgtatatcattaatttattgttttttccagtgccaattcagggctaatataatgggtggctattaagtcctacatgtgttctgaggttctctcagttgtttttaacgtaatctttatctgaatctatttacattagtttctaagcatatgctttagtgttctgtaagttttatgggttctttgttacatgcttaatttagttttagaagcactaaatatgggaatctggaagtgaatatcacagtactgattttctcagatgttttacacagtaattactcttcttaactataacctttgcattttttggccggggtgggtcttagaagtcctttctgcagaatttatccagtaaaagttagtttttggatagcctggggtttacttttaatgcatgtctgaatgctcagttttgataagtcaaatatatccttgcatctaagtccctgctgagtgaaaggttttgctacagctaaaagtctgagaagaaaagcagaaatcatcagggagttagcttgatgcatgaaagacccacaggaaacaaaactgagttgatgttaccaataggagcaattaagaaagaatggttttgtgccagaatgttcctgtaagcttatttgaggaatcactatttctttcttttaccaaacaacctttgttcatcttccttataaataaaacattctattcatattgctaaaaaaagtagtttgcttgggtacaaaaaaggagttttttgctcacattttgaataaacttagatactttcttattcagtctgataatctttgtcttttcattgtgacatttattcagtttattatttaatataattataatttgggttgaaatttttcatataactattggttttttatttgaactaccattattgttcttttttactttaccattttcttggtttctttcctgatcattttctggcgagctacatatttttttatttccccagaaattactaaatatctctttaatttactagagtctatgataaattagtgcctttatacttctagaaaattataataagcttaaaatagtttaatgcctttcaattctctttgccttctgctctttttctgccatttaatttaattctacatatattttcacactcccaaaccattattttttattttattttatttttatttttttgagacagaatctcactctgtcgcccaggctggagtgcagtggagtgatctcagctcactgcaacctctgccttctgggttcaagggattcttctgcctcagcctcccgagtaactgagactacaggcacgtgccacaacacccggctaattttttttatttttagtagagatggggtttcaccatgttagccaggatggtctcaatctcctgacctcatgatctgcccacctcagcctctcaaagtgtgctgggtttacaggcatgagccaccacacctggccccccaaaacattattactattgttttatacagttactattcatttaaattcacccatacatttaccctttcttgtactcttcatttcctcctgcatttctatgacttaatatgaggtcagttttcttctgccggaagaacttttagtatttctttatagctcacatcttctggtgacaaattctcttggcttttgtttatcttaagcatcttcattttatctttatttctagaggatataagagaattctaagatgcaataattttgttaagttctttaaagatgtcagcctaccatcttcaggtggcctttgctgctgcttctctttcttctcttcctcctgttcctcatccttcttttgtcttctttttttgaaatgtcacctaatagttttatttggctgtttgaagggaatatcctctcctacctctgtggctacttttaggtttttctccttatctttaatttttggaattatttttttcccaaaatttgttgtttcttgatccttcaagttaataaaattcaatgaagttacagcttgtggtctttcattagttttggggaagaaaaccagacataggcttctcaaatattcttcctacctttttccccccacttcccttggtacttcaaatgcatgtgttagatgtatagacaatggttcatgtgttcctgacacgatttttttttcttattctttcatctctccaagcttcagtctgacattggtctgtcttccaattttctaatgctttgttttatatctaatatgtggttaaatccatctactaggttctttttttctgtgcttgtatttttatttctagattttatattttactctttaaaaaaatgaactccatgccaggcatggtggctcatgcctgtaatgccagcactttgggattccaggcgggtggatcacctgaggtcaggagttcaagactagacttgccaacatggtgaaaccctatctctactaaaaatacaaaaatccaggcctgatggtacatgcctgtaatcccagctagttaggaggctgaggcaggagaattgcttgaacctgggaggcagaggttacagtgagccgtgatcacgccactacactgcagcctgggcaacagagcgaaactctgtctcaaaaatggaaaacaaaaaactcccattctgtgataaaattctccatgttttcacttgttttcttgaacactgaaaacatttttttttaaattgatatctgaaacttccaatgtctgatttccttgtaggtgtgtttctagtccagatttttttctttatatttgatgacttgttttcttctcctactagtatttattagtaaattggacattgagtgtgaaatgttatagagattctggatgatggtatcttcctttggagaggatttaattcttttctggcagagagaatggaaacatgttatcttgttgcaatcatagttggagaatctatggctcattgagcctttctagggtcttgctctgtttattttgtccctaaagtgtacttttgtagggttttcagtttaaaaaaatggatgtttattagagtttggtttttttttttttttcagtccctaaatcccaatatttactctcacagcactgtgcaactaaagaattctctgcttagattgtatcctcttaggtttattttctgcttgactctttggcctccaccctcgtgtagcttattaatcatcaaatgccttgaggggaaaagtggcaaagaccatttgggttgcctctgttagtttccacttggcagcattttgacccattgtctatcttggttgtgtttgatacattcaaaatattgtcttttgtttatttgttcttgttgaaaaatcataaaagttggataattttattttttcttgttttggaggtaggggtgtggggctgttatctgagacaagccactttatcataagcaggaacataagtacttattaaaatcttcatctaaaaatgttgtaaaaaaatctttataaatgaattaaatctttattttattctcatttgaataataaaaagcattttaatttaagaaaaacattatatagaaagaacacattttcttcttttctactttaggagttttaagattagatattgtcagtttgttacagtacactaatttaaaaaacaaacatgaggctcatattgtttttatggaagactaattgaaactctggagaagataaacaaaaatattagaagaatagctccgataattgatactaagaataattttacatggaataatttgtgcttgaagggggaaaacagattaattggagtttaagagctaaagaacatctgggaactttgttttgtataaatacaaaacaatttacatttttatacaaaacacagaaaatcctactataaataaaatgatgaaggtgaaattctctaggggacatgtagctctgttgtaggacaagttcattgtggtttgaatttataagttagaaagaactagaaagtcactaagtgaacactgaaaaatggcttctttaagagccgataaatgagtaggaaatttttgtccatttgatagtagaggtcattaggtcattggttgcagaaatgttggcaattttgttggttgtacttgtggttgttgattattgtgggagcagggttgaagactaagctctgattttttatcttacccaaattcctgcctaagaggtctagggagtcatgccccacaaaccacaaattctcatcagatgggttttatttaaccctatatattttgacttacttttgaacctaactctagcataatattatgagacaaggaaaaaaatatttaacccaaaatatatttccttaccataccttaacattgccctgcaaagtctctggtgggaagaatccacattctatagagaaacccctaccccttttgttttccggccttccttcccagatccaggaaataatcaactaagagccagtcacccttttaagtcctataaaaaacaatttacaacctgctgtctctaaagtctgctatctaagagcttcctctgaacaataaaacttggtctccacagtcctttacctttaacctgaacattcctttctatcaataccaggtcttcagacaacttcaaccaattgtcaaccagaaaatgttcaaatttacctatagcctggaagcccccactttgagttgtcctgcctttccaaaccaaaccagtgtatttcttaaatgtatttgattgataactcatgcatcctaaaatacataaaaccaagctgtaccccaatcaccctgggcacatgttctcaggacctcctgagggctatgtcataggccatggtcactcatatttggctcagaataaattccttcaaatattttacagagtttgactctttttgtcaacaatataaagagaggctggcgcctaatgtgcggcctcagagaagactcaagaccccaaaggagttgactgaaagtggagctaaggtacaagcaggggcccattgaagccccactgaattcaagctcctcctccagtagaactggtaagtccttctgaccccaggacctcccttaggttaaacgtccttgatttattctaagctggttttccctaggaagttgttgttaaaggatcctaatgcaagtttggaggtgcatttctaaagggtcttctcaattgcttttctctcagaattaactaagaataaggagaaaacaagtagaatgacccccttttgagcacttctcaaaaggggttctcaaaagaggtttatggcacctccacttgaagtaatatggtctttgtgcacagtttactttcagaaaaaaagtcctagggttgacctgcaaactgtagagtttctattctaagttatctttctctattttcttttctgcttgctttaaatctgctgttacttttctactgagattaaaaaaaataataataaccgctgtttggatctaacagtttttttttctttgttttgttttgttttttgttttttgttttttttttgcaagccagaaaatttatattcatctcatggctaaagtactaaagtaaagctataggatctttgtgtttgtatgtgtatgtatgtatatatgcatgtgtatatttaaaggcctttataaattctataatgttatgtttaattggcagttaaatgttttaatttccctctggcacaccgaactttttctccttataccttatcatgtaaattttgctatctaatcttcacctgagttatttcctttaatatgcaaatttggggctatttagctaactactgcctagggtgatgcaacatattatcaaaaatataaaagtctaaaataaaaaaaaaaggaaaacaaaagtcttttctaaatctataaaatacttgtatcagaatgcctaattacatctacatgtttatgtgtgtgtatacaatattttcactactaaaaatatatgaagagctctaatcaactggctttaaaaaagcactcaaatcaaatacagaaaacaaaaaaaaaccagaagagtagtcaaatgttttttcaagttcatgtgacttaagtaaaatctttactaaataaaccagcattaaaattatcagtaaataatatcagcaatgtctttagaattgttagcagttttttttttttgcatctgttgatcaagtagtttaatgtttattcctgtagaatactataagatttgccataagagttataaacgataaaacccagcccaagacagaatgatctttgcttgtatatgcttataaaatattgttggcttaaatgaaaacaactgcatactgagttattggtataaatacccttaaaactaaccataagctttattactaaagtaaatatctgaaattcacagctataaaaagggtttatagaaaaatatattaaatatttgctatcacagttttttgtaaataatctaggtaaactacaagattaattgggtaagtgtaatgaaataaaatcttgtaaacaaacttgtcataatttaggatctaaggttattatttgatataagtatctgggtaatttgtaatttaaaaattataggaatacttttttaacattcttattagaggtaaaatatctttgtctaatccaaaccttatttaagtgttaggtttaaaacaaggtaaaaaaaaaaaatcaggaaataatagatgcaaagaaagttaaagatgtagaaagatatttttggtaaagaatgtaaaaagaaaaattattttatacaaaaaagaatcttgtatggtgaatttttgccctaaaataaaataactgcgttgttcaaggaagaaagatatttggggtaaaacaaaaagtctaaccattgtgaatgatctatgtaagtcataataaggttagtaaaatgaatttataaggggcttgtgtaattcagttggctataattaaaaagaaatcataatctttctagaaattgatatttaatactaaaaaacgtacatgaatacaaaactaaataattggttaaaacaagattttattacaaatattgactttttgtgggggagggggcgaacggagtcttgctgtgttgcccaggctggaggctggagtgcagtggcacgatcttggctcactgcaagctccacctcccaggttcatgccattctcttgcatcagcctcccgagtagctggtactacaggcacctgctaccatgcccagctaacttttttttgtatttttagtagagacagggtttcatcgtgttagtcaggatggtctccgtctcctgaccttgtgatctgcctgcctcagcctcccaaagtgctggaattacaggcgtgatccatcatgcccagcgaaatactggcttatttttaatgcaaaaagtttttaagtttttaaattctataatctgtttaacatttttcagattgagatctttaaagcactactctcttttaaaaaagtcttaaatgatgactttctccttcaccttttgttggctcctgtaacttttactaatctaagggaaaaaaattgtttttgaaaacaggcaaatatagcatattttagacatgccttttggctcacgcctgtaatcccagcactttgggaggccgaggcgggtggatcacttcaggtcaggagtttgagacacagactaaccaacatggtgaaaccccatctctactaacagtacaaaaattagactggtgtggtggtgggtacctgtaatctcagctacttggaaggctgaggtaggagaattgcttgaacccaggaggcagaggttgcagcaagctgagattgtaacactgcacttagcctgggaaatagtgagaatccgtctcaaaaaaaaaaaaaaaaaaaaaaaaagccttttattctgcatagctgttatacctctatctttatatgtatcacgtggaagtaatatttcactttcaaactaaataaaatagctctaatcaaataacttaaaaatgtaagtgcttatcagattggcaaaagctagctcagatgcctcttaatttatataaccttagtaatctttattaaaaattaatttggtacatttaatctcaaaactctccagtaatttaaaattcttaaagtcatgtttaaaccttcaggatttttcgcaccactggaaatttgggttactaaaaagttaaaataataaaagcataaaataagcttttgttaaaattttattaaaattttataaaatacaaggatgtcaattttcaataaatgtaaggtttttggttaagaaactgtttaaaacttgctttaaaataaaggaaattatacagataaaattaaatgaaaaaaaaaaaaaactatctagggcaacaacaccctaagccctatggttatcaagaaaatagttgatatagggaaagggcaaaaccatgtaactatttaaaaaccaaagggtgtaatgttaaggaattgtttcattttgtagattagtatcattcagcttctttaaaaaaaactttagtggattgtagaaataactactttaaaaacaaaattcttaatttcaaatgcttcaaaatgtaagcccttgtttgaattaatgcaggacccacagctcattagtgaacaatcactgatgcacaggaagctattcctaaaaaagcaatcagcctagtaggccagataatgcccattataaggtctgtttgccctgagaaggggattgcccaacgctccctataaaataccaagtaaagtaccccagatgaagcagttgacatgtttcatatgcaagacatgttggactagctttatgataactgggatatcctcccacctaatacgtctgttacccacgtcatggtaaatgtgggggttaaaggggccccttttacatgggtacccctcccacagaatcataggtttatttaagaagccttatcaaatctgctatcccccataggtcatacagatgcaaccccctgctgggaaccccgacccttttcaccagaaaaggtaaaattggtctgggggtaaaacggctttctggaaccagagcacaaaaacatacaggttaatagaattataaaatgtaagatgtttaaacaagatttatgtaagttagtcataaccacttttacttaaatgccttataaaaataggtactatatctaactgggaatgttttcccctttctaatactataaaaccaaagacatgtaaatctgctcatgtaaattctccgctgcatagccttttgtgtggagcatttattggggctaatggcaaaaaccgtaagtatttttcggtaacaatgactgagctagagaatttctacttgatggggcatttactgctttgctatggaatattaactaaagctatccctatattaatggaagtaatgtttcccaaaaagttccataataaaataaaaatggtttacatgaaatcttgctacctgataagcaaaaagcctcttttctaaaactaattgtaaggagttgctaaactccagtgcctaatagctctcgtgagctgtttggtctgtaaatggcatttccaaggtaaacaaacatctcgtttcaaaagctgctgctctggttaaagaaggattaaaatatatgtatatatattttcttttatttggggaaagtatgtttttataggcaaatttccctttctaagtcctccagaattcagattgtagttttatggcaatatagttgtctgcataagttcaataataattttttaaaaaacaaaggcactcgttattttataaagactgaaactaaaataacctatttttaggtaaagtttcagtaaaaccaactttaaaaaaattctggccgggaacagtggctcacgcctataatcccagcactttgggaggctgaggcaggcagatcacctgaggtcaggagttcaagaccagcctgaccaacatggagaaaccccatctctactgaaaatgcaaaattagccaggcatggtggcgcatgcctgtaatcccagctactcgggaggctgaggcagaagaatcgcttgaacctgggaagcagaggttgtggtgagccaagattgtgccattgcactccagcctgggcaacgagagcaaaactgtgtctcaaaaacaaaacaaaaaacaaaacaaaaaaattgttgcaaatcaatttcttactacattttatacaaataatcaggcaaacataataagcctaaaacttaccttgcacacaaattgaccttgctataatattctctttaataaaaaaggtggctaaaaaaaattgtttcaaaggcaaagcataacacttaatactggatttcagccttaactttttttaagtacaaattaaatcattatttcttggcataataatcctctaaaaagtactacattataatttttcttcatatttttagttggtaccctaaaggagtaggttccttttcctggtctaacatacaaattactattatagctgtcaaactataaatgttatttatctctttttgttttacttccaaaaaaaccaagatcatggtattctaaagaccagagatacaaatctccctcatttggcatcctactgggcccagatctgttccactgctaatgctctgttgctaaaactatacaagccgcctccctctaggcccagggactattgcagaagaggtaggcacgtaagattgtaagggccagttttaagggataaaattaaaacaaaatcaaaccctccaaatcaaaaagggggtactaaaaatgcctaaaccgctggtaaaacaatttggttgccttttaaactgttatgtgtcacttttgcatccaccccaaccataaaaattttctgcttactataaaattaaaggaaaatatttactaacaggataaaataccttgtaacaaagtctcctgggtataatactcccaattatgagttgtaaaaataaatctatctatatatatttaatttttcagaacagtgcttatgtttgtatggctaattgctgtaagtctgtaacaaaaaccaagctcacacacaacagctcaacacataaaagttaaaacaagtcagtcttacagcttttccttttggtttttctatctgcctttttacttaaaacaatagtttaaaaaagtcacaaatgcctgtccacatccatttttatctggcctaaaacaattaattggctataagtcttttaactcttaaggccctcagctataggaagtcctgccaagaaaaaaatgacactgtagatttatataactttccctgtaacaaaaccttttctctcccaaataccagtatatggtgcaatacaaaagtggggagaaaaatagatttgtctattgttaacaagtctataacaatttaaacaccaagaaccaggcatttcttgcatttaatttataccctcctcaggatgctatatctataaagataaattagccagaggaaaagattaaatttggctgggtgcggtggctcacacttgtcatcccagcactttgggaggccgaggtgggcggatcacctaacgtcgggagttcgagaccagcctggccagcatagtgaaaccctgtctctactaaaaatacaaaaattagccggatgtggtggcaggcacctgtaatcccagctactcgggaagctgaggcaggagaatcgcttgaacccaggaggcagaggttgcagtgagccgagattgcgccactgtcacttcagtctgggcaacagagtgagactccatctcaaaaaaagaaaagattacatttattaaattctaatttaatgttggtcctacaattctcaagtaagatttatcaaaagatccaaataacccttaataaggaagggaaacacattgtaagtctaatcaaaaatataataatgcatatgggttttttctggctcattagtttgtttattgccctctatttctacctgtaaccttggatgcccaaaccttcactatctttatcatattactatattaacattaaacattttcttgtaaatgttatgccaaatgcagcagaagaaaaggcacgattaaagactcgaatcataatagctcaaaaaatctgatctaggattttttttttaaacaaaccctaggcctgactccatctcaccccttaaacaattggctattacatcacatcagaccatgtcctcccccattattcaaatcactaatatttaaaactattaccaccaatcagactacatgggaataagcattcctagtgccatgaaacctcaccaaatgaccaaatcaaacacccctaggaataagcctcctagtgctgtgggaaccgatgctgtttagttggcctgcaggtgcattctgtggaaagctttttggccaagagtggggactaaggactaagctcttattttttttatcttacccaaattcctacctaaggggtctatggagtcatgtcctacaaaccataaattctcatcagatgggttttatttaaccctatatattgtgacttacttttcaatctaactctggcataacattatgagacagggaaaaaaaatgtttaaccccaaaatatatttccttgccataccttaaaattgccctgcaaagtcacttgtggaaagaatccacattctatagagaatccccttgcccctttgttttatttccttccttctcagatccaggagataatcaactaagagctagacatgatttaagtccaatgaaaaaccatttacaacctgttatctctaaagtctgctatccaaaaagcttcctctgcacaataaaacttggcctccacaatcctttatctttaacctgaacattcctctctatccatcccagatcttcagacaacctcaaccaattgtcaaccagaaaatgttcaaatttccctatagcctggaagcccctgcttttgagttgtcccgcctttctaaaccaaaccagtgtatttcttaaatgtatttgattaatgtctcatgcatcctaaaatacataaaccaagctgtaacccaatcaccttgggcacgtgttctcaagacctcctgacggctatgtcatgggccatggtcactcatatttggttcagaataaatctcttcaaatattttagagtttcactcttttcatcaataatgttaaatattttttttttattctgaccaagtacttgtataaatgtttgttcagtaaattttctcattgtctgggaatacttttgtagcaattctattatcctattatatttcagtgcattgttcataccatatagatacaagaaatgtgtatgaataataagatgctatttgggagcaatctttcttccaaatttgaactaatttgaactactgacatacattttagttttttagtattctgttggctacatttgcttatcaaaggttaaaatttggattcattgatttataccagtagttctcagctatggactaagtgcctccaaggcacatttcacaatacctggagacactttttcttgtttgcacaaaggagaagttcccattgacacttgtagggtagaggccagatgctgttttatacttcaaagtgcacaggggagcccattacaacaaagctttatcctgcccaaaatgtcagttatgtcagggttgaggaactctgatctaaagataaaaataatatgaataaaaatgtaaagaaaatacacataaatgcagttactcaaattagtaggcattatgagtgtctagtatttaccagatttgtgcttattcaaaggtgaatgtagatctatgtgagagataaaacacacaaatatacatttttaatagataagtatttttatgaaaaataatttatttatatcagaaatgacagtaacagataggcgaggaatttgtgcatgtaaatagcatacccatgtttgaacttacagattaagcataaaatgcatctcatggaatgtcttgggtggagatgaatagaggcctgcatcacgggtagtaaaagaatttactgaaacagcagtgagttaaataaagcaagtttattagagagaaagtactttgcaaggaagcaacgggcaacacagcggagaagggaatgtctgcaaagaggcaggggctggaggaaagttttacagggtcatggtgctaggactacttgcatggagtgaggcatttgggaacaggatattgtgccactgggttttttgtggttagctgtctccaaacaattgttctcccctccctggggcccctctttgttgttaagttatcaggactccacatgaaatatttagcagtcatctgtaatacaatttactgtggagaactgtgaaatgggaaggttatatttttctgttggtgaaaagagaaataggagattgcttcaaaatggggtagcctaccataaagaaatgaaaatactggaagctttatgctttcaagtgtgtgcttgacacttcagatgaccttgattacattttgtttactctgcccttaaatttattaaatctacaaatttccaattgcgtacacatttatactttagcttttctgtaaccactattactgaaaccatggtaatgaaatcatctttgttagaattctgtagattgtcaaataaacttcagaaaaagtgagtctaattgcaagttgattctcaaatatcaactgataatggttgctggaagcattttaatattttattagatggagacagtttgaaatttaaagacaacttgaacttgcttgcttgaagtcacaaaatttgcattccaaatttgaaagaatggaggtaagaaaggaggcagtttaggaagagaacactatcatgaacccaggtgctttcaactatcatagtatttaaaccttactgtaactattttaagtggatattattatcatcattatataaaaggaaatgagactaattgttctcagtgtccagctcctaactagggaggtagcttgaattcagttcctttgaaatgaaagttactggtctttcctcatatgctccttctttttgacagaatttatactaatgttcatgacttcattgaatctattttgcatgagtgattttgctgaaggtaacagatgaaaaatacacacacattgctgatgaggggctcctaaagcagacttgatgaatccataagatggaacacagttaacaagttaagaataaacatagaatattccattaaaatatacctttaaatttgaaatatgtaaaataataatctagtgtaattagataatttaaaacctctatttttattttatttacctcggtgaggcttttggaatctgaaaaatgtatcacatccaaatagtattttacattttgactttttgcattatttccttatctgtagagaccacatccaaatagtattttacattttgactttttgcattatttccttatctgtagagacccttaatactactaatttttccaaatgtataattatgtcatatatttctttaagtcaaattttaattcaagtatcaaattatcattttaaccagctcttccttgtgttcctggatacccatcaggcttaatcacactgagttagaatccctaaccactatcttaatgagtgaacctgctttgttagtgtggctggatgtcttggcttgccagaaaaccttggctttatcattttaaaagtttgttctgacttcttagaaagtgttatttgagttacatggtttgattgtttattaaaacagtattataaatgcagtttagcttcaaattatacattttatttgtgttaaagactagaatacctctgactcatttcgtattgaaagagacctagccggccaggcgtggtggctcatgcctgtaatcccagaactttgggaggccgaggcgggtggatcacgaggtctggagatcaagaccatcctggctaacacggtgaaaccccgtctctactaaaaattaaaaaaaaattagcctgacctggtggcaggcacctgtaatctcagatacttgggaggctgaggcaggagaatggtgtgaacccaggaggcagtgcttgcagtgagccgagatcacaccactgcactccagcctgggtgacagagcgagactccatctcaaaaaaaaagaaaaaaaaaaaaaaaagctatccaggaatcattagagtttacaaaatatagggatttttaaaatttattttattttatttatttttataatttattttatttatcttttgagagggagtctcactgtgtctcccaggctggagtgcagtggcatgatcttggctcactgcaacctttgcctcccaggttgaagccaattctcatgcctcagcctcccaagtagctgggattacagatgtgtgccaccatgcctggctaattttttatatttttggtagagactgggtttcaccatattggccaggctggtctcaaactcctgacctcaaatgatccacccacctcggcctcccaaactgctgggattataggcatgagccaccacacccagccaggaataactttttagagtaaaaaaaagtaattgattatttttggtttttgtagaagtaataagacattttgatactttcaacttcatttattttctgtgttgttttaaagacttcttctcctagataacgagataattttgtaactttgctgattctgcatcagttgccatggtttttgattggtgctttactacctaagactgtacaaataacaataatcccaagaaactgttttttgagaataaaattttattaattaaatgctcaagttaaagcatttaaaaataactttcctgagtgcatagaaactgactaagaatcagacaaagaggctaacatctttctgtgtatattaggccaaattgttgggtgagatgaatgaaattcagaataaggaggattgagaggtgaagccagctgggcgtctgggtagggtggggacttggagaacttttgtgtctagctaaaggattgtaaatgcaccaatcagcgctctgtgtctaaaggattgtaaacgcaccaatcagcactccgtaaaatggaccaatcagcactctgtaaaatggaccaatcagcgctctgtaaaatggaccaatccccaggatgtgggtggggccaaataagggaataaaagctggccaccccagccagctggggcaacctgggtccccttccactctgtggaagggttgttcttttgcttttcacaataaatcttgctgctgctcactctttgggtccacacaacctttgtgagctataacactctctgcgaaggtctgtggctttactcctgaagtcaggaagacaacaaacccagtgagtggaacaaacaactccggacaggtaacctttaagagctgtaacactcactgtgaagatctgcagctttactcttgaaatcagcgagaccgcgaacccaccaggtggaacaaacaagtctggatatgccacctgtaagagctgtaacactcactgtgaaggtctgtggctttactcctgaagtcagcaagacaacgaacccagtgggtggaacagacaactccggacaggcaacctttaagagctgtaacactcactgtgaagaagatctgcggcttcactcctgaggtcggtgagaccacgaacccaccggaaggaagaaactccggacacaccatctttaagaactgtaatactcaccacgactgtctgcggcttcattcttgaagtcagcgagaccaagaacccaccggaaggaaccaattcaggacacaggatgaattgatgaggatggaggaaagggaaatagttcaactctgtgagctcatgttataactgatatgttttcttctacaggaaacattttctaaattctctaagaggaatgccattatgttttaaaataggtttatgggatgttaacttttttcttccaaatcaccttctatttaaggtcaaatgttttgcttattttttgaattagaagaaataaatgccacagaagcattctttttaaaaggttcttttcaatagcatacaaatcaaagagatctacctatactgtattaatgggaggaccaaattctgtctttatactgatagctaccttataatcagtagagctaaaatggttgtgactgaagagtttttcttttcttttctctccgtttctccccttttcctccctgctcctttcttccttcccttcttgcttccttcccttctccctccctccctctctccctccctcccttcttccctttctttcctattgctaagaatacaaagaacccctgcttattaaaagttactttgagggaaaaatgtgatatttctattcttaaaaaaagtaggtaagcaaaatctattctaaattctgcctaatcttcagattattggtttatatttcaaaataaaatatgggaatattttatgattttctcttctctttttaaaaaataactagtcattttatattagaacaaaaattcaccaaacaagatcctttctctaaaaaaattttcttttctttataaccttccttatcaaaaatacatctttgttttcataacttccttcaaatctctttcccgtacttactagttccttactaccttgtttcataaataaccttttcaagctgataatttgaattatacgtaggtatttttcccaataactcaggaagttcagcaaacaacattaaattagtctcatttgtcagagaagacacacaaaccaagatcatttcattttggctgggtttctatgccaaaccttgacacctcaaaatatccagcaaagacaaacataacacccggacaaaaatgtatgctgacagttctgaagaagtttctatttttattgtatcaataattttaaagccaccttgtttgttaaaaatttccttaagtcatgtgaacttgaaaaatactttgggcttaacttatgagtgctttttttttaataagccaatttggtaaacgcaatatataacataataaatgtacgtacataaatacttctgatagtaatacaaactcaccagtttagaggctacttttgtttgctcaataggtaatgcaatgaagactgtgaaccaacattttgggtaaaacagctcccatggcagttttatttttatttttatttatttatttattttgagatggaatcttgctctgttgccaggctggagtgcagtggcgtgatctcggctcactgcaaccaccgtctcctgggttcaagtgattttcctgcctcagcctcctgagtagctggaactacaggcctgcaccaccatgcccagctaatttttatatttttagtagagatggggtttcaccatgttgaccaggatggtcttgatctattgacctcgtgagctgtccgcctcggcctcccaaagtgctgggattataggcatgagccaccgtgcctggcctggcagtttgatttttaaaggccaaacctcttcagactccaaagaccactgggtccaaaaagtaccacagaagaacatcacctggaatctattaaacaggaggcccaaccctttttagtatagcaacataaaagcctaaatacacgggactccgtcccactttctcattcaacagcaatctccagattccaaagaatattggggccaaacagtatcacaaagaacatcagtttaccaaattctaatttcccattactgtatcaaacataaagtcatcaaaacacaatccaactgctgcagcaacaaacaagctccaagtgtgtccaaacggaaacagtcggtatgcttcctctctctctcagttgggcctgatcagctgcaaacaaaaattccttacgaatttctcaattgagaggagcccatcccagtgtctggtacccacaaaagacattcacttccctggacacacacacacacacaacacacaacacacaattacaagcatgtccccaagtgtatccatactgaaacagccagggtgcattcctctctcagtcagttaggcttgttcaacttgcaaatggaaattcctttaaaaatttgagaaattgagagcagatcctgctacctgggcccacaaaggacacacacacctatccagatgcaggtgccaattttcaaaggcagctcttctgaggcaatcaggaatgtggttggggccagatgcaatggggccggagagagacagaaacttgcttccagccaaaattgggcaagcagctatttaggagatcttctaagactcccagtccttggcagctgaaccatgagcaatgcttttcaagtcagggaatgaaaatctattaccagaacaccaggagttcaatctaggtcctgctgctcactgcacagaaggccaatcactgagacaataagtattgccaaggaggaaggctttaatcaggtgatgcagctgagaagaaaggagaacagtctcaaatccatctccctgactgattaaaactaggggtttatatagcaggtaagaaatgtaacaatgtgtaagaaaacaggaactaaggaggggtaagaaagcaattatgataaatgcagggggcctgatgtctcattgtctggatgtggtgatctgatgattttcaattatttggtaccttttttgagaagcctaagtgttgtttcctaaggaaggaactcagataaaacaaatgtaagtttcaagctttaagaccagcagggtcaatttctgttcatctacaaaaactgtttatatacaaaaaccattgacttggtttcaccaatttattttctctgcaacaaggtgtacaaggcttcccttttctctacatcctttctaacacttgttacattttgactttgatattagccatcctaacaagtgtgaggtgatatctctttgctttggattgacacatttaaaaagaatgcttttagcattatttaaacttatatttattctaacttactacattagcaaaacatttagtcttcaatagaaggtgatttgggagaaaaaaggaattatttgtccctaaattgtttccatgataatgtgtttctactccaattcctcaatctccctcatttttactctccatttgaaatctgtgtgtgttccaattaaaagtattctttcagaccaatatacgtgaaaagtggagcatagtgcagtattatgtaggagaagccaaacaagcaaacaagtaaacaacaaaggaatcacagtcatggtaattttcagcacttagttgtaagtaatattttcaaaggcttactaatttaaatactgaatatagagtcaaccaaacttattccaatttttgggtggttatcattttgtgtagttatgtcacatagacacattgggaaatggggaggtaaagcagtgtagagaagacaaaatccctcatgtgctctcatagaaaggtaataaaatctaaaattgataaattgcaagataataaattatgtatataatttagaaatctggtaatgccagaaaccaaagcagataaagcagtaaaaagtgattgccttttatgagagacgagaggaggagtgagaaagggcctcacactattttgttaaaagtcttaaataatatttgaggaaaaaaaatggatcactgggagaaaagatatttatggaaaataattatgttattattttacatctttatttgttaattagatttttggtgtgattgtcaatatttataagcttctgaggttttgcttttaatatgtatttttattttgagggtacatttcctaaaatgcaaaggcacatataggtgcctatgacaggcacatatacgtgtgttcagcattttatatagtaatgaagtcacaaatatagtcaattgaaagtaaaaatgaaataaatttagatatgctttttaaaagtgaattctgtactctgttcattgaatttaacacatctgctcagttttcaaaattattgtaatcacacaacagaaatgattagtaaagataaacatttcaaaaatgttattttaaaatgcttgatggcactaacttttttttaaagcagcttggtaacttttatggctgctagatttaataggagtcaccatggaaactgtctcacaatgctttgcagttgaatgagatataaaatacccatttaaaaacataaacactttgacagctgtaagaatatttacattttctcaaattatgatgtaatggtattgctaagggaatggagaaataagcattaaaacagaagatactcttggaattcttatgaactactcaggaactttggtttatctttatagatttttcctactttttgaaagatagtgaaagattagaaaaaatcataaaattcaagacattctgtccaagtatttagaaatcacttgctccttttcactcctttatctccatgctacatatccttttgctctttttttaatcttctcttcctaatctgcctgacactttatatcttctaaaatttttttaaattaaaaatagacagtgtattttaatgatcttcaggatttattcagggatgcactgtatcattactgttcttagtaaaaattgacatgtttgcttcattatctgaagcaggatgtgcagtgattcagctagaactcaggataagatggagggacacacagctccagccataacatctgtgttcaaggcagaaagggaaagggtgatgacagccatgtctcctcctccccttctcccccctcccctctcctccctctcctccctctcctcccctctcctccttcccctcccctctcctccccacctcctcctccccccctcctcctgccccccttccccctcctccccctcttcctctccccccttctttctccttctttctttctcctttttttgtaatctggaaaaaaaattcttccagaagccctcttcaccaagcagatttctgattatgtttcacagttgggttttatagatgctcccagattaaagaagttaaaaaaattaaacacgacttttcagcatcgatatataattaaaaatggcaagggaatagggggttagaaatggcatttctatagtcagtctgaagtgtctttctcagtgaattaaggatggaaaaatggtgaaggcagtgtgtcttaaacacaagtaacatttttgcaaaaagcacttaattattgccttggagtacaccacatcatggaaatgttgcacataactcgtgtgtgcaacattgctttcatagtaaggcaagtaaagcatcaaactgaggttcagagagatcagtggagttgttgctacacttcagcctgtttatcatgcctccttatcagtagggctcattttgattagtggctagaattgagagaagcctatgcaagcattttccactattttttcagaattataatttaggagctactcatactccaggatgatctcatccattcccattgctttaaatttagcatctgtattctgcaattaaatctgttccttttctggggttatctgtctcagtgaatgacaatattcctgttcgttggccccagacagaaaagttaatacactcttaaatctcattcctccattagtattgacatccaattagtcactaaacccttcctttacgttcttatcatttatttatttttgagatggagtctcgctctatcacccaggctggagttcagtggtgccatcttggttcaccataaactccaccccccaggttcaagccattctctagcctcagcctcctgagtagctgggattacaggcatgcaccaccacacccagctaatttttgtatttttggtagagacagggtttcatcatgttggccaggctggtcttgaacttctgaagtcaggtgatcctcccccctcagcctcccaaactgctgggaattacaggcatgagccacagtgcccagcctaacccttcctttatatatctctaaacaaaattttgtttcaactttgtttgaagacaacatctttctctttgaaagaaggttcttaatggctgcatacatttaatggtatggatcttgcctaatctagtcagttttttaaaattttattggaatccaaaattatatgcaattcacccttgaacaatgtggggggtaggggcgttgaccacctgtgcagttgaaaatctgcatagaacttttgactcccctcaaacttaattactaagagcctattgttgatcggaagccttactaattatataaacagtcaacaaacatatttttatgttacatgtgttatattctatattcttacactaaagtaagctagagaaaagaaaacgctattaagaagatcataggaaagaaaaaatatatttactattaagtggaagtgaatcatcataaaagtcttcattcttactgttttcccactgaatgggctgaggagcaggagaaagaggaggagttacttttgctgtctcaggggtggcacaggcagaaaaggtggaggatgtggaaggggaggcagaagagacagggatactctgtaacttcacagaaatacattgtaatttttgtcttccttttttctccaaaaatgtttctatatgttaccaatcattcttccaccatttgctttagtttcattgcccatattgtagaaagatcaatgtcataaaagagtaaaaatcagtcttgagtaaatcagactccttctgccagattgtctgatgttaatttgttttctggcactgcttcttttacatcttcctcattgtcactgatttggaagcacttatcctcccatcttctgttaattcttctggtgtggtgtctactagctcttgattttcgtcaagattcatatcttgaaacccttcatcccactccctctttgctgtatcgacaatctctttcacagtttccttgattgactctatcataaaccctgtgaagtcatacacaacatctgtacacatgtttttccagcaggaatttattgtttcaggcttgatgacctttacagctttttaaataacaatgatggcatcttcagtagtgtaattttcccagactttccaacattctttatatcagggttttcttccacagtattgacaatttcttacgcagagtaccatgtgtaataagccttaaacgtcctgatgagccccttgatctaaaggttgaattagagacattgtgtttgggggcaagtagaccacttcagtgcctttggtgtagaactcatgaagttctgggtcaccaaggtcattgttcaataacaatagagctttaaaaggcaatttcttactgacaaggtaattcttgacttcggggacaaggtattgatgaaatcagtccagaaaaagtgttcttgttgtccaggccttctttttgtacaaccaggactggtagctgatgtttatcttttcccctcagggatcagagattagcagctttatagataaaggcagtactgattataaacccaaatgaattgcacaaaactgtagagttagcctgccccttcctgtcttaaatcgtggtgctcatttatcttccttactaataaatatactttctgacattttcttccagcatagggcacttttgtcttaaaacctttttcaggtacatatatcatttctcctcaatgcttttcttaatggcttctggaatttgtctgttgtctcttggtcaacagaagctgcttctcctgttaacttgacgttttttaagccaaacctctttctaaaatatcaaaccatcctttgctggcattatatttattagtttttttctttcacctttcttttgctttaggttgtcacataatgacttagctttttcttgaatcatattagagcttataggtatgcttttcttatggctgtcctgcatccacaaaaaaaagctgtgtttttaatatgatataaaaaggtatttcataaaaagagcaaggttttcatgttgctagtgtggctgcagtgagagcttcagtaattttcttttttccatttatttacaatgatccttatgctgtattcatttatcttgaaatgtcaggcaactgcagctacagacctcattttatgattacatattgagcaactcaacttttaattgtaataatttgacttttctctgcttcttgggagtgctcccaaggtatcataatatcattcaaggtttatggtattgcactaaacatgaaaaatgtgcaagaactatgacagaccactttttactgtgataaagcagcctactggagagaactgctcatgaggcaatggttagaatcacctggtgttttaagctaatactggcaactcttgagctcatctcaacagcaacaggaggcagctacacaattattacagtagcatggtatgtactacagttaattttatacagttaaaatttaatactgaatctttgtatttatttacatgtctattaactgtgatggtgccatgtaggtatgatctgttcatgtgtgtaagttttggtaaattttaacattttataatttgtgtatattttgtggtagtaaatgataacatagactcgtatataatatctacatatattatttgcatgcatgacatacttaaactttcttaaatttttttatgttcctaggctacatagttcatctgctttttgatttatcacaaatctccagacaaatttagtatatttgttttttaaaactcatgtacaagtggacctgtacagttcaaattcatgttgttcaaggatcaactatatacatatatatagatttggatgcgaccttgtaattcagatatgtacaatttaagttcttagatggtcaatgtacatctctggataattttttttctggaatttatgcggattttttagtttttttgacattttttgctgtatgtttacatttgaacaacttgactggaataggatttggaaggggagttgtcataatttttaaccaaatgttccttttttataaatattattttattgtcttttggcaagatatgtttgaaaccagactagttttttcaaagtttatgccatctttatttccttaattaaatgaattattttatgtttttattttaaatgcagggggtgcacatgcatgtttgttacatgtgtatattgtgtaataatggggattgggcttctagtataactgtaacccaaatattgaatattggatacagtgttcagttggatagtcttacatttcctttctcattggatacaatgttcaacattagattggatatttttggagtccccagtgatgttagcctcatgaaataaattaggaagattttaatcattgcaatgctttagaatagtttaaataacaaactttcttaaactttattacatatacttcaatttttattaaagtatacatgtgcatagcttaaaatgtaaaacggtagtacaaggttcaaagcagatacaatcttttgaccttattcacaagggcaatttctcagatgccaactctattaatgctgtcttctttttattctgtgtttctaaataaaatacttgaatgtgtttgtggcagttatgatgaggtttggctttaatacagatcacaaatggcagtggcttatataaaacagaactttgcttctctgtcatataaatgtctggagggtggatagtccaggcaatgtatggcagcccggctccatggagttctccatggatgtttctatcttgtggctcagtagaacatgtcctgtattgctaatgttaccttatagaccaagtggctgcttcagctccagatgttacattccagctagcagaaagaagaatgagatgaagaattccctggctgccttttaaggaagatgctgggaaactaatacctgacatatctacaggccagaactcagtcatgtgactgtaaacacctaggagcaagagaagtagggaaacgcagccttgcacctccatagcccattgctgtggagaaggggagatagagattagaggatagggagtgattttccatttttatttcttgattttgcaattctagacattttctattaacatgttatgaaaatgtaggattgggatctcttacatccattaaattccaagtcttgatccttctcctcaccatttatgtttcttcctcgtattttaaaaaattaaatctctatttattgttcactattatttttacagagtaaagattggtcacggccaggcacggtggctcacgcctgtaatcccagcactttgggaggccgaggcgggcggatcacgaggtcaggagatcgagaccatcctggctgacatggtgaaaccccatctctactgaaaatacaaaaaattagccaggcgtggtggtgggcgcctgtagtcccagctgcttgggaagctgaggcaggagaatggcttgaacccaggaggcggagcttgcagtgagcagagattgtgccactgcactccagcctgggcgacagagcgagactgcatctctaaaaaaaaaaaaaaaaaaaaaaaaagattggtcacaggtgttccgtatagttttacatttcctttctcatacaatttttgtttttcctggagataataagtacttttcatttattcacttgtttctatatctgtcattgatttgtctttcaattgttcaaataaaagtaaaactctaataataaagtccaatatatcagataacatatcatttttttccctagaagccacctggaggcctctgccctcttgctttattctacactagatgttctctaggcctgttacacagctgtcatcctaagattttctttgccttcatcctgtgaagtcccttccaattttacttgtgaagacaaacctttttggcaaatgatgtctcttcttctcgcttcatttacttcttaatactgaaggcaggatttctctgtaaacttctaggaatttgtaaattttttgcgacctcgaatataaaaatatgtattttacctctcacatttaattattagcttggctggtcatagaattctagagttcaaaataattttatcttggaattttgtttccttactttttaggttccaggttgcttttctggagtttgatgccattgtaattcacaattctttaaaagtgcctattttttaaaaaacggtatttattctggaagcttttaggattttttttctagagttctgaagctttgcagtgatatacttctatataaactttttccattcattttcctgaacatttgattgtcttcatcagtgtctaagtcatatccatgggtataaaaaaattattatttcagtgataatcatcttgctttccatttttcagaaactcattaagcattagcattcttcttctggaattcataataaacattggctctcctaaattgattatatgattttttcttatattttccagtttatccttttttggttctcctttttaagatgaaaattttttcagctttgtcttccaactcttctactgaatttatacttctaccaaaattttaagttccaacaattttttgttatcaaagtatttattagtgtccttttattattttaagaatttaatattttggtttttttgggctactgataattaaaacttttgtatcctaaccctttatgtaacatttctgattcttcaaaaactttgttttgatgtttgtgtttttgttgctgtctttcacagtggaaacttttccaaactatatgatgtcttcatatttaagagtgagacaataaaatgttcattcaaaattgtgctttcaggcctcatataggatgaaatagctggttactgaggaatttcagtgtctatgttattttctaaagcttagtataaactttcagtctcccatctggtggtggaatgggtcaaagtctcacaccaagttttcatggggcctgatgatagagaggtgaatgaggatctcacagtttgacttgcacttaaatctctgtcttcagtaacatgcctcactttgtcttctgctgtccagagcctccacaaattgtaaatatcttggtgtcatctacaattgaaaaggaggtagccatgttgatatgtgggtttggagggggactttagagaactaatatttaggctcaagttaatcaatatcttttttattcagcaggctataacctcctgatggcttcttcctgcccagcacagacaaagccaagtcactgagtttaattgacgcgagactggctacaccatgtaggagacagagttattacacaaatcaatttttccaaaaattcagaggctagggtttttcaaggatactttggtgagcaaagggatgatgatgtggaaaaatggtcctcttctggatggggccacaggataactggtgggtctgggtgaagccatctctccagacatgcaaaaacctgcaaaagacagctcaagaggccaatcttaggttctacaatagtgatgttatctgcaggagtaattatgggagttacaaatcttgcaacctccagaatagtggctggtaattgtattcaggctcctcacatcttcctaatgtattggccattcattacctttacaaaggtagtttagttttgaggaagggctattattatttaaattataaactaaatgtcttccaaagttagcttggcccaagccctctagtaattaagaagaatttggaggttaaaggcaagatgggagttggttagatcagatctctttcagtatcataattttctcactgttgtaatttttgcaaaggtggtttctaggtcactccactttccaccattgccttcagtgatacccattgctgcctctgattcttaagcttctgtggccctttgagttgcaaatcttttactcttgcaggcttccttcccactataggctgttagcagaactcagaaagctgaagcattcaattattattatccatcatcttttcattttccaaaactgtaatgacctcttttttctgctattaatgtctcttctattatctctgtgtgtttggcttaatatatctttttaaattctttgccttttattttagtatatttcaggaggagtgaacataacacatttcttcaacctatgtttaattggaggttgattatacattaaatatgctaactttaatattctatggtttttatgggtataaaacattttagaatttataagtatattttctaccctttcctatatttgccttcctaatttactcagtggatcatatatttattcagtatgtttgtactcaaaagttttgatcttttccttagctatcattatagcccttttgtcattactgtttctgatgatatattatttccccatggttttttgggggggttggatttactagaggtttatctattttattgtccctttctaagaaactgctttttggttttatttctcacttccagtttcttttgttaaaaaaaatgtatgtgtagccacccaacaggttcaccttgccagctgcctagatagagccaatttattgagataggggaattgcaatagagaatgagttattcatgcagggctggctgtgctggagaccagagttttgtaattactcaaattagtctcctcgagaatttggggattgacatttttaaggacaatttgttggataggggccagtgaactggagtgctgactggttgggttggaaatgactccctatggagatggagtctccatagggttggagatgactggttgggttggagataactccctatggatatcaatccctatgatttcatagggagtcaatgctgtcttctgcactgagtcagttcttgggtggggagccacaagaccagatgagtcagtttactgatctgggtggtgacagctgatccatcaaatacagggtctgcaaaatatctcaaacactgatctttggttccaaaatagtgatgttatctccaggagcaatttggggaaggtcaaaatcttgtagcctccaactgtatgactcctaaaccataatctctaatcttgtgggtaatttgtttgttctacaaagacagtctagttcccaggaggaaggggggttttttgagacagattgttactgtctttgtttcaaactgtaaactaagttcttcccatagttaatttgggctatgcccaggaatggacaaggacagcttggagattaaaagcaagatggagttggttaggtcagatttctttgactgtaattttttcagttacaattttgcaatggtgaattcatgtgtatttacaaatgcatttactttgtgctttgttgtaatgaattctttttcttttttttttttttttttgagacagagtcttgctttgtcgcccagtctggagtgcagtggtgcgatcttggctcactacaagctccgccttccaggttaatgccattctcctgcctcagcctcccatgtagctgggactacaggtgcctgccaccacgcctggataatttttttgtatttttagtagagatggggtttcatggtgttagccaggatggtctccatctcctgacctcgtgatccaccctccttggcctcccaaagtgctgggatgacaggcgtgagccactgcgtctggcctgtaatgaattcttaacatgaaattttcttaggtttattttgtgtgttttttaaaattattgagttgaatatttaatttatttttaatatttattattcaataataaatataataaagcttttaaattttctactaggatatgataaaataagtgtttcattaggaagcattcctcccattattaatttatatgttgtatgtcattacactttctagttaaaataatttattgcctcagattacaaaagtaattgcaaacttgtttttaaaatacttaaatatagaaaaatgattatattagtctggtgcagtagtaattgcagtttttgccatttaaaagtaatagcaaaaactgcaattacttttcaccagcctaatatatttttagtgaggttccaagcaataaaaggtatgtaaatagaaaatagtatagcctgaagctgtaagaactactatgaagccagataaagaaagataaacggttagggaatgacaggaggggtaggggagacatgtttagctatggtgttcagaaaaggcctaggaatgtgacatttgaaaagataacttatggatatccctgagcaatgtgagcatttgggtgtagggggttgtggtgcagaactaagggaatagccagtgtaaaagtctcaggcagaaactaggttatttgcacaaaagcaaccacgtcggtgtgaaataagtatggtgagggaggagaaaaatgttcttagatgagagataaaaggtgattgggggcagattatttgacaatccatagaaagctggacttgaaaaccatctatggtcacacctgtaatcccagcactttgggaagccaaggcaggcggatcatgaggtcaggagatcgagaccatcctggctaacacggtgaaaccccgtctctactaaaaaatacaaaaaattagccgggcatggtggtgggtgcctgtagtcccagctacttgggaggctgaggcaggagaatggcgtgaacctgggaggcggagcttgcagtgagccaagatcatgccactgcactccagcccgagcgacagagcaagactccgtctcaaaaaaaataagaaaaccatctatgggtattgagcaggagagggaatgctctgacctaagtatggttagtgttgtgtttgttactgggtggactagatatcatgctgcaggaataaagaaagcagggacaccaggtagaagaatattctagtaatctaggagagtgatgacgaaggtgactttattaagtttgaacctacactagagatggtgagaagtagtcaggtttaccatctgatttgtgggtggagaggatttgctaataaattgaatttggggcctatgcaaaagagagttaaagttactgctcaacttttcggcctgtgctctttggtgcttttgtttactaagaggaagatgggttggccaaaggcagagtttttggtgtcagataaatcaataaatctgtcttagatactaactttgaatttgtctattaaatatatcccagtggagaaattgctttgaccatggaatataagcatctggagctcaggtgagggcctgaggcaaagatacaaatgagccatcagcccagggatagtgttaaaaccacggtcttgaaaagaactgcctgcaggtattctgtagtggtgtctgcctttctgtagataaagaaaggcagaacggggctaagtaataaactatatacaatgatgctgtgagtatgaattgattgccatttgggggttgataattatatttggaaagatgaggtagttggtgatttcaacaaaagttaaatgatggggaagaaatattgaccagaatagattaaagagcgactggacaatcaggagccagcaagaccccttttggagagttttctgtgaaataatacttaaaaatattttatggtcaacagagtgtgttatattcatctgttttcagagcaaaaagttggaagtagataattggttatatgttttcactaacaattatgtgttataaataattatacaataaacatgtaaatatataaatataatatgtaaaatatggtagattgtattataaatatgcttgttatatttttataaattcctctaaattgtatagatataattttaatcttagaaattatatctatatacagatttataatgcacataaatacacttatgtacatatgtgcatatgtgtgctgtgtgtgttgttgtgggtggaactagctggggctgatgttatgggcaataaaggaatttgccaagacagctgtaggtaaggaaaggcagatttattagagaaagtatgaagatatgttgcaatgctgcaacaggcagcacagcagagaaggggctgtctgcagaggcaggggccagtgggaaatgttacagggtcatgctggagggggttatgtgtggaacaggttgttgtgccaatggaatgaggtggttgtacctgtaggttgtttgcaattagccttctctcagagcaattgttcatttttctccccaatctaggaccctccctgacctgggcttccctcctcatagttgcttactcatcaggactccatgtgtgtataatacacatatctataaagtctgatataatgagagagattaatgacaattattcacaataattttggttgtattaatttctccttatattttgctatgtatatagaattcttgattcaacacattttgtctgtaaaccatatatatgttccactaatgtttctgaatttttgatatttagttctgatatcaaatgtcagtctcactccctttactcagtggcctttgggctctgatactaggtcagtcccctggaactctggttccctcagctgcgtgggaaacagctctgctatatgctcatcacataggagctgtagctaaccagcagtatccagaatcagaagactcatcactgtctctgcccaatcattccttaatcacccagataacccagttgtttgcattcttccttactctctgccagtccccggttaatgttctcaggctccctcttacctctcgatgtttctaaaaactcattatttctttagcgtagcaacagcaagaaatctggtatttcatttctttgctatttcatccctgccctggtcatacttcctccccatcccactgtcagaaagaagttggtttcaggctttccccttcctctctgtgatattttacttctaccttggactttattgctttaatgtctttggtagaaagagccacacatggtgaaataatctctatgatctgagtcattatttgtgtcctttatatgttaatgcaagatagatggctttagaaaggactttagttttattttcaagacttaatatttcttcaaaattttattttggttttctacagaagcatatttacattgaagctaatgaaaattgagcttcacagtctgttcacatgatcatatgtttttgtgggttttttttttgtttttttgcaaaagtgcattatttttgtattatttttattaaagagagataatgttatataagtgtcagattccacaaaatctggatatatccttggataagttaaatggttgttttttccttccctcccttccttccttttgaaatagtttagggtcattggtcatgttttctggggtgttatctgagcttgtggtctcatgaccgagaatattaaggagcatagacacggacgccagagtgaggttagagcaaaagtttaataagcaaaagaagacagctctccatagcagagggatcctggacaagttgacattttacagtggaatgccaacttttataagaaactcctctcatctctgtagctgtttgagtaacttttcttatgtgaaaagctgtctgtacaactctccccatctttacagctgtgggatgtctctaggtaagcacaagcatagcttttcttgtttatataattgtgggtttgttttaggtcagttcccctccccttcctgtgcaagctactatgaagcctgccatagtcatgtctgaaaaagggaggaacattttgcctgggagcccactaatcacaaaaagaacaaaaggcttctatgcgggaccttggctgcctggcctacttatctgtacagctgcagcctgagttttcttcaggctgctgtatttttgcctgtagctgtgatttttcagagctgcttctccaactagccatagttgtctgcctaactgatttttccttttcttctccctcattaccccccacttcaggataagagaccctaactgctgttaggaaggtcaggcaatggtatttctagatacttcctgatggagaggggtgttgtgtcgagaacaccagctagggtttcttctgggcctggttcaaaggtccttggaagaatggcatgtccatgtggggttccatttgcagcactacttggagtttaatagcctctaggtgagaggaaacaattccggttatagcattgagtatacagggtccaaacttaacacaagacatacaagaaaaagaggtcccagtaaaggagagctaactaggtctaaaaagaagactggaatctttcaagaagggattgtagctacctgggactgaagcctgctctttctcttaatgtgtcaatgattctaatttgattcttaagcacctgtaagttttattccaattggctagaggtgttgatccaaaaggaacatgcttcatttaagagtacacaggtctttgggaggcggaggcgggcggatcacgaggtcaggagatcaagaccatcctggctaacatggtaaaaccccgtctctactaaaaatacaaaaaattagccgggcgtggtggcaggtgcctggagtcccagttactcgggaggctgaggcaggagaatggcgtgaacccggtaggcggagcttgcagtgagctaagattgcgccactgcactccagcctgggcgacagagcaagactccgtctcaaaaaaaaaaaaaaaaaaaacagtacacatgtgccggccaggcatggtggctcacgcctataatcccagcactttaggagtccgacgtgggcagatcacgaggtcaggacattgagaccatcctggcgaacatcgtgaaaccccgtctctactgaaaatacaaaaaattagccagccatggtggcgcacgcctgtagtcccagctattcaggaagctgaggcaggggaatcgcttgaatctggggggcggaggttgcagtgagccaaggtcgtgccactgcactccagcctgggagacagaacaagacttcctctcataaaaaaaaaaaaaaaaaaaaaaaagagtgcacaggtgcccccctactttggctgtaaaaacatctagggctcatctattttgcattaccactgcggctagagagtttatggattgttgttgtgcctctttggctcctactgatgtcttccacccttgttgcatcataatagagatattaagtactgatctctcaaaaagagaaataccagcaaatcaaaataggcctctggctatagcatgtcccattcctggtttttccagtataggattgttgtgtgcatgtcctccccagtcctctctctcagttagatctccataccatgttatggaagtaatagacctctgtgtttagtgtacctgagatagggtactttctagaaaggagcacagattatgaattccatcagatgatgttgccatgtcagtggagtttaaaaataataggtcggggaccactgccactatagtgcatgttcccctccaatgcctagggagaattaggtgtaaccaggaaccacagagaaaataaagccctgtcccttgaagggaggattctaggttgtgatgtgtaagagatgcagctagtctttgcatccgcttcataaagaggttccccttatatctaatgggagcatctttgatatagggataaaaatacaaagtatagtcatttatggtgccatttgggactctacacactaggtgggaaggatcctgctgacagatggagctttggaagataatatgtcctgaccagtatctcagttgattcttaatgcaggcgctctcagtccagacatctccttttcgcccactagtgtgtaggttattactagtatcaaatatcttacaggggtctgggattccctgaggtggcatatttggaaaggaccgtgtgttatttgctattctgatgtaatactggtaagaggagttacgcaggggctgccgctcaaatttagaatcacagttaggaggcgtggatgggttttttaagtttttcaacattttatctcacgtgttagattagctttctcctttttttaccctccagacctcctcacttttagagattgtaagtgtaatgttgcagtatttgagatttcccgggtatggcacttttcctctgctttcaaagcagagggaggcatctgctatcattctatcaacttcacctagtctaaggatgtgtcttatccccaggggatgtgtgttcctgggtagaattaaaagtgctcccatatcaagttccatttatacctgacaagttcttgatggttaagggcaaagctatcaaagggaaccccaggactatgagttaaggatcatcaagaagcctcccagtttcagtgttattaaactgagcaaattgttcagggaaaacccagcaattagtcttgctgtatagatgagcaatggctggtactgttcgggtcaaagactaaaaagcattcctgcctctaacagtgaatgctactaagcttgacagaaacaaatttgcctcttatctgttactgccatccctgcaatgaagataataactaagcaaaatattacagaagtgagactgtctgtctgcttttccactcaggaggtgccacagggtgtaaccctactgcaaaagcaaagtaagcaaaataattcctgcaagtatggtgtagttaatgatttccatctgagtttctatttgtcaaaatattggattttcctctgggggggtctatggagttatgaatttggtcccatggataatcaaagtccccctataaatttgcatcaaaaagaagctgcaatacctgacagcagatctcaaaaggaaaagtggaaataactgaaagaatctggtagggtaaaggtgggattgagttagatgggtagtcctcactcatttacttatcttttctaattttcagtgtaaggtgcctgacttcttcacattggtacctgggatgctcttctgggatgtcaggggctgctttctctgctttccaggctttgacttgagtgtgataaatccaagagttgatacctgcaaccttaacctttgagagagtagagaggaggacagtgtaaggtctttgcaaatcggggtctagagaaggggaaagagagggaagagtcttcactaacaccaagtcttctgggttaaataagggcagtcctatttcttgggggttcagcttccaatggttgttttcattcctattggaagtgggcaaggaggttatatatttagctaattcagaagtttccttgtcaaatagaaaatcattggtaagaaaaggccaaccacacattatttcaaaagggcttaaatccaatttggaggcagtgcttctcacctgtagtaaagccacgggacgaagagtaacccaagggaggtgagtttcttgagagagcttcctcaggtacctcttaatgacatcatttgttttttctatttttcataaagactgtggtctcgaggcacaatgtagatggtattatatgcccagtgcttttgggtaacagacatcttaaatgaggggtccaatgtcactttggaggtacttcaggagtccaaaacaagaagttatctcattaattagtactcttaccacctcagaggacttttctatttgacatggaaatgcctccacccagttaatcaagatgtctatctatactaaaagatatggaatgccccttacttttggcacatgggtgaagtctatcctccagtcttctgccagataacttcctatcctttgaatttggtggggaaggagctgcctgttgaggggattatttttaaggcaagtttcacaagcattaacaagctgaccatttttagtaggttttccccccaaaacaatctttgggtgcattgataagtcttatccccacctaggtgaaaggtttggtgaaggagtttaagaacttttcactgactagaggctggcaagtggactttactgtgctctgagtgtaaccatcccgagggctgaaaagtgtatccttgagatgtggcttattctatttctgcagaagaatactgaggtcttacttctcttatggagccctcccagattacaggggtctcaaatgtgtcagatctcctgggtctttttgctgctgatttggctgcttgatctgctagtctatttccctcagttatgtcatccacacccttctcatgtactctgcaatgcattactgccacttcctacagaaggaaaattgaggatgaagtctgcctatttcctgatgaatttaatggaagatccattaacagtgaggaggtgtctttccttccagatatcagcatggacatggagaaccaggaaagcatagttagaatcagtataaatgttaactgcctttcctttgctttatttgagcatccttctgagagcaactagctcagctagttgagcactgatgcccagtgagagatgtgcactctcaataatgacattcagggtgactactgaataccctgccttatgggtttcttgttctgtgaaggaacttccatctgtgaagacagtccaatctggattttctaggggagtttctctgagatcctccctggcttcataggtttgtactactatctgttcacaatcatgttcaggttctctggtttcctctgagaggaaagtgcagggtttaggcaagggcacatttttaactgaactgcagatcctctagcagcaaggtttgatatttgaggaggtgattgtttgttagccagagactccctttagaggatagcagtcctgctgtattatgtggagtataaagagttaaattattctccatggttaacttggtggcctctggcaccagaagagccactgtggcacctttagccaccaaatcaagccccttacttaggtaactgacagactgctgggatggaccttgggcctgagttaaaactcccaaggctatttctttccttctgagacataaggattgaatgcctttcctatgggaagactaagggccagtgctttaagtaaggcttgctttagctagttaaaggatttttgggcctcagattcccaggttaagagagtgagttttagcacctgagtgtcttttatagggtgatacaaagggtgagcaatttcaccatacctgggtatccacaatctgcaaaggcctgtagtacccaaaaatattcttagctgtttgaggatttgggaaaggggaaaggaggtaatgggcttaatcttctctttgcccaatgttctagttccctctgacaggagtaaacctaggtacttcactgaggtttgacaaagctgagccttaaattttgaaaccttatatcctctcttagctaggaaattaagaagagcttcagtgccttcctgagaagccttctcagatgaggtacagtggagaatatcatcagcattgtaaaattttaatgtgaggatgagacaactaagagagatctctcaaaattgcctgcccaaacaagtgagggctgtctcagaatccttgaggcagcactgtccaggttagttgggcagtctggccagagggatctttgaaggcaaacaggtattgagagtcagggtgcaactaaatgtagaagaaggtattctttaggtctaaaaccatgaaacatttagatccctcagatacttgggttagcagagtatagagattaataatcacccaattaattcgaaccacagcctcattaatgagatgtaggtcctgaactagcttacattccccactgggtttctgcactcctaatattggatgttgcaggggctgttgcagggcctaaggaggccttgtgcttttaagttatccatgatgatatctagtcctttttcagcttctggctgtagggggtattgtttctgcttaggaaaagaagtggaatccttaaggtgaatctggactggtatagcgattgttcagccaatctttccctgaattacccatacctgtaagttaatattggtttccactaagaggagataaagagtttgttctgaagccattaggatggcagctcacatatgggctagaatatccctgcctagcaaaggagtgagactttcaggcataattaaaaaggcatggataaaagcaggttcctccaactacagctgagggtctgagaaaaatttcaagttaagggcttccctgagatgtccatcacagtcatgctaggggaggagggaatgcctggattggagaggagaaccaaaagactggctccagtgtccagaaggaagtctactttcttgccttccacctccagaatcacccagggctcctggatagtgagggcagtttgagcttctggagtcaaggatctttgccaagaccagctcggctggggagaccctaacccagcagcactagaggaattaaagacacacacacagaaatatagaggtgtggagtgggaaatcaggggtctcacagcctttagagctgagagccttgaacagagatttacccacgtatttattaacagcaagccagtgataagcattgtttctatagattatagattaactaaaaatattccttatgggaaacaaagggatgggctgaaataaagggatgagtttggctagtaatctgcagcaggagcatgtccttaaggcacagatcgctcatgctattgtttgtggtttaagaacgcctttaagtggttttccaccctgggtggaccaggtgttctttgccttcattctggtaaacccacaaccttccagcatgggcatcatggccatcacgaacatgtcacagtgctgcagagatttttgtttatggccagttttgtggccaatttatggccagattttgggggacctgttcccaacagatctaagtcccaggatccatcagtcctgctggaccatctgtgagactggccttggacttggtgatttatgcctccagggacagtccaacctccagtggtccccaccacaagctagatagggtcaaggtggcttctttttgttgcctgggcactcccttttgaaatgtcctggcttaccacactggtaacaatttgcaggcgtaccctggggatcctggagtttataggcctgtaaagcaagcactagtgcctgtgtctctctcttgtacttcctctctttttcctgggcctcttcctggtccctgttgtaaaagaccaaggtggccatgctcaggagatttttctgaggtgctactcagtcctatagcctgcttccatagcttccttctgatatcaggggttgtctgattagtaaacttgttttttaatattaactgcccctcaattgaatcaggagatagagagatctgtttcagtaaagcttccctcagactttccataaaggccaaggaattttcatctggtttttgatctatcatagatagcttagagtagttaagcgatttggccctgatcctttataagcattccagtatgcacattagaaagtgttttctttcccactcatgtataggatcactggggttccaattagtattcttaaggggtactgcctcactccctgttggaaatggagtttcttgttcctgttattgttctctaatcccccttccagtttcttccaagttctttagttccccttcttggatgaggaggttttctttggctataggagacatgttgtttatcccaacttttctgctgcctgtaaggttacctgtttctccacagcagtcagggtttggattagaagaacataacatctctccatgtatgatcaaatacttgggttacttttggaaagcctctatatatcagggtcatcagagaaccttcccaggtctccctttatttgcctaagttcttgtagtaaaaagggaacttgaaccatagtggcatcatatccactgggcatttcttgcaggcataatagtgaagtcaagggagttggaggctttggagtggatggtgctggaatggccgatgatatagctggagggggcccaagataaggggtggggggtttgaggggctgaggcactcagaagttttctttgatggttttccaggaattagtttctctgattttggggaatcatccactatgtgcctgcctgatatgactgcttaaagagctggatcaattgtgcaatgcttacaaagatttgggttgtgtcgcaggacaaagaaagccagtacatagggaactttgaatcatttgccctcctgtctgcagacaaaatctaattgttggatagtattaaaattaacacttccctcaagaggccaggcctgtctgccctgcagttggtaataaggccacgctcttgtacaaaagaatatgagccactttttcttcagggtctgatgataaaagcaatcccagtgtctctggctgtacttgagaggagtgcaggctgaggatggttttttacccatctagaaagagaaaagagaaggcattccttagtctctttcctttcttttggagtgacccagcatggagaaaaagacagaaggggtgtcccccctctccccttctctctttggttgtctgggtcctggtaacctttgtagatgctgcccatgaatgcaagtgtgacctttttttcatggatcccgaggagctagttagcaggaatagtcaggcttatctgctgaagtccctagctctctgctggtgcttcccctttaactcccttgcgtgactggtatggatcccaggtctcccaggtatatggatcctgggaaaaaactgtataatagttgtacttgggcaaagccccctaatggagggaatgttctagctctaaatacctatattcaggtattttggcccagactaaagtactcattcctaaacaatgggtccgattggcttccaaacataaaacccctctttcttttagatgccattgcaattggatgcagaatggatgccttaaaagaatgtaggaattgaatggctgtcttccttcagatggagacagcgtggaggctaaaatctgcctttcaagggcaatttccaccacactgtcaaagacatagtttctccattcacagataagacatggagccagatgtctgatagaaaggtgcagatgagagaagagttgggaaattatagattttggacaaaggactaataagtctccccagggaaaaatcccatctgactagttggtatgacagagattggaacactaaaaagtagctctgactccaattactctccagacaaaggttagaaagggaagtttggggctgtccccacaacatgcctccccacaagaaaaaaataatccatctcatagagagactgtctagttatgctgcacagtgctggcttctcacatggaaaaagagacagcttaattaatattccccccatccaaccccattgagggctatcattgagagataaataggtctttagatccaagtcttggaatctccctgtttcaagaaaatcacagagacagcaattccttgaaatacattcttgattactaaggccccagctgactttacccaacaggattatatgcccaggttgtaaaaacacttgcaatattgcattcaaagaaggaataggagacatgatagccgcaaaacgaaaggaagaaaatgcaacagaaaactctggaagtcctggtgccaatacccagcaggctgtcagggactggagttagtccaagggcctccaggttacaccgaagtgtagccttggccaaaaacctttggttgcctgaggacctccttccagccccatgcaatggctaggtcctccacaaaagggaacttgattggaacacagccaacattcccaacaaccaagggtgagcagggttgataaagtcctctcaagaaagcctgtcccctgagtcttgtaagactggaagttaccctattggcttttaactgactgatgggccagtgtgtttttttcactcttgagagaacaaaactgagaacgagaagcctcagaaataaaagtcaagagttaagagtttgctcctactcactctttcgatggatcccaggcaagcccacactaataaaacagtatagggtcactgattacgttgtctgggatgttattcaagcttgtggtctcatgactaagaaaattaagaagtgtagacatgaacacaagggtgaggttagaacaaaagtttaataagcaaaagaagaaagctctccacagcagagaggggtcctggacgggttgccattttacagttgaatgctaaagcttttatgagaaacttctctcatctctgttgctgtttgagtaacttctcttatctgaaaagctgtctgtacaactccccctatctatgcaactgtgggacattcctaggtaggcacaaagcatagcttctcttgtttatataattgtgggtttgctttaggtaagtcccccccttccctccctgtgcaagctcccatgaaacccaccatgttaatgtctgaaaaggggagggaatgttttcctgggagcccactaattacacaaagaacaaaaggcttctatgctggaccttgcctgcctggcctgcttatctgtacatctgcagtctgagttttcctcaggctgctctatttttgcctgtagctgtgatttttcaggcaggctgcttctctgaggactagccttagttgtctaccgaactggttttttcttctacctcacttccttccttccttcttttttctttcttttcttccttccttttctccttccttctaccccacctttctctttcactctctgcttccctttcttttcatccatcccttccttccttccctccctctctctttccttccttcctccctccctccctccttccctccctgcttgacctttccttccttccttccttccttccttccttccttccttccttccttccttccttccttccttccaaaaacttcaggatactaaaacaataatgataatgagaacaactataggtaatatttgtggagcacttactatgagccaggaactgctagtttgcaaaaatcaacaatcaatgtagtaagtcctactattatccccactttacagataaagagtcctagatacagagagatctaacagcttgcccaatatgtcatagaataggtagatgtaacagaagcattgttagcctatacagagcctttgggcagtttatataaaagcatctctacctctaactgcaggaatgacaaaaggcactcctttccatggtcatgtggccccatatcagggcacactgctgggctgggagatgaggaatggctgccaggctcctactgcacttttgccctggttccatgggggcaacacacaactgtacagccttacagtccctagacttaaatacaaggaatattaaatgaaaatgttaatagcattgacactcatattaaaaatattatcttagaaattcattagtttactaaagctgttagaataaaacatttcaggaaggtgtatatcatcaatataaatacgggttataaaccaacagtattttaatatatgagcaataaataatcacaagatttaataaatacaaatctatttttactagccattatcatccagaaatattcttgaccaaaaaagtccctcaactagaatatatgtgaactatgtgaaggtaattataatattttaaagagataaaattagaatttaattatattgactgattatataatacttctaattagaaagattatatattttagaggtagaatttttttttaccaaattaaaatatataaaatttgaacagattcacatcacaactagaagacttaatttataaaatagcaaaacaagtttgcacaaatatttaaaaatattaagacaactatttggtaggtggaattctaagaaagccctcatgatctgtcctttgtgttacatctgtataacttcctccctttgtgtgtggatggaacctgtgatttgcttccaaccaaaagagtgtggcaaagttgatacaatgttacttctattattatatttcataagacttaatcttacctgactggggaggaagaccatccaccttgaagtagcaacctgccatgttgtgactacttatggaaagggccatgtattcgttcgtcctcatgcttctgtgaagaaatacctgagactgggtaatttacaaaggaaagaggtttaattgactcacttccacagggcgggggaggcctcaggaaacttacagtcatggtggaaaaggaagcaaacacgttcttcttcacatggcagcaggaaaaaggaatgcagaatgaaggtgggaaaggccccttactttaataaaaccatcagatcttgtaagaactccatcagtatcatgagaacagcatgggagtcatcaccaccatgattcaattacttcccactgggcccctgccatgatatatggaattataggaactacaattcaagatatttcagtggggacacagccaaaccataccattctgcccctggccccttccacatgtcatgtcctcacatttcaaaacacaatcatggttgggcgcagtggcccatccctgtaatcccaacactttgggagggcaaggtgggtggatcacttgaagtcagaagtttgagaccagcatggccaacatggtgaaaccctgtccctactaataatacaaaaattagctgggcatggtggtacatacctgtaatcccagctactcaggaggctgaggcaggagaatcacttgaacctgggagacagaggttgcagtgagccaagatcatgtcacttcactccagcctgggcaacagcacaagactccatctaaaaaacagataaacaaagacacacacacacacacaatcgtgccttcccaaaagtacccctaatgtcttaactcattcaagcattaactcaaaagtccaagttcaaagtgtcatttaagacaaagcaagtcccttttgcttatgagcctgtaaaaccaaaagcaaattaattacttactagatacaatggggatacaggcattgaggaaatacacccattccaaatgagagaaattgaccaaaacaaaaagactagaggccccatgcaagtccagaatccaaatagcagagtcattaaacaataaagttccaaaatgatctcctttgactccacgtgtcacagccaggtcatgctgaggcaagaggtgggctcccaaagcctcgggcagctccacccctgttgctttgcgtacaatcctcagtcccagctgctttcacagctggtgttgagtgtctttagcttttccaggcatgtggtgcaagctgtcagtggatctacccttctgcgatctggaggacagtggccctcttctcacagctccactaggcagtgttccagttgggactctgtgtggggattccaaccccacatttcctttctgcactgccccagcagaggttttccatgagggctccacctctgcagcataattctgcctggacatccaggcatttccatacatcctctgaaatctaggtggaggttcccaaacctcaattcttgtcttctgcacaactgcaggaccaacaccacatgaattcttctaaggctgggggcttgccttctctgaagcaatatcctcagctgtaccttggtccctttaaccatggctggagtggctgatatgcagtcccaaggctgcacgcagtaggaaggccctggacccagtccatgtaaccatctttccttcctgggtctgtgatgggaaggacttccctgtgatgggaaggtctctgacatgccctgcaaacattttccctattgttttggagattaacatttggcttattgttacttatgcaaatttatgcagcaggcttgaatttctccccagaaaatggggttttcttttctattgcatcatcagtctgcaaatttttgataattttatgctctgtcacctcttaaacactttactagttagaaatttcttccaccagataccccaaatcatctctctcaagctcaatgtttcacagatctctagggcaggggcaaaaagctgccagtctctttgctaagcacagcaagagtcacctttgctctagctcccaacaagtttctcatctccatctgagaccaccaaagccttgactttattgtccatatcactgttagcagtttgggcaaagtcattcagtaagtctctaggacattccaaacttccccacagcttcctgtcttctgagctttcaaagtctctaggaacttccaaacattccaacattttcctgttttcttctgagccctctaaactatttcaacctctgcctattacctatttccaaagtttcttccacattttcaagctccttatagcagcaccctacttctggtacaaatttactgtattagtttcttctcatgctgttatgaagaaatacctgagactgggtaatttataaaggaaagaggataacttgactcacagttctgcagagctggggaggcctcaggaaacttaaaatcatgatggaaggggaagcaaacacatccttcttcacatggtggcagcaaggagaagtgcagagtgaaggaggttggggaagccccttataaaaccatcagatcttgtgagaactcactcactatcacaagaatagcatggagatagccactcccatgattcaattacctcccactgggttcctcccataatatgtggcaatcatgggaactataattcaaaattagattttggcgtgggcacagccagaccatatcaggccacatggcagtgcactgttggtgacctctaggttctgaggacagcctttacttgagatccagtgggaaactggctcagtcaagggaaggtaccccttgtcctgatctctgtggcctcattagtttggcagcctgtgctaacaaagctgaaagctgctaagaggtcaggacaactcccaggccttagaagcctgccctagggggacacagcatctggaccctctgccctggggtgactcctcccaagaatagttcctgggaagttgcccagcccttcactggccacacagatgcaagaaaacaagttttgctgacaacttgaatgaatctggaagtgtagttctccctagttaagcctccagatgagaatctagcccaactgacaccttgatgttagccttgtgaaaccatgagcagaggatccagttaaaccgtgcctgaactcttgatctataggaactggggcacaataaatacgttattttaagctgctaagtttgtggcaattcattatgcagcaatagaaaaagaatacagaaattatagaaacattaaagtcctatattacagcaactcttactgaaaatacaagtattggtgcatggacaggtagatcaatggaagagataatttcaactttaattttattataggagataacctagtatattacaaaacatcacaaattacatttaagtatccactcatgcctggtgtactatttactccttttctccatttgggaatcacggatacatcactgaaataaataacaggcagattaggcccattgtattgtgaaagttcaaatcacaggaaagctaaaataaagcatttttcaaatcttagtccattctaagcttgagagtgataaaaataggtcagagagaaaaagcctacatgaatatttaaaaaccgatcatcacaattttacaactaaaataaaatttttaaaattaaaagaatgttttcattaaatatgaaaaagtttaatatatatattatatagggagcaaatccaatctgtaaattaaagtgggtgcagagcataacttacaaatgataaaatgcaactagtaattgttatattgtagcatttttgcttatggaggaagaagctggtcaccaataaatattccttactttggtcaaagcctgaggagcatgagtagtgggcaactcaggactgaccctcagaaagttagtgacctggctcatcatgacagcccagatttcaatggtagtgaaagtcaaattattcttttaatataaaattccttttcaaaatgccaagtgcatgattgtcaagctggtaatcaaactttctgtggctgtttgcaatgagcaatgtccttgcttctcttgtaccattggaaaaaattcttctgctcaacactcaccaatcggtgctggcttgcttgaactttgtgtcatgcaagtgacaagcaggattctgtgagataagaagtaactaaataagattagtgtccttaatcaggactaatcaatcatttcaagtggaaaatttatttggatttgagtgacctgaagtgcattaacagcagattccataataatacagcaaatggtcatatttttacaatgctctacgatccccataaggagctaatttacttttttccttctgaatttttctaatcataaagattcaatcctctgtccccactgacttcccagaatggctttcatatgcatttacattcatgttaaatgtgtgaattgttttaatggcacttctttcacaacttgaaataattattttggttgagttcaccatgcttcaatatgttgtgtttgccccattctgagatttgtttaagagtgtagggtaagctgatgacatttcaaatagcctaatttgtctttgtatactgtatgttccaatcaaggacatttcaaagaatatgaaaattgtgtcagaaaatatgttatcaatatacaatcaatgtgtaaagtgtagaggcacgtttttccccaatattaatagttattttaaaaaaggagctctggcagagggtcacatgattctcctaatagctttctctgcaggcgtctccataattattctaccctgtggtatgccctgtcagtacagctaagtatgacagagccaatgaagtgatcaatgcttttcaggatctcttttcaactgagcaatgaatgattgctgagtgcagatagttgtccattggtgagtactctcattagtgacattaagcctgtgacaccagtgaatgaaaagtgaactgaggttgttgatggtcagcaagtcagctcccggcaagtgaaatattcattcaaaattattagccaactactgaggtctgcaatgacaactagggttactttcaatttctatgtaggtttatattttattagttattcaaggtaaagttaatttcaatgaataattcttgacagtggcagcttttttcagtactgtcattttaggcttgaaaaaacaaaaggacaaatcactgcctgagtgtgtatgtgagtttgttgtatgtttgcatgtaagtgagctttgtcatcttcctaggaggtacttacattattaagaaaaaatggacattttttaacagctaatattttgattgcttactataaaccatgtactctattaaaatgctttgtacagccagatgcagtggctcacacctgtaatcccggcactttgtgaggccaaggtgggtgaatcacctgaggtcaggagttcgagaccagcctgaccaacatggagaaaccctgtctctactgaaaatacaaaatcagctgggcatggtggcacatttctgtaatcccagctacttaggaaggctgaggcaggagaatcccttgaactcgggaggcagcgattgcggtgagccaagatcaccgttgcactccagcctgagccacaagagcgaaactccatctgaaaaaaaaaaaatgctttgtacattatactttattttctccttaaatttaataggatttaatgtgagccatggggctttggttaaaagtatattgaaattccgcaattcaaaatggagaagataggtcttaatagtaatgcatattaaaaaaaaagttaggattttagctaaatataatcatagtacaagccgtctactggtgtggttgtcaagaaaattaacatatagctgcgttattagtataacaactgaaaaataagaactatagtgcagatcagacccctgcaaagcaagtattcacttttggttgtgtatttttaatgggagactggtaaattggccaactactgaggtctgcaatgacaactactattgtagcccacttggatgaaagtaaccatatggtgggtactcaagcaaccctatcatatgatgaacagttcaagtaactttggaacttagctacagaaaatacatataaatcccatgaaaggtatcttcaagcacatttacacctgttcaacacagggactgtgttcctggaaagaggagtgtggatttcatcagcattataagaattggaacaatatggtccatatagatatctatggatatccaattgccccagcaccatttattgaaaagaccatgaatttttcaatgctctgaagtaccaactttgctctagataaaacagtgatgtattcaagtgtttagttctgggctctattttcttgcctgatctagttgtgtagttttatgctgacattgtatcacctcagttacttaactttttaattaggcttgatatctgataatattgtgaaaccttgttctttgactcttgagagtcatagctgttctggaccctcgaatcactatataaaggttagaataagatgattttgaggggaatatttgggattttaatcagggttctattatctatatatttatttgaggaaaattgacatattttcagtattgagtcttccaatccaagtttattcatccatttatttaaaacttcaaaaacttctctcaatagagtttataattttctgaaaggaggatttacatatatcttttgttgaattatttctagcagttttatattttgatgctattataaatgatatatttaaaaatttttattttttatttacttattgctactttatagaaatgcaattgatttttgtatactgaccttatttctaacactttgctaaactcacttgttaaatcaaaaatttatctgtcattttgtaggtttctcttatatacaatcatattatctgtgaaatgttgaaagctgtattccttctttctaatctttataccctttttcccctagcattgttactacactggcttctaccttcagtaaaatgttactcttggcaatcagcatagagttgtggttctctccataacctaaaaacaacctttattacagacgttagtctactgacatttgccaatattcctaacatatctgatttaaataaataatctcgctttctttttatcttttgtatattagatttttcttccatcttgttatcttttgtatatttttattatatggttatccaattttcagcttaaaaatatagattattttactatcattttgtttctgtagaattcttctcaatttatcaaagtataatgcgaattgatacttttattttctttctgagtaaggaaggggcttagaacacattaaatccactgtcttctttgttgaattacatgttacttttctgtcttttaatttttttatattttaaaatttaaaggatgttattgttttataaagtcaatattacatttttttgacctttgtttctagtcatctctccaattttatttgtctgaaggagcacctttttaatatttctcttagctcagatattctagtaacccaccttcctagtttttgtttgtctgaaaatgttattatttacttttacttttaaaggatactttctctggctgtagaattctagattgtgtcctagtgtaggtgccatattatttatcttattttgaatttaattggcttttaaaatctgtaatttatcatctttcatcactttagtacaacagacattaatttaaaatttgcttctgttccattcactctcttttcttcttctagaacaaaattacatgtatgttagaccttctcaacttatcccctgtgtctcttatcctctagatgtttcatcaattgtctctccatattgcaatatggcaataattttaaaaataagttttggctcagaaattctccatctatgtttattctgttgttgcttcaatctgtttggttcttaatttggtggtgtctttcagtcttgtaatttcatctcttccatatgtttcttatagattttctagttctttgaagaagctctaattttgtcttttatatccttgaaacatggtaagtatagtttattttacagcatatgtctgtttaatatttagaattcttaagaatttgtttctattgtctgtttttctgttgttttgtttataatgtctttcttctcttgggcctgattatttatttatgtgacaagtcactgtatttgaaaaattctggaaatattttgatggcagtgatgttatctttctccagagaggatttacattgcttctgatggacttcaaatagcaccagaaatttggatttcttaatacagtttaaggaattgatattatctaatgttggatgtagtccctctgtggcattatttctagtttgcccttattatgagaatgcagttctttgaggaaccaaaccaatttgtgggaatatttactaggcacactcttagcaggcatgatttccaatctttgttctcccttttccatttaaaaacatcagaaactgacagatttataaggggaaggcaactccgaatagtgggtttacttttcttcatggcattattagccctctaatgcctttatgtaaatatttttatgttttgtccaagtcttgaagttgtcctcccaattttctaccagccttaggagaaaactgggacttgctcaaagacacacacctataaataggagagttggcgctcaaacccagttcactgtagctctaaagtccatcttcttaacctatatgtgatactttcccactacatggttgttgataagtttcaaagaacaatgcacaatgattcctagatgtcaccagagaagtacggatgattagagactatgaacaccaatatagtcttgtagcaacatttgacagttaatagtagccagagttagacttcattcttttaggtttagtgacccagtgttgtcagcatgacagtgatttaaattctcagacatagtcacaatactaggttcatgaaaggtaatgtgcaagtcagaatgccagtgtatcaatgtataatttaaaaaattaagctatcctgaacattggaaggtttatgtgagacaactagtgatttctatgactgttgataaatgattgaaacaaagatgaactggaatcagaaggttctatgtaatcagaattatgaaatcagaataagaattattcagatgttacatagttacactaccccagtctccagtcatgagttcttaaatccatggaccaggacatcctctcctctacatgagtgagtgctgccaccttattaattttgaagtttcccttttcagtgtgctaagatagccaacccctttttaaatcagtcttgcctctatgaagaaatatccagaacactttggagatttggatattctaaaacttttcaattaaataatgaattacactcttattttagttttggaatagtcaaatatattgattgtgtaggaagactttttttaaacaataattcagtgtgcatctttatacaattccagataggtgttatacacattgttcttgtctgatatatactgagaaaatcaagtatttagaattttataaattctgtaaaaattgcttcaattagaatataatttaatattttgaaaactaatagtttcaaaaattgtgattaaagtcatatggatgtatatccttgtgtaagttaaaattatcattaaatatttattttaattttacttcctataattattacaatcaccgatgtaattacttctttatatattcaagttagacatttggcttttcaggattttgtttgtaaagaaaaagctttggagtagatgatattgaagatatgttcctgatctaaaatttcacaactacttcattaatacagattaggaagaaagtcattctactggctgcattttaaatttaggtacaatgcacatgtgtgctgccatcattagttagggctgggtgtagaagcatcgcctcttccatataatgatgcacttgagagctgagctcaattgtttagagatagaatgttaaatatgtctacgtctggtgcttatagattaacaaagtttaaatattgacaatttgaccatatttttttccagcaaataaacttggaaaaaagttggagaaagaatacaaagataaagaacacacatttttctcatgccttaaaaatgcagttccacccttataattgtgcagttattattatggaattacttattctcatggcagccttttgactttgctattgaaattttaaatcccctgttgctaccgggaagcatttattatacgcaagtataacatttttcctttgatttttgaagatgttgtttataaaaatttcatgagatacagtgtttctatacacattttaatatttgaaaactttttaatgaaccaaatacggaaggtttcagggcaaaagcaagttatcttggtcataaatatttcaatcttttttcaccattttccagtgtaagtataagcatttcttttagagattttagaacattctttgcatttttcagtcttcacaaattaaaatgactgaacaatggccatctgctttaactcagtacttaacttataatcttgtatttttaaaacttgtctctttaaagtgcgattgatctccattaacgtattatttctctgtgtatttttttcatgtttcacaatatacttagtgtttccacctgagaagaccaaagactatcctttgattttcatgctcctctacaatagctgaaactagtttgacctaagagtagttagcacttgagtttttcttgaaaataattatctaaaaaataatagccaaataacttatattctaaaaacaggcacacttaatctcctttacaactctagcaaatcagattttgaacatacgttaagcattctgaggtgtgggcaagtaatcatctgttctttcagtatttaattgcttttttaattgcaactgtgattttgacctccaatataaagcaagcatgacttactgggttactcagacagcagcagaagtgcttgtagatgaatgttatcttactcatcaaattctgacaaagtgtttagttaatttacaaaccacttgcacacagagagacacttaaaaatgtgttttcaatgaatggatctaataaaattttaggtaatatataattacaatggtaaaaatactgttttgttttttcatttcggaagtattaaggggtaatgaaaggaaatatcaattgcttttccactttaacccaatttaatctttacaacaaatcttttaattgggttttatgtaaagaaacaataccaaggctccaggtgattaaatacgtcaccagtatgtcaatgtttctcagtgtgtatgtgtttaggccaaggtttgagcctggacgtgtcttgttaataatcttgcttgtgttttggtaagctaattttaagtattttctaaaagcaagggatatatagtaaataagtacatccataaaattaacaaatcagaggaaagataatttgtcagaatctgtttaggatgtaacctgtttaggtagagcattattaaagtacatttgaggaatctacagatagaattgctattttctctttcctttctcaaccaagtcacctgccctccatcattcctttctcctcctaaagcctctctcagccaagagggaagtgctctggaactttgttgtacccttggaggaggtaaagcctcagagctcttaagctaatccaagacactctcatacagaaagaaaaatagtaagcaccttttggtacttcagtgcctatgaatagagcaagttcagaaactatcttgaacaaaactgcatgctgcatgtgacgtaggaactaatagagatatggttgaggtgaggaaaagggacaagtctttgtttctataaactacacctgctaatttggtgctaagatgaagccatttttaggatgaataaacacatctctgctttgtaaacgtacccgtttatacatttttttgtattacttgatagctttggtattatttcatcatttatctgttattgttaccctggctgcctctgctgttgttactgttttgaaaagtaacttgaataattatgaccaggaaattttggcaatgcctatgtcaagcagtggcagatatagtcatggctacataattaacattttgatcaatgacaggctgcatatatgatagttgtcccataaggttttaacactgtatttttactgtaaccttttctatgtttagatatgtttagctacacaaatacttaccattacattacatttgcctacagtgtttagtacagtaacatgatatacaggtttatagtccaggagcaataggctataccatatagcctaggtgtatagtaggatataccatctaggtttgcgtaaggatattctatgatgttcacacaaagacaaaattgcctaacaaggaatttctcagaagctatttccatcattaagcaatgcatgactgtatagtgaaccgtgaaaacttggaatataaaaatgttaggaatctactggagttgccattcttgctccaccttgtctttttcttgtaaatttttagtgcttctgtaatttagcattttagttatggataaatttcatatgggcatataatacatttacctttttacaatttaatttttgatttgtttgtacactgtgctcaaatgttccaaatacctttgttcatgaatccagttactcattcataatagtgtgatacatacacagctacccaaatcctaccccaaatcctaggagaattcccatgtggttctgttcagttttattttggttgaaggctgaggttttcatctggtgtctaaacaaatgaataatcctccactctcatgtcagagagtgtcagatagctggatactcaaaggtttaataaattagtgggtatccacatttctggacatttgagcacagtatctcctttacttagtcctggtgaggaaagatccttcttccattgtcacttcatggatcctgctccgttcacttgttcctgtctggctgaattgtcattctgtcaccacctcttccttttataactctagtcctaccccgcatatatctataatattctctcttgactagcattagtgttttttgggtcttatttttgtgtgggatggggaagaggagaaaccacctttggaattgttgaaggaaaaggtggaagtaagagaaataaacataaaatacacggattgttaattacagataagatcctacacatacttgttcaacaaatatttatcaaatgcctgttactactcaaaaatatatttaaatgctgagaatggcacacttttaaaaaagacaagttctctgctctctcaaaaatactatgtatgactttgagggaaattgtgagaaaaagagatttttttttcctaagtgtaatgggacattattatagatttttgagctgtggaattatatggcttatagtatgtttttggaggattagtttaggctataaggagcagaagtgatagctggattagattgggaggggtgattaagggaaatacaatcaaaggtaattaccttgcttttggcatttattaacccaagcagtaaatatttgttaagtagctactatgtacccctaggcaccagcagtaaatattttagtgctgacctcattacccagagccttgatgttttcaccatattaataaggaagagcacatccctagtttttattatgattccaaggtattaaagaatattatattaaatatgtgaaatgggataggataatgtttactgttctcatttgaatatttattctcttcaattgttgattagttaattattctttggaagagaaatttcgactgatgattaaaaaaacagttttttaaaaaaggcaaagaacttctgtggaatgactcttttctgtggtggtttttgaaccaaaatacagtagtccaaatgttttagtgaatgtttaatctattttatgtatttttgcatattttcatggttattcaatatataaatttctcaaggtttataaaatgaaaatgcaatttttcaccactttctaaaattttcaaatatttatagtatttttaattcacacactactgcatactatagttctacatgtggcaatggagcctcaactttgctcattgctgcaattcagacatttctgagaatccttaacaaaactcttgaaaaggctccattcattagcaggctttgtgtgagacactgagaggttttctggtaaaagtcaaacatacccacacaaaaactaattctaaaagtagggagaattaggcaagacagtcttaatattgatttctggtaatggcaaaatgcatattattcatttatgttttctcattcagaccattaaaaactcatgtaacagatttcaatggaggtgatttgaggtagggtggtggtagtggaatgaatatattaatcttgacttctaatttgattgcactgtggtttgagagactgttgttatttcagttcttttgcagttgctgaggaatattttactcctgattatgtgatcagttttagagtaagtgtcatgtggcgataagaagaatgtatattctgttgttttggggtggagagttatgtagatatctatcaagtccacttgatctagagctgagttcaggtcctgaatatctttgttaattttctgtctcaatgatctgtctaatattgtcagtggggtattaaaatctcccactatacttgtgtgggagtctatgtctctttataggtctctaagaacttgctttatgaatctgggtgctcctgtgttgggggcatatatatttaggacacttagttcttattgttgaattgaaccttttaccattatgtaatgcccttctttgtctttcttgacatttattggtttgaaatctgttttgtcagaaattaggattgcaaccccggcttttttgtttcctctttgcttgttaaattttcctccattcctttattttgaacctatgtgtgtctttgcgtgtaagatgtgtcccttgaagacagcatactgatgtgtcttggctcttcatccagcttgccattatgtgtcttttaaccagttgtcctatttacatataaagtaagtattattatgtgtgaatttgatcctgtcatcatgatgctagctgtttattttgcagacttgtttatgtggttgcttcatagtgtcactggtttgtctattttgtttattgttttttgtagtgactgataacagtttttcctttccacttttagtgcttcctttaggagctcttgcaaggcaggcctggtggtgaagaatttccttagcatttgcttgactgaaaagtatcttatttctctttcacttatgaagcttagtttggccagatatgaacttctggattggaaattctttcatttaagaatgttgaatattggctcccaatctcttctggctagtagggtttctgctgagaggtcttccgttagtctgatggggttctatttgtaggtgacctggccttttttttttggttgcccttgatatttttttttccatttgaccttggggaacctgatgattatgtgtcttggggttgattttctcgtgtaggatcttactgggattatctgcatttcctgaatttaaatgttgacctgtctttctaggttgaggaagttctcctggatgatatcttgtagtatgttttccaacttggttccactctccctgtctctttcaggcaccccaatctgtcataggtttggtgtctttacataattccatatttctcagaggttttgttcttttctttccattctgtatttttttttctattcttgtctgtgtgtcctattccagaaagatagtcttcaagttctgcgattccttcctctgcttgttgtattctgctactgatacttgtgattgaattgtgaagttctcaggtccatcaggtcagttatcttcttctctaaactgggtattctggcagtcagctcctgtatttttttaatcatgattcttagctcctttgcattgggttacaacatgccactttagctcagtaaagtttgttattactcaccttgtgaagcctacttctgtcaattcagccattttagcctcagcccacttctgtgcccttgccggagaggtattgtagtcatctggagaagaggcattctggctttttgagtttttacatttttacattgattcgttcttatctttgtgagcttatccacttttgatctttgaggttgctgacctttgaataaggttttcatgaggtctttgttatggatgttgtgttgttgttgttttctgtttgtttttcttttaacagtcaggccattgttccatagggctgctgctgtttgctgctgtttccactccagaccatagttgccttagtttttctcatacccggatgtatcactagtgaaggctgcaaagtggcaaagatggcagcctgctccttcctctggaagctctgtcccagtggagtactgatgtgttgccagcctgaacatccctgtaggaggtgtctggaggcccccaatgagagggctcacctagtcaagaggaacaggatcagggaccttcctaaagaagcagtctgggccgggtgcagtggctcatacctgtaatcccagcactttgggaggctgaggtgggcagatcacgaggtcaggagattgagaccatcctggttaacatgatgaaaccccgtctctactaaaaacacaaaaaaattagccaggcgtggtggtgggcgccgtagtcccagctactcgggaggctgaggcaggagaatggtgtgaacctgggaggcagagcttgcagtgagccgagatcgcgccactgcactccagcctgggtgacagagcgagactccatctcaaaaaaaaaaaaaaaaggcagcagtctggctgctttttggtagagcaggtgtgctgcactgggggttgttgggaggggagccatttgttgttacatttggactctccaaagctggcaggctggaatgactgagttgaccaaaccacagagatggtggccacaccctccccctgggaacatggtcccatctcaggcagactccagcctgttgccattggctggctggaattccaagccagtgggtcttaacttgtgaggtgctgtgaaatttgggcctgcagaatgatgctgcttggctctctggattcttccccattcctagggatatgtacagacagatctcccacctttttggggatcctggggctggagtatgtaaaactccaggatctctgtgtgtgcctaagcaactgctctgctgagactccacacagcaatatgtatcgaatccaaggccctggtgccatgggctcacaaggggatctcctgatatatgggttgcaaagatcggtgagagaagtgtggtttcctgggtgaggtcacacaatcacctgctgcttcccttggctgggagtcagggctcttttggctgtgtaccactcctgggtggactatcaccccaccctgcttttcttcattctccgtgggtcagcttgtttgcctaatcagtcccaaggtgagaacctggatatttcagttgaaggcactgaattcacttgcctctttcattcctctccatgagtgccacagactgaagctgcttctaatcagccatcttgcagaaaccactagtttcatttctttagcattaggaattgaatttcagtataatttagtggttagaagcagagatcttggctctttcaattatttaatctgtctttttggaaaaagtacatagcttctgtctgttttagtttgctcatccatatatggggttagtagtactacttatctcttaggcatattatgaatattaaataagttatttgtaaaactcctggagcactatggcacatagtgagcatatatgaagttaatcactcatttaaaaatattttttctatgagaagaaaagtctcttttatttgtatatcctcaattactagtgaggtaaatcatataggatgcccatatgtttactagtgaggtaaaacatataggatgcccatgcagttctttattgaactgcttgtatgaaaccaacccaatagtcccatagatagatagtttttttctaaacaaagaaatcgatcccactggtcttaaagctcaaaacttgcatttgttttatctgagttccttccttaggaaacaaacttcaggtctctcaccaaaaaaagtataaaaaattgaaactctcctgattaccacatccagacagtgagatgctggagtcctcattcatcatgattgcttctttttccctccctagttcctgtttttgttgtttttttcagacattgttaaatttcttccctactatataaactcctagctttagtgagtcagggaagtcaatttgaagttgagcttctatctctttggccatagcacctgattaaagccttcttccttggcaataatcattgtgtccctgattggctttccatgagatgagcagcaggacctaggctgaacccctagtgtcttggtaaaatgtacatgggtgtttggcgaatgttttaatctttttatttttgtttttaatagctctctcagctttctgtgaggtgagcaatggtgcctagactgaacccctggggttttggtaaaatgtacatgggagtttgggaaatattattatctttttatttttgtctttaatagctctctgagtgagagagactcctttagcccttgcatctaacttctgtttttcaaatttccattggcatactaaagaaaaatattatacatacactagtggtgtaaatcaggatacattacatatgaagcaatttcaattatgtttctgaaatagtgcagatgggataagagtgaggaaggcagagatttaccacctatataagaaaagctctaatatatccagcatgaagtgggtgagaactacagaggaggttgagtgacaaggcaggaagtagattttattaaacttcagaggaatgccctgatttctagagtctgcacagagtgttgataccataatggtaatcacaacctatatctggatgatatggtaatagggcctgatataatgtagtcctagcatatggtcactctacaaataggacttttgactggtgctattggtggcctatattttttattacttaaattatttaggtctcctaattgcaataaaatattaaatagtgtaatggaacttttttttttttgagacagagtctcacactgttgcccaggcttgagtgcagtatcatgatcttggctcactgcaacctccacctcctgggttcaagcgattctcctgcctcagcctcctgggtagctgggactacaggcatgccccaccatgtctggataattttttgtatttttagtagagatggggtttcatcgtgttagccaggatagtctcgatctcctgaccttgtgatctgcttgccttggcctcccaaagtgctgggattacaggcgtgagccaccacacccggctgaactattaattacattagctaaccactcacctatttaaacacaataaagctctctgtgtcatatgtcaggaaaatgtaactgagagatttatttgagaaattcaaaggacaagcattcatgataaataatacagaaattatatgaattgacttatccaagactgtcttgcatcattgcacatgatataaatgaggaattgaacattctgaaaattttgactttgttgacattaaaaagctatttaatatttgcttgttgaaaatatcaccaaaataatttgttgacaaagcaaatcagagtttattgcttaccatggaaagggaaacatttactttgatagagttttagtagtgtctcagaagagggagggcaaaggaaggatatttttgaggccttgagggacctggcttaaaaaggatcttttcaatgttggaactcgccttaatcagtttgggctgctataacaaattaccatagatggagcgacttaaacaacaaacttgtatttctcactgttctggagatttaaagtcctaggtcgggctgtcagcagggtgggattcttagtgagggttctcttcccggtttatgaatggctatcttcttgctgtggcctcacatggcagaaagacggctaactagctcttaggcctcttcttcttcttcttcttttttttttttttttttattatactttaagttcaatgtgcacaatgtgcaggtttgttacatatgtatacatgtaccatgttggtttgctgcacccattaactcgtcatttacattaggtatttctcctaatgctatccctcccccctcccccatccctctaccgcatgacaggccctggtttatgatgttccccaccctgtgtccaagtgttcttgttgttcaattcccacctatgagtgagaacatgtggcgtttggttttctgtcatagcgagagtttgctgagaatgatggtttccagcttcatccatgtccctacaaaggacatgaactcatccttttttatggctgcatagtattccatgatgtatatatgccagattttcttaatccagtctatcattgatggacatttgggttggttccaagtctttgctattgtgaatagtgctgcaataaacacacgtgtgcatgtgtctttatagtatcatgatttataatcctttgggtatatacccactaatgggatcactgggtcaaatggtatttctaaaaggacactaatcccattcataggggcttcaacttcatgacttaataacctcccaaaggtctcacttccaaatgtcatcacattaaaattagaccttcaatgtgtacattttgggagaacacaaaccttcagtctattgtaggagttcattagaattgggcaagcttcaggatataatattttaaaagtgatagacccagagaagcaaggattttgaggcaagagttcctaaatgagccttggccagtcaataagactaggtgggctgtccactatttttagatgagtactttcaaaaggttcctgaaagaacaattgaatatttctgcaattttactttcctgggaacagattgctaaaataataaaataatgttaatgtcagtgtaaagctgtgtgaatgttgctagttttatttctcaaagcagtacatttgtagataaaatatctatttcaagcaatgtaacaaggaacaaatgccacgagaataatttaacagacctaggagccaatgcagagaccagactctggttttaatgtctcctctacaaaaataaacattatttgtttgaggggaatcattgcatttgatccattacttccttatcaaagatactcatatgcttgattttctccatttacgaggagtttgctgcagttggaaacagaggactgaaagggactaatagagtcttgatggctttggctcttttgtttgtgtttaagagcatcacaggaaaagaaaattagggagattttagtattaaaaagagctgtaacttttcaaaagctattcaggcatgatttagagttgatccagaatataaataaagtgatatccaatgacagcagtcaaataatatggtctataggtatatatagtgtttgctctcagtagtttattaagaatcatttttaatatcaactttatgcataatttatttacaattatttcatccaattaaagtaaataaattgatacaccaccaatattagacaaaactgtgttactcccaaaaagtttcattatgcccataggcagtctatccccccctttttttctagacccaggaaactaccaatttttttttttggtcagtatgattagtttccaattttaagacattctgtataaattgagtcttacaaaataatttcacagtgtctagtttttttcactcagcatgcagattttaatgtcatccaagttttgtggtaatctgttactttttaataatgaatagttttttattgttatgataatacaattttttttcattcattgtgcatttgggttgatttcaattttggatagtgaataaaggtgttatgaagatttatgtaaatgttttcatagagccgtagggctagaatggctagattgtatagaaggagtaatttttataaatattttaagaaataatcaaattgttttctaatgtggcagtaccattttacatttccattatcagtatatgagagtctcagttaccttcatattttcaccaacacttagtattgtcagtctttttaatatagctattctaataaatgtgtagtagcatcacattaaaaatttaatttgcagttctctcataatccttgatattgagaatcttttcgtggacatattgacatttgtatattttttcgcttattgatttatcttttgtgtatctgtacaaaactttggcccactttttatatagttgtttctttttttattgagttagaaggacttcttattgaacacacatattttgtctcacaaatgtattgcaaatatttttccaattctgtggcttgcattttaattttttaaaaaagatcttttaaatagcgggatacttttattgtaataaagtttaatttttcagggttttctgttatgctttgtgatatttgtgttgtaattaagaaatacttggctaacaatagatgcaaagatttttctcatttttttcttccagttttaagttttaaatttagatttctgttccattttgggttaatttttggatacaatgtgaagtaaatgtcagtgttcattgtttccatattgatattcattagttccaaaaatatttgttgaaaactattttcctttccctattaacatttctcgtcatccttgtcaaaaatcaattgagcctacatttctgggtctacttcatttatgtgtgtatctgtcctttcatgaataccacattgtctcgattggtgtagttttataataagcctggcaatcagatatggtaagtcttccacctttgttctttttcaaaattactttggattttctaggtcagtgtaatacttaaaaattgatttttaggtctgggtatggtggctcacacctgtaatcccagcactttgggaggccgaggcaggtggatgacaaggtcaggagtttgagaccagcttggctaacatggtgaaaccccgtctctactaataacgcaaaaattagctgggcgtggtggcacacacctgtaatcccagctgagggatagcgaatcacttgaacccgggaggtggaggttgcagtgagccaagattgtgccattgcactccagcctgggtgaaagagtgaagctccatctcaaaaaaaaaaaaaatagatttttgatttcccttttactttctgcaaatgattatttaggatttgaatcattttttagttaaatatgttgtagactttgccagtgttgtgaacttgttctgtagtcttctttatggaaagattttaaattataatttatttatcttaatagatattggactatatacttctctgagctaaggtagtttgagtctttcattaagtttgtccatttcactaaatcttcaaaatgttttttggtcaatgttaataatattcacttaatattatttttaatatctgtaggatctgtagtgactattttttctctcattcttgatatcagtagtttgcttcttttttccccttgtcattgtgtctaaaagtttgccaatttttaaatctttcacccatttttttttgctttcatatattttctcttttcaattacatttattttcttctttcctcttgttttgtgtttaatttgctcttcattatcttatttcttaaggtggaggtttacattattgatttggaacttttattgttttttaaaataagcatttagtcttctaaatgtttctctaaatacttatttagcttcatcctattgtttttgatatgttgtgttatcattttcattttttccataatattttctaatctttccttattgattcttcttgacaaatgggttatttagaagtgtttaatttttacttatttgagaattttctagctatctttctggtgtgtatttctagttgaattcccttgagataagagaacatacttcacatgatgtgttttttcagaattttgtttaggcttgtttcatgcctacaatatcaattatcttagtgaatgtaccatgtgcatttgaaaaaacagtgcattctgctgttattgggtggactattttttgttttttttgtttttgtttttttttttttgagatggagtcttgctctgcctccaggctggagtgcagtggcgcgacctcggctcactgcaagcttcgcctccctggttcaagcgattctcctgccgcagcctcctgagtagctgggataacaggcgcgccaccacacccagctaattttttttcatatttttagtagaaacggggtttcactatgttggccaggatggtctcgatctcttgacctcgtgatctgcctgcctcggcctcccaaagtgctgggattacatgcatgagccaccacgcctggcctggatggactgttttataaatgaaaattaattcaaataggctgataatgttgttcaggtgtcaatttagtctctaatttttctgtctatgcattacttagattattgatagaggattaattgtagtttgtttattcctccttgcagttctatcagtttttgcttcgtgcattttaaaactctgctgttagatgaatacacacttaacatagcagcgtcttcttggtgaattgattgtcaggcctctgagcccaagctaagccatcatcacccctgtgacttgcacgtatacatccagatgacctggagcaactgaagaaccacaaagatgacatttcaccattgtgatttgttcctgccccaccccaattaatcaatcgaccttgtgacattccccccggacaatgagtcacatgatctccccaccctgcaccttgtgacccacacccctgcccgcaagagataaccacctttaactgtaattttccactacctacccaaatcctataaaactgccccacccctatctccctttgctgactatttttttggactcagcccacttgcacccaagtgaaataaacagccttgttgctcacacaaagcctgttggtggactctcttcacagggatgtgcatgacactgatcactttatagtcatgtaatgtccttctttatcttgacaatattccttgttttgttgtctgcttcacctgcattaacatctgcccgagcttgctttttattaatgtttgaatggtatagtttttttcttttcattttatttttaaactatttatgtctttatatttaagtgggtttcttatacactgcatacaactgaaccctgtgtgtgtgtgtgtgtgtgttttaattcaatcagataatctctgtactttaatttaggtgtttagaccatatacatttaatgtatcactgtggttgaatttaaatctaccatctctttggttgttttcaaaatgttccatctgtttattctttggttttctttttctcaatttaggtctccttttggattgattttaaaatgattccattttaaatgattctattgcctcattggtttattaaatctttacaaaaactttttagtggctacttagaattgacaatatgcaactttaatttattacactctaccttcaaataatatcacctcacatgttgtgtttgaaaactaagctctgattttttcttatcttgcccaaattcctatctaaggggtctggggagtcatgccctacaaaccataaattctcatcagatgggttttatttaacactatatatcatgacttactttccagtctcaccctggcataacactatgtgacaaagaagaaaatcaaaatattttattcccaaacatgtttctttgcgatattttaaaatggcgctactaagccgtcctttgtgggaacaaatttgcacctgtatataatctctattaacatagctagatctttttcttccaggccctcctaatcctgaagagattaactaagagtctagcaccttttaaaggtctgaacaggaaacatttgtcatctattacctctatgggcagccactataagacttcaaaagaaccttggtctccacaatcttttatcttaacctgaatatttcctttctattgatcccaggtcttcagacaaactcaaccaactgtcaaccaaaaattctttcaatttacctatagcctggactccccaccctcttcccctgcttttgacttctggaccaaaccaatgtatttctttttttttttttttttttttgagacggagtctgactctgtgtcccaggctggagtgcggtggctggatctcggctaagtgcaagctccgcctcccgggttcactccattctcctgcctcagcctcccaagtagctgggactacagtcgcctaccaccacacccggctaattttttgtgtttttagtagagacagggttttaccatgttagccaggatggtcttgatctcatgacctcgtgatccgcctgcctcggcctcccaaagtgctgggattacaggcttgagccaccgcgcctggccaaaccaatgtatttcttaagtgtatttgattggtgtctcatgctgccctaaaatgtataaaaacaacctgcatcctgaccaccttgggcacatgttctcaggacctcctgagggctatgtcatggcccatggtcactcatatttggctcagaataaatctcttcaaatgttttacagaatttgattcttttcattgacatgttaaaggattacaacagtatatttccacttatctataatttataccactgttttcatgtttcattgtatatatgttgtaaaacccaaaatactttaatattatttttgctttaaacagtagtgtcttataaagacatttttaaaaagttttaaaatctgtatctttattattttatcattcccagaactcttcatttctttatttagattcagtttctgtctggtattataatccttctactggaaaaaattgagttaatatttcttgtagcacaggcatgctgacaatggattctctcagcctttatctgaaattatgtttaacctttgtttcttctttgctttgagagatgttcccactaataaagaagtctggatgaacaggtttttttttcttctgcacttgaaatatgtcatcccattgtgttttgatttgcataatttttgatgaaaagttactgtattgtatgtaaaatattcctgtattgtatgaaatgggtcatttttttctgtctgctttcaagattttcacttttaaaaccttttctttagtcttcgtatgatgtatttagttttctttctttttttcttttctttttttttttgagatggagtttcactcttgttgcccaggctggagtgcaatggcacaatctcagctcactgcaacctctgcctcccaggttcaagggattctcctgcctcagtctcctgaatagctgggattcaggcatgtgccaccatgcccagctaattttgtatttttagttgagacggggtttttccatgttggtcaggctggtctcgaactcccaacctcaggtgatccacctgcctcagtctcccaaagtgctggattacaggcgtgagccactacgcccagccgtatttagttttctttttaaacaatacttatgttgtgtttttttctaagccttttaaatgtgtactttgattcctttagttatttttgaagaattcccagtcattatcttttcaagtatttcttctgccccattctctttctcttccccttttgagatttcaattacatgtgtatttgatggtttgcaattcatccacagatcctgcatgctgttgatcccatcaaaggcattcttcttatctgttaccatgctttttatttctataatcactgcattaatcatatggatcatatgtgggcctgattcttcctattgccttgtcttctagtagtgtgctgtttttccttgctttgttgtgtttctcaaattttgtacttgataagctgatggtatgtataagatacatacacatgtatatgtatatgtatacatataaataaaatttattgagtcttttttttatttgtgtctagaagtggggctaatttctctctttgttcagtttttatcatgagggattgagctaatatagtcagaagttgagctagttttatttatttatttttattcttatggttatcctcagtgcactgctgatttcaaattcctctagtgttgtcttttacttagagtggcagctgagtagcaagttttcctcaatattcctcttacaacctcagctttagggttcccctgtgagtctgtgcctgtgagaggttcttttcttttcccatgttcttgtacttttctcagcaggagacttctgttacttgcttcctgttgcttgctagccttgtgttggtgggtgtagggccattctctgctacctgggttcagcctcagtcttaggcaggtccctgggcttcagagatggtactttctcagtgattctggccctaatccagctaggattagggtttatttgtctccttaccttagtttgcagttgtaatgggtccccacctacatgcttttacccttgggcttaagcttttgtttcataatagggatagggcaaagggatcatgctttccctcagtgtctgttccttccctttttcaggtcttttagtgagggagcttttgtaatttcagcaatgggtctctcatctaagttcctggtgagatccctggagaagagtttgtgaatgggtttgaattcttgaatctgaggctctgaagggttttataatctcattctagctcacactcatccccttttagaaattcaataatactttttagctgggtttttcttactgggttataaagcacccagtgcctcttcctcgcatgctctgtctgcctcagcttatgctcctctgtccttggagacacctgacttttcttaggtatcagacaagatttttgctgagtaaccccagccctctgatttatgcaagaaaagttatgcttttgaagattagctttttctgattgttagaaggtgggagaggcattctttccagctttttacttgctaagccaaatgcaaatacaattttgagaagtagaaaaagaaagtatattggcaaaagtctacaggctcagaaaagacattatgttgtaataagtatatgaagatattgctgaaacaatgataactgtgttaagattttcagatgttttccctagagcaatgtgaatattataaacctgcttttaaaggccaaaatactatttattttcaaaatgatgattttgtgaaaaatgaaaaaaaatttaaattatgtgattatttactgaaaatacaaatgataaaattgattttaatctataaaacaaaacaaaatattataatgctatatttcttatagtaggtatttagtttttgagtaatccttaagggatggctaggtagatcctttacgagttcattaattattgccttcatttgaaagcttcagttgcatgtaacagaaaatccaacttaaactaccttaaatagaaaagtgaatgtgctttctcataaagacaagaaactaaagacagtaagattttatgcaaagattgaaccagaggtttataatgtttaacaggactccagtgatattcctctgaaccagtcattgtccccaagaggatgcagtgtacttcttggattgatttaaattacaggactctttcctggaagtggcagttaattcaacttcctgagaatgaaacatattgtaaatgaatatcaggaatatgtatgaggcaaaaaaaaaaaaaaaatgttagtgaggcactccccagtatctattctacacacacacacatatatatatacgtatatatatatatacatatatatatacgtatatatatatatatattttttattgcccaatacatataaaacaccaaactagacatattgggtgtttggaggggatgaagagaaatcactgtttacttttaaaaactagagcaaaatatgagaaagcattttgttgaagaacgttgtaagaaaaatgattcagagattcctctattgaagtacattcttttttttttttttttttgagttggagtctcactctgtcgcccaggctggagtgcagtggcgcgatctcggctcactgcaaactccgcctcccgggttcacgccattctcctgcctcagcctcccgagtagctgggactacaggcgccagccaccacgcccggctattttttttttgtatttttagtagagacggggtttcaccgtgttatccaggatggtctcgatcccctgacctcgtgatccgcccgcctcggcctcccaaagtgctgggattacaggcgtgagccactgtgcccagccatgaagtacattcttgagaatctcaggattttagagcttggaattacctgagagatcactgagtttacctttctcattttacagatgaggtaatggagaccacagatgctaaatgacttgcaaaggtcatgcggtcagcaggtggtgaatcctaggcaagaacatatttttggctttgagactgcagctctttccattactccatatttattttgaaacagagaaaaaaattctgattagcttatatgcacataaagtcatttgtcaccatagaatagccttactgcagtaatacattgatggcaaaagttccatcctccttttcaaaggcctagtttgtatgtgtgtctgcttatgaatgtaactttagattaaagtgcttattagtttttttcccctttgtttcaaagacatttttcaaatgttttacctttgacactgccacctgcccacacttatgaatattaaataatgttagaggttaatgcactactaatgataggttgttgtaactcaattggaccctcttggcaagaaatgctcaataaaatgctctttctacagcaaaactaagtggtcctggttatatcctgtgtgattgaggaaaataggattttattttggtatatctgtgtgacatatatgtctttcaggataatataaaaagagtatgtatgacttttataaatcatttatgagtttaccacttttcatagatattactcttttagtagtgcttgtttttaaaatatcatgccaagtaatttaacttttaatattgttaaattgaaaaattttaaaatcacaatgaaattgttttacatgttaattatagtaatagtagctatattatgataaagattattaggaagaatctaaattttgacattggttttactagttttctattactaaaaggtttcattaattctacttctctttataataaaggtaaaagtgtattttaaaaagaatggcctgtaaactaagtctttttgaaaatatatcaaaatacagaatgtgatataacagcagaaattgagcactgttattgctcttggaattttggtgtgtaaaagtaaaactgaaagagaatctctatctttaaaaaactgacaatctgttagaagaaatatggcatgaacatataaataactatacacagacaaatgtgatatgaactgtatgagtaatacccagtaacttcagaatacaaaggagaagagatgactttgactaagaagatttacgggaagcttcataaagaataaactagttgggctaggctttacaaatgcttagttgataaaaaagagaaacaaaagatgtaaaggcaagaaagatcacagcatttcagggaaaggcagaaaatatcatttggtgggagagatggatctatgaagtgaagtcaatggaattagagattgaaaaaagggtaatttgactaggaatagtggaccacagacatgattctgtagctaatgctggttattaaaagtatgagcttgagagctcatagtcatataatctaaatatactttaagaataatttttttgtaactagatataggatggacttgaatatgtgtgttagtttagaaaggcatagaaaaaaatctaatgatgttatcacgtattccaagcaagagataataaattcagttctggcaccagaaaatggaaaagaggttaaatataattagcattatagaaattgacttggcaagacattgtgactaactaatggtttgtctggatttgttggggattaagagacatatttgagaaaaggtgtccgttactttaaggaaggttggaagacggaagactaaacaagatattgagttagtgatttgaagatgcttctttcaataaagaaattttctcaattgtatagagtcataggggtgagactatattataaagaattgaggggtaactgaaaggtgagaaaatggctttggaattatactttacttttttttctcaaagaatttaactttttatttccttctgtttaagtttttatactattggattattagtgttgaaatgctacttgttcatacaaaatgtctttcattagtaacatgtaggtatttgataatacagctaataaattcctgaaaaattagatattcagatacccagccttagcttacatatatgaatagggaattcaggttggacaatatttctatttctcctattttattgtatttccatgaatacaaatgtaaaaagagtacacctttataccatttctatttttaattacttagttcttctggcacaccctttcaaagaatgtaatgtttctatttcacttaattgctgtttaattaatatgcagttcataagtgaggaggataaatgtaataattcacaaaagataagtaagccaaacactgtttgttcattccttctgggctatgatttgagaatatgcaggacaatacacgttttataaagattcaaatgagattatttcctttggtgattctctaatatattgtctcttaagaatgctaacttattttgaatgactgtcttgtgtggcaaaaataaccttctaagttaagagtatataatgatagatgacttaatagtacagtgttcaccaatatcctatgatgatgaggaagtgattggaaagacagtaatccatctggatatagtcattttcaatatcctactgaattaacgactatgcatttttagtggaacacatttatatttggatgtagtggatgtaagtgtctacaacagcattcttaactttctgatcttcaaaattaattttagtagaagacttggtttttccaaaagctatcttcatttgtctgtaaaatctacactgaatgaactcgtgtaataaatttactgattgaatttgattaatttatttaatttttctctttagaaattttcttctaaatcaggtaatttaaacaattagattgagtttgttacatatttttaaaaatagttaaatggaaacattgtaatattatcacaattaatttgttatttaaatgatagcttatgacacattaaactttttctagtgctgggattctttttagaaagttaggctgtgcacggtggctcacacctgtaatcccagcactttgggaggccaagacaggtggatcacctgaggtcaagagttcgagacaagcctggccaacatgtgaaaccctgtctctatgaaaaatataaaaattagccgggcatggtgctgggcacctgtaatcccagctactcgggaggctgaggcaggagaatcacttgaactcaggaggtagaggttgcagtgaggtgaggtagtgctactacactccagcctgggtgacagagtgagactctgtctcaaaaaaaaaaaaaaaaaaaaagttaatctagcctcatagagtcttttggaacctatctggcttgtagttacttggcagatatattttctttaagccaatatgcccagtcctgtatttagacatacagtttatggcctaattcttacataggttacaacaaattcctttccttaggacaattctataaagtcttctaccagtttcatctcccttttaagatgacataactgcacacatgtagcattgctatggaggaatatactcagtatggtgagaatcagtcatctggttacttccatctctaacatcaactccagaatatatgctaaactcttcttgtgaatccttgtcatctaatagccctgtgctcattttgtctcagggaactaggctttttaagtcatcttgactcttgagtctttttctataatccatgttcaatagctcagcaaacaaattctcagaattccatggatcttaaatgtcaaccaagataaaaaataaagggagttccattttcttcagggactgggtgactaaatgtaaatgatcaggaaatacagtcttgagagttgttttactgtttactagcagaatagttatgactccagatcctgtatccttcatgtgtaaaggaggtagagcaattttacataaatttttttttgcattaaaggtggcattttatgtaaaagcacacacacacacgttcagcaattatgaaatatataggacatgtgtgtctataagtatacctataaatatgcgtaggaaaaagtcctccaaaaatgataatacttgtagaggatttatagttcatgaagtgcttttctaaatactatattgttattatgcgttatattaatttaatttttacatataacaaatgcagatggttatatttatttcatattaatctgaagaaaaaactatgacaaagaaaatttaaatatggaggagcaaagacatagcaagagaaatagtcaggatagaaatttagatctacttatttcacctctaactctagtctgccttctatctgggaagaacaacttggctttatctatttccagtaatagggaagttcttgcttgtcccatgtctttagttcagttttagtatttatttctgtgatcaatttatggctgcagattccatttacaataggactttgatgaacccagggattccataatactggctcagtgtgtgtgtgtgtgtgtgtgtgtatgtatgtgtgtgtgtgtatatatatgtgtgtgtgtgtatatgtgtgtgtatgtatgtatgtatgtgtgtgtgtatatatatacacatatgtgtgtgtgtgtatatatatacacatatgtgtgtgtgtatatatatgtgtgtgtgtgtatgtgtgtgtatgtatgtatgtgtgtgtatatatatatatacacatatgtgtgtgtgtgtatatatatatgtatttcccctctcctatctattttgctgttcatttttatcttctctgttggctcctcttcctgtatctgactgctaaatattggtacttttcagagctaattattttactttttaaaaaaaattctcttcagtttttgctaggtcaccaatgatttagataagaatctatatgtcatcacctcacagatttgtaacgccagctggtacctctcttctgagctccagatccatttatcaattctgaaatttgatgtctcacaacctcccacattcaaaatctccaaaacttagctcatgaactctccaaaacccctttgaattcgaaattgctcctcccacagttgcaaaagccagaaacctgggcgttaccactatttcttctcctttcatatctactccttccaattcatcactaagtctttggctttttcctcctgattgtatcagggactaaggatttttaatgtatgaataaacacaatcttttcttctccctctgacttctagaatagatgtatgcttatttcttttgtgaactcttggcaacttatttactgtatagaacttaggaaaatggctaattcttgcaggaaatgcaataaaggatccctgagtctttccattcgtgggaaacttgggttgttgagagctaatttttcggccacctttgtgcggcaacggacagatgagaatggaaatgctgatgaacattacctgctaggaggagatgaataagtagcatggcgttgtgtggtggttagggagtgggccctgtgactgtgagagagctgtgtgttgagaggaaaatctggctgccaatgttgaaacttgagttgtaaggcagtttactggcagaattcgttcctacccagagtacctcaatctttcttttcacttgaggccttcaactgattggatgaggcctactgacattatgagtatgacctacttttctcaaagtctactgatataaaagttaataatatctaagaaataccttcacagtaacgccgagattgctgtttgaccaaatgacgggttactattgcctagtcaagttgacatatacaatcaaccatgacagagaggatctattctattttcacctgattcagttccagtaattatttttttgtatcttatatcctagagatctctcagggtttcttccctcagccccagatcttctcccatacttatatataagaaacgtcttccatttcctatgtctcagtttgaatgtagctttatcagaggagtctctacttttctaaggattaggtcaattcctctgttagatgcttccatagaaccctctgctaatcatttgtttaaaatctctgttcctttctaggaacagagaacacaataggcatgcagtaactattaaagtaatggctggatctaccttagaacacacttaacctgcactgttggttccatagctttctgctttgctgagagtgacatctatggcaattttctctatcctcctcaccccttaattacaagttgagaagctatgtttgtgggtggggcaggtccactgaatgactatgttggatattgagataagcaaacagactaaaggcttaggttgcgcacaacgctcactttatcactttttagctttttcttctctctttcccgtagcagctggtacaattagagggaacagaggctattggcatagcttgggccccaggtaggaggggcccaagcttggcataaatattagaataagctcttctgtgaagctcttctcaggctttagagcacatggtttttaaaatttttttatttttgtattattatttttttaactcttactttccttgattttttttctttaatgcttttttttttttccctgtccaggttcatgttagcatatgaactaaaaaatatcaaaaaggaagaaggactgctgtattgtcatgttggcagatttattcatttcatattgacaatgctaatttattatactttcaaacccatcttgccctcagggatgttagatgatctggttccactgctattaaatgcttgctcctgtaaactttgtggacatagaggctgagggaacccaataatttaatccagaagtcaaattatcaggcgcctttgcccagtggtgtttctgttaaattcacaaaaataatttatgggccaggtgcagtggctcacgcctgtaatcctagcactttgggaggccgaggcaggtggatcacctgaggtcaggagttcaagaccagcctggccaacatggtgaaaccctgtctctactaaaaatacaaaaaattagctgggcatggtgaaagtcacctgtaatcccagctattttggaggctgaggcaggagaatcgcttgaacctgggaggcagaggttgcaatgagccgagatcacgccgtggcacaccagcctgagcaacaagagcgaagctccttctcaaaaaaaacaaagtaataatttatgcattgtgaggagatgcctataacctactaaacatcatattcacaatagcatggcctcttcacctaaagtgtgaaaccttcagattaaagcaaggttaattacgttttctacagtgtcatatttctacaaagtacaaaatgcaaagcaaaataacccagaagctaggaatgagaatttttattctttttttaggactaagacgttggttagttttgatttgaattcctggaaaacctagtgctttcttaagataatacacttgacagcctttattaaacatactaaatagattagaagataagtttgtgcataagtctgtgcttgttttggatagtttcctatttgagtgttgtcttttttctaatattccttcactctgactagattagatgtctctcttctctcctattataacaatcaataaatagctgttattttttactcatgattttgcatcatatttactagagtatgtgtctacgtcctcttttaactgcctgttggcaattgcctgttgcatcttattcactgagcaactaggcctatggcaaacaatcaattattagcatctgaatgaccatatatatatatctgttctcgtctttttttttgagacggagtctcgctctgtcgcccaggctggagagccgtggcacgatctcggctcactgaaagctctgcctcctgggtttgtgccattctcctgccttagcctcccgagtagctgggactacaggtgcccgccaccacacctggctatttttttgtatttttagtagagacgggggtctcactgtgttagccaggatggtctcgatctcctgacctcgtgatctgcccgccttggcctcccaaaatgttgggattacaggcatgagccacaacgcccggccctgttattgtctttaaaataccctgtgcttcctttcttaactgaatgtaacctcagaggaagttaggtaacagatgttaggtaattgggcattctctgcccctggaatcatccttacactctgaggcattcaggcctttccatgtacagggactattttgtaggaaatgaaacacagtggctgtattagcttgggctgccacaacaaataccatagactgggcaacttaaacaatagaaatttatgttttcacaattctggagactgggaagtttaagttcaatgtgccatctgactagatgaagtccctatttgtggcttatagccggccttctccctatgtcatcacatagtggagacagaaagaagaatagctctctggtgtctttttttttttttttttttttaataagaacactaattttatcagattagcaccacccccaaccttatgacctaatttaaccttaattaccaccctactccaaatacagtcacgttggttgttaaaagtttcaacctgaattttagggtaaacaattagatccatagtggggaattgaagaatttttaatataatttcaatttttaatgctggaaagcatgattacatatgaagcaaactcagcaaaatggccaatgcacaccaggccactttccttccacacatgcctgccttttagctgagaagaggataaggaaagcaaaatgcgtgttccatccagttctagaagttagatgttgactttcagaatacaaaccagaaaacaggttcagggtgggagaaaagctcacagaacagagatgagaggctttgctgcttctgactctgctcatttttcttccctttttttttttttaccttttcctctccacacctttagcctgcaaagctctacatggtaatattagcagattaaaaggaaatttgagagaagacaagtttaaatgccagaaagcagtgaagcactggataaagtgttaatcaaagcaagcaagaagcagcagctcaggatatacttggaagcagacacagcttccttaactacatagctttctcttcgtttgacatttttatttccagagtactacttgagcctcaaaagcttgctttttagtgaggaaaaaaattaaaaggtttattcaaccttttagggtgaaggaaaatgttgagttctctgagcatttccttgtgcaatgagtcttgtatatctaaaccactttggtttcctgttttaatcttggctttgatatcacatggtcctttttaaaatatatatttatattgtttaaaactaatttttgaattttcatttggtttcaaaaatgaatctaaggactggaaaattttctacaatttacaaaagaagaaactgaggttcgtagtttatgtagtgtgcatgagatcacgtgtctccaagtggttaaggccatgattcatatccaagagtgactgactccaaagactgtgttgtcttttcatataaaatacttcgatgtgtaccaagaaaaacatttatgtttcttcacttgacaagcacaagtcctgtctttataaaccattagaaataattatagccttcacagtggggcagaaagcagttttctactttgatgtatgtcttgtagggaagaataacattttaactatgattttgactttgttcttcattagtttacctcatgttgagcattttgtcatgctgattccctctgaagatttttaatgcaatgcgtggtgccacaaatttgattagagtaactggcatttgattgtgccttggctcaaactttcctccttagtgccccaggtgctagtttttcagattcctgcagtaatcaggaactaaggagatttgcactcttgacaccctaacaggtaaattaacttcgtgatctgtcagattccactggagtcatcataattctgactgttgtgacatacaatccttgtaatgttttctaagtggtttgaagatggatggcacataaatatgtatgtctaaagatgagtataacattgttatgcttccctttgcatatttgctataggaaaaaaacactcattttgtcaaaaattctcaagaatgatcaacaacttttactgcaaaatagtgtaatatgctatataattgttacttaagaatttctaaaacaaagttacataactcatgaatattttacgtggaaggcatatgatgctggaaagacttgggggcaaatattggcttttcaacatactggctgtctaggcacaagtaagtctgagtttactcacttttagaaagtttaagataaagttttaggctttatttttaacaaatattactagactactaactacacaaggcactgtgccaaatattttaaataaaatagtgaacaaaatagagaggtagccccactctgatatggcttacagttgtaaattttagttgaataaacaaataaatgttacacaatgtgacaagttctatgatgtgtagtatgaggtgtcctgggagcaagtgaaattaatcccagctggggttaagacttaaaacatgagcataaattagctaagtagtgagagagagtgtattaccaaagacatgaagctctttagaggtaggcagaagcaagattatgtggaaatcagaatacatattaggagtttggactatatccaaagatcaaacagaagccacatagagtttgatttattcatttgttaattcaacaactgttcatcaacaaatgtattagacactacttttggttctaggaacatagtaataaaaaaaaaaaaaaaactcctgggccaggcgcagtggctcatgcgtgtaatctcagcactttgggaggccgaggcgggtggatcatgaggtcaggagtttgagaccagcctggcaacatggtgaaatcctgtctctactaaaaatacaaaaaaattagccaggcgtggtggcacacgcctgtaatcccagctactcgggaggctaaggcaggagaatagtttgaatctgggaggcaggggttgcagtgagctaagatcatgccattgcactccagcctgggacagagcaagactgtgtctcaaaaaaaaaaaaaaaaaaaaaaaaaacaaaactccaaattttgacccttatgcttatatgccactgtgaaaagacaacctcaatataaaaaatacatgattatatttgaaggaagaatatcagcgctattgtagaaaatgttgttgttgttttaaaaatggagaaaggctaggggtttgtcagtttagaaaaaaataatctagaatggctgcagcacagtgagcaggtaggagagtgatagcaaaagagcctgagatgtcaccagaggcctctgtgggacagatcactgtaaagacttaaacttttactgtaagtgaaatggaaagcctttgaacattttttggcgggtaaataatattatctgatttatacttcaaaggaatcacttggctattgatttaggaacaatagtagggtggcaatggtagatgtcgaaaatcaattagagggccgtcgtcaatgctaagatgagtgatgatgaccaggatgaatttgactggcttcaaaggcaagtagtggaaatattcttggatatatttttaggttagatcatttaattatttcctaacatgttgaatgtgagtgacaaaatagaacattcaaggaagacactcccaatttttgtttatctgaacaattggaagtttgaaattcccaataataagataagaaagaaaacagtttaaacatgtttgtatgatataaggttaagagttcagattttgacataatcatctttgagatgtctaacagactcttaagtggagaatttaaataggcagttgggtaaagtatttggaattcagagaaagtagctataaatttggaaatttttaaagcaactagattagatggcattgccaaggatcattctgtgtccgtatgcttgtgggtagagaatagaagtggcaaaccctatttgtggcaaactcttaatgttaagaagtctggaggaagaggaagagtcagaaaaacagcctaaaaagaagtgtccagttaggtaagagaataccaggagaggatattttcttggaaggcaagtgtgaacagtgatcttaagaggaatgaatgtcaaattcttctgaaagtctgggtaacttgaagactgaaaattaaccatagcatcgagcaatttggggccgttggtgatgctaacaaaagaagtttcagtggtgttagggagatggcttctggttctagagccttgttgtcatgctagctaatctgtggataacaagaataatatctagataaaatattttaaatattttaaaagaaaatatttgacgaaactgaataatgaccagaaacaggcaaaaactaaagagcaattaacccttgaaaaatgaaactatttcaaatgaggtgtgtgtgtttgcttgtgtgtgtattgtctcatagtacttctcaatctgaatggggataacagaaagccaaggttttgtttgtttgtttgtttttggagacagagtcacactccattgccggggctggagtgcagtggtgcagtcttggctaactgcagcctccacctcccaagttcaagcaattctgtctcagccttctgagtagctggggttacaggcacctactaccatgcctggctaatttctgtattttcaatagagatggggtttcaccatctcttgatgctggtcttgaattcttgtcttcaagtgatcctcctgccttggcctcccaacgtgctgggattacaggtgtgagccaccatgcctggccagaaagccaaattttaaagccttattttgttagaggactaagttcagagctgacagagtggctggaaaatttaaatgggaagtttacagagggaacggtctctaaaatctgtataaaaactaccaaaatccttgtcttcctattgaaccacccatgtagggaagattccaattttagtaaaaccagcatccagaaagagaaataaatgaaacaaaacaaaacgaaaaacttcagttcctggccactgggggagaaagattttagtttgaatctaactgcctgctaggcaaaatctcaacacctttcagataaaagttactaaatccagagaatctacaatatttctaacacaatttcaaggataaaataaaatttattaggtgtaaagtagctgggaaaagttacttaataaaaatatcagtcagcagaaactctaagatgatcaagatgttgtaagtagtagacaaggcctttttatcaggtattgttaacatcttcaaaaaccaaaggaaaaacataattatagtgaatgaacaggtgggaaatcttacttgagaaagtgtgggaaagaaccaaatggaaattctagaattaaaaacaaatatagagaaaaagcaggcatttcacaaatataaaagagccaatatctgaggaggatacaactataaatatatatatatatgtctaataattatatacctaataacacaacttgaaaatacatgaagaaaaactgacagaactaaaagggagaaatagacaaaaccgtaattggagactttacacatttctcagtaaattatggaacaacttgacaaaatgtcaataataatgttgaagacatgaatggttttatctaccacatttatcatattaacatttatagaacatgacaactgcagaattgacagtcttttaaagcatatatggaattttatagagatagaatgtatgctagaatattaagaaatctcaataaaaattcatgttccttgtccataatgaaattaaataagaaatcaaggtaatcatagaagaagtataaggcagtgctttgaggggacaatttgctgttatgatgcagctggaggtgaagtgggatcagtagatttaattttttttttttttttttgagacagagtcttgctctgtcacccaggctggagtgcagtggtgcgatcttggctcactgcaacctccacctcccgggttcaagtgattctcctgcctcagcctcttgagtagctgggattataggcgcccgccaccatgtctggctaatttttatatttttagtagagatggggtttcactatgttaaccaggatggtctcgatctcctgacttcgtgatctgcccgcctcggcctcccaaagtgctgggattacaggtgtgaaccacttcgtccggcccagaattttttatgttgatggacataactgattggtgagagtaaacttggtgtaagaaagaggagacttggaggtctctgagtgggcatgggtacaggagcagacatagtttacttacagtaacatgagaaggaaggcagtttacatgtgtaaagatactggaagatagatagcatggcgagaattcgtatgaattcacattttatgtctgccagataagtgatccaaccagatttgtggttttagaaggccattgtaattatagtttggagcaattattttgtgggcaagattgcaggtagccatactattaggagatggctataagccaagtaagacatgatgatggcaagaaatagttaatagtgtgtaaacaactctgacatttgaaagacatttggaatgtggaggcagcaggacttttttttgttgtttgtttgtttttgagacagagtctcactctgttgcccaggctggagtgcagtggcgcgatttcggctcactgcaagctctgcctcccgggttcacgccgttctcttgcctcggtgtcctgagcagctgggactacaggcacctgccaaaacgcccggctaatttttttgtatttttagtagagacggggtttcactgtattagccaggatggtctcaatctcctgacttcgtgatccgcccgcctcagcttcccaaagtgctggggttacaggtgtgagccacagcgctcggccacaggacttgttaaatgataaaagagacaatatagggagagagggattcagaggaactgaagaaaattcccaggagtttgattcaggcaatttgttttaaggtggtagcgtttactaagatagaatgcttaagaaagagcaaagttgaaaagaagatgatgagtttagtcttagaaatgattggtaaatagatttaaagtttcaccaaaggatctgtgctgaaggtagcatttgccaaatatcagcatacagatggtaactgccaccagctatgtggttgttgagatctccaagaagaggtatggtgagtaggatgggaaagaaatggaaaaaagaagggaatggaaggtctacaaaaagccttgatttattaaataattattctgggccatgcactctttaataagttgtttttacatcttaatatatttcatcctcacaaaaatgctatgagacatgtatgcttattccattttacaagtcactaaatagagaaagatgattgtattagtcttttctcatggtgctaataaagacatacctaggacttggtaatttataaggaaagaggtttaattgactcacagttctgcagggctagagaggcctcagaaaacttacagtcacggcagaaggggaagcaaatatgtccttcttcacatggcagcagcaaggaaaagtgcagcgtgaagttggggaaaagccccttacaaaaccagcagatcttgtgagaactcactcactatcatgagaatagcatggaggtaaccatcccatgattcagttacttcccactgggtcccacccacgacacatggggattatgggaattacagttcaaaatgagttttgggtggggacacagccaaaccatagcaatgatctttaaaaatgtagacaaaatggatctgaaagtaaaaggaacattacaagagtatgatgaccctgaagtcacagacagtttgaagaaggagaccaggtcctctgctgagagtaagaggaaattgctgtgatacaagagtcaagggaaatgagaatttaaatgtgcagtttaattgctgtgggtgctagaagatgagacagattgatgagacatactataggccctgtttattatagagaccatgatggtcatggtcagccatgattgatgttttgctaagcatgtaaccaaatgaaaaagacacagtgggaatatggactttggcaaagaatcggatgaggtaataaactatgttgaaaggtaaaaacagaaaaagctaataagaatataaaaatgttgtcatggactggaggtcctagcaagtttaaaaggcaagtttaatggcagttgctgaacaaaagagtcaagatatttggaagttgctatctgaagcagggtctttgcatttaatattttaaaactggagcacttctgaatgatggcaaattccaagaatggctgtgagaataaatagaagtaaaagcaacaggaaatgaggatgtcaaagacatgcatagatagtctactgaattacttgcttccagggatcagaaatgccagattctggcaggacttggtatggagacaaaactgggaggaggagacaaatattcagtgattgaggtggaggcagaataagttggttgatgagaccaatgaggtggaataaagatctgtgccccatttccaaagaaaagaggcttttatgggagagtaaaggactgatggtctaaaagagctagtgtggagagtactaagcccacctcctcaccttggtatctggtccatagtaagaactgaagaaaacagaactattgtttcagtcttgccttttctttgtatatatttatatgacttttcatttatctttttataaatataaacactattatgtgccatagagtgaagcagaattttctcccaagggaactaatatgtgcttgatttacaaaatagaaatcattatgaattgtatgccttactaaataattctgtaattatatgttatgaaacaacttaaaggtgtgatgcaaaggaaagaattgtcatccaataaatggagtttaataatttttatttcacggtatgaaattttatatagttttttatgttagaggtacagcaggtgaaagtaggttttatttgattttaaggatctaaacggttttaattatacaacagaatgtctcagaaaacatgaccattttcaaatacttttgatgaggagatgggttttttttaatttaaaggcaaatacacagggttttggctatatcaaaattgtgaaataccagttagcttaggataactttatcatctttgaaaatgatgaaagtaattaatacacttctttttaaaaccacatgtaatttttgagaatagatgactatttcaaatagtcatgtgaaacttctcttaaaattaaaatagatattagtgaaagagtcataaatgcaggctttcactttattggacacaaaatatagaagacatggaaatgtgttgggataatggtatgatcttagggtaggtaggaatgctataaatatgaaattatcccatatctttgtccaagctttgtggcactttcttccatatcctggatgtcatactttttcaccagggtcttcacagctttttcagcccttgataaacccttctgtttgaaagcaggtggttgcccctctgtcacctggaaaagacgtgggctttctcagtctgaagatggtattcactgggaaaaaagcatggcctcccacctgacaaagagtatagctgctgtgccttcattctacagattatatatttaggctaagccttttttttttggattggatcttggacattatagattaagtttcttggacttattttagttgtcagttctaactctaatgatgctcaggcccagtttgcttcccttttttcctgatcctgagaggaggtctcggtatcttcacagctgagcagtcattgtcagtgcacattttgtgatttttgtcatttggggattttctttgccacatagttacagaatttgatttagcaattgggaccacaggcaaaccatatctttgataacgctgacccttgacaagtcatcatcctacaaaataaattacagggaaaacagttcttattccagtgttcccttatcaaactctacatcagagttagctgtgagtgatttctacttttagtattggagatgaatattagatattttctttttctttctttcctttcttttcttcttttttcttcctttccattcctttccattcctttcctttccttttctttttcttttcttttcttttctttcttttctttctttggcagagtcttactctgttgcccaggcaggagcacattggcatcatctcatctcactgaaacctctccctcctgggttcaagcaattctcatgtctcagccaccggaatagctggttacaggcacctgccaccatgcccagctaatttttgtatttttgtagagctggggtttcaccaagcaggacaggctggtctagaactcctgacttcaagtgatccacctgcctcagcctcctcaagtgtgggaattacaggcatgagccactgcactcagacaatattcgatgtttctatagataattcagttactttataatcaaataatgattattaatttttctgatattctagagccatcttgaacttttcactattttaattaaacttctgtatccatgtgcttctctacccttttttggttccctccttcctatctttgagcttccatgataagaatacaaaccacacttaactatgttttccccaacctcactggatgttctcctggttttcattgttggcttttatcctaaacacatacttttaatgtagatgttctccactactccatcctgggctgcttctgtttatttatttatttattttttattttgagaccaggtttctctctgtcacccaggctggagtgcagtggtgtgatctcggcttactgcaacctccacctcccaagttcaagcagttctctgcctcaacctcccgagtagctgggattacaggcacccaccaccgtgcccggctaattttttgtatttttagtagagatggggcttcaccatcttggccaggttgatcttgaactcctgaccttgtgatccacctgcctcggcctcccaaagtgccgggattacagacgtgagccaccgcacccggcctgtttttatgtttttatatacttttcactgatgtcttaaaagtagcatgtccagaactaaactcttggttttattcccaaaatctagattgtgcttgtgcttagagagtaaatctcttaacacctgcctacaagaaggcatataatgtctctgctgccacctctcctgtttccttccaactttccacttgctccgtaggttctagtaacgttaacctttgttcatttcttgaacattaggaagcacattaatacttcaggacactgtccatcctgaactctttgctcaccatgctctttctttaggtctcatcttaaataagacgtcctcagagagcctattccagctactcatctacatttatcaactcacacacccattagtctctatttcaacatcctttgtttcttaacagtactaatgactctagtttgcaattattttgttttatctatgagaatatgtttcagaaaggtagaatcacattgctctagtatatccttgtatccctattacctaatttagtgcctggtgaatatacaataaatatttgagtgactgcatcttaagaatttcttttgttaaaatcactcccttttagttgtctatgtatgctgtggcattagcttcagtgaagtatctgaccaatggcactagtctagacttagaactgatctcctgggaaggcccaaaactctgcctggcaacagcatatttcaacctatacccagcagcatacccatagggcctgatcagtttgaattcccttaaagtctacctgttatcaattcattttaaactgcatgtgtatctatctcttcaaatagtatgcttacctatccctctatttgtttgtttcatttagaaatgaaatacaatcataatctttatagtattatatagtactcataaataattagtttcctaattggcagagggattctccttctctccattaatgacatgatagttttgaaaatagatagttcctgacagctgtatatcaagagtttatttgtgggtagagtgacattacactcatatttcccataaaagttatataatatatgtggttattaggcttctcatctagtcctcaagctagttcttaaagcctattgaatattcttaaagtgaaatcgtaatactacaatttcaaacaatatattatttataatgttataatgtttggtattctataaaaaatagggatctgaagtcaaatttggatgtacaatatattacattcattccagcagtcagtagttctcaggcaggtatataacagaatcattcatggagcttttaaagtatacaagttactaggtccaatgtgggagattataaattagtgaatctgcattgtgacatgatatttatgcattgtttaaaagcttcacaggtgactctaatacacatctcttaagaaccaacattcagggaatttgctcttgaaattttccaaatccatgaattaaaagaaggtgtgttggaggaaggggttttaaggcttttcactatgtgaatgtcaaggaagtcctaatttgggaaatgcgataattttattttcctatcttactttacatatctggaattttcaggttacttaccttttctttacctggaatctagacctatagtcatgataataatggctttcttgtttgtaggggaatgctttataactcacctcggtttataatgaaatattcttcttgtatttcagttcctttaatctcttggtctatattatggccaaacaactctcatggcctctactagaacaaaatgtagtccttcgtgaataacaaaaatagcatttggtaaaagttatttatacagctgataaaatgttattctaatttgcccttgactttgttctgcttatatactattatttttaactgactgagaaagttaatatattcagtttatccaaatacataatcagaactagatttaattgcaggaaaatttggaatataggaaaatatcaaagaggttaagatgaattttatgacatctcaccaccgggaaataattttatattgtttcttattgagggaaaaaaataaaggctgagattaaaccctaagtgtatccagccggtagggggcagttcttctaattcataggactattttgtctttaaatttagcactcggagggtccctttccttgacctttgacatcagtatttatgcaccagatggataatatttttgtgtgaggcagctttggcaccctttggctaagatacggaaataatatatatttattaatacctgatggcataaaaatagttaccataattcaactcatctaactattatcattatatagacctctgttagtaacctgaactacttggaaaatttaaaagtcagggtttgtttctttctttctttctttcttttttttttttttttgaggcagagtctcactctgtcgcccaggctggagtaaaatggcttgatcttggctcactgcaagctccgcctcctgggttcacgccattctcctgcctcagcctcccgagtagctgggactacaggcgcccgccaccacacccggctaattttttgtatttttagtagagacagggtctcaccgtgttagccaggatggtcttgatctcctgaccttgtgatctgcctgcctcagcctcccaaagtgctgggattacaagtgtgagccaccgtgcccagccaagtcagagttttttgtacacagaatcctgagctacataggcttgaagataattcgtactggaaatgaacaaaaatatcactgtcctgcaatttgtttatagtttgcctcttccccaggccttctttttcctgatattccaattttgcttctttcagacatctgagaaaacagctaaaccatttgccactgccagtgagtctgtgcatattcttatcttggctacttttcttcccacacacagtgaatgaatgacctgatggactgaagctcagcccatcgggaggattatccctcacagttgtcctcaggggcaccctgagtgaggctatgatgcagaaacagtgctttcaaaaggtgtatcatttctgctacaaatggcatgcacttgctttataatgctagggttcctccctttaagtgtcctattggggcctgcaaagattccacactgaattatacataagtgacctctacacattgaatctgctgctgtgtggcctaagcatattggcagcctgggcctgctaccataccctttcttgctctggaccccacccaaaaatgaccttctgcatcacctaatgaatgggtcagagcaataatacacgctgcctccaacatccgaagaggcctacaagatgttgagattctttctttgtgatgggtggcacgggtgtaatagcttgtcgtttacattggaggagttgtctcagcaagccccaggccagtgaacctctgaaaactttatgcatatagcaaatatcccctgccctccggagcatgttgctgaccaagggcatcccgagtacatgccacttctgttcatcaagcataatttacaaaatatcatcaacataatggacttatttgatgttctttggagtattcagttccttttagactatcttgtgatagaaggttaaactaagccctggggcaaatcaacaaatgtatttattatccaccacatgtgaatgtaaactgtttttaattccccttcctaatggatatggaaaaggatgcatttgtcagatcaatagcttcatgtaacataccagagattatgggaatgcattctagtaaagataccacatctggtatgtcatctgcattacagctaccatgttttcagtggcccattttcacttgccatgacctatctgtattttatatatttttttgcaggtgacagactggtaaaataaattgagatataatgagagctatcacttctgcacctcagaggctaaaactaatctctgcaattaaccctaggatgttatattttttgatttactaacgtggtctgtttcagggacttgcacttggcttttcctgtaacaataacctttataccactggacaaagaatcagtgtgagggttctgacagctgttaagtatgtccatcccatctgtacattcagggactggggaaatgacaaccaagtaggcccatgtacccagcagaaaattttaaaaaacttagaactgagaaaaacctaatggaaaaccgtggccagcactctggttattatctgatctcataatgtcgttatctgctcaaatcctgtatcctatccacaacctttaaaatatgtaggtattccccttttctcagtgtgtacttaccttgttgcacagcctctttggagatggacttggggagtcacttctgtatgtacctgccagggaattgcagttattcctcaaatagatctgacctctctcagttgatgcagccttggtttgagaactggctcagggttgagaactgggaaagggattgactttccattgaggaagctggtcagccttttgtttatttattcgtgatctctttgggttatatagtaagtagtactctcgttcagtgctcatgtatcctttctctaggaacaccatagtctatgagcatttccatggatccctgtgggttaggacacccccctcccgccccctgcatcctgccattaagactttgcacttgttacagtaattactcccaccttgctgctgacaattaagtactgttacatgtctctgatatttggggaagccattatctccattactaccagggagctcagttctgcaactttatctcctacctacagagcacgtacaactacagagttttcaaaaatgttggtacctccgtcaccaagacctcccttattgtttccgtaaacagattgtaaacagattgtctcctggacacttctgcagaactgagtcaggtggagggtctttcagtctcctataatgggttgactctagcatgtccacttctctgtgcttttgattcttccatcatctgcctgctcactcttgaatctctcccatatttaatgtgggccattgtcttctctgagcttcttatggagcattgtttttagtgcatctctaagcatcattgccagggcgttcaattttgagtcatgggatagtgccctgtttttgccaacctttcatctatccagttcccctatctaataaggccttgattttgtcatgtgagcattgtctaagctgtgaatcctgccttctctaatgttctgtaactttcacaattaagtcctagtcttggtgttcagcttgattagcccttcaagtgtggtagatgagggtttctctaaaccctgacagagaagccctcagatttccacactttgcttcatatggttgattagtgattggagcctgttgtttctctctctaaagcaaaagttgctctcaggaatagtcactcaattgcacactaattttgcagttcctattttttccccttatctttcaaacaccaatgataacacatacactggtgcatctgtaacctatatcttgtatcatccatcacaggtgaacatttcagcaattgtcctgcttcatcatgccagggactatcagatgacactttgtccagtggtggggactttattgcatctggctactgagaaattcagttttagaatcccatccttaaagagtctacttcctaaggtactcctggcactagctgtcttatgtcaggtttcctagcaggggggcttgatgaagggattcctttgtgaggcagggttctcagaaaacaacctgtaaagaagtaagggaagatcaggatgggggaagaagctaggacatgatatggtctcaagagaagtacagttcaacctgatcccatagggagctctgaagtataaattgcatcatagagactgtcctctccagaagcaaaagatctgggcatcggtcagtcatcagccaagggcagcccacaggcagagggtggatgcaggatcacctgggcatccctgggcaagaggctaatgccagtcaagggcaattcttcagagaagagttccagtgtgagccatgggcagtaggtaggggatgcataagcagccattaagagggattggatggggacacctatagcatctgctacacgtcacctcatgttagaatactgaaaaataaattactattagtaggtcagcttttggagttttacagacctgcattcatttgggcaagataattaacctttctgactgtttcctctacagtaaaacaggaataataactcagcttaaatttgaaagggtttaagcgaggatgaatttgtgaagtctccagtagagtacttgctttataatgggtgctaaattaatgttattatgttgacaaagaaagtagaacttggctatttaccaagaaaataatatgtatgtttatctaattctatttaacacagaaagctaattgatatcttttacttacctcaaaaagaaatgatgggccgggcacggtgactcacgcctgtaatcccagcactttgggaggcccaggcgggcggatcatgaggtcaggagatctagaccatcctggctaacacggtgagaccccgtctctactaaaaatacaaaaaattagccaggtgtggtggcaggcgcctgtagtcccagctactcgggaggctgaggcaggagaatggcgtgaacctgggaggtggagcttgcagtgagccgagatcgcgccactgtacttcaacatgggagacagtgagactctgtctcaaaaaaaaaaagaaaagaaagaaatagaaatgatggcactatgcctcttagttcatttgcaaaataaattaatgtcataataatgctgtattaatctcacatgtaagaataaaagtataatatttaaaatgaggtattatatatgcattaatcaatatgattaatattcagagaaagtgagctactattagaatttcctttcaacatactactcagtaatttttgaaaaggttattgatgaaatgatacatgtgcattaaatgaaattgctcacacacaaataaatatctctatacattcagatatatattggcacaattggcccagcatttgctgaacataagtgattcagtaaattacattagagtatacaatgattgcttcttgactatttttctcttcttttgttgtcatttcatctcctgaagattgactaatttttttgtttttttgagatggagtctcactctgttgcccaggctagagtgcagtggcttgatcttgtctcactacaacctccgcctcccaggttccagtgattctcctgcctcagctttccaggtagctgggtttacaggcacatgccaccacactcggctaatttttgtatttttagtagagatggggtttcaccatgttggcctggctggtcttgaactcctgacctcaggtgaccgcccagtgtggcctcccaaattgctgggattacaggcatgacccattgctcccagctgccaatgattgacatttgtctgttgattcttatttatctaattccttttggtagatgaacctttgcaagtaccgtgtctgctgttcttgggtttcttcatttaattctgagggcgtttgcatttagggaatgacactgatttacttaattgctttggtataccctttataactactacttgtgtctctttgacacaagaacacacatgttcacgttcatcaggggcatgattcctattgttaactacttccctttaggaggttgtcttctaggtaagcatatttcttttatgcttatcaaatatgaaataaatatacaaccaactcaatagaatgtcataggctaatatggtaccacagaatgaagcaattataaagttaagctgcataatgaggttacttttggagaatattggaccttaatggcaatttaatcaacttaacctgctttaccagagatgatatgcaacagctaatatattgagccatcaatagatggagatagaaactgaatctgtaaacatttgctttgcaaaaccacattcatctcaggcaaataaccttttttcacttaaacaattactttagacaatagcaacaatttaaaaactgagatacatgcagtacttatcacaataaaatcagtatctctatttttaaaaccatttcgaacagtaatgtgaattttttgggaatatatgtctaagcttgtctccatttgttgtgtagattaaggtatttaccatattttatgttaatattaatcattttacaatcattttcattatgtttgtcctataattacataaataagaatgaaaatgggcagattttcaagttgctcactatttctatttttcatccaaaagaatagtgcaatgaggagtccatacctgatagacatgtggaaatatagctggacacatttatggagtggcagtcaatgacaaggcacaaatacatagtgttatgacatgggaaatagttcttaaggttgaagttcccactagagagcttgtggtgtagacacttagaattgagagcctaaaaaagatggtatgataagagcaggtttcacctactgagtactatcttttctcatgttttctgtacctcgtatctctcgtatctctaaaaggtcaaagatactgcataagccctctggaagctacctcttcccaagtctccatattcacactgcttttgattaatcgatccgtttaccttctcactgtgcatcgggccttctgtcattgtttccctttatatccagctcatcattacaaataccttcaatgccagtacaatccttagatcatcctaacctatgaaactcaaactctgagtgaatccactatctcttcccttggaacactctcttcacttgcttctgtgcattttcctaactcactggccatttttaaaattttagcctcttttgatgactttgttttttctctattaaacctacaaattttgtcctggtctccttctcttctttgtctgtctgtctatattcctttgctattttattctattctcatgtcttttttttttttttttttttttttgagacagagtcttgcttcgtcacctaggctggagtacaagggcataaacatgactcactacagcctcaagatcctgggctcaagtgatcctctcagctcatgctcttgactagctgggactacaggcatgcaccaccacacctggctaatttttgtggtttttaaagtctttttggtagagatggagtctcactgtgttgcccaggctggtcttgaactcctgggctcaagtgattctcctgcctcagcctcccatagtgttgggattacaggcataagccactgcacctggtgctcatgtcttatataatctttttttaagttaccagagttatgtatttaattgctttttattgtcacgttgatttggatatctcacatatttcagaattaacaggttcaatttcatcctctgtcagtcaaatctgtgttcctcatctcctccccacctagtcctccaatttcagtaaatgacattaatctgaaggcttgaaatataaaacagaggatgatatttgagatttacttttcttcatgtctaagctggttaggcctgaggtcaactgcaatgtgccaggagagttctatattaacactactcaaaataacaacctttcaacatctcccacctcagaacaatacacacacactcccctttacctcttcagggcccctattttcttaacagttcttattaagtctattattatatttcttatttacttactctttctgtttttcttaccagaacttttgagggcagacaatctgtcttttggctatttgtcttcatcccctaccacggtgtatggcacataaacatcacgaaataaatagctttgaatggcgaattaaccatcttatatctacttgaacatcatttataagaaccactggggccaggtgtggtggctcacgcctgtaatctcagcactttgggaggccaaggcgggtggatcacgaagtcaggagttcgagaccagcctggccaacatggtgaaacctcatctctactaaaaaaatgcaaaaattagctggatgtggtagcaggtgcctataatcccagctactcaggaggctgagggacgagaattgcttaaacccaggaggcagaggttgcagtgagccgagaccgtgccactgcactccagcctgagcaacagagcaagattccgtctcaaaaaaaaaaaaaaaaagaactgagaacacatcagatatggataatgaacctaggatagttggacatgatgagagacacttactagttattgactacaaaagagtagccaagagaaactgagagcagcctcactctagggacatcttatttccaaaaagacaagcatgactgatcagtttcctctttttatttactgctggtctttcattatatgcttcacaaagtacagggaagaacaatgttttactggcagagttagaaatcaagataaggagtgagaactaagataaattgcaaagactcaactattagtgtagaccttggacagctagctaaaagaatacagcctggtgaattggagacaaaaggtactccaaatatttggctaaaattttgcaaatatatttgggttacttaattcatttgaagtgtttaagtcaaattataaatcacattctatttatttaaaaatatttattgaggacctaccatgtaataagaacttaggatatatcatcaatgaacaaaacaaacttttctgccctagtggtatttatattctggggtaaagacaataataaaccataaaatatgttagaatatgttaagcataatttaaaaaatagagcagtatggctgggcacggtgcctcacacctgtaatctcagcactttgggaggccgaggcgggcggatcatgaggtcaggagattgagaccagcctggccaacatggtgaaaccccatctctactaaaaatacaaaaaattagccaggcgtggtggcatgcacctgtagacccagttactcaggaggctgaggcaggagaattgcttgaactcaggaggcggaggttgcagtgagccaagattgcacaactgccctccagcctgggcgacagagcgagactctgtctcaaaaaaaaaaaaaaaaaaaaaaaatagagcggtacaacggtatatgagaataccgctggtattgtaggtggaggtgcatggttcatgtatgtaaataggagggtcagggtgaatttcactgagaaaatattatttgagaaaatttgaaggagtgaactgtgctgataactgagaaattaatccacctggcagaaggcacaatcagtagagaaattcaaaggcaagagcaggtttagtcagtttctagcgagagcaaagaggttagtaggtagctggaatacagtgaacaggacatgggatcatagagataaggtataagtaccttgtttttttgtgctgagtgaaggtaccttggcatgatttgggatcaaatgaacgttcgttatatattctcctcttagtggttccactggctaatattggaaagatctcttgtcacttttgccttcacatttacactttataatttaacacacctgggaaaggcacaattatatgcttcattagtttcctgacctaatatttggcagaaggccctacatatttttctttatactttattttcatcgaaattctttgaaactttattcagagaagtaggtaaaagcctcaggcataggcttacacagtttcatttttatcttttacatctaaactcacacaattatccataagctctatcatttatgcactttcatttaacaaacatgtattcagcacctactgtatgccaagtactgtcaaatgtatatgtgagaacacaggccttttttggttccatatgaattttaagatttttttttctaattttatgaaaaatgacagcggtattttgatagagattgaatcaaatctgtagatttctttgagaaatatggtcatattaattctgatccatgaccatcggatgtttttctgtttctttgtgtcaccttcaatttctttcatcacttttctgtagtttttcttgtagataccttttacttcttgggttaaattaattcttagggttttttttttggtagttattgtaagtgggatagcttgcttgattttttcttgtctagataattattggtgtgtagaaatggtactgatttttgtacattgattttgtatactgcaactttactcacttcacttatcaaacctaggagtctttttggtggagtctttggatttttgtagatataaggtcatatcatcagcaaagtgggacaatttgatgtcctcttctccaaattgcatgccttttatttttttctcttgcctgattgctcttgctaggactcccagaattacgtcgaataggagtggtgaaggtggacattgttgtcttgttccagtccttagaggaaataatttcagtccttttccattaaatatgatgttagctatagatttgtcatatatgacctttattatttcaaggtatgttccttctatgtctagtttgttgagagtttttatagtgaagggatgttgaaatttttcaaatgctttttctttatctattgagatcatcatatggtttttgtccattttgttgatgtgatatatcatatttatttatttgcatatgttgaactatccttgcatccctggcataaataccacctgattatggtgtgttatctttttgatgtactgttagtggtttgctggtattttgttgagaatctttgtgtttaagttcatcaggaatattggcccatagttttcttttttgttgttgtgttctcatctgaatttggtatcaggataatgctggcctcataaaatgagttagggaaaattacctcctttttgataattttaaaatagtttcaggagaattagtattagttctttgtatatttgttagaatttgtctgtgattccatctggttctgggcttttcttttttgagagactgttactgattcaatcttgctactcgttattggtctgttcaggttttctattacttcctgattcaatcgtggtaggctgtgtgtttcaaggaatctatccatttcctcaaggttttccattttgtcagtgtatagttgttcatgacagtctctgatgatcttttgtatttctgtggtatcagttgaaatgcctcctttttcctttctgatattgtttatttgcatcttctctcttctctcttggttagtctagctagtgttaatgtacatcttgttgaagaaataactttttattttcttgagtattgatttgtagtctattttgttcagttttgctctgatttctgttatttctttccttctgctaattttgggtttggtttgttcttgcttttctagttccttgtggtacagtgttagattgttcgtttgccccaatctttttgcttttttgatacaggtatttattgctataaacttccctgttagcactgtttttgctgtatctcacaggttttgttatgctgttttcattttcatttgtttaaagtaatttcttatgttgaataacatttaatggttattttattaggaatttatctgtctatgttaatgagagctattagtctctatttttgtttttgttttgtagatattttgtcaggttttagcatcagatttgtgctgggcacatacatcagttggcaagtgtttcctctaattttctgaaagcacttgttataagatttgtgttaattgtttcccttaaatgttgataatattttactatctgggcatgtactttcattgtggggaggtttttatattaaattcagtttgattaatacatacagagttattcagattttttatttaatctagtttcaagttttattttctttcagatattatagtaatttaaccagttgtaaaaggccctacagttaaaagaccaaacttgaaaggctaaatattaaaaacacaaactacaagttatttccatgaaatcagtcaaatcatgaaataaattttgtgcaaatactaaggaaatatatacatctatataaatattagaaaaaataaaattagactacaaaattgtattaggaaataagagtgtatttagcactcttaaataaaaatgtatttattaaaattatttttattgacaggtcataattttatacatttatgaggtacaatgtgatgttttgatatatatatgcaatgtaggataattaattcaagccaattgacatattagtcaacttgcaaacctatcattttttatggggaaattaaacttgtaatttactcttctagttattttgaaatatacattattattgactattgtcaccctgctatgcagtatatcacaaaccccccattcatctaaagctttgtaccctttgatcagcaattacccatttgttccctccctgtactcccaatcagctcttggtaactaccattctattctctacttctatgagttcaactttcttagatttcacatataagtaagacaatgtggtatctgtctttctgtgcctgtcatatttcatttataataatgtcttccagattaattcaaatgttgtcacaaataacaggggacccccaccctttttaaggctgtatagtattgtgtgtgtgtatatatatatacacacacatatgacatataatttattgtcatatatatatatatgacagatactttatcctttcatctgctgatgaacacttaggttgttcctatatcttggctgttgtgaatcattttgcagtgaacatgggaatgctggtatctctttaatgtattgattttggttcctttgggtgtatactcagaagtagaattactgggtcatatggtagttctatttttagttttttgaggaacctccataccatttttcataacatttcttttaatttacattcccaccaacagtgttcaagagttcccttttctctgtattctcaccaaaccttatctttcatctttttgataaaagccattctaaaggcgtgagataatatctcgtttttaatttgcatttttctatagtgatgctgaacattttttcatgcatctggtggaaatttgtatgtcttctttgagaaatttctgctcaggaactttgcccattttaaaattggctttattggtattgagttgagtttattacatactttggatattaacttaccaggtgtatggtttataaatattttctctaattctgtggattgcctcttcagtctgttaattatttttattttgtgcagatctttttagtttgatgccatcactttcgtctatttgtgctttcattgcctgtgttttaggagtcgtagccaaaaaaactgttgcccagaccaatgtcatttagcattccaggccaatgtcatttagcattccccctattttattcgagtagttttacaatttcaggacctatatttaagtcattaatccattttgagttgacttttatataaggggtgagataaaggtccaatttcattcctttgcatgtggatattcagctttcccaagagcataatctgaagacagtgtttttccccattttgtactctcagcacctttgttgaaaatcagttaaccatagatgtatgggcttgtttctaggctcactgtcctatttgactgatgatgtagctgtgttatgctgttttgattactatagctttgtaatttgttttcaaatctagtaatgtgatgcttccagctttgttcttttgggtcaagattgctttgacttcaggaccttttgtgattccatacaaactttaggattgtattttctatttctttgaagaaatgcattggaattttgacagagaatgcattgaatttataaatcactttgggcagtatgaacttgaattacactttagaccaaatatacctaacacacataaagaatattccactcaacagtagcataatataccataatgtactttcttctcaagtgcacacagaacattctccaggcatatatatgttaggtcagaagacaaattttaacaaatttaaaagtatttaaattatatcaagtgtggcaatggtatgaaactagaaatcagtaacaagaaaaatcttggaaaaatacacaaatatgtggaaattaaacacgatgctcctaaacaacctgtaggtcacagaagtaatcaaaaaggaaataaatatcttgagacaaatggaaacataaacataaacataacacatccccaaattatggaatgcagcaaaagcagtcctaataaggacatttatagcatttaatgcttatatcaaaaaagaaagatctcaaataaataatctaatgttaagcctcaggaaactagaaaaagatgaaaaaaccaagtccataattagcaaaaacaagaaaatagtaaaaaccagagcagatctaaatgaaatagagactaggaaacaatagaaaaatcaacaaaatgaagagttggttttttgaaaaggtaaacaatatggacaaattgttagattaagtagggaagaaagatgactcaactaaataaaattagaaatataagagcacacattataactgatattacaggaacaattgtgaacaattaataactaattggataatctagaagaaattgataaatttctagacacatggaccctaccaagactgaaacctgaagaaatagaaaatctgagaacaatgtaaaataagaatgaatcagtaataagaattcttcaattaaaagaaaacatccttgattggatggcttcactgctaaattcactcacacattcaaagaagatctgatgccaattattgaaaatttccaaaaaaatgaaatggagggaatacttctaaattctttttatgaggctggaattacactgacaaaaaagacaaggacactacaagaaaaatatttataggcaattatttctgatgaaataatgcaacttattctcaccttgagttcagtttgagaattgaactcaaacacattacttcaaagactcattttcaagtgcacacagcacattctccagacatatgttaggttgcaagacaaatcttaataaatttaagaagattcaaattatatcaggtgtctctgtgtgtggcaatggtatgaaactagaaatcaataacaagaaaaatcttggaaaatacataaatatgtggaaattaataattaccacaataaagtggtatttgtcattggaatacaaagatggctcaacatatgcagatcagtaaatgtgatacacaacattaataaaatgaaagatgaaaattatatgaccatttaatggacatagaaaaatcatttgacaaaattcaacacccttttatggaaaaagttttcaacagcttagatatagagggagtgtacctcaacccaataaaggccatatatgacaaacttgtaggtagcatcattctcaatggtgagaagttaaaagcttttccttcaatgtcagaaataagataaggatgcccactctcaccacctgtattcattatagtactggaagtcctagccagagcaattaggcaagagaaagaaatacaagcatccgagtagggaagaaagaagtaaaattgtctgtatttgttgatgacatgatcttatatagagaaaaccctaaagatacccctaaagaatttgttacaattaaaattgaattaagtaaagttacaggatacaatattattacacaaaattaatagtgtttgtatatactaataacaaattatctgaaaaggaagttaggcaaacagttccatttacaatagcaacaaaaattaaatacttagttctaaattcagcaaaggaagtaaaagtcctgtacaacaaaaacactgacgaaaaagttaaagaagacacaaataaattgaaagatatcctgtgttcatgatatataaaaattaatattgtgaaaatgtctgtactacccaaagtgatttataaatttgatgcaatctctatcaaaatgccaatatcatttttcacagtaataaaaaaatcaatattaaatttgtatggaaacaccacaaatacccaaaacaatcttgagcaaaaagaacaaagtggaggcatcacacttcctgatttcaaaccatattataaagaacttataatcaaaatagcatggcgcctgcatacaaacaggcatatcggccaataaaacagtatccaaaacccataaatatgcccatgcatttatagtcaaaatatttttgtgtcagttttgatggctacatttttcattaatttgaccattccatctgaatagtcaaattcactacaaaaatgttattcacaaatttcttattttttaaattactgaagttcctctttcctgattattaaaaatttgtgttgtctctcattctttccttttaaaatagcttgttgaggtataataaccaaacaataggctgttcatattaaaagtatatagtttaataagtgttgagatatatgataaatgaacactacaattcaggtaatgaacattcccatcacttcctcatttcctcatatctctttttaatccctccgtcctaactgtcccaataccactcctttttctagacaaagcctaatctcatttctattgctatatagatcagtttccatttcctaaaatttatataaaggaatcatatattattcttttgtttgatttcttttactcagcaaaattattatgagatttatatatgttgctgcatgtatcatttgttccttcctttttatttctgagtaatattctattgtatgaatacatcaccatttgtctatccaacatattgtgggtgggcatttcaattgtttatagtttctggctattacacataaagtgttctgaacattcatgaacaagtctatttaaagacatgtgctttcatttctctggagtaaatacctaggagtggaatagtttctcctatggcaagtgtatgtttaactatttaagaatttgccaaagagctttccaaagtggttgtaccactttacattccagaaggcagtatataaaaactctggtctctccacatccttagtctttttaaatatagccattcttgtgatatccctttgtggtttgaatttgcattttcctagtgataactggtgttgagcatctttcagtgtattcatttcccatctgaaccttttacttgtacaaatctttgtcggttcaaatcttatgtccatttgttttttaaactgttttttaaattactgagttctgataaatttttatatattatggctatatctcctttatcaaatatgtaatttgcaaatattttctcccagtatgacctatatgttcattctctaaatacaatcatttttgaagagtagaagttttaaattttgatgaagtttaacagttttttttatggattgcacatttgcattttatcatagcaatttttgcctaactcaaagacacaaggaatttctccaatgtattattctagaagttttatagttttaggcattccagttaggtttatgatctattttgagttaatttttatatggtgtgagctgtgggttgaagtttattattttgtatatagatatccagtggttccagaactatttattgaaaaactattattttctctactgaattgcctttgcatctttgtagaaaatttgttcataaatgattgagtcaattttgggggtcttgttgtgaagacagggtaatagatgagtgaaacaaatagtgacgcaaactcatctattcccctgtctttacaacaagactacactggcttgcttaccatagctttataataaataagtaatgtttgtcctccaaaattgctcttatttttcaaaatcattttggatattctaggtcctttgaatttccatatgtatgttagaattaggttgtcaactgctagaaatcctgctggtattttgattggaggtgcattcaatttgtagatcaattttgggagaattgaaatattaatactgtggagatttccaacatacgaacacaatatagctctccatttattttaggtcctctctaatttctgtcagcaatgtttttagtttttaatgtttaagtcttgtacatcttttgtcagatttatccctaagtattttataaattttatgctactttaaattgtattaaaaattttcactatctggacgttcattgttacagtatggaaataaaattgatttatgtgtattaatcttgaattctacaaccttaccaaaatcacatattaattccagtggattttttcataggtttctttggattttctccatggacaattatgttgtctgcgaataaagacaattttatttcttctttactgtctctatatcactttttcttgactttatgtcttagctagaacctccacttcaatgtttaacaagagtgatgagaacagacatttgtttcctatatcctgatattaatggaaaagcatacaatcttttatcattaagtatttcagctgtaggtgatacggacaggaggcagataaatactgggtagaagaggatggttccccagcaaaggccccaccttaaatcctggaaacccacagccctaaatgggaacaggcatttatcttttcatgtcccaaagttgccttttggtctgccatgcccgcctatcctgtacccatataaaccccaaacccccggctccacgaggagacaaacagaagagcagaagaatagcagaatggcacgataaagagaagagaaggagtgtctgaatgtcgagaggagtttggctggggatagtcaggggaagataatcttcccactccattacatttccagctccctatccatccctctgagagccacctccaccactcaataaaacccctgcattcatccttcaagtatgtgtgtgacctgattcttcctggaagccgaacaagtacctgggtaccaagaaggcactgagctggttaacacttaagccatcccggatggcaaggctaaaagaggatactgtaagacaggcccacttgggctttgggagttgcagacactcaaccctggatgctgccatagggctggagctcaggggcacacaccttagctccggcacctgccctcctgcatgctccctctcgtgaagggggtttgagcagggcatggtggctgaacagatgagccacacccctgttgcaagttctgtgagggacgtcagggaactcgcctatttcacaggtttttcacagatcccctttatcaagttaaggtagaattcttttcttttgctagtttgttgaaagttttgaactgtgatggataatggatttgacaaataccttttctgtttctatgaagataatcgtatagtctctattctttagtttgttaatttggtgaattacactgattgattttcaaatattaaaccactttgtatccttgggaaaaaccccacctggtcacagtatattgtctttttatatattgttggatttgctttcctaatatggtgttaagaattttgctatgttcagccgggtgcagtggctcatgcctttaatcctagcactttgggaggctgaggtgggtggatcatgaggtcaggaaatccagaccatcctggccaacatggtgaaaccccgtctccacttaaaaaaaaaaaaaaaaattagccgggattggtggcatgcacctgtagtcccagctactcaggaggcttgagcccgggagactgaggttgcagtgagccgagatcgccccactgtactccagcctgagccacagagcaagactctgcctcaaaaaaaaaaaaaaaaaaaaaagaattttgctatcttcagaaggatatgaatctgtaattttcttttttggtaatatctttgtggatggtatcagaatcattctagtttcacagagtgtgttgaaaatattccctccttttcaatgtcctgaaataattttagtaaaattaatactacttcttcctaaaatgttggtagggtttaccagaaagccatctgggccaaaagtcgtctttgtgggaagatctttagctacaagttacatttcatctatatatctatgtgtatctatctacctatttatctctctgttatcaatcattatgcaggttattgatttttttctggattgaattttggtactttgtgtcttttaagaaatcgtcatttttactcagttgtctcatttgttcttgatcaatctgctgagaggtttatttgttggtcttttctaagactcaacttttggttttcttaattttctctttaggttatctgttttctattttattagtttttcctctgatcatttttttcctttttgtttttcaagatgtagctttaggtcattggatttagactttacttttttaatgtaagcatttaaagatatctatttctttctaagcaatgttttagctctatccataatttaggttatgttgttatttttattcagtctcacatatttaaacatttctctctctcttttttgtttttttgacccatggatattttgtgaaagtgttattgtattagtccattctcacactgctgataaagacatacccaagactggggaaatttagaaaagaaagaggtttaattgacctacagattcacgtggctggggaagcctcacaatcatggtggaaggcaaggaggagcaagtcatgtcttaaatggatggcagcaggcagagagagaacttgtgcaggggagctcccccttatataatcatcagatctcatgagagctattcactatcatgagagcagcacagtaaaggcctgcccccatgattcaattacctcccaccagttccctcccacaacacatgggaattcaagatgagatttggtggggacacagccaaaccatatcagtgatttttaaaaattgttaaatatttgatttttatcttagctacattattattcttgatttctcaataatcccattatggttagagcacatattttgtgcaattccagtatttcaaaatatactgagacttattttatggttcaacatacagtgcatcttgatgaattttccatctgctcttgaaaagaatgtgtactctgaaggctttgagtatagtgttgtataattttcagccaagtcatagtggataataatgttattcggcccttctttgtcctttctcattttttctggttgtcttttaaaaattcctgagaggctgggtgtggtggttcacacctctaattctagcactttgggaggccaagataggtgaattaattgagcccaggaggtcaagaccagcttgggcaacatggtgagacaccgtctttacaaaaaatacaacaaaatggctgggtatggtggtaggcacctgtttcccagctactcgggaggctgaggtgggaggattgcttgagcctgggaggcagaggttgcaatgagctgagatcaccttactgcactgtagctcaggccacagaacaagatcctgtctcaaaaaaaaaaaaaaaaattcctgagaaaggataattcaactatccaaatatgattgtaaatttgtctagctctctttttattaattttgtccatttttttgtttatgtattttggggctctgttagatatgtgcatatctatgattttatgtcttgtgaaatcactattttatcattatgaaatgttcttcctttgccttaagttgctatatattattaatataacaactccagccttcttacccggtttacataatatgtatctgtccattcttttccttttaatctatctgcattttaaaatttaaactgtacctcttgcagaatagttatgtcttgcttttccaaatattaaaaaaaatctgcattcctaattggaatccttagttcatttgcattcaatgaaattttcgtgtgcttggatttttgtctaccacttcactacttgttttatatttttactactttttatttctctggtatttgttttctgacttttttgagttaattgcatttttacaaaaatattttactctaatttatctatttgctttaaaattatactactttggaacatttaaaatggttgctccaaggcataaaatacacatttttaacttttcacaccccactgggaaatgtaaaaaccttgcaatcatataggtcattttttctcactccattttggctatcattgtcatatatagtacatctatacatgatatacttgtatatgtcagatttacatgtttttacttttctcattaagcatttaaagctatttccttataaacattgctgtagttgtatctcattatttataatatgctattttttataattcaatataaaacattttgcatctctcttgagagtttctttgattcgtacatctttttgatccatagatttttttgtttttgttttaaaacattggaacacacatacacacaataatttttgttgtaaatagtgatgtgttatcaaattatgaaaaaaaataattgtgtttaaccacctcaactcaacttctgatgctcttattttctctataagacctgagatttcatttggtatcacctctcttcattgaaaaagactttcttcatgatttcttatagtgttagtctgctgaggatgaatattctttgtgctagtttgtttcaagactgactttgtttcccttcattcttgtaggatattttcactggatttataattcttagttctcagttttatgttgtagcactttaaacattgctacagtttcttctggcctctattttttgtttgccttatttttatatgtatgtaatgtgtcttggggcactgcttttaagatttttatgccattttttcaacacctaaaattaattactacataattaatatttgtttccatattataccttgcttcatatgttaaaaaaactaacaatatataatacatataattaatggcactaataacttttaaaatagccataacaacattttagtaagtttgatatctcttgggacattactaattgtgttaacattattactaattgtgataatacctaatgtgtgtctagaaagccttgttaattcatttgactttgagttaataaagtgaatatttctttgtgaaaaagattaaatttataagacagagaaaagaaaaagatttttatgccattttggaagttcagtggtttgactctgacatgcttggacataattttttttatttaccctgtatggggcttgctgagattcttaaaactgtgaattatgtcttccacaaaattttggaagtttctcaccactatttcttatatatcaagatatatatttatgtataatatataatgtaatatatgatatatgtaagatatatatctaatatatatgatatatcttatatatatcatatatagtttcatttatatatatttgcatatatatggaattatatataggttcatttgcatatatatggaaatatatatatcattcaatttgcatatatatatgtgtatatatatacatatatatatacacacacatatatatatatagttccatttcctctctcctctcattttgggactcaaattacatgaaacacatggttttgataaagtcctacaagtcactcaggttctatgaaatcattctcaatcttttttctgctttctctaaattgaacaatatttattgagctctcttcaagcccactgtttttttcttctgtaaatctaattgacttctaatccctaaaggatgtatattttaaaaaatgatcttatactttttagttctataatttttatttgattgatttttatatcttccacttttctgctaagattccttttttttcattaattataagcatgtttttaaatagtttttgacaatggtcatacttgctactttaaaaattcctttctgccagttccagcatctgtgacatcttagtttcaatgtatgttgtcttttctcttgtgtatgagtcattttttctgttcctcacatatctaataactttgacttgtatcctcaacattgtgaagtcactggagtcatttgcctgtgtttctaaaatattaacctttgactcacactctaaactccatctttcctgtagtagcagaaactgaaagctctgattggtgttttagccttagctatgtgtatcagtcagtttgagctgctacaataaattaccataaggtaggtataattatcccccatcatggaaaagtcaaagcatgggccactctcctgggttgttcccttcactcaagttttctcttcccttcgggcccttctgtgggttcatgttcattttctactaggtggggtgcttgcactgattaatagcctgaaatatttgccttcttattgattgttatacaacctcttttaaagtaaaaaaaaaaaaagcatattgcacagagaagtggatttaaaattttttttatgaatgagctatataattatgttgattcaggcaatcaaaactcattggacttcaattctgataattaggaaatgtttgatcttgtatattgagagaatggggaagctatttgttgcgtgtaatttaaccttttgactcatattttccctggaggctctaatggtagagcactcagaagtatttggtttagttcctatctcaaaattgctgtctaataaaacacttcagtttctgctttatacttccattgattggtgttaaaattggcttaggaataccaaacattacagtgtttgaattcgaaacatataatcttgttattggaaaaagcatatttacttttaaatgtgttcataaaacatattggaaaagggctactaactgtgcaatttagtgtgaactgtgtgactaatttgtttaaaatgtaaatgcaaagtatttgaatgtaattattgactgtcaaattgatgattactgattaatattattcatcaatgcacaatagttaacatggataccaaattagttataaaatcaggaagctgtgactttggaaaagggaggagatcagtacagattgatgttttaggaaaaaaacttccagtttcgtaaaatgtcgttagcaacaaaaaagagtatatagtgtacaccaatatatgttctttcagttgctttgtttcttaatataacttttattgttaagttctgcgtttctaatttgacagtattcttcagggaaagaatcaaaaggaaattctaaaagaatttcagaaaacttttttaattgttcagaacttattgtaattgccttttaaaattcagattcacctttgttaattagattaccttttttttttttttttttttttttttgagatggagtctcgctgtgtcacccaggctggagtgcagtggctctgtcttggctaactgcaagctccgcctcctgggttcacaccattttcctgcctcagcctcccgagtagctgggactacaggcgccagtcaccatgccaggctaatatttttgaattttttttttttagtagagatgggtttcactgtgttagccaggatgatctccatctcctgacttcgtgatctgcccgcctcagcctcccaaagtgctgggattacaggcgtgagccaccacgcccagccagattccaattttaatcttgaaaacaaacttaaaaaattctgcgctattgttaacaggaaattttgaggcttatagtgtttattaatgttcacacttagagttaggtcattaaaaatacttactttatactttcctaaaaatgtattttgatgtttattccagtacgtaaattttccatttataatgagaaacacaaaattgagtctgatttctagatcattttggttgttaaaactactcttataccacatgtgaatggaagttacagtaaaaggtacatagtgaatagggcaatcacaaatatagtactgtctattagaacatttgataaagatggtaatgaatatatatatatgagatatataaaatcaaatatactaagagatggaaaagcaaatgtatttaacaaatcaaatatataccactgatgttctataaaatgactacctactgaaaatcttcaaaaataaacctcaaagtaatcttttccttgctttaacaaatttcatgtagatattgctttagcaaatgtcatggtagattaccaaataagtattaaacatgtgttgctagtgtatattttgatgatgctcatctttgcctaataaagcaatacatttaaggggaaaaatgtttgtcatcctagatcaaaggcatctaatatgtataatatatatgctatataaacacatatattctatatataatatctatgcaatatatattacatattatatatcctatatataatataatgcatataatatatatgcaatttaaaatgattagcatcctaaaactatttatgatccagatctgatccaacatatatataatatagtggatataatatatatgcaatttaaaatgattagcatcctaaaactatttatgatccagatctgatccaacctttcagttaaaagttatataatcttacacctcctatttagtactaatgcattgtgtagctccatgttagtgggttaagacaaggaatacatagcaaagcaattaactaacaatcaatcaattaaagtcagtggtatgtatggataaagtttggaagtgcctgtgtggttagttgttcaaaaacctataatagagtataggctgttagcttccaacgtcttgatggcataggttttatccttcacttaaaatccaactttttttgcttggagaagatagaatagttgagaaggtaacaattaatacccaaaaataaaatctgaagaagcaactcaaaagcaatggaagtattcataagggaatacttgattcttactgagctattggttctctgctttccatgtctgtctaggccagtacttattttcatggttaatttacatctcagtgactccatatttttagaagtaatcataatttaattccaaaggcaaaatactaatatgaaatgtggtatgattccttgaataacacatgtaattacttttaacatctcaattaatgtggaagatacaggtagatttttatgggaaatttataggcttagaaagctataattcattttattaatagaatatgtgagcaagaagcatacattttgcttatttattgatttttttacttccttatttttatattatatataaattatatattatatttatattatatataaattatatattatatttatattatatataaattatatattatatttatattatatataaattatatattatatttatattatatataaattatatattatatttatattatatataaattatatattatatttataatatatataaattatatattatatttataatatatataaattatatattatatttataatatatataaattatatattatatttatattatatataaattatatattatatttatattatatataaattatatattatatttatattatatataaattatatattatatttatattatatataaattatatattatatttatattatatataaattatatattatatttatattctatgtaaattatatattatatttatattctatgtaaattatatatatttatattctatgtaaattatatatatttatattctatgtaaattatatatattatatttatattctatgtaaattatatatattatatttatattctatgtaaattatatatatttatattatatgtaaattatatatattatatttttattatatataaattatatatatatttttattctatataaattatatatattatatttttattctatataaattatatatatattatatttatattctatataaattacatattatactgctggagttcagtggctctatcttggctaactgcaagctccgcctcctgggttcacactattctcctgcctcagcctcccgagtagctgggactacaggcgccagccaccatgccaggctaatatttttgaatttttttttttagtagagatgggtttcactgtgttagccaggatgatctccatctcctgacttcgtgatccgcccgcctcagcctcccaaagtgctgggattacaggcgtgagccaccgcggccggccagattccaattttaatcttgaaaacaaacttataacacgttataaacacgttatgttagtgtttccatgggaacacctgagaggagcacctggccaaaaccaaggagtcagggaagatttcctgaaagacgtgccaccttgtctcgttaaatgttaaaggaggagcagtggttattgatttattgatttttttacttccttatttaataagaaatatcaaattaaagcattatagtgaattggaatgggaaagcatatgaacgggaaaagtttgattcaaaacagttataaggatgggatgtagaaggatctctgctccagagagaagctatgaaataataagagggaaaactacttaggacctgtgtgtcttccatgaggtagtggaatgaagaacttttcagagtttctgccataattatggttatgattcttcattttgttcttgaagcccttggggggaaaaaaggagaagcataatctttattatatttcaaatttaacctcattacataaaaccccaaaatatctaattcggattatttcttaaaatgtcaattcttttccctgatagttaccagataggttagttgacccagagaatgaggaaaggcacaaaagtcctgtttttcttggtctctcatcaatccaagaacacagagggataatttttgtcttcctatttgttcagtttttgaatcaacaactttcatttagaactggagttcctactattacactgaatatagtgaaggaggttaccaactgagtgcagtacaatttgagaactttgatgcacaagaattcaggaatgtgggaatccagttgtaatctaagctctctacccagatgcctcattcagtgggcagtggtgaccatttgctgtccttctgctgaattcctgtcaaagatccttgtcagcaaccgaaaagaaacaaggcaaattcatttatgggtaacttctctgtttgcaagcatcacttcttaccatccctgtgttacagataaacttactgcacaaacgcagtggtctttatctgctcctgctgtttagtggaaatagtgttttctcaatctcttctgggttaaccactgctcctcctttaacatttagtgagacaaggtggcacgtctttcaggaaatcttccctgactccttggttttggccaggtgctcctctcgggtgttcccatggaaacactaacataacgtgtttataactatctgtcttggggactgttgtccactgaactataaattgcataaggtcagggaatatgtcttcacttttggatttccatcgtccaggattgatcctgggcaataaaggattcacgataaagccctggtgaatgaatcaacaaatgaatttcaataaatgatgtacttaaaaggcaaattaactatgatatattttaggaggctttattgagtaaaagtgattgagctttcccatgaatgcatcatttgaataacaatttttaaattaacaggttagagaagaggagataatttagcagctattggttggcatagtggcctcttttgtcgtaatttttcattcaaattcttgttcttgttgtgaaaggatgatattgtgaaggtgtacaccctttatttttataatccctgcaattcctttgtttatttcttagttctttattttcaaactaggccttggctttaaagccctgccatggaaaggaaggtgatagcagaaattcaaagtaaaacagaaaaagtcataggttttattactcttattacatcacaaaaatagataataaactctcataggactggttgaagaaaggataacacctaactagagtaggtattgtgaaacaattgtgtctcaggaaggaacctgtttctatttctattacattgagttctaaccacacaaacaaatcttcagacttatttagggatctgagggcagaaagagaacccaggaagccagtgcagtcctcgtttcatatttccctgtgccatgtgatcaaggtttgatagcagaggaatacactgactaattggcatgtatgggcagagagaacttgggaacagccaccttgactgctgctgcctagagtggtgtcagggagcaggtgaggtttttagttgagttggagggcttggcttgaaggtgtctcatggtagatggaagaggcagccataaatgatagcacaaccaagccgaaggaccggaagaaatgggtggaaaaattgatgccagcaaagactaggggtcaaaggcctcctccacaagttgttgatgttgtaagacagcctctcctctgtagacactgaatgtcaaagcttcccctgagaaaagatcaaggaaactgtgcagctttaacttgtacctcaactgactatgatgaacatattgacttgatgctatctacctttatttggaatggaggcttgaattacagaataattttcagagagatcaaaagttacatttgcagttctgacttcttagtgtgacattatcttactcattatattagtttcaccaagatccagttctctaaaatgaaaaggaaaaaaaaattgtaataacttcaagatggggatccatcttctgtgtcccacacagaatagtccattaatgctgacaaacatattttcccatttattgccaacaacatgttatttcaggactttatattgtgtatgttaaatttctgtctctgtctctcttctctctctctctctctctgtctctcatacacacacaccttgtacaatatagctcaccttactgaaataacaaataatgtgaaaatgttatgtattcgatcaaagccacaaaataaattgcagagataggttatagattgaggtctatctcccttcagagattttgtacttctcatttattattgtgacctgaaagaattgatacttcctcaaacataaccttgttacttttttcttactaattgctggcaaatgataaaaccttcagcttgcagatgacttctaaaaaacagtgaatggaaaagagccttgatggcttaagtaatctgttaatagtaaaaagattgatttattataatattgttatttattgaagtcatgagatggcaggagagagtacaatggggtattgaatttttatctagagaaagaaggcattgtgttataaattttttaagttcaattttttaaattacagtactatatcaagattcagttagaagtattaaaaattcaaagattcagccatttcagttgtcaagcatgtagaatcgcaaactttaataagaaaaaaagtttatcaaaagatgaaatggcaagaagccctagagtaggcataactggtgacagtatgtgtggtgtcattaccacattcctctgcaggatgccacacattccagtcccttgtctttccatcattaaataatacatagtgacttttttgggtctcctaaatcttttgttttctttagcgaatattaagttgtaaaaaaagaccataaaaggaacatgtttcctaaagtttttacttctgaacattaataaaatattctgtcaacgttgttaattatttttatttttaaacatgtaaaggttgtgcagttcacacatggtatttactattggattttgtagaatcaatttacttagtagaaatacccttagtttgtaaacaagtcatctaattttcatttagctatataagtaccacataaaaattgattattctcttataaaatcctacggtgacttatttcagcattctatatttccagtgatatgatgtagaaatcaatgctgttgttactaacttaatggaagtataagagttgcatttgatgttgatttctatgttccatgaagaggaagagactgtgtaaacatatatgttcttacactgtcaatatatatgttgacagaatattataaaaggttagttcaattactgtgcagacctatattctaaattatcagcaaatcacagcacacagccaattctcctaactataggcaatgtccgtttaagacagctgtttttccaaccatttttaatattttctgggtttaggaattttccaagtcctcttaagtacagcttatttcagtggttgatttttttttggtctctatgtgtaatattttcaaataacaataactccaaagggtgaagatataaaagatttgtaataatattaagcaaatgaagagcagcagacgtattattaacatgacatataaaatggacaggataaattagaaaaggtcctataggagcactcataaaagttttcatctagccttttgcccaattatattttatattctgaaagaatggaaacaatctctcttaaaattttatagcactcagggcctatactaaatctttcatatgttttcaaattattcatttgcaaaaattaaatttatactgtaattatttctttaaaattgggtagactcaaccagtggcagtggttttaaaaagactccttaactgtgaaacagaattcattgcataaaatacattggaacattcacattcagttattacgacactagtctttcacttgaatgtgtctgtttatgaatttatttgtcaagaaatttttgaaatctatttggtgaaagtagagaagagagaaaaaggataacagatgaggttaccagggaacgttatgaaaagaaggttgtgtttgggagaggtgtgaaaatttggaagagtgattatggcaaataagaaagactgctatttggagatgagtaaaattctgtgaagaaaagtgaggttgggaataatcagtaatgaagtcctttgccacaattttatgtatttttccaaaagcttcaagtaagagcagataaaatgaactgcaggtttttccacagataacctgtgaagggtaggattggggaccgtttggttgaaatatttagttacgagatttaaggtggatatagaattacatgaagacaggcttgttttaacattacaatatataactaaactgtagtgtaattaggctaaatacatttaactcttcataaggttatgagaatgtttagaaataaaacataaaacataaaaattacattaaattggtactaaatcttacatagtgccatatttatctacatatgcaaaagtgtacattgtgtctctctcctacattcataattatacagaattaatcagtttgtgatatcttactttttgcttcaaatcaatcattaattttgaagaactttagattaaaaatgaataggcttctgtagatacactaaaatgtcggattctggtgaacattttcacaatcttggctgtttggccagtttttaacaaacctggagtttttttgttgtgctcgttgttcgtgagattttcgtgtgtctgtgtatgcattcattcaacaaatgttgagtttctgttaggtagcagacataattctagacatcctgaatatagttgtgaacaaaacaaacctagtgtctgttctcaatcttaggatctgattctaaattaggggctctgtaaataattaatcacttacaagtcaaaccgtttaattacttgggtaccttgtttattatagttaatagcttttacttggcctttgcacctggggtcatcctagctccactagaaacaggcaactcaattgaattacagcaggttcacctgcttttgtagctatggtatagctaacctttaattcctaacatcaagtcttcatattcttttctctacagtatgccaagggatgtctgaaaccttaattctttgaagtgggcatgacattggttctaagtttgggctaactaacccaccataccattatgaatgtagtgagcttttcaagccggcagattgtctgctaagggcacctacatcaacacatttagttcactcaagtcccctcaaactcaatatgtacaaatatgctgtagtgtttgttattaaacatgcacagatttccatttatatcagtctgatcaaaataatttacttccatatgtggttattttagacattatttaaagaatgtaaagtaatcctgaaaatgtcaaatgagtattacaataacttcacaaggctattgattctttctgatgaatatacttatttgtcttataaaatttatacttattattaaggaatcagagcatttaaaaaatagatttttaattattgtacaaagcaattaaatatccaaacctgtgttgaatcaggactgtgagtgatcttagtatgtgaaatagtaatgttttctgatggccagaactacatcatctctattgggagttcactgtcttgtttgttacatggagaataaaatcttttatatgtaatttttaaaaaacattattttaagacaaaaccttagttttactttttgcagtgctgcagaataaattctgataaaacaactgttaaagggtccctatgataaaataacactgcgtcctgggtaaattatgacaaatacaaagtttactgcacttcaagaattgctaaaataagttaaatcttaaaggtgcctaaaataaaatgaaatgataaaataaagcagtttgttctgaaggaaagtgcatatttcagtggtgtgatggaaagataaatccatgggagtccagcaatatagagaagctgaatttgaaattcctacgttaagcttggaaccttgaagggacaaaagtgttctccggttgataaaaccttctaaaaccagaaagggcaaatgcaaattcaaattcaagagaaaacatctttcatttggttccaaaccaatctcacagattatattttaaaatgagtttactttaggaaacacaattactaagcatggcagagaataagtcaccatggttgatatatagggaaacaacaatagacttatttcccccaatgacttcagatattggaatgatcaaatttaagatataaattactttgaaacatataaagggataaaaataaaatggaactgatataattacaggaaacaatcaataatgtcttggtaggtttaaaaactatcccaatagaaattttagatgcaaaaaaatgtaattgtagaatcccagcacttcgggaggccgaggcaggtggatcacctgaggtcaggagttcaagaccagtgtgaccaacatggagaaacaccatctctactaaaaatacaaaattagacaggcatgatggcatgcacctgtaatcccagctacttgggaggctgaggaaggagaatggcttgaatccaggaggcagagcttgcagtgagccaaattgcgccattgcactccagcctgggcaaggagagcgaaactatgcctcaaaaaaaaaaaaaaaaaaatacttgagtgaaaaagatagataaagtttagtagagagataggaaaatggatgatagagttttgggagctaaccagaatgtaatacaaaacataaaaggaagtagaatataaaagagtggttaagaaatatgtatgctaaaaggaacagtaacaaatatctaactggagttctagaggacagaataaagaaaatggcagaatgacaatatttgcaaatataatgggtgatgatattccagaagtaacaaaaaatttatagcatatgctattaaggtgtcaaaagaaatttttatttaggtgctttttagtaagtttgaagaacaaagacagaatgaaaattgtcaaagcagccagtgagaaaatacacatcaattacaacagaatgacaaatagattgggagtggatagcttaagagtaaaatgaaaactaaagaacaatagattaataatctttcaaatatgaagaaaaattaatgtcaactttagaatttgtacctgtcaaaaatatctttcatggatgaaggcaaaataaatatctttttagatatgcaacatttaacacatgttaaccaaagaaacttttaaaatacgtattttggaaagaaatgaaataaccccagatcccaggtttgagatacaaaataaaaatcataggcaaataatctagataacataatgtaaataaaatactgtttgtataaagtaataatgataagtatgagaacaattatttttaattaaatacaaaaggaaagagaataatgaaaaaccatagcatataagatgggattgattagatttcaagtgttggaaaatccttttactatttgtgagagggtttataatccttcttgactttaaatgtgttaaaccaaaatattaacatatctgcaacaagaaagaacagaacactatagagaagggttgaggatttctgggttgtcgacctttggggatccttttatccctatttcagttcatggtgtaccagactttcccatttaacagtcccaatttatacttaactggtgtgttcaacagaagttaacagtctgcaggatcatattttactttctacttttggctacctcagctatattatcattattatagaaaaatattggttgtattttatatctcaggataaaaatttagagattaggacttattttcattccttctttgactctgcattggaaggtgaagtcctgtctccaaatattttcgaattctttttcaatataaatggtgtttagattctacgttgctaaaacttaatagtgcccagtgtcctctgttcattttagaattacataagttttacaattataattatagacttttctttcttccaagtgagataaaatgtcttgctagtgcttactctcctaaaattataatatatttgcatacaaataaaattgttatgactgttggaattattttaaaaatgttaatcaaattatctatactagaactggtaacccagttacatatttgtgtctacacctttactttttcaactgcataatatgtgttatgacacttgccttgaggacaccaatgaaatggatatttctaagtcgtttctccaaagtctttagtcctaagtgtcaaattgtgctctcaacttaatttattttgtttagtaattcattgagccctatggctttaaatatcatctttatgctggtaaacataaaaggcataaacttgaattcccctcccctacccatcctgtagtactgacctctccatttggtgagcagtgctgagccattatcctacttattccagccacagcataggaattttccatggttcctctttttctcttactcctgtccacattagcaagtcctattaagtatgcattcaaacaaacaatgtcttgaatcttttaatttttccatcttattatgactaccttagtgcaaaacactatcatctgtcacctagctcactgtaataacctcctactgatttctctgcttctactcaggctttcctcaatcatttattttttaaccaaggtatgtgtatatatatgtatctatgatttaaaaatacattaaagacacaaatcaaattatgttcattatctgctttaaatctgccagtggctttctatgatacttaaaataaaattggaatcagttgcttgtctgcaaaatcctcccttccataccatttcctccatcaccaccatgccatcagtgctagctgttccttctttcaattctctccctcatctttttaagactgaccctcttgtcattaagatctcagactaatgtaatttcttagaggcttttctgactactagagttacctagtcactctgtactaaatgccttattttttctctatgtgatatgttattatttatttttatctctgtatatctctctatcatctatgtaataccccctaatttccagaatataacatccatgagagcagcagcaacctcatcactatttttcacacaagccattagaatactacctgggcttttgatggtgctcattaaatatctcttgtatacatgaaggacatacttttctgctgttttgaattaatactttattttttttttacttatgtagcaaattttgttaatgtgattgcttattgataatggctagtggtcttatcatccaagaatttaaaatatatatatttctgactacatttgtaaatgtcttattcaatatttaaattaacttaaaccttcttgaaataatgctcagagtaatttctactaaattggttgaactttgagagcttctaaaacctgcacatgaatagtaatttatttctgtctagtccaaagttgtttgaatatgacatgatttagcctatttttttagtacatgggatgcttcataacttcaagaataataaattttaattttgagcaccctagcccaaaaaaaggaaactgtcagcactgatctagtttttagtgaattcccctgcaatgaaggactgattgggttgtggttttaaagctacattaattctgtttctaactcttttactttctattttttaggagtatttgttacaggttttcatatctttagtataaattatctttctttatgcaggatacctttctgaaaagggtccgtttaaaatttctaggcaatgtatttttcttttagcatgttaaattagagttttttaaaaagtgtatgtattgaagaaaatacactgtcaaataggagatattcatatatgcattccaatagcaatcagttgaacttttgaataagtactgtagaaaaatatttttctgaatggtgcttttacaaattaaattcatataaatgattcagattttttaccttcaaccttgtcaggatttaaagtattctctttttctgtttccttttggtttcatcttaggtagtagtctttataaaggcatttacatttttcaaaaactttcttgccttagagatggcgtgatttgtcattaaattaattggaactactatatgttgaacttgatcgtaaacatgtgtacaaaattatacttttaaatttggtgatttaccatggcaaatcctatgaagtaggtttattaatattgttgtcattatttattttacagaacagagattcaaatgggttaatgacttttctggcaagatataactatgaagaggcagaattagatttgcattcaggctgttctgtggcagagaaggggaatactaatctagaaacaggcatagactaacgtgctgtgatgtttaatttaactatggaacacagagctcctggggagagcactgacaggcaacccaccaagcttttgtaagtcatgtgctgccaaaattcccctgccctgatgaagagggatctggatccaactcaaaataatatggtaggagccttagtcacatattcagacctgagtataaaggataaaaacaaataaatttgagcctatattttcagaagtctctgtaagctaggtgataagttatgactgttatgatactacagctgctactactcataggggattagttgccaagaaaagaacaaacaaacaaacaaacaaaaaactcaggcaatctccctatctgatgaaacaattcatttcactgcaaaaggaatgaggtcccagttttctcaccattcccaccacagtcatgagaattcatatcacaaaggtggtggtctacagattctcttacatgctttgaatcaatggggcacacaacttgaatacctaggctcagaaatctagaggttgaaatgtcttttatttctttctgtacgtaggtaggatatgttatttctttgttattactgctaaatatatagtgtgtattgatggtgatcacatttaacattgagtgtactgatttcataaaggaaaaaaagaatacctgggtggtttgtcactgtactagaggagagatgggcctcccctggattgaggattatagtcagactattggcaagaattttttgaaatggcattatgacatttttttcgagatgaagggttgcataattttgtgttgtcacgtgattggaagtggtgaagatgcatttatagtgaatccaaataggaaggtgatgttaaataagaggcatccttggcactctgtgcacaggaagaaatgtatgtgtgttggaaatccaagggtagaatatccatcatagtgtctgccattttcacatgctgccccctatcctgattcagttggtggctacagataaacatgtttaaatttcaggtatcttgactctcttgagcatatataattggacttggggatgagaccctgatctaaggtagggagttcatagactgacctacagagcatgacgtggactcttgtaaagggatatgatgtgtctttctcttagcaagtcaaactagaaaaaaaatagtttaaatcaggctgtaatgagaatagaaggtgaaatgatggagcagatttacggaataaggatcaatggccattggtcatcccaaatcatgagaaaatagaagataattaataaggaaaaataataaggtagaggctgggtgcggtggctcacgcctgtaatcccagcactttgggaggtggaggagggcggatcatgaggtcaggagatcgagaccatcctggctaatacggtaaaaccacgtctttaccaaaaaaatataaaaacttagcctggcgtggtggcgggcacctgtagtcccagctactggggagtctgaggcaggagaatggcgtgaacccgggaggcggagcttgcagtgagccgagatggcaccactgcacgccagcctgggtgacagagcaagactctgtcaaaaaacaaaaacaaaaacaaaaacaaaaatcaggtagaaaacagctttgtaggatggaaaagaacaaggcaggtatttgatttagaaagcccatatcattaggaatagagaaacatttggttacaaaaaatgaccgtacaatagagtgaaggtctatatggcttttcactgctgttgaagtctgtagagttcattgaatcctaaatagtgtttcagtaccagttcctgtgaagctaaaccatattagattaatattctttgtttctttttgaatgagctaatattcctttcctctcaagaaagagaactaaatctgaattgcttaatttaaacccacaatttatttaaagattttgtcaaagaaaaagtgcattggatagaatgaaacaggcaaggaacgttttattcaattgtaatagaggtcaaaattattgcagtaatggagattgaactcaactcctttgaaacaaaaggcaggtcgatttttaagctctggggtgagctaatggaaaagtactacagaatgttgtggggaggttgtcaatgtgattagcccatttgtgtttgctaattgatactttttgaagttaggcccctactcccaaacagagactagcagataggggctgtgtctttcttgatgattatatttcaaagagatagctcttgggtgcttgagaaggacatttctgggttgtaaaataacaaagaggctggggaaaaaattacatctcaagaagcagagaaagaatttacagttgtaagtgttctaaaataaatgctttaggaaaaagaaggtcggggcctatcttcaggaagaagcctatctaaagtttggctaagctgaggtaactttaaggttaatgctgtcttcttcaattaccagaggaattcacagatctaaaaggtgttgccaaccaaacttcagaatggcaggaagcagaaagactgcaggtaccttggtggccagaagtctgtatgttttccccaatacaccatcattaagatgtcatcgttttctgtcctttgaaaattaccaggagcatcctttgacccaatttagatggggtgcgtacatattcattcattcatctgacaaataccaagtatctacaatctaccagatactgttctaagcactagggatatgtttatcagtgaacaaaatgttcaaaattctccatactaatgaaactcacattctagtgggaaagcaacatatagtaaccaaaataagtaatacaagtatatagcatgtagatggtgttgttttgtaagcaatacaagtatatagtatgtagatggtgttaagttttgcaaagaaaattaaagcaaggaaggggaatataccacatctacaatgttatagtccaatgtatggacccctagccactctggggctattccatgcatattctctgggcaattgctaggtatgagacaacacttatgacatggggaaataaccaaattggtgtatgttacacccttttgacttctatttctatgctatacaggctcattatttaccattaatttgcaaattaactgtcttaatttaagataattaaatgcatattaaaaatattttgaaaggctgtattataacatactagtattggtttactaatttagttgattggaaggttatgggtcatattttggtctatacttcttcatattttgtacattttcatcaatgggcatatttttaccttgataattagaaaatttttgatactttaaaagtttagcttcttatataacttaatcatcatcattataataatcacttttagtactaagcactttcttttttatcatcttatttaaaacctcaaaaatgagtctagggaagttgaggctagaatataaaagacctagtatgcacattaaagttttgacaataagagaaaattgaaagtgtttaatgtgaagactggcattataatatttattttgaaaaaaattaaaaaaacctgtaagttacacccagagtggaatgatttggggaggaactggagttgactatggtattgatggagggagacatgagtatagttacagagggaaggaaatagtagggctttgctaaagagaaaggctaaggagacattttggaacgaatgataaccaatatttcatttaactcacacttctgtaacaggggtgtccaatcttttggcttttatgggccacattggaagaagaattgtctttggccacacagaaaatacattaacaataatgatagctgatgagctaaaaaaaaaaaaaaaaatctcaaaaaaatctcataacgttttaagaaagtttacaaatttgtgttgggccatagttaaagtcatcctgggctgcatgtggcccacaggctgtgggctggacaaggctggtatcgaaccaaccttatattcctgagtgagagggctctagactgaaaactcccaagccctcttgatactgagctgtccatcatccccaaattccaaatgcctatatggatgaactccatcctcacatgtgtttcacatttttacagtgggatttctattatttttatatatttattttgcaaattatagtaaaaatttatcagttttaaaaacaaaaggaaatagttgaaaaacaaaggtctgcaagttgattgaaatactatacttttgctgtaggggagccattgtagttttaggaagttgtgttatattagtttcacctccattaaggcttttaacccagaaattcctctttttaaataatatcaaaacaatttccagtaaataaacactaggtgcaaggaaaataattatattagtatgatttccttcaaatttgttgagaaaggaggctccatagccttcgttctacagatgatcaactttgaaaaacagtggtaatgtggctgtatgctcgcatatgtcttttaattgactagttagctatttacttttctgcttgttgatgactttcctaattgaatagaaaagctatagttacccaccacaatataaaatattgaaaggtgatggagaaaaagcactttactagtctcttgggaaagaaaattgcatattgtgtctgtaattattttgctctctgaagaaatatatcagactgccatttctacatcaattttctggatatcgtgggacccattattttaatgtcaacagaaacaagctcttgtagagtttctctgccttttctatgctccagttaacctgagggacctttaagctataatttatagagaaagacaacagcataacacaaatgagttagagattgatttgtaagtcatgtaaggcatgcagagtaacaaatcgtggaccaaggcaatgcagatcagaaaagaaaagaaaaatctgcactcatcacactacctaaaagtggacatgtaatgggacgttgatttaataaatgtcacgaaatttcaaatagaccaatacttaaagcctgtatgagaaatataactaattgtttatccattcaatggctacttatagctcaactataatggggtcagacactgtgctgtgcaatggagatacatgagtgagcagagtagatgtggcttctgcacttacataggattgaaaatgaaataatcaatggtgataacatttgtagactatactttgagagctgtacaagaacatctcatttctttttgggagaccgtagaacaaaagtgcatgaaaaataagtaaggtggttaagtaagcagaaggtttagggagcattggaaagaggtaaaattatatgggaaggccagagagacaagtagtggcacggaactgaaggaagttcaggatggctagaatatggcaagtgttgagacgagtggagagccaggcaggcggcaggcagcaggctttgtatgacctgttaaattacaactgacacccaaataagtccaagtgcattcgtctttctaggattatttatcaaattcctacattttttcaagctgtttaagatacaaagattaaaaaagaacgattttttaacctatcgcatctccaatttggtgtaatagaaagtgaaataaaaggatgacagtaatacagagtaaaaagtgatatgaatgtaaaagccagaagctgctaaagaaacagaagaaggaaagtcaggaggaaggtctagagcctgagaaagacttaagaggtgattcttgggttgagtcttaaaggccatcggaagctggtgaagcagaggagggaagaacagttgaggcagtagtaccgacgtgtccagtggcttagaagcacaaggaacaagatttgttcagaactgcaaggggaatgcttttattacagtagcatttgtcaaagtgtgcctcagtaaacaatctgcaagaggatctggagacactctgtgtacttcttggaaagttacaatgcctattagtgcagtaagggatctgaaaatatccacagtggggagtgctgtttaactttatttcatatggtgtttttcagaacaatttgaccacagaatttcctctactgtcttcttttagtttaaaacctattaacattcattaaatacaccttgaagttgatattagaacctagactgggtggtggaggaggtcagaggatggggctacagaaggtcagatcatgaagaccttggtctgccaggcagatcgttagtgtagaacgcacccatttccttccaggtgaaaggtactccattgatgtggcacatccaactttactcactccacgctaatggggttgtggggagtgattcatatgaaaggtaaatttaggaggagttaaatgagagtatcatagctgtaccattcctcctcttggagtgtgctgccagctgggagcacctgctccaggtgggaagatttgctctagttcagcaccacctgggtctgggagggcaattttcctcttttgggattcaatattaagaggtgcatttgactgtaagaataaacaatatttccaacatagtttcattggcaataagggagatgtcttagttagccattcctcattcattgttttatttctcaatctcttcaacattttttataggcaaggaggtgatatgtgttgaccttcatgagatccagatattgaggattttgtctttatcctgtagataattgggaaccactaaagtattttaacagaggagtgacattgccagatttgcatttgacggcttagatagcagtgtagaagatatattaaaggaggaataaatagagtctgagaaaccaatctaaaaggacagcagtaatccagacaagaattaatcagatcttgaactacatcaatggtagcaattcattggagaaggggatgaatatggaatacacataggaggttgaatgaacagaattaggagactgattagatgtatgatatttgagagagacaatctagcacaactctcagatttctgaatagagctggtttgcattaattttggtggaaatgaaaaactagttctagcagactgagtgggcatgccttaggaatccaactggagatgtctaggtgtttgttgtatatacctgtctgcattccagagacatttatagtctagaaatacagacatggcagttgttgattaattcgtggtactcaatgtcatgacatcaatcaggttctttaggagggtgtgtggaacaagaatactacccagtatcaatactgaatacttattacatgcccactatgtaccagcattacattaaacactttacacacatgctctcatttaattctcatgaaaactttttaaggtgagcactattacactattatcatcactttccaaatgaaacttgggaaaacagacggactagaaatggcatcctaggaacactaacatttacggggcagttgaagggaagaaataaacagtaagaaaagaaaaagtggttgaagagaaaataacttttaacacgaagcatggtgctgaaataaaagaagaactggtcaacaatttcaaatacttcatagatgtgaaatagaagctgaagagtttccacttgatttggcaactaggaatcatatttattgtgttcataaaccttcccatgatatataatatatacacacacacatatgtcactctgtcacccaggctggagtgtgctgctatgatctctacttactgcaacctctgcctcctgagttcaaacgattctcgtgcctcagccttccatgtagctggaattacaggcacgtaccatcatacccggctacatttttttatttttaatagaagcggattttgtcatgttggccaggctggtctcaacccctgacctcaagtgattagcccaccttggcctcccaaaatgatggatttgcagccgtgagccaccgcacctggcctcccatgatactttaaaaatacttgataaaatacacttgtattcagtaacatacacagatggtctttgtggtttgctattttaattattttttacaggggacgtatattcagagagttttgctatgcaatgctctttgacaaatttaactttattcagggttgggggttaagcctgctatgggattaaagaacagaaaaccacagggctctcattctcttattgtttcttctattaagggtcaaattcaggagcatagtgtacaatagcaattattcgtcagaaactcagttccctgttagaattctactcagaaagtaaatagaaaaaaaggagaattctatatgcatttgggggaagagacatggtcgatgacctagaatttgatgaaaatcacctacctgagagtcagattgattattaaataaattagcaccaatcaaaacttctaaggcacagagctaaatgagcttatgaccctgtacattgagggagttattaggatgctaaatcttagaacaagtctctgcatgcatgagttttaatgaagcagatgtacaagcagatgaacattattttaagaagcaatcctctccaaaaaacaagataatattgtagttttatcagcaattgtttacataccacttgatttctagatttaacgctgattaacaatgcactttcttttataatctacttttttatcattggtctggctaatttataagattttgtgtctgtgtgttccttctgaaaacagtagaaaaatgatattgtaacaataaatatggagcttacacaatgggaaacaaggaagagaaatcttaacatcaatggcagagttaatgtagaattgcagaatgcaggcccaaagtaataaggataaggtgacaatcttgatctggttaagagatatatagtacctcacgcattatgactgtcctgttacttggagtcgttgacaactgactaaacatagggacacatttggtattcttttgcattcagcagaatgcagcagaataagcttggcagatataaaaaaacatttatgttcctccttctgcccttctccatccccttttgaagtgcctatacacaggggctttgcctggggatttcccagggctcctcctgccaaacaagctcaggcagggcagaggggtctcaaaatcctgaggacttggttgtgaatttggagtctgaattatttatctgttttcattcctagcacatttgcctatttttttcttttattcaaaacagtctatttaatttctgaaatgcaaaagaatgtttggcatggataaatagctgtgatttctctctctgataaatcttgcaatgttagagtttaccaaagagaacccacatattcttgtcagtagcatgggctttggagtcaggcgactaattctagatttactgcttattgctcatatgagtatgagcaagttactatactactgattctttttttaatgtctaaaattgagttaataatgtttagtatatattcatgaaaaatataaggagttattgtgtacaaagtgcataagacagtgtctaatcctcagaagacactcaataaagggagtctaccttagagttgagctgtcttgagtccaactacctgggataaagtctggactccatacctagcagctatgacttttgctaagttatataacatttctctgcctccatttccttgtttgctaagagggattcataatagggtctactgtgtaagttcatgagaagattaagtgagttactacataaagctcttagaacagtgctagacatagtaaaatcttaataaatgtttttgatgaaattgattatataaaaattactatcagcatgcagtgctgtcaaaggtataatggaaaactataatgaaaacttgatttctatccaaggagcttgtgctaaacagcaaatgtgttcatttttaagggttcactttcctttcctcattacttttgaactctgttcattacatttgaactttgtctagtgctttgaaatgtgaagatcaacataattttaatgatctcatcaactttatgcagtagatacccctctgagcctgggggagatgggagtttaaatccagagacagacatgtctgtggtcttacagcaaagtaatggatgctctggtactgtgtttatggactttttacactgagtccactgcttagtctgattagttcacagtccttcataaagaatgtgagcatgctatccatccaagggtttatataaactacaaagacagcaagcaagaactaaaacagaaccatttttaatgcacactttttattgttaatgcaagcgacatcatgcagaaaataacatatctcattttccaagcaatttaatggtcttccagttatcatttgacaggatcaagctataaatctgtttttatacaatttgaggaaggcttatggaatccattatttatttcatttttttgtaagatctaagtaatattttttgtagttaatgagctgccaaacatttagttttcttagtaaaatctgagtatatcattttacttgttgaattttgatggatacttatttgcattagattataaaaggttaatactgaatttcaaatcagtgcagagtcagtttctattagtacctgccatcatccttgctagtgcataatccttcaggctatataaacaccagtggcctttcttgatttaaatgaagcagagaaacattgttttagttcagccctaaaactgaacccctcatataatttctaggagttttcatgggatataaaaagagaatggggctgattcagatattcttctagctcttatggaaggtaaaattaaaacaataaagttataattaatgaaatacaacattgtgcaatggagagtagagctcttgcgatagctcctttgtcttggagggctctctgtgcctggggtgggataggatgggaggggaagcttttgcacttagatgactttcttcacttttggggcatgataaatctgtgtcccaccttttaaggtagtgatgctggatgaccagtatcacatctgctatagttggactgctggtgtggaaattgctcttttggactcagtttctgatgttatctgagtagcacctctgcagccaacctaaggcaagaggtctacccctggaaagcatcctggctgtgtcagggctgccagttcttgggtctgcatttctgcttccaaaattgcttgtgcacttattcctggctgttgggagctgcttctcatcagaccactgcacaaggtgtcatttcaactaatgatatagtagcatttatatttaaagggggtggatatatttttaatattttaacagatacatagctttttttttttccagaaacaaccatacacaccaaccaatacagacaatgacaacaaggctctccattaggatgaagcctcatatctgatgtttaagtccagaaaatgtcattcctagatatatatacacagatgtgtttttgtatgagtaaattatcaagtaaactataatttttaatatttggaagatgattatcatatcatttgaagtgcttttcactgtaagttacttttatggaaatagtattgtgaaaaaacttatttcttaatgcaacttataagaacaaattcttatgtattttaattttatttttaaaaactatatttttctgaaatatgttataaaatatgttaaaatatgtctgtcacaggtatagattattaaaaaataataaagcttttatctgctttttacaatacatttttctttggctgtagtctataatatcattttatcataaaacaaagcccatcaacactatctaaaactagtactgaaaaagaaaaactggtatatagaaattctctatgacttcgtttgtttcagagtagcatttgacataaaggtcaacattgactaagcccttgcattatcaatatattcttccagaaaaattttggcaacaacataaaacaataggatgttttaaaattattaataatttcataatctgctttaaagatagtctttgaggaagactttctctaaggaaatacctttaaaagtcaaaataaaaatctgtaatcctatctgcatggtagaatcaaaaggcactgagtcttgaactaataagggatagggggaggattcttgaagtacatgaaacttcatttatactatttttaaaaaaaacagaaaataccataaccagacacagtgccccatgccagttacaaactccaggatgtattatcgtggagaacactctttgatgattggctatgtaaaggtgaaagtggattacacattttggaactacaacagggtgtattttctatgacacaaacatctcgtgttaaggaattggcttaactgttctaacaaaaaggtcttaaaatgaagtggcatcatcaatgttgtcttcattgttatcatcatcatcatcatctagattttatttttctcttgtgtgacagattagagaaaagaggtttgggctggagggagccaattcttcatgaggatattcaaggactaaatttgcttccattatgttgctctgtcatttcctgggatatggtcctggagtcaagggagaatgacaggttaccttcacatatgttttctagcctgcaagcaaaaaagaaagagtggaagtgaaaggaaaacagtttaccctttatgcatataatatggaagttacccacatcaccttcatttagtggaatggcaagaacttacaatcgtagatgcaaccagctggaagggaagcagctatggcacagctaacgcttgcagatagttctaccacaaaaattatgaaaggaagactgatacttcacaatctgttctacacttcttaataacaaagcaaggttgaagaatatcaaaaaggactaataaaattataaaatatggatgacctgtttaataaaataaatagagaaggtggacagcaaaattattaaacagaacaattaagtacacataaaatcagtctaaagttttaaaaataggaaagatagagatcttgaattgttagaaataataaatttgatgagttttaggttgactgaagaattctctgaagattttaaaccaatttctacagtactcagtataacttattcagacaatgtattttgtcagatatgccttacaaaagtaattcaacttatgtaagcacatatccacatctaagtactgaagaaaataatgtcatattgttaaaacagagtacacatttcactagtttattcaacatggtaaagctcttgaacaaaaaaggtctttctaaaacacaatcttagattcttattttttgcctacttcttttgcatgaattagaaatgtaaaatcgagagtaaaactaaagacaaaaatatgatgataatacgatttcattagattatgaaacaatttcaaacttacgtcttggtgtgggagaattactctgaacagggactcttcatggagtccagagatactgggagtcttcaaacacatgcaaagtctttctaaaacataatcttagattaatattttttgcctgcttctccttttgcatgaattagaaatttaaaatcaagaaaaaactaaatagagcatagaagaatttttctaaatttggataataatgcttagatataattaatactcagaatatgttgaaacagaaaatgataaatgattgtacattgcagctaatagtatttcaccatttaattattcaatttattaaagctttgtgatggtaaaattgtatttaatcactaaggtttattttcttgctgctctcaccattttaaatatttgaaaatgtctgctttaagtatctgcataagttggagaaatattaactagcataaagtttattttttaattttaaaatgatgctgatgataattttgtggtagttgttttccctgttgatcataaattgataaaaacatagaggttttggatttaataagagacagatgctgtctgaatccatttgtgctgctataacaaaatatcttaactggataatttgtaaaaaacataaattaatttttccacagctatgtaagctggaaagcccagattaaggtgctgcctggtgaaggcctgatctctctgctcccaaaattgtgtgtcttgatgctgcttcctctggacaaaaggaatgctgtcttcatgtgacagaaggcagaagggcaaaagggagggaagtgctatggtttgaatgtgttgcctccagaattcaggtgttgccaacgtgatggtagtaagaagagagacctttaagaggtaattaggtcacaaggactccttccctcctgaattggattaggtccccttataaaaagacttgatagaaagagtttgtctcatttttcctttctgctttctgcaccatgtggggcccagcattcctgtcctccaaaagatgtagctttcaaagcaccattttgggggcagagagagcagccttcaccacataccaaagtacacagtcttaggtattaatattttgttatagcagcacaaatgaactaagacagatgttttcttgattagaaagatgaaaaagtagattgaactaacaaatgtacaatattttggtattaataacatctcatttctgagataagctttgtaacataatttgaaatcaggaagtgtgatgtccccagctttgtttttcttgctcaagattgctttgcctattcaggatattttctgcttccatatgaattttagaattgttttttccatttctgtaaaaaaaaaaattagaattttgatagagattgcattgaatctgcagatcacttcaggtcatatgaataatttaatattaatttcttcaacccatgaatacaaggtatctttccatttatttgtgtcttcttcaatttcctattcaatgtgtacagttttcttacctccttggttaaatttattcctaagtatttaaaatattaaatatttttttgttgctgttgtaattgacattttttaaaatttctttttttcagatattttgttagtgtatgaaaatgcaactgatatttgtaggttgattttgtttcctgcaaatttattgaatttgcttattagttctaacagtttttttgttggcgtctttagggttttttttaaatataagattatgtcatctgcaaaaagataattttactttcttatttggatgtctttaatttctttttcttgtataattgctctcattaaaacttttactattatgttgaagacaggtgagcatccttgtattgtttttgatcttagagaaaaagttttccacattttactgctgagtctaaagttagaggtggtcctgtgatatatggtctttattgtattgagatactttcctcctgtacctaatttgttgagaatttctatttttgaaagaatgcctagttttgtaaaacgctttttcagcatttattgaattgatcatattatttttatcctttattctgttactgtggtatattacattgttgatttgcatatattgaatcatctttgcacctcagggataaatcccacttaattatgttttgtgatctttttaatatgctattgaatatggtttgctgatatttcattgagtttttttgcatccatgtttattagtggtaatggcctgtaattttatttttttgtaaagtctttgtctttgctatcagggtaatgctggcctcctcaaataagtttggaagtgttgtctcttcaattgtttgaaagcagttgagaaagattggtattaattttttttaatggttggtaaaattcaccattgaagtcatttgaccctagatgttttttcctttttgttgggaggtgtttaattactgagtcaatttctttactcattgattaatctcctcagattttctatttctccatgaatcagttctggtaggttctatttttctagaaatgtatccattcttgtagcttatacaatttgttggcatataattgtttacagtagtttttttatgatcttttgtatttctgtggtatcagtcgtaatgtctcctctttaatttataattttatttgaatcttctttttctttagtccatctaaagtttcataaattttgtttatcttgttaaaaaatctcctactttcattgcttttttctgttgttttgctagtctctgtgtcatttacatatgctctaatatttattactctcttccttctgctaactttgggctcagttttttcctttccacattccttgaggtatgaaggtagtttatttatttgagatcttttgttttacttaatgtatgcattgatagctactattttttttcttagaactacttttgctgcatcttataagtttgatattttgtgtttccattttcataagtcacaagattttttttttacttctcttttgatattttcttttacccattggttgttcaggagtgtgctgtttatttccacatattgtgaattttccattttttcctattttcatcctatcatgatctgaaaagatacttgattaaattcagtctccttaaatttgttcataattatttgtggcctaacgtatgatttattctgaacaatgctctgtgtgcacttaagaaaaacatgtattctgctgctattaaatggaatgttctgtgtatgtctgtaactccatttggtctgtaatgttcaaatctgctgtttctttattgattttctgcctgaaagatctatctaatagtgaaaatggggtattatagtcccctactgttattatattgctgtccaattcttctttcagttgttaatatttgctttatatacttaggtgttctgatgttgggtgaatatatatttacaattatgtcctctcaatggatcgacacttttgttattataaaatgaccttgtttgtctcttgtgacagtttctgacttaaaatctatcttgcttgttacaagcgcagccacccttgctttcttttggttaagatttgcattgagtaggtttttccatcccttcactttcagcctatgtgtccttaaagctaaagtgattttctagtaggcgcatatagttggatctcgtgttttatgatcagccactctgtgtaccaagactcattcataactccttctttaccctagcactcacaatgaataagtcactaaattctgtctaaacttttttatttttttgcattaccacttggtttttatttatggacgttcacctattgtttatttgccgtcatatataaagcattattataaacaaattttttgtctacatttttatgtcctaaatatatctctctagaagtaaaatttcaaagtcagaggatatgaacttgtggagcaaaatacagtttctaggcattgtgaaattataaaaatgaataaaccgtgactctgagatctacattcacgtattgaattgtcattttgaaggccttataagggcatcttctaccatatctgaaataaaactaactcttggtttcctctgctgatctgtcccactaataaaacctcttaaactgttctttttcccttcctctctctcaataaatgagactaggaattatccagatgagtaagtgacaaacctaagcatcatacttgatgctcatacattctgtcccttttacaccactgtatcagtaagtcttttcaggtccatctccaatatatatcttggatctgtctgcttggttccatttttactgatgtcgcttgtctccaggtcaccatagcttctcgctttgatacttcaatagcctccttggcaggtttgtatcttccactacttctgcatgccagcctagtatttacatagctgctgaaatgctcttttcaaaacacaaactgatttcatttgttgccccattaatctgtttattgacttagcattgctcttcaaatagaatctaaactccttaacaatgttacacatggcctgagggatctggcccagctcagtttctcaatgttcattatttccaaagtccagcccttctcacagttctctggctctttcactttcttgtcagttcctctttgttcctcaggttttctgatatttgcacatgtttgtttctatttggacagttctttcctaactaggcttgttacaaaattttatgacagcctccgttgcatattttgtttacccttgcatttctctgagagatgcctgctatgaacaccctatgtcaggcattctgcaaccccaccacaaactcataattgttctattttccagtatagtatgtaactatatatttaatttttttattacaaagggaattatatcctatgctcattctgtcattttgaacagttctcaaagttattgctgaagcttaaccaaaatgaatgtagatagcaatgtgaccatataaaatattttacatttttgattgtagaaataatatgtttattgcaaaagaaagtaaaaaatacatggaaatattaggataaagtaatatttaccttaaatcccacaactttgatattgtaaccattaacacctctgtgcctaccctttcaaatttttatttttatattcaatcaagcacatttatacttaaataattgaggttataacaaacattctttgtttctacggacatttctttgacacgtgtataatctgcagtgatcaaatcagggtacttagtatatcgaacacctcaaacattgatcatttttttgtgtcagaaacattcaaaatctgctttctagctatttgaaattatacagtaaattgttatgatcatccttcaattatacagtaaattgttgttatgatcattctatacatccttcagtgtatagaacactagaacattttttgttgttgttgttttgtttttagatggagtctcgctctgtcacccaggctcgagtgcaccaaatatcaaaattttaaatagacagaatttttatgacactgcattttttttcagtgggtttaacttcctagcatcccatgctttctgaaccacctggtggtctggttctcgcaaggtggatttataagagttgacaatggtatgtgaaccaactggataatgcagggctttatacatactcatgtttttttattatataatttttattaagaggttttattttccacttggatcaaaatatgggaggatatttggtaagtaaatatagtcatgtgtcacttaacaggagtaattctgagaaatgaattattaggtgcatttttattgtgccattttattggcattattattgtgccaatgtcatagggtatactttacacaaacctgataatacagcctaatacatacctaggctatataacatagctattgctcctagattgcaaatctctccagtatgttactataggttattgtaacacaatggtaagtatttatgtatctaaacatagaaaagatacagtaaaatatggtattataaactcatgggatcactgctatatgtgtatcccatcattgaccaaaatgttgttatgcagtgcatgtgcatgactgtatatgtatgcacagttttatttttgcttcagtttgccttctggatccacactggcattgctatggatccacatggcactgctagaagaataaatatatgaacacatttaaacatccataaagtatgattgcgtatctatttaaattagttttttatttttattttatgggttcatagtaaaagaatgtatttatgggttaaatgagatattttgacacaggcatgcaacacataataatcacatcagggtaaataatgtatccatcacctcaagcatttattctttgtgttatgaacaatccaatatactctttcagttatttttaaatgtaccattaaattatttttgactatagtcaccctattgtgctatcaaatactaggtcttatttatcctttccatttttgtatacccattaaccatccctacttccccacccccgactccctctgctacccttcccagcctttggtaaccatccttctattctctatctccatgagttcaattgttttgatttttagctcccacaaataagtgataacatgcagtttgtctttctgtgcctcccttatttcacttaacataatgacctccagttccatccatgttgttgaaaatgacaggatctcattcttcttttatggatgaacagtactccactgtgtatatgtgccacatttttaaaattcatctgttgatggacacttcagttgctccctaatcttggctattgtaaatagtactgcaataaacatgggcatacagatatctcttcaatatactaattttctttcttttaggtatacacccaggagtggggtcgctggattgtgtagtagcaccctttttagctttttgaaaaatctccaaaccactctccatagtggttgtactactttacattcccattaacagcataacagggttcccttttctccatgtcctcaccagcatttcttacagcttttggataaaagccattttaactggggtgaggtgatatgtcattgtagttttgatttgcatttctctgatgatcactgatgttgagggccttttcatacacattttccatttgtatgtcttcagatattgagaaatatctattcagatcttttgaccatttttaatcagattattaggtttttacttacagaattgtttgagcttatatattctggttattaatcccctgcagatattttctcccattctttgggttgatacttctttttgttcattgtttcctttgctgtgcaaaagctttttaacttgatgtgattccgtttgtccacttttgctttggttgactgtcctcgtggggtattactcaagaaatcttcgcccaccctaacctcctcgagattttcaccaatgttttcttgtagtagtttcatagcttgaggtcttagagttaagtcttcaacctattttgattttatttttgtatacagtgagatttaggagtctaatttcatttttctgcatatggatatccagttttcccaacaccatttattgaagagactgtcctttccctaatgtatgttcttgacacctttattgattatgaatttactgtagatgtgtggatttctttttgggttctctactgttacattggtctatgtgtttgattttatgccagtaccatgccattttggttactataattctgtagtataacttgaaatcaggtaatgtgattcttccagttttgttctttttgcttaggatagctttggctattgtaggtctttttgtggttccatataaatttaagaattgtttttcctgtttatgtgaataatgtcattagtattttgatagggaatgtattgagtttgtagatgtagattgctttgtgtatttatggacattttaacaattttgattcttctaatccaacatggaatatatttcaattttttggcctcttaaatttcttttatcaatgttttacagttttcattgtagagaactttcacttctttagttaattcctaggtatattttaactttatttgtagctattgtaaatatgattattttctggatttctttttcagactgttctctgttagcatatagaaatgctactgatttgtgtgtgttgattttataacctgcaactttactaaatttgtttatcagttctaatagttttttggcagagtctttatataagattatatatattccaaatataagattatatcatctgcaaacaaagataatttgacttcttccttttcaatttggatacccttaataaactttctcttatctgatcgctctagctagaacttccactactatgttgaaaaacagtggtgaaagtggggattcttgttatgttcccaatcttggaggaaaggcttgcagtttttcccaatcttggaggaaaggcttgcagtttttccccattcagtatgatactagctatgggtctgtcatacgtggctttcattatgttgaaggcatgttccttctacacctagttttttggtttttgttatgttgaggcatgttctttctatacccagtttccttgtatacccagctttttgagtatacctatcttgaagggatgttgaattttatcaaatgctttttcagcatcgattgaaatgatcacatgttttttcccatcattctgttgatatgatatattacattgatttattcttgcatatgtttaaccattcttgcatccctggataaatcccacttggtcatgatgaatgatcttcttacggtgttgttgaatttggtttgctagtatttacttgaggattttgcaccaatattcatcggagatattggtctgtaggtttttttgtgtatgtgatgtgtctttgtctggttttggtatctgggtgatactggcttcacagaatgagtttagaagtattccatcctcctctattttttgtaatagtttgagtaggattggtattagtgcttctttaattgtttagtattaatagaattcagcagtgaagatatcaggtctcaggcttttctttgctgggagacattttaatatggctttgatttcattactttttgttctgtacagcttttcgatttattcctggttcaatcttggtaggttgtgtgtctctaggaattttgtcatatcttctagattttgcaatatgttggtggcatatagttcctcagagtagccactactgatgctttgaatttctgtggtattggttgtaatatctcctttttatctttgattttatttgggtcttctctctttttttcttagtctggccaaaggtttgtccattttatctttaaaaaaaaaccaactttttgttttgttgatcttttatattgtttccttggttcaattttatttatctctgctccaatttttattatttctttttttctattaattttgggttttgtttgttcttgcttttctagttctttaagatacatcactaggttgtttatttgaagtttttctttttctttttctttctttttttttcttttttgaggcagagtctagctctgtctcccaggctggagtgcagtgacatgatctcagctcactgaaaccttcatctcctgggttcaagcaattctctgcctcagcctcccaagtagctgggattacaggtgcccaccaccacgcctggctaatttttcttttttttgctagaaatggggtttcaccatcttggccaggctgatcttgaactcctgacctcgtgatccacctgttttggcctcccaaagtgctgggattacaggcatgagccaccgcgcctgggctgaagattttcttcgcttttgacttacagctatacacttccttcttggtactactttcactgtatcccaaaggttttgtgtgttgtgtttccattatcatttgtttcatgaaattcttcaattttcttcttaatttcttcaatgattcaatggacattcaggagcatattgtttaatttccatgtgtttgtatagtttccaaaattcttcttgttattaacaagaagaattcttgttaataataataagaattcttcttgttattaactggctttctttcattgtggtcgaagaagatgcttgaaattatttcagtttttctgaatgttttaagactggttttgtgacctacatatggtcacatgtcaagaataatccatatcttgaggtaaagaatgtttattctacagctattggatgaaatgctctgtaaatatctactgggtctctttggtctatagtgcagactaaacccgatctttctttgttgattttctgtctggaagatctgttcaatgctgaaagtgggtgttgaagtctccaggtattgttgtttgaggtctctctctctctctctctttagctctaataatatttgctttatatatcttggtgctccaatgttacgtgtatatatatttacaattattatatattcttgctgaattgacctgtttatcattatataatgatcttctttgtctcttgtattttttgtcttaaaatttattttgtctgatataagtataactactcctgttctttttttcatttccattggcatagaatatctttttccattcctttattttcagtctgtgtgtatctttataattgaagtgtgtttcttgtaggcaacagattgggtttttctttttactgtccattcagacattctatgtatttttattagcgtatatagttcatttacattcaatgttattattgataactaaggatctaattccttccattttgttatttgttttccggttattttgtggcctttctcttccttctttcttttctcccttttagtgaaggggatttttctctggtcatatgatttaattttttgccttatatttttgtgtatttgttgtatattttttacttgaggttaccatcaggattgtaaatactaccttataaccattattttaaactggtaacaacttaacattgcttggataaacatacaaattaactatgaagcaaaaagaaaagtaaaaaacactacacttatctttgtcttcccactttttaactttttgttatttctatttatatctcattgtaatgtctatgtcttgagaagttgtagttgtttttgattggttcattatttggttttactacttaaaataagaggagtttacacaccacaattacggtgttataatattctgtgtttttctgtgtacttactattgccaatgagttttataccttcagatgatttcttattgctcattaactttcttttctttctgattgaagtactccctttagcatttcttgtagcataggtctggtgttgataaaatccctcagcttttgtttgcgtgagaaagtctttatttctctgtcatgtttgaaggatattttcactgaatatactattctagggtaaaaagttttttccttcggcattttcaatatgtcatacctgtaaggtttccactgaaatgtctgctgccagacctattggagctccattatatgttatttttttttttcgttgcttttagtatcctttctttacctttgggagtttgattattaaatgcctttaattaatcttctttcagtaaaatctgcttggtgttctataaccttcttgtacatggatattgataactttctctaggtttggaaagtttctgttattatttctttgagtaagctttctatcattatctctttctctgccttctcttcggggccaataactcttagatttgctcttttgattctatcttataaatcttgtaggcatgcttgtttctttttatttatttatttattattattattatttttgatggagtctcactctgtcaccaggctggagtgcagtggcacgatctcggctcactgcaacctccacctcctaggttcaagcaattctcctgcctcagcctcccgagtggctgggactataggcgcacaccaccaggcccagctaatttttgtattttttagtagagatggggtttcaccatgttggcctggatggtctcgatctcttgacctcgttatctgcccgcctcggcctcccaaagtgtcaggattacagacgtgagccaccacgcctggcctcttttttattcttttttcttttgtcttctctgtgtattttcaaataacctgtgttcaagctcacgaattctttctttggctgataaattctgttattaatagatttctgatgcattcttcagtatgccagttgtattgtttaactctaaaatttcttcttgattatctttaattatttcaatctctgttaaatgtatctgatagaattctgaattccttctctgtgttatctttaatttctttaagtttcctcaaatcagctattttgaattctttgtctgaaaggtcacatatctctgtatttctgagattggtccctggtgccttttttagttctgtcaggtcatcttatcctggatggtcttgatgcctgttgatatttgttggtgtctgggcattgaagagttgggtatttattgtagtctttgcaatctgggcttctttttttaacttgtccttatttggaagctttttcaggtattgaaaaggacttgggtgttgtgatctaagccatgccttcattaggggaaccccaagcccagtaatgctgtggttcttgcagactcatagaggtactgccttggtggtcatggataagttcaggaagaattctctggattcccaggcagactcttgttctcttccgtaatttctcccaaatcagtgaagtcttcctctctgtgctgagctgcctggtgtggagactagagtgacacaagcaaccctgtggccactaacactaggattgcactgggtcaggcctgaagccagcacagtactaggtctcactcaaggccctctgataacacaccctggctactgcctgtgtttgctcaaggccctatgtctctacagtctcaggtggtaaagccaactaggcttgtttccttcgcttcagggtgttgagtttccccaggctttgttgagccaaggccttgaactggggaccacaagtgcctccttggtgctctgtctcactgtggccaagctggtatctaaggtgcaagcaaagtctcctttactttatcttctgcttttcttaagcagaaggagtctctctccagagtcaccacagctgggaatatgctgggtcttatctgaagtcagcacatctcagagtctcacctaagacccatggtgtactgcctgggtattattgctgcagttattcaggacccaagctctcttcagtcagcaagtgatgaatcctgccaggactaggtcactcccttcgaggcaagaagttcccttctggcccagggtttgtctagaaatgtcatccaagagctaaggccttgaatgggagctttgtagctctgccccctgagtggccatcaagaagcaagacaatagtcttctttattcttccctttcctcttctcaggctgaaggaaggggtctcttttggagccatcagttgtattgcctggggttggccatagcagttgtgcatgcactcttttagctgccttctgggtgtctcagttattgcctgccccccaagctcgctggctccaagccaaggtcagtaattggaattttagtccttgtgtcctagactgtgtttcaagtttatttagagtcctagagcatttcagtctatggtggccaggcttactggaactcaagttctgagtgctgggatgggtgattctcctctggctagggcgggtctgaataccccctccattggtgggggtcagctgagttcagcccagttttgtcttctgctgtgatagggcagcactgagtttaatgcaaggtctcacaatcactgcactgtacctctcccaagtgcagtgatgccacgtgaccgctgcaggggcagggtgggtgatgggaggggttggcattgacaattcaagactgtcttttctaccctcttctgtggttctttgaacaatatgaagttaaaaccaggtactgtgagtgctcacctgattttggttctcatgaaggtgcttttttgtgtagatagttgttgagtttggtgctcctgcagtgaggatgattggtggggccatcttgctctcccccctctgtatatctttattatgttctttagtattgaattcaaataacaaacccagtaataggcttaattaaatcatatttgcattcaatatcatctgccaaggaatatgtcagttgttaactcagaatgaaactgatttttcataattcttactagggatatttcctcacttttcagttttaagttagtatttttttttttttttttgagatggagtttcactcttcttacccaggctggagtgcagtggcacaatctcggctcactgcaaccctctgcctcccgggttcaagcaattctgctgccccagcctcccgattagctgggattacaggcgtggcccaccacgcccggctaaatttttttttttttttttcattagagacgaggtttctccatgttggccaggctgctcaaactcccaaccacaggtgatctgcccgcctcagccttccaaagtgctgggattacaggcgtgagccaccgtgcctggctttgctagtatttttaatacaaaggatactttttgtttattcttattatttctggcttcatattttatgaaagtaaatcaagataactataaacaatagtcatttaaatagaatactttaaaaatacattatcttttataatcttccttagagagaatgacaggattaggaagaaaatgatatctagaaccaggtttaagccatgtctgacactgccagtatgatcttgaaatctgaggctcatgttctttaactaaataataagaaaataccaactatataaatgtacagagttgttactaaggttaaatgaggcaatgtaagtaaacctgcactgaaaaatttaaaggttattcaaatgttaattatttttattgttttatgtattcatttctttcccttggagcaaatagagaaaattaaagggatataaagtggaagaaaaatgtaaaaggcaacctttaggaagaaatcatcatgatccaattgcaattgtatagatagttttgccacttaccaagaatagactcttgctatatcagtggttttattcccaaggaatctcacagtgttgaaaactaatttataaaataattgttccaatatggaaaaaaattgggagatggagaatttcatcctctaagtgatggaagtattttttcttcaagaattttaatactgaagtttttttattagcacaattgcatagttctaaattctacacattactgaacaaatcgagcattgataatgcacatcagcatctgctcaaaaatgtcttttattttcctaaaaccactgacacagagattaacacagtgctgcttataaattctttttcacacatttttatgataaataaaacacaaagcactcaagataaattttatttttacccagaagttctaactttttgttttaattgcattttaactagtacttatgagatagatgcaattaagttcttattaattgataatgttacattaaataaatatctattttttaatgttttaatgtagaagaattgcatgaattgtaaaataatcatagttttctaacatattagaaagaagaaagctatgaggagaattttaacaaatagtaggtttggctttgcctggcatgagtgtgggtagttgtggaaaggtacataaagaagatatataatgtaatgttgtatgaacagacatcaaagtacaatttacttgctttgagcaaattgtcatgaagcttaaaagcaatgtggaggaacttactagcaagtggaactatcttaagaaaaaaggtgaaataataattccttcaataaaaatctattgagcacgttctaaatgccagacactcttcatagtacagaacttaatacagaccatcttcattctgtgtttattccagtgggaggtaactgacaatacaaagaggaaaatacgtaatgtattggaacatgattagtgttatgaatgagttcagggatgagtcctgacaagagtagaggtggataattcagttgtatttagaaatactctgagaaagcctcaatgagaagttgacatttgagcagaaacatgaaggaggagagggggcatgcaatgcagatatctggagaaagaatatttgaagcagacaaaattggaaatgcaaaaatcccaagtcgagagtttgcttggtatatgagagggatggaaagaaggccaacatgatgactaaatggaaatggaaaagtgggaaagctttagatgcagtcggagagatagtttggcccattgtaaaacctcagccatttttacttggagtctgatggaatctagcgacaaacctgacttccattgcctggcatagtacagtattgagcaaaggtgtaaacagagggaatatttaagagagtactacattaatccaggtaaacagtgaggattgaactaggcttgtaatagtagcaggatgaaaagtggtaatattcccttgatgctaccttcaaaatatgtccagaatacacagggctttcacagaacccaaaggtagagtttcaccttgatggcaatagatacctagaaccaagatcttgaacatttcttctacagaaaagtaactgaatccctgaatagcttttgcttgtttgtttgtttgtttgtttgagacggagtctcacccttgttgcccaggctggagtgcaatgacgtgatctcggctcaccgcaacctctgcctcctgggttcaagcgattctcctgcctcagcctcccaagtagcagctgagactacaggtgcgtgccaccatgcccagctaatttttgtatttttagtagagatggggtttcaccatgttggccaggatagtctcgatctcttgacctcgtgatccacccgccttggcctcccaaaatagtttttataaaacagaaggatttaaagacttcaattgaataattgagtaaaaatatgcaggaaacttcgaagaaacatttttatcatatttggagttaattggagataaaagatattcataaaataatgtatagaattcgctttaaaaactgcagttttaaaacattagatataagtaccatttaaatatgattatgactttaaagaattatcttgaaggtattattttaaatggctgtctaatttttgctctcttaaagaagagtctaaatgtagatcttctactcagtataaataaaaggaaaacatggttaaatgccctctaaaataaggaattcagagtatcaactgaaattaaggctgttgaagcagaaataacttgataaatgtttaatggaagccaaatgtaaggattgatccaggaaggcatagcaacaagtcttggcacgacccagagttggctacaagttggaagggttttattaaagtttaagagaagaaacaggactccttatattggagttgtccttttacactgaaggtgcaatatagagtttataatcattcactacagattgcaacatataggctaaaatgtctacatacaagataatcagtaaaatttcatgatgcaaaaaatcaaatcagcatcgtttttaatgtcaggatttcatacattaatcagtatgtcaaaaactggagtaactccgataagattatttactaacaaacaggatgtcaccatgaatcacaagacatttcccaggagggctaatttggaagcttgccagatatgatctgtaggttatcagtagttaatgtaaaggatttattttttgtatgaagagtgagacatgtaaatagaaaacggtataaaagagttcaaagaaggaagcacgaagtgaaaacttaaatttctgaattgcttgtctgcaaatagaagccaagatacacatgagactgcccaggaaatgcatatagaaaaaaaaatacccaagccatgattactatatttcctgcaaatattagaaaagttagtgtggagaaaaactgaaactattcattatattttaagcatgaattggttgtttgcagaaatcatgaataaatatattctataaacatattttccatgtattttggaaaatacatattatatatttttatcaccttttactcaattatgactttgtatcatttctgaaagtagtttcaccaaaataagcctaatacgttactgtgtgttgtcttgtattattttctcacctattattggcatactccagttttaactttagataaaacaatatatcatggcatttcatgctttcacctgtacaatgactaagataaatagttggatgtgtcaaaaagtaactccggaggtggtgtgagcctgaaatttacatatttttgttatatattaaagaatatataatttaaaacaatacctataatttaatcacatatttgataatgtaaagatgaatctgtaccaattaaaacttagaattttttagcaaagaaacctaccccttattccacctggactaaaaaagaaggaaggaatgggaatgagggaggagtgtgtgtttgactctcaggcagtccatattttatgtactagggaatggggaaggaagttaggatataattttgcagaatagtgcacttcaactaacaatattgtttgcagctccactcctattttttattgattttatttgctgtaaacaagtatcgagggtctttggggttccacaaagcagatgggccaccatctctgctgcagctgcctctcctaatcctgctctgggctttgaatttctccactctgcaatctgtctatgctcttctattcactttcttcccccagaaacgtgctgcacactcatcaactgataacgtcctcccttacctccttgatgtttttatcattatttttatatttctatcatcattttaaagagtcattttgagaggagagtgatgaacagatctatgtctgcaggttgaatcaaaagcatctattcctttttaaaaatatattttcttaagttatgaatacacaataactgcacatatatacagtatgcaacttaatacatttgacatgtgtacacatctgtgaaaccatagttacaattgagatagtatataatatacaaataacagctccatctcctcacaaagattccttgtgcatctctacaatttcaaattttatttctttattagaaatatggccctgcaaattatctgtcttcttgggtgagactcagaagtttgtcaataattctgtccatttcattgaatttattggcataaagttgttcaaaatattcactggttaatattttgatatccaaatagtctgtaaagctgtcacctccctcactcctagtgttagtaattgtgtttttactactgtatgtcttctcagtgtggctacaggtttttcaaaattattgatcttcaaaaaaccaacttatgctttcattaaaatctgttgatttctgaggttttttccttgatttctactctgatacttaacactctgtttattttgcttaatttagatttaatttttcttctttttctagggttacaggtgaaagctgaggtccttgattcttagaactttcttctttctaatataggcattttgtggtatatttttccttttcatgtgtaaattggtttacgtggtatttattttttctcaacttttatttcagattcaggggatacatgtgcaggttttttccatgagtacattgtgtgttactagcgtttgttgtacacatgattttgtcacccaggtagtgagcatagtatctgataggtagttttttgaccttcaccctgctcctaacatctcacttgaagtatgccccagtgtctacttttcccatctttgtgttcatgtgtactcaatatttagttcccatttataaatgagaactgtggtatttggatttctgatcctatgttagttcacttaggataatggccttcacctatatccatgttactgcaaaggacatgatctcattcttttttatggctgcatagtattccatggtgtatatataccatattttctttatccagtttaccattgatgggtatttaggttgattccatgtctttgctactgtaaacagcactgtgatagacatatgtgtgcatgtctttatggtagaattatttatattcctttgggtatatatctaataatggaattactgggttgaatgataattctgttttagtttctttcagatattaccaaaccattttacacaatagctgaaataattacattcccaccaacagggtgcaagaattcccttttctccacaacctttccagcatttgttattttttgactttttaatgatagccattctgactgatacgagatggtatctcatcgtggttttgatttgcatttctctaatagctggtgatgttgagcattttttcatatgtttgctgcctgaatgtatgtcttcttttgagaagtgtctgttcatgtcttctgcccatttttaaatggggttgtttgcttttgcttgttgaattgtttaagtacctaatagtttctggatattagaactttgtctgaagcatagtttgcaagtattttctcccatttagtaggttttctgcctattcagctgataatttctttctttctttgtcctgtgcagaacctctttggtttaattaggttacacttatgtatttttgttttgttacaattgcttttggagactttgacatgaaatttttgctaagtcctatgttcagaatgtcatttcctagttttttctagggttcttacaatttagggtcttacatttaagtctttaattgattttgagttgatttttgaatatggtgaaagggcagggtccagttttagtctaacttacatggctagacagttatcccagcaccatttattgaatagtgagtcttttccctactgcttatttttgttgactttgtcaaagaacagatggttgtaggtgcacagctttatgtctgggctttctagtctcttttgtaggtatatgtgtctgtttttatatcagtaccatgctgttttggttgctgtaggcttgtagtttgaaatcaggtagtgtgataccttcagctttgttttcttttgtttgtttgtttgtttgtttttgcgctgtttgttttttttttttttttttgctaatgatggctatattattttcccacatttgtattgttttaccactttctttggattgagtttcagactcctcttgtatctcgatgagttttcttgccatccagattctgaattctatgtctgttgttccagccatttcagtctggtttaggatcattgctggggagctaatgtggtcatctagaggtaagaagacactctggcttttagagttgccagaattcttgtactagttctttttcatctgtatgggctgatagtcctttaatctttgaagttgctgtcctttaggtagggctttttgcttttgtattctatgatactcttgaggatttgattgtggtacatgttgggtttagttgattggtttcatttctggatgctttcagggggacaaagctcagttcagcattgctgggctgtatgctctaaccctgggggcactaggaccaggcctatcactttgttctgtggcactttggggtcaaacacctgctacactagagagcctggggcattcccagttcactggcgacaacactccaataagggctgccagcaaagcactgcagtagaatggcagggagtgccatacacgtgtgcactgcagcagaggtaatgggtctgtgctcaccactggggtggcgggggccacagatgattgtggccaatggggtgacagaaggggctgcacgcatgtgctcacgggttggctgttgggggtagtgtgcaccagtgggagaatgctgcaggcaggtttgtgccagcagggattcatctgcaaaagtgctctgataggaatgtaataggcagtgagcaaaagagctagcaccatggctgacggcaaactttttagtggggcagctgaggctgggtggcaaatgggtttggccaggcaggaccttggaagacaccagcagacagaggaccattcagatcagactgaccgcatgggaaagacagccctgctctctgcaggcccagctgctaataaacgctaaagccacctagaggaggagtatggcaagccttagttgtggacacccatgacagtgctcctctccagcctttcccacgccaaaccctctgggcttcatgcagactggagttctatcttgtccatctctcctggcagttttccctgccaactctaatgtccatgggggtcatggggtctcctgcagctaggatcctggaggtctatggctagagtgggctgctccatgcttatttcactcaccctttccctagaagccactgggggccaggaaggagtctggtgcttggcaacctaacttcctcccctttcagcctccgggtctacatcctccctatatccactcccaacacctgctttctgaagatctattcagagtctgctggtgtacttgatggcatggtctctctcagtgggagaagctcttcctggctgtgtctgtcagccatcttggctatttccttgtatattttcttatagctactattttagttgcatctccaagttttaatatgttgcattttcattttaatttattttaaagtattttaaaattatcttttgagttttttatttgacttctggattttcataaatatgttattttccgaatatatttgggaaattttcagagaactttgttactgatttctaaattaattatattgtggtctaaggatatactttgtatgatttttacaaatatactgaggtttgtcttatggtatataatacagtattgataaatgttccacatacaatcaaaaagaatgtatattctgctcttttttgaggtgattgttttataaatatcaatgagattaaattcaagccttctataaccttactgtttttctatttttctatcaattcttgaaaaatgatgttgaaatttgactacacttgcatattttttccgtttctctctgcagttttattagtatttacttcttcgcgtagtaattttttattgggtgccagttattttaattttaccttggtggctgctgaacatgtttatatcatcatacatagtgtgaactttgttccaaaattagttaagtttattggaaacacactgatactttcaaatcttgcttttagatattgttaggcaggatcagcacagcatttagtctatggcacatttttttcctaatgcataggtaaaactcatatgtggtctatcctatttcctgtgaattataaggtttctactctgctttttagaaacaagaactattcccaggtctgtgtgagctccagatattgttccctctaatctttttaggtgcttcagtttccggtccatgatagtttcttcacatgtgagcaatgataaatactcattaataattcaacagattctttttgaaaatctctggtgctctctctccctctctgcatttttctcctctacaataattttctctgggaactctgacccacgtaagttcctttgactgtctcctcagttatgtctcctcaattaaggaaactgtctggattccctcgtcccattctttatcatagaaattttctctcttctgtatactagagaaatcatagtttttaactttatttgttcctcgtttccaaggtttactgtttgtctttgcctgatgttcaatatctgcaaaacaattattttgcatatgttgtctcttttttagatgtttccagcaggtatttaaatctatacttgttaatccatatttaacagaaacctacgccaaaatgtatttattctaattttaatttttttctatagtaatttggattgacatataattaaatacctatttgatattcttacttggcgtatctcattttccatatctaaagctgaactcttgttcattctactaaagtttttcttctgcagccttcctcatctcaataaattctgcataatatttataatttcataaaccagtaaactggcagtcttcaaagatttcttctctctttagccaatctaatcaagcaccaaaaatatttcttgaccatctcctgaatttacaaccatcattccagctccattctctaccctattcctagttattatccttttccatatctacttcaaacttctccaaagttaaaagaaacaataaacaaacaaacaacaaaaataaatgagagaattcttctaaagacagttgtatacactgctgggagaaactaaatataagcagctctttatatcttattttaatcaatgaaccacaatataatgtacctacttataatttattaaaaatttaattcctattttaaatttctttttgaattcttattttaacttatttatttaaataaaaattcccattttaaatttattattgaaatatatagtgtaagtaattttttaaaaatggtttgagggactactacaaacgcatgcatatggcaagattgttaaaatggaaacaaggaagcaaaagttatggacaaaaggaagggagatatactaaccaccttagctgacctagctgatctgtcgtagcattaaatttagcttagagatttttgggcatcccaaaagcaatagaagtggattaattatcattgatttgataaatcaattcttcaagtatcaatttttcctaccaagaagaaaatattgaagtacataattgacaatattatgcaacatatttgtttttctcttttactcagtatctaaggcattttccctatattgccattttaaaaatcaatctccaaaaaggcaacatttttatattgaaaaattaaaagatttatatagctatatctcaatatatatctgcacatatctatctatatgccaaatattaaaacatagctatataaatatttaaattatgtatatatttattcctatatctatctacctatctatccatctgatccatgtgatttttttgtctttgctatgcagatattttcccataaatgatggaagaataagagtttttgaagtttatgtttgtaaattaccatggttctaactttatatgaggatagagcatatcttaaaatatatgctaaagagggaataatatatttcatatatccttctctttttttttttttggctagcattttgacagtaactaaatattgtcaccagtttaagacaccaaacataacagattattttggactggaaaaatttcaaaccagcattatcagtcagcaatcctgacaaagaaagcccctcaagtcatcattgtttgtaatagcaatgacaccagtgttaactcctatggaaggacaaattgcttgcctaactttgaattgcactgcctttttcttgacccttaagttcactaaatatattccaaactaattttaataacctgatctggagttgctaattacataattcattataatatctctctaactgatttcagcacattggttttacaataccctaatccatcctcctctctgtagccagactgaactttcaaaatgtaaatctgcccagtaattcctcttaataaaatccttggatgactttatttttcctaatgacaatgtctaaaattcttaacaaggtttataatgccttctaggattttgccctgcctatcatcttagcttcaatatatgtccaatttcctcattgctctctctgctccaaccacactgaactttcattcccaagtgtttcttgaatacttgattctggatctttgtacaaggaattttttattcctgaaacactgatatatcctctctttccccactgccaacttattcttcagatgtcagttcatacaccacgatctctgggaaacatttgcgaatgtctctgctcccctagactagattacgtctctccactactttccatgacacatagtactctgccttttatatctctttcacatgcataagttgtgtttaatgtatgacttcccttttgaattttaaattgtgtgaggcaaggacaaggtctgtctctatctttgttatatgccagtgtttggattattacctgaaaattaaccattgcacaaaactatttgctgaataaataaatgaaggaggctcggtgcggtggttcacaccagcaatcccagcactttcagaggccaaggtgtgtggatcacctgaggtcacgagttcgagaccagcctggccaacatggcgaaaccccatctctactaaaaatacaaaaattaggtgtggtagcaggtgcctgtaatcccagctacttgggagaccgaggtaagagaatcacctgaactagggaggtggaggttgcagtgagccgagattatgccactacaagatcacgatgatcatgccactgcactccagcctgggcaacagagagactccatctcaaaaaaaaaaaaaaataaaaataaaaaataagtaaataaataaatgaaggaatgaacagacagtaaagcgtctttttttttttttttttggttgatttaaaacatctaacatgtaggtagaagctattgtttgacttctgaacctgacatgtagttattgtaaacttttgagcacaagaaaaagataaatagtgtgattatatgaagaataattaagatttccaacagaatggtgttcgtttttttttcacagagaaatgcagcttatcaacttttttgtgtgtagtagaagcagcttcttcaaatgtctaagtacaaaagatgtagaaaaccttcaataaaattagttcaaagcatctgtgtatttcagtaatctgtgattattgtgtttatggctgctgagtgtgttcaggaagtgagattacaggtgacttttgaagtgttttgagaacttacttatacccttttttgtgtggctattgttaaccactcagatcttatgaaccgagtttgtgatggatgctaaggaagtgctctttgatgaagtaccttgcctaaggattttcataattttcaagtttggcatcggaactataaacatgtagataaaataagcgtgttttatgacccaacccccctttaaaaactgtgcagttggcagacaagcctattattttcttcaattttcttctgctgaaatgaaaggaaatatgctactatagtattctggtgggtataccatgtcctttaattcctctctctctacaagaaaaaagcccagctatcctccccaaacaacaaaaggaagcatgtaaaaaaattagtaatctattttctaattataagaggttttttaagcttgaaaagaagagttaaatttgttggcattaacctttcaattttcaatggtgtataggaatagcagagagaaccaaaagcgtgctgtgcctctgatgtgtgcactccgcgaatgaccaaacccaatttctggaaaaactgataatgatcagcatttgtcatatgaatctggatgatcaaataaaatcaattgttattctgttcattcatccttgactgattagggaattcaaatggaaagtcagacagaaggtgatgtgcatattaatgattaattattcaagaaatacttcaagtacacactgtattccaggaaaagaattttacagtaggttgcttgaaaacatgcaggaaaaagggatacatagaaaaaaatgatatttgagaagaaagtcacatttttaacagttttaaataatttcataacagccacaatgctgcttctaaaactattaagaaggtccaagagcttgcctgtgtgcatcctttaattaaaatgaacttttcaggtggatttttctatcccattaatctgtggctcatagaacatttggtcaaatgtcacatacttgctaaggtccagggattttagctgtacaatttctgaatatgttcatgtacccccaaacatatgctatcaaatttcagcaagttttttggatccttgaggaactcacatggctgggtgtgcaggatacattttctagggacatatatatccaaacgtaggagactcccagttgttctgttcccagctgatgacctaaattttcatttctaccattatttttccaggttgtaaatctgagctgattcctccatgccatctgattcaagctcataattttaccattctctgtgtgccttattccatattcttttttgtccattactaccctctttcgctccgagttcaatgtcttatatatttttaatccagcttcattaatgggtctattttcttactgtttcttttgtgtaataacttgatcttaactcagaggtagacttaccctgaaggtaatgacgcttaagctttaggcttgccatttaatttgcatgtgtcactttgaaggcccttaaagaggctctagaaatatattcacatgcttgtaagtttctgtaatatttgtaagagtaagacattttcactatagtcatgtgtttttcctttgcctgctgtgttagtcaggattctccagaggtacagaaccaataggaggtacatatgtagatatagatacatgtacctatatctaaatagatatagatacatgtacgtatatctatttagatataggtacatgtatctatatctatttagatatagatatagatacatatatgtgtatctgtatgaaagatatatatatgtatctaatgaaagctaattctccttaataaactctgttatagtttattaaggagaattagctttcactattatacagcaaagccctaccatgtgccatctgtaagctggggaaagaaaaagccagtagtggctcagtccaaatctgaaaacctcaaaaccaggaaagccaacagtgtagacttcagtctatagcagaaggcccaagagtccccaggaagatgctggtgcaagtcccagagtccaaaggccaaagactgggaatctgaggttcaagggcaggagaagtggaaggaagcatcaggcatgcaaagacagagagaactaggggaatcagcaagcaaaattatccccattcttccaccagctttgttctagctgcactggcagcagataggatggtgcccacccaaattgagggtgggtcttcctctcccattccaccaactcaaatgtcagtcttctctggtaacaccttcagagacacccccagaaacaatacattgccagccatctaggcattgctcgatgcagtcaagttgacacctaatattaaccatcacacctgtcaactttttttcttatactcagttttcatggcacctggtgttggagttgggttgagcattttaaggatccagtttagggaaagttaaattagagatacatttcatttgagtctagtgggatataaattttagttcttagtcattgctgtatgtgcaattattgttagctgtgctagtgtagaaatgcctatcaagaaacaccccgactgcccactgtgtggacccagcagcatcttgacacgaagtaacagggcttatagctacctggcaccagaagcgtttgggcacagaagtggcatatacttttaaaagtggagagagaatcaaaatctgtggaaaacctttctaaatctcctagcgcatatatgaaagaaattcagatagagattttcctaaatttgacaagaattctaaaaatttatataacattaccaataattggttgtgaatctaaaggaaatatttctatgttattgagaataattttaaaaaatatatcaaccaagctagagggaagagtctgttctatcaaaatgataaaaaattgttgtcatacaaaggggtgaaaatatttttaagttcaatttaaaaagtaagaaaaataagtagaatggagtgacatagacaactaattcataaaattataatttttttctagatttgatgatgttttaaaattatccagcttttcaaactttgtgatttgttgtactttcttctttttctaaataattattcacatttgcaccaaatttgtaatttataaatttgtattctttttaatttattgtatgtcagatccaataaacctggaacatctcctgccctaactcaattagccccaataactcaaaataagtggaaatcactataataaaaatttgatttaatgtaggggctaaagtggatggaaatctacgctctggaatgagactccctgagataaaaattcttgctccacaacttattattctgtgaccttgggcaagttactcagcatatctaaacctcagctttctcatttaaaaaggagactggattagaaagcgtaattccttgatgctctttataactgtgtgatagtaacatgaaacatagtgagtaaccaactaattaaaattagtatgcatgttgaaaaccttggattccctgtaatttcacatcagccctatggattcctaattgttctttcaggtatgtgtagagtaagaagaagtctagtgtggcaactgacctacctgtccattcttttaactagcatagtcccgcttttattaacttcatttacactctaagctttagtttgaacaaggtgctctgtgtctgtatatgtgtgttcatatgtgtatttgaatacaactgcccttgcccaatccttctatcacaagaatcatgtgataacattagtgaaaatattacaaacagaaaataagtggtaatcgcttctctatttgacttcaatcttatatgtaggaaggatggaaggatatgtttttatttaaaataaaacaaaataaccacagaaaattcttccttctagatcagagattaagcattcaatgaaaatagaaaattaacaagaagtgattgagagaaacataagcttccccaaattctcagggatattaaaggattatcaagtttcccatagcatatgggactgagcctcatgttaatatttggttatttatatttgaccaatattaaaagaatgtgtaaactcaaacagcaggaggacttggataaagagctaacactggcattttatgtatagctccccaaagacttgctttattgatttagtatttttaattgtactttttaattagaaaaaaatcacattttaataattgctactcataattgccagacagaataatcttagtccgtctttaatttgacagcttttcaaatgaatgaatcagtttcatccccaaataaattcacttccaattaaaagttgattgttttatgacaggacatagagatattttctttgattcttacatgtcattgagaagtaacaataatcagcatctctgaaatttcctttcacttatagagacccaagccttctggcaattttccatgaatgaagtctttcttgtaatcaagatattcctgttttattaatttttttcttttatatttgtctgcgtaagaacagggaactgtcttaacagaatttctaatacctaggtggtcagatattccttcaaattaaacaaatttgatgtcttaaaactaagtgtaacaaataaataaataaataaagagaatgttcagctcctttgctaagctatacccagtaatttagaataagagtttaacggataaaataaaataagcaatagttactatttcatgtatatcctagtgcaggggtccctaaccctgggccatagactgatacagtgtctcctaaggaacagggccacacagcaggaggtgaataccagcaagggagggaagctgagctccgcctcctgtcaagtcggcaaattagattttcatgggagcatgagccttattgtgaactgcttacataagggatctaggctatgtgtgccttatgagaatctaatgattaatgcgcttgaatcatcacaaaaaatggtctccactaaaccagtccctagtaccaaaatggttggggaacaatggcctagtgtacagttctcttgttttgaaagaagaagaaaccaggcaatagaaataactggtgcgataaattgacacttgaaaagcaggtagttaaggggaacaatgtttaagaaggcagtgagttttgaatcattaagacttgtaaagctgagtgtctaaagtgaacattttaattatggcatgtttcagttgtaaaaatagatcattaagaatcacttataatcttggccctaggataggtattttggatatattcttaattatgtaaccaaatgcctaataatatgtcaccagtattgtagatttctgttgccacctaaaattctgcattatatgcctgattctacaataaactaaccaatatcccctttggaaaatataaggctttaaccatttctttattactgaatacttatttttaatttttaatattttgactaatgttaatatgtgtatctttctacatagaatattttaattccattttaaatgagtaaattgtatgtttcccctccttattctgtagttcactaatttatcctgagggactggagttatttgatttacattcaggttttgtgtatgtgtgttttgtgtgcatatgtatgtatgtgcatttgcaacatgatttgttcttcatgtagtgtctttttttgttgttttttgttttgtttgtttgtttgttttgttgagacagagtctcgccctgtcatccaggctggagtgcaatggctcaatctcgactcactgcaacctccgcctcctgggttcaagcaattctcttgcctcagcctcccgagtagctgggattacaggcgccttccaccacacccaactaattttttatatttttagtagagacagggtttcaccacgttggctgggctggtttcgaactcctgacctcatgatccacccacctcagcatcccaaagtcctgggattacaggcatgagccaccatgcccggcccgtttagtattttttagtgttttaatttctttgagaaaattgatttttttttttttttttttctgagatggagtctcactctgtcacacaggctggagggcagtggcacaatcttggctgtctgcaacctccacctcccaggttcgagtgattcttctgcctcagcctcccaaataactgggattacaggtgcatgccatcacacctggctaattttgtagttttagtagagacagggtttcaccatgttggccaggctggtcttgaactcctgacctcaagtgatccacccaccttggcctcccaaagtgctgggattacaggcgtaagtcaccatgcccagctgaatattgactttttgatcctcagtttaaatattgttttttttttttttttaatttttatttttgagacagagtcttgctctgttgcccaggctagagtgcaatggtgcaatctcggctcactgcgacctctgcctcttggattccagcaattctcctgccttagcctcctgagtagctgggactacaggtatgcaccaccacacctgctaatttttgtattgttagtggcgacagggtttcaccatgttggccacactggtctcgaactcctgacctcaagtgatctgcctgctttggcctcccaaagtgctgggattacaggcatgagctaccacgcccgacttaaatattgcttcttatagcatacttcttcactgatttcttcccttgcttgtacctgagagttctgatttactgttgtttttttggcacgcatcctacccaagttaatggctttttttatgtgttctgtaatataaattgattatgttacttcagaattttgagcatattcaaatcagttattcccctacccactgccacaggacataatcaatccttttgaacacttatactccctcacaggtagaaaaatttggggtggagtaactctggaagactaagcatctttactaagagcctaagcccttaagaaaggccatgtaaatcagctaggagggggaactaaactttgtgttagtctcaacatttaaattgaacagaaattgtttgtatcagaagatatgatatttttaagagacaagagcaaagattttttggttttgttttgggttactcttcaactgagcagattagagattgttagaaagattagataagttgcagaaaaatgcaaaagctccctttcctttgtacatctgagtaaatgtgagtaattagtattaggggtatagaaaccttaagagagtcctaagcaatttttcatggcctcacagatgttcactaaagtagtcaaagtctcttcttatcagcaagaagtgtgaagaattgcctgagagtgaaaagtcaacagatttgcaagagctttagaacaccaaggtcatgagtacctacaactgggaacactgagcaattcagtggatgtcagcacagatgccaaaggctatacatgataattacagctcagcagatgccaccccacatggatactaatgatcagaagccagataccacttggtatgactataagcccctaggtttgaggtgatcactgggagaggaaagagaagaaacgacaacctgaaattattttgtttcccactgaaatgcctgaaatctctggaatacactaaaattttgcttttggccgtcagctggaattgggtctagaaatagatagaaaggtgaattaatgaaaatataaagggaatagtattttttatacaccactgtatgtggtctgataactcataataaggataatttggccgtcagctggaattgggtctagaaatagatagaaaggtgaattaatgaaaatataaagggaatagtattttttatacaccactgtatgtggtctggataactcataataaggataattttaataatgacacaattgaagaaagagctactgttagtaataccttggggactgcagtttatgaaacacctctcaatgtatgactttttgctaatctagttttattcactgaagtatttcctacagtgagagtgtgccaggaagcactggtaagaaaggaatgggtacaatgtgtgtaaacggtgtgcctgacaatttagaagactagaggttaagagagatgtgaaagccaaatttagagaagtgaaagccaatttttcatacctgaatgtttttatttatcctcccaaggatgatacacacaggggtgtatgttagactcaagaggtttaatttcagagttgcagagttgctgctgatcatttaccagagtgtagcctgggaaagccttaagaccagggccaaataagttaatacaaacaagggagaaaggtggtaacaggaggtgaaatgggtgtttctagcacttctgtttctccatggcccaaatcaggcattctaaatacgttcttggatactcatgtagaaagtcagaaggaaggtgaaaaatagaaattgatcaggaatgatatttccagaaaaagattatagtagttatataaaataatattttttatttttgagttagaatatgtaaattacaagcccattcattcatcaaaatgataaagagctgtaacttttgagtgactttaatcttttctgttagtcaatagtgtttatcagatatttttattgtccctccctcaggtttcatgtgcacttccctaaccccttgtcattaggtgcttgagatacaggttgacctttatctgtgggagaaaattgtaggtattgctgtagatcggagagattcaagagtcaatgttgagtgcaggactttgagaatggtggagtgaaaacctctgtgaaactgttcctttatgaaagcaatgaaatgctagaaaaaattgtcaaaataaaatttttcaaaacctggaaattagtcaaatgtttgcaacaatatacatttattcaacaaaagtagcagagcctaggtaagaaaagcagaacatttttatattgacttgttttaatcttcctttttccaattatgtgatagccttgaatcatagcagctatgaaagccagcaggcttgcagccactggaggagacagctggtgaggaactcctcacaaagctccactctgagagcataccacaatgtgacttatctaccagctccatggaaaaaccccattcacagggcgttgttgttatttgaccctgggaaggagagaaaagcttatttccagagttcccctattatattattcgaaatgtttagttttcaacaaaaattatgatacatgcaaagaaatagcaaaggtatcccatatatggaaacaaaaaaaagcagttaacagcaaacaatatcccgaggacattcaaatgctgaacttagcagacaaagattttaaatcaactattatgattagaaacaagtaagtaaaggaaaccatgtccaaagagttcaagaaaagcatgacaacacacaacttttgccaatcagcagaagtttttatagaaatatttgaagcatttacagaaatatttgaacaattattagatgacaagtgagataaattagtggatatttctgtggctatacactgcagggaatatggactttacagaattagaggaaagtatgactgtattaggccagtcttgcattgccataaataaatacctgagactggataatttataaagaaaaggggtttaattggctcacagttctgcaggctttacaggaagcctggtgcgggcatctgctcagcttctagggaagcctcaggaaggttacaatcatcttgcaaggtgaaagggcaataggcatgtcacagggtgaaagcaggagcaagcgaaaatgtagagggggaggtgccccacactcttaaatgaccagatctcatgtgaactcagaaggaaagctcccttaccactgagagcatggcccaagccatttgtgaggaatccactcccaggatccaaacacctcgcggggatgacatttcaacatgagatttgggcagggacaaatatccaaactacatcaatggcaatggtgtctcaacacgtacagaatgagagaaagtgccacaaaattaaaaagcgacaaacagagattctggaattgaaaagtaagtaactaaaattaaaacaaaaaactactagtggagttcaacaacagatttgagttgccaaaaggaaggttcagtaagctcgaagatacatcagttaagattatctagtcagaagaatagaaagaaaaacaacacaaatttggaggtaagtatacactcttgcagccattaccaaaatctatgctatgtacatatccatcacctgcaatagtttcttcttatgttctttattattatttttttgtgataagaacacttcacataaaatctgccctcttagccaatgtttaaagtacacaatactgtattgttaactgtaggcactatgctgtacagtagattgctagaatttcttcatcttccgtaactgaaaatttgtaccttttgacaaataactttctgtttccttctcctcacaagattcccctcattttagagcaggggttttacacaccaaattgtcaacaatgagtatttcttggtgaagatttggtgggtgttcagtcagtaggtgtaccttccattttaactttacatatacctgtattgttttatttttaaaaataattaatgtaaataacacttataacaaaaatgaccaagatgaaaactagtggctctcagatgctgttaactttggagagacactctgatcatagattttggtaatggttgcacgagtgtatacttacctccaaattcatcaagttgtctaccttaaatatgtacagctttttgtatgtcagtcatatcccaataaaatggtttttaaaataaaaaaaataaaaacaatacaaaatgtgaatacagcctcagagacctgtgggctaccatccattgtaccagcacaaagataatgggaatcccagatgaataggagagaaaaaagagcagagaatatttaaagcaagaatggctcaaaacctcccaacctgagggaaactgttaatctactcacagaagaaatcagtgaactccgagtagtagaaacacaaaaagctccatacctaaaaacatcacagtcagtgttcaaattagaagaaacatagaatactgaaagcagcaagagaaaataactcatgctgtgaaatgaatgctcacaaaaatggaacgaattttcataacatacttgaagtgctaaaagaaataaatgaaatagagaataaaaaatgaataagaaaaaacaattagttctttaaaaagatcaacaaaatagaaaaatttacctaggctgactaagaaaaaagcaaagagaagactcaaatgactaaaatgagtaatgaaatggaggacatctctaattatcctgcagaaataaaaaagattatacaggaatcctgtaataaaccgtatgctaacaatgatgtaacctagaattaaaggaaacatttctagaaataaacaaattaccaaaattgactcaagaataaaaatgaactccaaagtaacctataacaaagattaaattgccaagtaaagaacacttctcacaaagcaaatgccagtcctagatggtttcactggtaatttctgccaaactcttaaggaactaaaaacaattcttcacaaaatctttcaaaaaatagaaaagggagaaacacatcccaactcgttctatgaagctagcctgataccaaaaccaaataaagggatcagaagaaaacaaaactacaagccaatgtcccttatgaatattgatgcaaatattctcaacaaaatagtagcaaactaaatccagaaacatataaaaaacattccatcaggaccaaatggaatttattccagtaatgcagggtcgctctaacatctaataatcaacaaatgtaatataccatattattagaataaaaaaaccacatgattttctttataaatatgaaaaaactgacaaaatccaacacccattcatgatgaaaaaaagtactcaacataataagaacagaagagaacttccttaatctaataaacagcatcagtggaaaactcacagctaacttgaagaaagactgaatgatttctgttgaatagcaggaaaatacaaagatatctactctggccacttatatgtaacattatagtgaatgttctagttaagacagtcattcatgagaaagaagtaaaagtcatcagaatggaaaaggaaactaaaactatctctgtttgcaaatgatatgattttgcatatagaaaatccaaaagaatctagtggattcaatttaaataataaacacattcagcagtgtttcaggatacaagatcaatatacaaatatcaaatctacacaccatcaatgaaaaatccaaaaatgaaatgcggaaaacaaaaccatttagaataccctcaaagacataaaatacttagaaatgaatttaagaaaaatgtacaagacttgtacactaataaaactgttgaaggtaaagacggtccaagtaaatgaaaagatatgttcagaggttgaaaaacttaatttttaaaaaaaattatttattttttgagatgcagtctcattctgtcgcccaggctggagtgcagtgacacaatcttggctcactgtctcccaggttcaagccattctcctgcctcagcctcctgagtaactgggtttacaggagcctgccaccacacctagctagtttttgtatttttaatagagaaaggggaaaaaacttaatattggtaacagacatccaacatagtttgtttgatagaagttcagcatttaaaatacaaaatagacatcattttgaaaatgtaataacaaatatatgtaggcaaatatataagccaagagaagctggaatacgcaaacccagtagctgacaagataaaattgaaggaaaattttcagaaggaatgaagatagactttatgtactggtaaaagcaacgattattttcatcagataacatcagtttaaaatatgttaacacagtaactgactgaattctggggagcaatagataagtccataatagcaatattaatccaaatacctcagaaatatatagaccaaattgatagaaaacatacaatacaaggaaagatacagaagattagaataataaccagtaataaattataatatggatcatggttaaaaacattgtcaggaacttagaagagctggagagagagaacgtggagcagcaagtatcagaatagctgataaaacaacaagcccaaatgcaagtaatagtcaagtctttaatcacttactgtgaaggaataagcaagaatctcaaactggaggtagcactgacctcatgttacatccacctgccccatgagcgtatgcaccaattacgggtcgggtagattagtactaacataatggctgtctgactgttgagggagctctgaggaaagacttttgcagttttatagacctgggggttggggtgaggtctggggcaaggctagaagtggaaaatgcctgagtactgaatgagtccgaatgcagaaagtgttttcaagatcctccaacaaggagaattccaaatagaaggcctcgactaggaatgcagatgagcatgagagcatggctggccaggaagctgagttcttgactgcaattcctgtcagagactgcagtgcactggctgtgtagccagtctggtgtggggagggcaactttcccccatgaggcctgccagctaaagccattataattgcttgtggttgtacctgaaaaatcacaaaaaatttttgaccatgggctgaaactctcaaacatacaattcaaggccaaactgaaccctgccacttagttctgtcactgactagacatgagatcttgagtaagttatttaacaattctgtgcatgagtttttctattcgttgaatgggaatacgcttggtaaaggaagtatactgatataatatattttatctacagaaagaatatcagacacatagtgttataaatttgttagcacttgtttatatgcatacataggcacaaacacacatgtatccatgcatatctatattatgaatatatctgatgtacatacatactattatacatttttattgtatatgtgtttatatatgtacacacttacacaaacaaatgatttttgtacctaacaaatgcacatacacattctttcagatttaaatgaaatatttacaaaatttggccatttgatatgctgcactttatctctgtgtcagttcacttcccattggctagaattcagtcacatggtgacaacagaatgattctgaaatgcattctagctgtgtaactagagatagaaggaacccatttttgaacagttagcatctcttctgtagtttgcctctttctagttaccaactactatgcataccctttttcaacacatatattaactctttcaccaaaagaaaaaacagaaagtttcactagttacgcatttcaaagtccagaattttagaggacataccctcctccccatcaagaatgaatatgtatatttctggtctgctaacataaaaaccagaaatatgattatttgttgctatccccttacacgatacacaatagcagagccaggaataggctattacaataaaaactcacactaagaaaaaaggaagaaatggaaacacattacagtcattgattcagagcaacattgctgttttgctgggctagtattgtaaaatcctccaccctaacagtactggaagttttaaaaattagaccttagatctgttttttgggaggaacacctggctccactacctgggaggttttgtcttatcttttgacctgttggacaaatgtaagaacactggagatcatgttccctttgaaggatgaggagtgtggcacaatttcttttggtttgcaagttcaatgagtcaaaactttttttggagcataatattaggtatttcagtggtacagatgcttcaaaaacataacagaatttgtatctatttgttttcagtatcttctatgaggcagcagccaaagccaaggttatgttgtagacattgtttttaagttgtttctaatttctgtgcttattccttgtgcccatctctctcttaatggaggctactttaaggccttctgaaaaggtaggcttggatgggaaggccaaactatttcatcagacctttgccatagggttaagcacctttatttaactgagaagactttcaagtcttttcttgctacatgggatgaggaagtactgggctttttataaccatgtcccacttttctagagcctctctattccctttcatttatacttgaaaactgatcaaacttgaatcagttaataatacattgctacaaacaagcagaactaagcaaacaaaacagaataactttctggctctttccagctactttctatgaagtagcaagttttctaggcacttgatctgccttacaaatgattgcaggcaactaataaatgtattaccactaaaataaacaaaaaaagaaaaacctctgtctttacagcctgtgatattatttccttgccacctcctgtttggctgctaagtcaatggcacatattttaggttttggttatgatatcatgccatttctaatacgaattatttcttattgcatctgaagaacaaatttgtaaatgacattaggtagggagcaagttttctcaaaactatttctcaggactgtatactaagctagtatttttaaacttttttttttttgctacaacccaaaacaaaaaacacaatttatatcattctataaacacacacagacataaacctgtatgcatacacatggataccagatgggccaacactatgtcatatctaaactgggactattactgtcaaacccatatgtgtggtatgggtatctgaaattccctttatgatgctaaattggtttttcacatgaaattttaaaaatttgcttgaaaactgctgagcattttgtatttttagtagagacagggtttcaccatgttggccaggatagtcttgatctcctgacctcgtgatccacccgcctcggcctcccaaagtgctaggattacaggcgtgagccaccacgcctggccaactgctgagtattttgaaatggtatttatgacagctaggttagtcctttgagacatcagattgataggaattttatatcctgatttagtgttacatttattgaagagttttaatgattaaaaataaataataaataccatgtattatatgataatcatgtttcatttaaaagtacatacgtatcttttcacttaacgatttatacccttaagtgttaaagtatatttccatttgatctaactttaatagtacttaaaagaattaagaataaacagtggaaacaacattaatctttttaatatctaaaagaggtctttattactattataataactactgataagagatgcaactttacaataggagtactgagttttctatttaaaaagaagttttctatttaaaaagaaattttctatttaaaaaggcattgtgtaatttcctaaagtttgaagtattgtgaaagcgcatcttaatgtcggaagggtaacaaatcctaaagttgattagtaagaaaaaatagaatagcatcacagttcttttttaaaaacccttaactaaacagaaaatacaaatttggaaacttaaaaattaaggatctgtttgtttctttgcatttatgccatggtctctgaatttgtatttttttttttttttgaggcccattcacaggacgccatatgaacacaaaactgtgtggaagttcctgaaaacaattccagatttaacctttcagctaaatgataagcatctgaaaacacttagtaagactgtcttttccgaaacctggttgaaaggcagcacaggtaatagactaatgtgggataaatttggcgagataaaatgcaggccactgtttcgagttctttatcattataatgcttataatttcacttaacaatttcagttgacatggtaaaaatgtactatttgggtgtgtttcatttgtaagtttataagtagtgaaatgaataacatctcacattttagtacttagagtttaagatatatacttgtgtttctctgcctggagcatgactcagaattacccagtgatcacattgagacccatattgtcgggtttaaacatcagaatttctggttcagtaggtataggatgaggcctcaatttcatttataatacctcaggtgatgccaccagtgcagggaccacacttgtggaaccaatatctgagatacacatttagtaacaatatagtgttgattttcataggtaaaacagcagatagtcaacatgattatttgactaagtcagatactaacccagatatagggaaaaaagcctctctagatagattttcatttcccaattttagcttttggtcccttcatgaaggatttagtggatatattaatagacttgttatattttaattacgggggctaggcatataatttaatacattctttatgtcagaagcatccctttttgttcctcagaaaaataaatgaaggaagatattgctattattattctccacagatgaggaccccgaggcacaaatatcacacagagcattcttgcttagaatcgagtttcaaacacacttcagcctaattctaacttgttctctgtgtattatgtcactgttagtacaaactggtttatcaagatcatgacatttaaaacttaactggaattttaaagaatatgtgtctattgaaaaaatttacatatttccagagttttccctccatggtcttctttcataattagttccatttaatctgtgatcaagcaatgaaaaataaatcaaaggaattttaaaggggataaaataattttgaaagggaataaaggacaaacattcaacattgctttgctattagattgaggatagtaattaaaacttaatttgttttataaatcactgaaaacatatttgtaacagtaaaaaatatgggaacaatctaaatgtccttgaatagaagattggctatacatattttgatatatctattatatagaattctagacagtgattaaaaagaatgaactagatttatatatattgatatggaaacattaaagagtaaatagaataattgcaaattatattaataacacatttatgaaaaaatctaaatttatgcacatagacacacacacacacacacacacataaacatatatctttttaaactatacaagtgggtccagaaggacatttcaaaaatacatatttttaaaaattgttgccttagtgtaggggagtgaaattgaggggtgataaagggctaaaattaactctttcttctacatatatttgagttggttttattctctcacaatgtgtttatttatttgttaatatttgtaattatacatttatttttttcaaacattttctaaaattaaaattagaaacaaacatttaatttgatggcaccttaactcacgtgattgacgattaaaatatgaattttcaatctttcacaagtgtcaggtattccaacttgcatttcaatagggtgtactttcaacacttaaaaattaggagactctgtgtttacacctacctgtgtcaaaatccctctcaagtttttaaagcatttagttccgacagctcagatctgtttcactaccaaagaagtcaactcattaaatatatgacctttgtagatttctttgttcatccagtttagtaaaaaggcccaactaggtgtctgtctctctcctttttctttattcatgtatgtgtttccctccctctgctattatttaaactattccttctagtagcccctcatcaccaggctgctgactttcaatctgctgctggggcttccatttctctggtgcaattccacacagctgtttgtaccttctggtctcttttctggccactagttcttaaagcctcattatttaataaagcttcctaaacttaccattattcactaagcctcttgatcattcaggttttataaataatcgaacagtaataggaaaacaatattatatttctaagtagtgaataaaacacattatgtgtgtctaagttaaaatgctacaaaaaatgattactatattattatattatttactgactatattaatattactatatatgagtacttatattaaaattactgtatgtaatgtattttacatatagtcatctctctatatacatgtgtacgtagatataatttactgaagtcaaatggaaggatttttcattagatcacatttttatggcctgaacaagggacatttttatgattgataacctaaagctcatgaaaactaaaagaattgccagtttagttactaacctgtaacaatatcccagatcaaacttttattatctagctttatgttaatattaaaacccatttctataaaataatgtttttctcttttatatctatgtcaccttgactgttttctttgtgtagtcctttgtcttacagtattatttctcttctatttctttcactttatttcattctgtaacccacttttatgagattgtatctcaaaaactccgtaattcctcattttcattaaattgtatatttacttttaatgctgaaaatatttttatattactaaggttctaacatttctttaacctgcatagattttattttctgttgtggtttatattttatttaacaactaaaaatatggtagctaaatctcatgaaatatgtagtgggcatcttttctagacatcaattaaccataattcaaataatttattcttataatagaagaaataaaatctttagctgagatttagtataaatccagtctttatgtagactcatcaagaaaaaaaggagatccaagagaaacccaggaaaggaaggcttcactgctgaattttaccaaatattttaaaaagaattaatatcaattattctgacactcttccaaaaattgaataggagggtatattcccagactaattttatgaggccagcattaccctgacactaaaggcagacaagttaaatgaattcagtaaaattgcaggatacaaaatcaacatacaaaaattagtagtgtttctctactaataaaatattcaaaaaggaaaataagcaaacaattccatttatgaataacaataaaaaattacttaggtgtaaatctaatcaaggaagtgaaagacctgtaaactgtaaactagaaaatattgataaaagaaattgagaaaaatagtaataaatagaaagctgtgctttctatgctcatgggttgaaaaaattaatattgttaaaatgctcatactagtcaaattgatctatagattcagtgcattccctatcaaaattccaggacatttttcacagaaatagaaaaacaattcttaaattcatatggaaccacaaaagaacccaaatggccaaaacaattctgagcaaaaagaacaaagctagaggcatcacactctctgatttcaaaatacactgaaaagtgattataataaaaacacaaggcaatggcataaaaacagatatgttgatatgataaggctttgtgtccccacccaaatcttatcttgaattgcattgcccataatcttcccaaatccccacgtgttcagggagaaaccaggtggaggtaactaaatcatgagggcagtcacccccatgcagttctcatgatactgagtgagttctcatgggatctgatggttttataaggtgctcttcccactttacttgagttttgacaaaggtgctaaaaacactcaacagagaaaggacagtctctttaatgaatggtgttggagataaatggtgtttgaatttatgagtgacgacttacagtatctgtagaagaaatttctaagcaacaaagtgatcaagatatggtctggctatttctaacatcctatgttcagataagggagcaaagaaatgacttaaagttggaagttctctttaaagggaaagcagagcatgagagttttgaaaatttgcagcctacccatataacagcaacaacaagaacaaaaaagctattatgggtggaagaatccaagaaggctgtggagcaaccacttgttagaaatatttgtgtgactaaaaaagagctaggtgctgatagccaagacagtgggaaaaaggcttcaaaggcatttcagagatctcctaggtagacactcctatgataggcccagaggctaaggatgaaacaatggttttgtgggcctggcacagaaccctgctgccctgcatagcctcaggatgctgctccttacatgccagccactccagctgcaactcaaaggggcccatatatagcttgggatgcccctctggagggtacaagccataagctttggtggtttccatgtagtgttaagcctgtgggcatgtagactgcaacagtgaagaaggcttggcagcctctgccaagatttcaatgggtgtatgagaaaacctagatgcccaggcagaagcctgctacaggagtagagccctcacagagaacctctactagggttatgcaaaagggaaatgtgggattgaaggtcctacacagagtcctcactaaggcactacctagttggacctgtgggaagggcactactgttctctagaccccagcatgttagatctactggcagcttgcactctgcacctggaaaagctgcagctactcaactcctacccctgagagcaacctcaggggccataccctgcagagacatgggggcagagctattcaaggccttgggagcccaccacttgtaccagtgtgctccagatttgggacacagagtcaaaggaagttaattttgagttttaagacttaagccttgctgggcttcagatttgcttgaggcctatagcctctttcttttggtcaatttatcccttttggaatgggaatgtttttccattgcctgtttccccattgtatcttggaagtaaatagtactttttgattttataggctcataggtgggaggaacatggattcaaactcagataagaccttggacttgggacttttgagttaatgatggagcaagttaagacttttggggactgttgagatgggataattttattttggaatgtgagaagaatatgagatttgggggccaggggcagaatgatataatttggacatcccctccaaatctcatgttgagatataatccctagtgttggagatgtggccttgtgcaaggtttctggttcttgggggtgggtcccttgtgacttggtactgtcctcatgatagtgagtgagttctcacaagatctggttgtttaaatgtgtatggcacctccccttattctctctcctgctccttctctctccatgtgatgcgtctgcttccattttaccttctactatgagtaaaatctccttgaggcttcctcagaagctgagcagataccagcacctgccatgctcatgcagcctgcagagccatgagccaattaaacctcttttctttataaatgacccagtctcatgtgtttctttatagcaatgcatgaatgacctaacacatgctatattatagaaactcatataacttagatataatgaacaagttcagatacaaactatcataattgactcaaaggaaggataacttgaagaaggataactaaaataaattaatgtattaaattggtaacttaatattctcacaaagaaaatccctgacccacatggattaataatgaagtctatctagtacttaaaggagaatttagagcacaagcaatgaacagttaagaataaaaattaatttataaaaatgaaattaagaaattcagttcaatttgccaataacatcaaaaatataacctgcttaggaataaattgtacaaatgaagtgcaagacttgtacattgaaaactataaaacattgttgaaagaaattaaatagaaagtaatccaatattcattgatctacataattaatattgataagatagcaatactatttatattgatctacagattcaacacaatccctaacagaaataccaattgtcttttttttgcagaagttaataaattgatcctaaaattcatatagaaatttaggagatgcaaaacagccacaatatattgaaaacaaatgataaagttgaaggactcacacttctctatttcaaaacttactacaaacctatagtaacataaaagtgtgatattggcataaatatatagagagatcaatggaacagattgagtccagaaataatgttttaacttgatggtctattggttttagacaaggttactaagacaattcagtggtggaaagaaaactcttttcaacaaattatgcttggagacctaaatatcaagatgctaaataatgaaggtagacccctaatttacaacatacacaaaaaattaccaaacatgaatcaaggatataaaggtaataattaaaactataaaacttttagaagaaaaacttaagaatcttcataatcacaggttaagccatgtgtttttacacataacactgacagtacaagagacaaagaaaaaattgaataatttggaccttataaaaattaaaatattttgagcttcaaagaatagaatcaataaggcaaaaatgcagcccttgaaatggaacacagtacttgcaaatcatatatctaataagggtctcatgtccagaatatgaataacttgtaaacctgagtaacaagaagacaattaacccaatttcgaaaatgagtatattagctgaatagatacattttcagagaagatataaaaatagccaataagcacataaaaatgtccaacattattgtcattaagcaattccaaataaaaattacaatggcatactactccatccccactaacatgattaaaatataaaagaaagtattaagcgttggtatggatgtagagaagttggaactcatacatttgtcttgggattgtaagatgaagccactttgtaaaacactttggcaattcctcaaatattaaccataatgttacatttgccccatgtattagtctgttctcacactcctaataaagacatacctgagactggataatttataaaggaaagaagtttaatggactcacagttccacatggttggggaagcctcaaaatcatggtggagagtgaaggggaagcaagacacatcttacatggtggcagacaagagagaatgagacccaagtgaaaggagaaacccgttatgaaaccatcagatctcatgagacttattcactaccatgacaacagtatgggagaaacaaccccatgattcaaatatctcacactgagtccctcccacaacacatgggaattatgggagctacaattcaagatacaatttaggtggggacacagtcaaaccataccatttcactcctggcccctcccaaatctcatgtcctcacttttcaaaaccaatcatgtcttcccaacaatctcccaaagtcttaactcatttcagcattaacgcaaaagtccacagtccaaagtctcatctgagacaaggcaagtcccgtccacctgtgagcctgtaaaatcaaaagcaaatttcttacttcctagatacaatcagggtacaggcattaggtaaatacagctgttccaaatgggagaaattggccaaaaccaaggggctaaaggccccatgcaagtccaaaatgcagctgggcagtcaaatcttaaagcttcagaatgatctcctttaactctatgtctcacatccaggtcacactgatacaagaggtgggttcccatatcttgggcagctccacccctgtggctttgcaggatcccagctactttcatgggctagtgttgagtgtctgcagttgttcttttctgtcacatcatcagaatgcaaattttttgaattgttatgctctgttttccttttaaaactgaatgcttttaacagcacccaagtcacctcttgaatgctttgctgataccctaaatcatcttcctcaagctcaaagttccacagtcctctagggcgggggcaaaatgctgccagtctctgctaaaacatagcaagagtcaccttttctccagttcccaacaagttatttatctccatctgagaccaccttagcctggattttattgtccatatcactctcagcattttggttccaaacttttccacattttcctgtcttcttctgagccctccaaactgttctaatctctacctgttacccagtttcaaaatcttttccacattttcgggtatctttacaacagcaccccactctaccagtatcaatttactttattagtctgttcttaagctgctaataaagacatgtctgagactgggtaatttataaaagaaagagatttaataaacttatggttccatgtgactagcgaggcctcacaatcatggcagagggcaaagttgaagcaagacacatcacacatggcagcaggcaacagagaatgagagccaagcgaaaatggaaaccccttctaaaaccgtcagctcttgtgagacttactgccatgagaacagtatgggggaaactgcccccatgattcagttatctcccacctggtccctcccacaacacttgggaattatgggagctacaattcaagatgagatttgggtgaggacacagttaaaccatatcaccccagaattccactcctaaatacacatctaagaaatgaaaatatacattaatgccaaacttatatacaaatgtttatagcagtattattcacagtagccattatgtggaaaaagaccaaatttacatcaatgagtgaagaaacttttaaaaaatatgtgcatatcattataatagaaaattttggggtgaaaaaagtgatgaactactaatacatgccaaaacttgtgtagaccttgaaaccattatgataaagaagccagtcacaaaaggccacgtgtttatgactgcttttatatgaaatctccagaataggccaattcatttggacatcaagtaacatagtggttgccacctttgggatatgaggtaagggacattattgctgatgcataaggtgggcggatcacgaggtcaggagatcgagatcatcctggctaacatggtgaaaccctgtccctactaaaaaaatacaaaaaattagctgggcatggtggcgggtgcctgtagtcccagctactccagaggctgaggcaggagaatggtgtgaacccgggaggcggagcttgcagtaagccgagatggcgccactgcactccagcctgggcgacagagtgagactccttctcaaaaaaaaaaaaaaaaagagtttcttttgggaatgataaaagtattctaacgttagattgtgacgagattcaatgtatctttacatatagtaaaattcaacggaattgtacattttaaaagggtgaatttcattgaattgtatctttaagccttttaaaaaattgggataatgttaatcttttagagtgtacaattcagtgacatttagcacattaaaaatattttggaaccatcacagcatccagttcccccaaaatttctatcatcctaaaatggaagcccatgcccattaagcaatcactcaccattcccctaaaccctggtagccactagcctgttctctatttctatggttttatttattctgaacattttgcatgaatggaatcatacaatatgtgaccttttgtgttgagttctttcgcttaacatagtgttttcgtggtttatctgcattgcattatgtacttcattgtacctcatgagctgttaattgtttctttaatagctgaataatatcctcttatgtaagctatttttaaaatgctttttaaaaatcaattggagaccaatggacaccaataatgcaagccagctcctagagagccctgtgattgaaatcaatttcttttaataaatttgtttaatatgaaaagagaaatacaaaagaaattttaaaaatccactagaaatgggttagctgagacaaactctttctgtgaaatgatttaaacaaagttaagtaaaatgaaaaattagcatatcagagacatcagtatgccaccatacattgaatatatcatacacgtacactacacaacttcagaaatataatttacctgtgttttcccactcccctcagaaagcacctttgcataacatactgtgtggaattctgtcatatgagaaagaaatttatttcttatagattttctataatctcttatattagagtaacagtattttatgatgtgtacattccttttactaccattaatcctttgatagacaatcctcttagctgtgcaggataaagctcactgtccctttcttatgtttgaggactctgagtttcaaaatcttactagttctacaccagtgaagggtagaagcaagccttttgagtctgggtcttctgaagccaacctttagctttgttttacccttttccatgaattacatttttccatgaataaaattaagctatagtatcaaggaaacttgtttgttaacatgtatcatcaaagagccttcactagaataatatgtggcattaattgatacaggttttgatgggtaatctaaaatatctttgctgaaatactggcttatagaaatcagtgccattgcttttacgatcttttctagtgtgagaacagtcttgcatggtgatgctaattctctccctgttatctgttatcaggagaatggctcttgatgtaatatgtcctttttatggcactggcctgaatttaatgttcaatgtaaattttaatcttttaaatgtctgcaaaataaactcttttttatgaaagtgacaccaataagagagtgaagatgatttttaatggcaaaggaaaataataaatatgtgtttattttaaaacttagagcattgaaaaatgtgattatatggcacattataaatagaccaaaagtcaaaagaagatgtaaaataaacttctaataagatgtattggctaaaaatcttgtgttttatgggaaaatgaatcaaatcgtcactcagttttgtacccataaggggatacagttttatccccaagtaattggagatttagtaaaattgacacatttaggattaaaatgtggtatgacttaatattagaatcagaatgaggatttcagaaaaatattgtgagtcattatgtacttcaatcaaaatctaatctagacaacaaacatggaaaaaataagattgcataacaattattggtgaattttaaggtagatattttttattaagctttttttttttttttaaatagccacagggactgttaaatgttaatgtctgaagttaaaataactttttcactggagagaaaaaagtttgactttaatagccaactattcatgatatttattatcagaaagaatgactgaagaaaccaattctaaagctcatattattgtttttgtagattattctcaagattgactggcttatactagaaatcttgaaaagccaattcatctggttatccagggatatattttaaaatccgtaaaaagtggagaaaccatctggactttatatttattgagaattggtatttaaacaaattttaaaagacctttctgagatttttgtttgttttagtagaagggcgtttcatagcaaattttaaaagcttgatggtatataacttggagtcagaaaaaacaccttcttttggtggtataggtgctttgatttatttttagaggtaaaaaattcttagctcttccacccgaatacctatgggtgtaagaaccataatactttcttcaggcatgtgggggcttcttcaatatcccaaagctatttgttcctccccactcctggcagggctgactctaacacacacatgctcttgatctgaaacataatttaatctgcagtggttagacataatagttactcaaaaaatagttgataggtgaatctatgcattaactagcattggaggtaatttccaacaatgtaaactttaatacgcagtactgatctaaagttcattcaggaacaaaatatttattgctagatgataatctgaaatagatgtagttcatgcattcttccagataaactaatgattatcattcaattataatgctgaattctatggccacatatcacggtgccattcttttgaccttcccatgtaaaagtgatttttaaattcttagaaatagtctattatgcctggtaaagggtattctattaattacttttgtgaaaatcttagttatgtttatactaaagtgtaaacttttgggagaaatatattcaatgttattgagaatttttatagttactaaatcctgtaactgatcatatttcctcttatatgttggctattagaaagcctttaaaaactatttgattttaaatagatatgatattgttttgatataaattttaaaagattgaaatgttttaaaagtaaggaaaatggagctaaaattgtccctgtatccagcattacctccttgaaaatatatagaatttcacagaatatgttttgtaatttaatattattcttgccttcatcagtttttcctatgtttatcttcactgtatttcattaactttttaaacaatattatctgtatttttgtatgctcacaagataaatccttttagataacaaatgaaatcctttactgaaaaaagtcaaaggctttgattttaatatgtgttgttatgcataataagaaactgttttccttctctggaaatttttaatgtaaacaaaatatttgaagaaattataaaaaataacaatctgtatatatttttaaatctgacttcaaattgatacatgaggcttagacatacgtgtgtcatttgataactgtcttaaatatctaaatataaatcaaaaagcattttcattacttcgactataaaaacacaaattcagtaagtacttcaaatcttggaagaataacttgaaaactacaataagtattataaaaggtaaggatgaatgtgactgaacttgaagaaaatgtgggacataaatgaaaacagactctcatcagcacataggtcctctacatgtggacgtgattacacagagatgtgtaaagtcttactgataacagtgtggtcttgaaatacttaaatacccttcaagacaaattataccttcagcttaaccacaaatcaatgaatacatcctaatgacaggatgtctaaagaccatatatatgtatatatagccagaatatatatgcatatatatagccagaatactcctatagtaactctaagtacacagtgatgatcagcaagtgataaaatactaaatacagacttggagcttagctgaacagttggatggacaagtcatgaacaactgaaattcgtaattaaataagaaacacagtttctaaactgttcaatatttattgttcatgcttactgtttggaatcaggcatatctacattagttttgaaccaaacaatgttaaaatagtcacatgcttatacaatcacttacgggaataataagagttaactatattttgggtacccttcacatacttcttaatattttgactcattagtatcttaatagatgtccattcactagttcatatattttacaagtctaaaaaattcatattattatactaaaaaataataggcaataaaaaagtttaattatcataaattcctataaactttgggattaaacttttaaagttaagcaaaataacatttttgaaaatgttttagtgattttttaaaggattaataattaataggttgttacaatcatttgtgtattataaaattataaattattcctttatgcaatcgccaataatatttaactattttttaaagtaacttaatgctatgaatatgatgaattcacttaatgctatgaatatgatgaattctcatttccgtgtttattccctctgcaattggcttcattgagagggtcgattttaaaagtttgcaatgttcgtagtttgccttaccaatagtcctctgaccagtcacctcaagccaggatgatttagtgatatccttttagggagagcaagtccagaagaagaccagcatctgacaaaggtcctttatgaacaatttgattcattcttgtctctgcaacttcactttctttctgtcccttacaagagttctcctggaacctcccctaactgtccaagtttttttttttttttttcatttttttgatgagagctttaattcattgctgtgattcaactttaatgtatatgcttctgattttcaaattcataggtttttagaccttacctcagctcaacattcacataattgaactgctaatatttctgcaaacaccacttttgaataactgcatatttttgtcatacagatatgttatacttgatcaatctttttaaaaaggttgtacatattttcctatcatgaatactgtggtcctgaatatatacttacagtaacttttacttgtattttggattatttatttatgacagatttctaaagttaaaagtaatgaatcaaaatgtgggtatattttaatatctcgatagttgtctacaaatgatcagaaatatatcatcccagtgttacatgagaatgccactattgctgcattctaaattttaaggctttggtaatttaaatgttgaaaaatcaccctctccccatatttgagagtcactcctgactgtggctgtcctggccaagcaggctgccccttttctttctccatccttatttttggtgtttcttgtcacttttctgttaaactccagtgttctctcttggataatgtatttgaggtatggttttctcatacattattttggttcttataagtggataagttgtctatgagatgcttctagtcagccatcttaaaccagtcatacttcattttaaaaattagcactgtttttattctaattgaacattgtgtaattggttatttaaaacataattccaatttccagtgctctcctaagtgtgtcctaacctgcttttaagtgaattctttaaaatactttttcctgtactgtgcttctgacaaactgggtaattcactgttctttatcaaccttcctagcttgattgaagtccatcaagtactccatgttacctgcttctggtcttgttcatttgatttcctactatacaaatatttttccttccatatctgtcaatcaaaattgtatctacatttcaagatccatcataaatgcttctttttcataaagtcattccatatatttcccaccagacacaatttatttcttctccagaccttcatatcattttatgtactcatttaaggatgtttgccttgtattgcctcttataattatatactttgtaattttcacaataccagaagagtatttatttttattttggaacagagagtatcaatatttgaaggctatttcaatagacgctctgagctcaaaataaaatgaaataaatttctttacatcccgtccagttagctgtgtaatatttacgtatttgcttttttaatctcaaaataaatatccagttttatttgcctgctgtcttctacaagttattgcattattctaagcgaggttattagacttgtgtcttaaaataactactcctggtaccttagaagaggaaaaattggacctatgcaaaataatcccatttccaaagattctttaatataataaaagctatgaaaaggccattttattgctttgttatcttatctctgcaatcatttagaccttataaagagattccataaattaatccatctggcttaaaatttatataactttcttatatttttcctaggcttccatctaagggcctgagaagaaaattgaccatcatagagttttatcttattcctcaatagacagaattctaaggaaaaaaaaagagttgatcttcaaatattttataaaattctttggagagaaatactgtaggggatcattaattaagctttcatttattcgacgagtgtttttgctaaatgcctaaaattatctaggctgtgtgatatgagctggagatacagagagcagtcagtttcttctctcaagaggttacagtctactggcagagactgaaaacaaagagtgccatggcaaaaattctgtgaagaaagatcccagaggaggcctgttaattaggttggatgggggcagggctgaggtcagaaaaggcttccctggtagatagataacagttaaactcaattttatagggcaaggagggattcaccactgacaatatgaccttattcatccaattatagttccttgaaacttttaagtccttctagaatggctgattttagctgaaggtctttgtaccagagagtgggaaatgtttagcaagattcacaatcatgtttgctttaatcagactttgtaattggccgttaacctttcaaaaagtcactatcaaaatgattaattaaactttctctaactagtatttttaattctttttaatgccttctgttcattaatagaagtatagttaagagctattttcaaatatggggtcctgcattaggggtttcacaagtcctcatgagaatggttctttgatttttcatgtaatagaaactaggtatataaatacttttatgaaacttattcctaaccaacttgattttgataaattacttttgcaaagtctgggaatcattatttaatgggctggaaatcagtattgtttccttattgtctgatttttcttttttttttttttcaacaaaccacttttattataaaaatttccagacttacataaaaacccctgtgaccccatcaaccagtttcaatagccatcaagtttgccatacgtatttaatctatcctccctttacctccccacctttttgctttttggctgaagtttttttttttaatttttatttatttatttatttattttttattatttaagttttagggtacatgtgcacattgtgcaggttagttacatacgtatacatgtgccatgctggtgtgctgcacccactaactcatcatctagcattaggtatatctcccaatgctatccctcgcccctcccccgaccccacaacagttcccagagtgtggtgttccccttcctgtgtccatgtgatctcattgttcaattcccacctatgagtgagaatatgcagtgtttggttttttgttcttgcgatagtttactgagaatgatggtttccaatgtcatccatgtccctacaaaggacatgaactcatccttttttatggctacatagtgttccatggtgtatatgtgccacattttcttaatccagtctatcattgttggacatttgggttggttccaagtctttgctattgtgaataatgccgcaataaacatacgtgtgcatgtgtctttatagcagcatgattcatagtcctttgggtatatacccagtaatgggatggctgggtcaaatggtatttccagttctagatccctgaggaatcgccacactgacttccacaatggttgaactagtttacagtcccaccaacagtgtaaaagtgttcctatttctccacattctctccagcacctgttgcttcctgactttttaatgatcgccattctaactggtgtgagatggtatctcattgtggttttgatttgcatttctctgatggccagtgacggtgagcattttttcatgtgttttttggctgcataaatgtcttcttttgagaagtgtctgttcatgtccttcacccactttttgatggggttgtttgtttttttcttgtaaatttgtttgagttcattgtagattctggatattacccctttgtcagatgggtaggttgcgaaaattttctcccattttgtaggttgcctgttcactctgatggtagtttcttttgctgtgcagaagctctttagtttaattagatcccatttgtcaattttgtcttttgttgccattgcttttggtgttttagacatgaagtccttgcccatgcctatgtcctgaatggtaatgcctaggttttcttctagggtttttatggttttaggtctaatgtttaagtctttaatccatcttgaattgatttttgtataaggcgtaaggaagggatccagtttcagctttctacatatggctagccagttttcccagcaccatttattaaatagggaatcctttccccattgcttgtttttctcaggtttgtcaaagatcagatagttgtagatgtgcggtgttatttctgagggctctgttctgttccattgatctatatctctgtttaggtaccagtaccatgctgttttggttactgtagccttgtagtatagtttgaagtcaggtagtgtgatgcctccagctttgttcttttggctcaggattgacttggcgatgcgggctcttttttggttccatatgaactttaaagtagttttttccaattctgtgaagaaagtcattggtagcttgatggggatggcattgaatctgtaaattaccttgggcagtatggccattttcatgatattgattcttcctacccatgagcatggaatgttcttccatttgtttgtatcctctattatttcattgagcagtggtttgtaattctccttgaagaggtccttcacatcccttgtaagttggattcctgggtattttattctctttgaagcaattgtgaatgggagttcactcgtgatttggctctctgtttgtctgttgttggtgtataggaatgcttgtgatttttgcacattgattttgtatcctgagactttgctgaagttgcttatcagcttaaggagattttgggctgagacaatggggttttctagatatacaatcatgtcatctgcaaacagggacaatttgacttcctcttttcctaattgaataccctttatttccttctcctgcctaattgccctggccagaacttccaacactatgttgaataggagtggtgagagagggcatccctgtcttgtgccagttttcaaagggaatgcttccagtttttgcccattcagtatgatattggctgtgggtttgtcatagctcttattattttgaaatatgtcccatcaatacctaatttattgagagtttttagcatgaagggttgttgaattttgtcaaaggccttttctgcatctattgagataatcatgtggtttttgtctttggttctgtttatatgctggattacatttattgatttgcgtatattgaaccagccttgtatcccagggatgaagcccacttgatcatggtggataagctttttgaggtgctgctggattcggtttgccagtatgttattgaggatttttgcatcaatgttcatcaaggatattgatctaaaattctcttttttggttgtgtctctgctcggctttggtatcagaatgatgctggcctcataaaatgagttagggaggattccctctttttctattgattggaatagtttcagaaggaatggtaccagttcctccttgtacctctggtagaattcagctgtgaatccatctggtccaggactctttttggttggtaagctattgattattgccacaatttcagctcctgttattggtctattcagagattcaacttcttcctggtttagtcttgggagagtgtatgtgtcaaggaatgtatccatttcttctagattttctagtttatttgcgtagaggtgtttgtagtattctctgatggtagtttgtatttctgtgggatcggtggtgatatcccctttaccattttttattgcatctgtttgattcttctctctttttttctttattagtcttgctagtggtctatcaattttgttgatcctttcaaaaaaccagctcctggattcattaattttttgaagggctttttgtgtctctatttccttcagttctgctctgattttagttatttcttgccttctgctagcttttgaatgtgtttgctcgtgcttttctagttcttttaattgtgatgttagggtgtcaattttggatctttcctgctttctcttgtgagcatttagtgctataaatttccctctacacactgctttgaatgcgtcccagagattctggtatgttgtgtctttgttctcgttggtttcaaagaacatctttatttctgccttcatttcgttatgtacccagtagtcattcaggagcaggttgttcagtttccatgtagttgagcagttttgagtgagattcttaatcctgagttctagtttgattgcactgtggtctgagagatagtttgttgtaatttctgttcttttgcattttctgaggagagctttacttccaactatgtggtcaattttggaataggtgtggtgtggtgctgaaaaaaatgtatattctgttgatttgggtggagagttctgtagatgtctattaggtccgcttggtgcagagctgagttcaattcctgggtatccttgttgactttctgtctcgttgatctgtctaatgttgacagtggggtgttaaagtctcccattattaatgtgtgggaatctgagtctctttgtaggtcactcagaacttgctttatgaatctgggtgctcctctattgggtgcatatatatttaggatagttagctcttcttgttgaattgatccctttaccattatgtaatggccttctttgtctcttttgatctttgttggtttgaagtctgttttatcagagactaggattgcaacccctgcctttttttgttttccattggcttggtagatcttcctccatccttttattttgagcccatgtgtgtctctgcacatgagatgggtttcctgaatacagcacagtgatgggtcttgactctttatccaatttgccagtctgtgtcttttaattggagcatttagtccatttacatttaaagttaatagtgttatgtgtgaatttgatcctgtcattatgatgttagctggtgattttgctcgttagttgatgcagtttcttcctagtctcgatggtctttacattttggcatgattttgcagtggctggtaccggttgttcctttccatgtttagcgcttccttcaggagctcttttagggcaggcctggtggtgacaaaatctttcagcatttgcttgtctgtaaagtattttatttctccttcacttatgaagcttagtttggctggatatgaaattctgggttgaaaattcttttctttaagaatgttgaatattggcccccactctcttctggcttgtagggtttctgccgagagatccgctgttagtctgatgggcttccctttgagggtaacccgacctttctctctggctgcccttaacattttttccttcatttcaactttggtgaatctgacaatgatgtgtcttggagttgctcttctcgaggagtatctttgtggcgttctctgtatttcctgaatctgaacattggcctgccttgctagattggggaaattctcctggataatatcctgcagagtgttttctaacttggttccattctccccatcactttcaggtacaccagtcagacgtagatttggtcttttcacatagtcccatatttcttggaggctttgctcatttctttttattcttttttctctaaacttcccttctcgcttcatttcattcatttcattttccatcactgataccctttcttccagttgatcgcatcggctcctgaggcttctgcattcttcccgtagttctcgagccttggttttcagctccatcagctcctttaagcacttctctgtattggttattctagttatacattcttctaaatttttttcaaagttttctacttctttgcctttggtttgaatgtcctcccatagctcagagtaatttgatcgtctgaagccttcttctctcagctcgtcaaagtccttctccgtccagctttgttccgttgctggtgatgagctgcattcctttggaggaggagaggcactctgatttttagagtttccagtttttctgttctgttttttccccatctttgtggttttatctacttttggtctttgatgatggtgatgtacagatgggtttttggtgtggatgtcctttctgtttgttagttttccttctaacacacaggaccctcagctgcaggtctgttggagtaccctgcggtgtgaggtgtcagtgtgcccctgctggggggtgcctcccagttaggctgctcgggggtcaggggtcagggacccacttgaggaggcagtccgcccgttctcagatctccagctgcgtgctgggagaaccactgctctcttcaaagctgtcagacagggacatttaagtctgcagaagttactgctgtctttttgtttgtctgtgccctgcccccagaggtggagcctacagaggcaggcaggcctccttgagctgtggtgggctccacccagttcgagcttccaggctgtgttgtttacctaatcaagcctgggcaatggcgggcgcccctcctccagcctcgctgctgccttgcagtttgatctcagactgctatgctagcaatcagcgagactctgtggggtaggaccctccgagccaggtgggggatataatctcatggtgcgccgttttttaagcccgtcggaaaagcgcggtattcgggtgggagtgacccgattttcccgattttccaggtgcggtccctcacccctttctttgattaggaaagggaactccctgaccccttgtgcttcctcagtgaggcaatgcctcgccctgctttggctcgcacatggtgcgcgcacccactgacctgcgcccgctgtctggcactccctagtgagatgaacccggtacctcagatggaaatgcagaaatcacccgtcttctgcatcgctcaggctgggagctgtagaccgcagctgttcctattcggccatcttggctcctccccccgatttttcttaaatgctggttttttttttaaatacatgaaatcgttttatgtattttgaatatttgaatgaggaatccatgctatttgtttcttctcacaggttaaaaatttcaaatgcttatatttagcttgcattattaacaaatgtctcttttctcacaattcatacatttaacaccactttgtgctctgttagtaatattttaattgttctttgacaccttaattagatagtaatcttttttagacaattttatagtattttaataatttgtctataaattttgggattatgtcaaatactctttgaattctattttgagaagcttttgtaaattcagtttcagccaaattttatacttttctctgaactcttcattttaactccatttacaatgttaaattttttgtttgaataaggatcattttccttttttattctcccctagtacatctatacagaagtcaaccaaaatttcgtctcactctgcatatatgtctgaaattaaaaaaaaacttttattttcaaatttcttctcaaataattttgatagatttatgaatatgccaactatgttaatttaaggaaataattgagggtcaatttctgaactctcttacaaataatgtattagtccgttttcacgctgctgtaaaggaatacctgagactgggtaatttataaagaaaagagttttaattgcctcatggtaccacagtctgtataggagccatgatgctggcatctgcttaacttctggggaggcctcaggaaactaacaatcatggcagaaggcaaaatgggagccaagactttatatagctgagagcaggaggaacagagagaagagggaggtgccacatagttttaaacaatgggatttcatgaaaaatctatcactagaacagcatcgagaggatggtgctaaaccattcatgaatgattcacacccatgatccaatcacctcccacggaggccacatctccaacactggggattacaattcgacaggagatttgggcagcgacacagatccaaaccatatcgaatggtaagaattattttaattcccattgaggttgtttataaaatctataaaactaacatacatttgtaggtatatatttatctatatatacattttatacatacacatcactacttaaatatgcacgtacagcacacacacagagcactcatatgtatgtatgtttgtatgtgtgtgtgtgtccttcagatgttagaacacatttgaaaacttccagaaattaatgtactttgtaacttttgacaagttattttatcattctgagccttggtttcttcatctgcaatatgcagtaacaatgtatggttttctgggttattggaataattagtgttagaacacctagcacagtgcatgacaaatatttaatgcttggtacatgatatttactcttcatggcatgtttggtatatatgaataacaggaatagctgtttctagatttaagaaatctagattaagaggttgcttcttaaggagtcatttatttaggaatagccaatcaacccacttgtcattaagatctgaaaacattaacttctattttatggagaatatctagtgaaaggtatacttagagttctaatcaagaactattattttgctcaataattaacaatgtctttctttataagtatttaaaaagagacttgtttttaaagtctcaggaaacttacattcatggcagacggcgaaatgggagccagcatttcatatggctgagagctgaaggaagagagagtaggggaggtgccacataagtcattctcttatgaacaagtaactaatactaccaaatctctttctagacttgtttttgtattataatgtttatatcataaacatgtattcataggcagacatatatttacttttattttaaactttttaagtgaacatatattactttgtaatgtattttttaactgaaaatgtcacatgctaaataacacactgtagtcttattttatcataattgaaacactatctctaagcaatatatttcaagaatgagacagagaggggaggggaagaaagaattctatgtcaaattacaaagactagtatagtcatgtggaactgccactgggtgtcttcaaatactggctctaccactactagctcatcaagcttgggaaggatgtttaatttttccctgctttcagtttcctcagttgtaaagttgaagcaatcacagtgcctgactcatagggttataatatgtttagaatagtgtctctcatataataaaatgttcaaaacaaagaaagtcaaacaatatttgctgtcatcttgtgaacagatttttttctctagtttttttctccactatatttgcataagcttccatttaattgacatatcatagcatcaggatatttcacccctaaacacttcagagtgtatctaggattcaatatttgtttctgacactttattttttaaggcaaaatttatatacagtgatgtgcatatgtataccttaaatgtatcacttgatgagtttagacaaatactgtatcccagatccttagcaagatacagaactttactatcaccctaaaagttctctttatatttcttcccagtcagtctgttgtctgtcccataggggcaatggctctctatttctttttttaaattctcactatgaattgaattcacatgaatcatttaaaactttgtaatgaagtcagacagcatgtacccttttgtgaaaactttattccaatcaacataatgcttctgagatttatccatgttgtatgaatcaatagttcattccttttcatagctgagtagtattccattgcatggacatacaagagcttctttacacattttcttccagagggacacctgagatttttatagagttcagctattatgataaagctgctagtaacatccttgtacaagtcctttttggacatctactttcattcctcctgagcaaatacctaagaatgaattactgggacatacgttagatgtatgtttcattttataaaaaactgccagatatttttacagagtaattgtataatttatactcccagtaacaatgtgtgagaattctagatgtttcacatctatgccaatatttgattctttcagtttttaaacttttggctattgcagtctccctcttctgtttccaaataaatgcgcttattcaaaaattctgatttgtataagtatgggtgattcttattttttcttgtgccttttcagtaagtttaattttgtaaaagcatttttagcaataaattcagcattttacaaaattaaaaaataaatttagctaaaaaacgttatataaatacttgtcaatgttgtgtaaatgattacagtacttgtagcttgcgatataatttcagggacttctttacattaaaatgcaaatatactgtatcccaaaccaacttgagtaaagataatggtttcagggaaatgtgttggatgatgaaagaaataatctgaactatgatgaagaaactaaaagagaagagtcatgtgagatatttgaatatttatgctttttaaattaaacacagtttttccgaagtaatagtatgtaatatgaggtttttaacattattgttaactaatttaattattattattagatacagtctttttcatctacatgtttaaaatttcactaatttaaattggccaaaacttttaagataatgtttgcattggtaaaatttggttatgtatattagttttaaaattcatttaaaccctttaatagtaactacaacaacataaaattattatattcaatgaataattgacaaaataatacgtttaaaatacatgtagataacttagcatgacaatctttgatctggacgttgatcctaggagtatatgattctcccataattacacaatgaatgtaacactgggactaaaaatcagtccttctcctgccttctagactagcatttgatccatttattatacaggcactcctcagagaaatttcaggtttagtttcagagcactgcaacaaaatgaatatcacgataatgtgagtcacacagattttttggtttcccagtgcatataaaacttatgtttgcattatcgtgtagtctattaagcagtgattgcattatgtttaaaaatatatataccttaatttaaaatacttaattgctaaaaaatactaatgactacgtgaaccttcagtgaatcctaatctttttctagtggagggtcttgcctcaatgttgatggctgctggctattcaggctggagggtgctgaagatatgggtggttgcagcaaattctctctctctctctccttttagagatagtcttgttgtttttgccaaggctgaacttgaactccggggctcaagtgattctcccacctcagtctcccaagtagctgggacttcaggcacacaacaccatgcccagtttggctgtggcaatttcttaagaagatggcaatgaagttttctgcatcaattgactcttccttttacaaaagacttatctgtagcatgtaatgctgtttgatagcattttacccacaaaacatttcaaaatttgagtaagttctctcaaaccctgccaactgctttatcaactaagtttatgttacattcaaaatcttttttaaaattcagtgttcacaacctactcattagaagtagatttcatctaaagaaaccactttctttgttcatccataagaagcaactccttatttggtttaagttttaccatgtgattgcagcaattcagtcacatctgtaagtaagctctacttttaattctagttatcttgctctttccaccacatctgcagtttcctcctccaccaaagccttgaacccctcaaagtcatccttgagggttggaatcaacttttccaaactcctgttagtgttgatattttgacctcctctcatgaatcacaaatgttcttaatggcatctagaataatgaatcttttccagaatgtccagtttactttgcccagctccatcagaataattatgtctatggtagctatagacttatgaaatgtatttcttaaataataaaacttaaaagttgaaattacctcttgattgataggttgcagaatgaatgttgtgttagcaggcaggaaaacaatattcatttacttacacaattccgtcagagttcttgggtgaccagatgcattgtcaatgagcagtagtattttgaaaggagtcttttttctgagtagttgatctcaacagtgggcttcaaatattcattatagaatgctataaaaagatatgttgtcatctaggcttggttgttccatttatagagcacaggcagagtagatttagcataattgttcagggccctagaatttttgggatggtaaaggagtagtggcttcaacttaatgtcaccagctgcatgtcacagtcagctgacctgcatgtcaccatcacgagctgtatgtcatcatcaacctctcctttgaaactttgaaaccaggaattgacttcttctctcttttagctataaaagtactagatggcatcttcttacaatagaatgctgtttcatctacattgaaaatctgtttagtgtaaccacctttatcaatgacctcagctagtgttctggataacttgatgcaacttctatatcagcacttgctgtttcaccttgcactttatgttatagatatgtcttctatctttaaacctcatgaaccaaactctgctagctctcagcttttcatctggagcttcctcaccctctcttaactttcatgaaattgaacagaaatagggccttgttctggattaggtttcatttaagagaatgttgtggctggtttcatctatccagaccagtaaaactttctcagtatagcaatgaggctgttttgcttacttagtgtgttcactggaatagcacttttaaatttctacaagaactgttcctttgcattcacaacttggcttactatttggtgtaaaaggcgtagtattcagcatatttcatctttcaacgagccttccttactcaggttaatcatttctagctgttgattcaaagtaagagacacatgactcttcctttgacttgaacacttagaggatattttagagctattaattggcctaattttaacattgttgtgtttcagggagtagaaaggcctgaggacagggagagagatggggaaacagccattgaatagggcagtccaaacacacacaacatttaccaattaagttcattatcttatatgtgcatagtttgcggtgcccaaaacaattacatcaatggtaacatcaatgatcactgatcacagatcacaacagatataataataatgaaaaagtttgaaatattgtgagaattaccaaaatgtgacacagaaacacaaagtgagcacatgctgttggaaaaatggtgctgatagacttgctagatgcaaagttgcacgaatctttgatgtataaaaaatgccatatctgtgaagcactgaaaagcaaagcacagtaaaacaagatatgcttgtattgtgttgcctagaaggaggtctagtttaagctcagacatccaagcaagaacaacctttactttaaagaagcatgaaaatcactcccccatggtcactgtgtatgaattgtgactaagaaagtcacactaataagcactcagaaaaaaagcagacatggcaagcatttgatgacttttaggacattaaaaaaaatgattggccctgaaaatgcaatttgtaaagtttctaattctttcaagttcataagcaaagtgtaagaaaatatctcctgacagcacttgagtaatttgcttcaatcttatgaagtaatgtaaataagaaatggagaaagacaccatcccactcttacccccttattcttcaaaggcttcagaagaactggaattaatttaagttgcattagaaatattcacaaatgagtatgtctttcagatgtacaggcacacagtttaactttaggaattggggttggatgacagtttttagagatttatgtaagagtaggacagatatgggaaaaactcttctttctagtaataatcagccaccctctccaaactgtctccattattaagttctataagtgattgtcatcatgtccagagcaaagataaatgaaaattaagggtaggtatatattgttatttatataaaataggaaaaatggcattttgtgtatgggaggctcataaacattaaaaaacattcaagggcttttctggtcccatttttctcacaatgtctcaaatctattaataattatatgtaaccatgttttcttccactagaacccatcagttctgtgagaggatagctactatatgtaattgtctgaaaagaatactccaaatgtataaacatgcctttgttattcttgttacttgagtaaactatttgaaaatgcctattacattaaattcactgttacagaatacactgaaagaaatacgttgaaagtaccgtaagtgtaatatatatattagtcatatctatatcaaggagcctgagcacacagtatatattttttggctttgtttttttcagtggttgcaaatgatggattttatgtaatactgaaaggcctagctcgacctcaaacaaacgtgtataaaaatctgattgaaggaagtgattcaccagactcgttcatatctcagagtttccacagcttcatttggagtgaagaattcaaaaactctacacttgctgagatgtacctaccttcatatgactcaatggtaagagatgagtatttgctttttccacaagcaacaaggtaacgggcttttgtaaaactttatctcttccagacattaagatccaatatctttagagtcctgaaatatttacgataatatagcctttaaaatataaatgatattattaatacttacatttgattaaacatttttgataaaggatgccttcaacagcatctgaccactggcagggtttgtgtggtgtatttggtaacagacaaggttgatgtggctggatccctgaaagaaggataatagtagtttcagataagtgagagggaataggtgatttgaggagggagagacaggaagactaattgattatgaaagacctttaaatcaagtcaagaatgtatgtttattatgtttgtctcaagagcaatgctaagatagtcaagtagttaattacattacaatcagaaattcttaattgaggaaaatcttttgcatctatataatatttcaagactattagctggtcaaaaattaaaagttccatatctttccgaatctctggatactccacatgggatagaggtctgaattgactagaattgtggctgatagtcagttctcaatttagggtgatcaagatgttcagagtagaaaagagtcaaagaaccaattaaaaccaaataatttagcattatggggtacaatcagaaaaatccagaactaatatcatattcaagagaaataagcatggatcatatccagaaagaatgacaaggataaaaatgaacaagcctataaaagtatattattcatctcacatgaatgaatgatgtttctgattgtcttcttgttagggatggaaaacaatgcatttgccatgtcagtgaccacatataatggacctaatgctattttagtctgctctagcaaatatgccacgtttagcacaacagctgtaattagggcttcaaagaccgattttttttttttaatgttcaaactcatgtattaaatggggatatgatgggaatcaccagatctgcattctgctttaggtctttaggagcagtactaatttctggcattccacctgagatgtgatatggttttcaatttcctatcttggccagagtgggggaaagggtagagagaagtttcagaggcttccacttaatctttactgtgatagctcttactgcacaggccaagaaaccaatgtggaaactctacccactaccaagtatccatttaaattttgcttttagggaccatggatattgcccatggggtaggcttatggacccagtgaagccactgggaaacagacccaaaccaaaactttactttttaggaattctgcctgtttattctctgtaacaggtgaccatgatgacattttgtgtatcaaggctttaatgtcactatctcaaattttacagctccacttctccatcagggccctagccttagcataaaataataataaaaaaatacttgcagaggttgagactgctatagcagagctccagagaagataaatatgaatatatttatatctatgtgcatatctatctctctatcatgtatgtatctgtctacctacctacctaccaattatctacctacctaccggcctatttatataccaagtcagattctcagatttttctgccctctaactgttgaaaatgagattttctttatgtgctgccaaagaaccctgggattagatcattcatcttaaatgggtgattaattttcctcttccttttattgtattcctttagtgcactgagagctcccagcagcaatcatcctatgccatggtccttataaatactcattctacaatatctcagacgtctgagatattgtaccttccagtacattcccttctactagtacctaatgcctgcttaacatcattaaaattttatcagtggtactgatacaactggtcagagactaccagtactccagtgatggatttgtattgctagctggctggcaggcagttaagctctaaatccagtattttttctagtttaataaaattttttgaaaaaatgaaaagatagaaatcaaggcagacaattttaacttgcagcaactctgtggtttttgttgttgtttaagtttgcagaaggacaagtatatgattactgataaacttatttcacattgctaaaaatttaaagtatccttgctaaccctgtcccctgtagaaattatgagtttagctggtgttatgaaacatgctgctctttccctattttaaaaatttgcctttttgtgtatttacttagtgggcctttttcaaataaaaatattactatttccaaagatttgtgtctaggagagttttgtagttttgcacacataaagggctatatttttctttctcccttttttggctttataaaaaaacattatttgcttttttattgagtttcaacagagaaccgaacaactaagaagaagaaaaaagttataacattttcactcttcaatttcaccctccaacagtttggtaaactaatgggcatcatttgagtataacaaacataaggtgaaaaacatctaatccaaggatcaaatttatttctcatgagataatgtatagttgtgaataaaaattgttaaagctccaagcatctgctgttctaactctttactacaccctggacgaaaaataagtgcagtataaatgtacagtgaaacaattttttttttgcttttctcaacatagatttacacattgaagctgaaagctttttcattagagttgattatataaggaaagagataaaaaattacacatttatttacaagatcaccaacttaatgcttctaagtagctttaaaatctttcattaattttatttttccaattagtcttacaacttttaaaattataataataaattcaaatttcttagagacatctcagcataaatatagtatggtctgtgccaaaacacacacacacacacacacacacacacacacacacacagacacaaacatgcacttctatatttcatatttatatacttctatattcaacatatattactatctgcagttaaacatattttactaaaatctatttttgctatgattaaatttagcaaaattataaaagcaaattattaagttgaagattctcaataattattaaaagaactttctagtttgttaaagtagttttctttgaaatacatttggaattatgtggaaaaaactgataaaaatatattaatatattcaacaggcagggcccagtgagggtaaattataaaatagtaatttttttttacaccaaagttttcaaacaagtggtgtagtattactcttccatgatacctggatcttagcacctcaatcagatcctaggtattaatgaataacctcactctttttggtcttacaaattccagtcctgtctttatatcaaattttcaaactttcatgcttgatactcagcttatgccttattgtgccatagaatccagcagtgggaagaatagtttaaattggtctattcccctttcttactttgcatactcttttactcactagcttggttttctggctctttccagtcaggaaaggaaggaggctgggaattaaaggcaaaatggtaatgggaccttatgtgattggatgtccaaatataggctcgttttctcagggtgtttcccctcctgcagttccctggagctggtgttgcctcctagagggctttttaataccgtacccttgatccctggcttcaggcagtgaccacttgaatcgctttttagggtcaaaattcatctctccaggaggttctccagggttgttcccttttcgtacagtttagctggatactttttgtgggtccccccagttgatgggctagggaaagtttcaagtttactccactaaattgctgtgtcctcactctgagcccagaggtcactgggagtggaggaaaaagaaaacttcaggactctaaaaattgtcatgaagcaggtatctttcaatctttgctgccaacttcctgatctcatttctcaagaggatcttgaatttacagttgaaggagtttgtactcatttgagacagtagttgaaattatggactttgaatcttatacttaaaatagcattgggcacaaaaatctgtatttggaagatttttttttttttttttttttttgaggagtctcgctctgtcgcccaggctggagtgcagtggcgcgatctcggctcactgcaagctctgcctcccgggttcacgtcattctcctgcttcagcctccccagtagctgggactacaggggcctgccaccacgcctggctaattttttttgtatttttagtagagacggggtttcaccgtgttagccaggatcgtcttgatctcctgacctcgtgatccacccgcctcggcctcccaaagtgctgggattacaggcgtgagccactgcaccccgcccatggaagatttttgaatggataacaatgaaagtgtctagcagggtgtcacatactaacgcaggaaaaataattataggttcactgctttggtctaggagtgagattacaaaggcagggaatacacagtgattaaattcttagtttgtgcctatgtaaaaaaatagtttaagtaataggatatcaatacctattaaaaaaacaaaatgatacttatttgtgatcattttggaagctataataataccatttattttcttggtaagataagaaaaggcaatggttctacctctctttgtaagtgtataagttggggaaccagagataataagcatatgtagagaatgtaaataaaaaataaaattctaagcccccagccaactgaatagacccctcgtcttagccaagaacattacaaagttaacctgaaaaactagttgaggacataattgccaggggggtcagacattcctcattataccctcttgcttttggtattcaggcacaactgaccagcattaatgttaaaacagagaccttaagactgacaaaacactctttgtagccataaaatgccaacatgacagatggcaggccctggaagatattgaagtattttaccccaaaatatatttctttgacatattttgaaatggccctgaaaagctgtctcttgtggggaaaatcaatattctatagaaaatcgccttccctttccaggtctttttcctgatacaagagaaaattagctaagaatctggcacctttttaagtctgatatgaaacatttacaatctattatgtctgaagcctgctacctggaggcttcatctgcataataagaactttggtagccacaaccctttatattaatgcagatcctttatattaattaaccctttatattaattaaccctcttctattgattcagggtctttagataatagcttaactctttcaactaattgccactcagaatgtctgtgaatccacctatgacttagaaggcccctcttcaagttgtcccacctttccagatagaaccaatgcacatcttacatgtaatgattgaggttttatgcctccttaaaatgtataacaccaagctgtagttcaaccaccttgggcacatgttcttaagacctcttgagactttgccttgtgccacagtcatttatatttggctcagaataaatcacttcaaatatctcagagtttaacttttttcatagacaataatttaattgcttatggcataaacttaattgttgatatttatattcttaatgggaataaatcccaactcaaaaatattctttattttcttgtatcaattactagctagtctgtcaataacaaaacctctgaaaaaggacagggtggagggaggaaatgtggtaaaatcaacctgctgccagtatgtatatttccttaatttacagtaaagttattttgaacaaattaatcactaaaccatcaaatcctaacttttccatttcccaaatacaaaatatttctaacctgtgttatcagcacaacctgtattattcaagctgaggataatgaagccatgagtattttatgcatactgcccagtacatctgaggttttatcagatatctagagaaaattcagaaggcattgataaatggtggatccaactaaagaaagaatatctcatttcgtaaagcagttgaatagcaatttcatcttcagatcctggataaaactcaaccaatttgtttcaaacaagaacatattccaattaattgtaagttctgcatcaagtgactattgggatatcttggaagagtaaaggcaaagtcatgtttgataaggacaaggaatttaagctatttgattttgctgcctccagatttctgataatgggtgctgcctgaccttctgagtacgccattccctgcggtcagtgctccatattcttttacttgtctcttcattatccaacattcttcacagattcattcctggtatggtcttaccctggttccctaaatcttttacctcatttattcatgggcatttttgaaagtggtgttttatagagcatatttttaatatgcaacacaactactataaaaaacaaaatgaacggcaactagaaaaataagttttcaatttaagaaacacatctaaattattcgtgacacaaaacaggagtcacaataaaaaatcaaaactatttcaattaaacaaaaatacataaatgtcacatatcaaaacaaaaataccatgaatcaaaacttgtaatatatatatgcagtgaaaaaagacacagaatgtgatttgctgtttagtattgatctatgtgtgactggagtataaagtttatgttttgtttttttaattaaaaaaaattttgtataaatttatggggaatatgagccctgaaaatttgagacaggtctcagttaatttagaaagtttattttgccaaagttaaacatgcgcacccatgaacagcctcaggtggtcctgatgatatctgcccagggtgttcagggcacaccttggttttacacattttagggagagatgagacatcaatcaacatatgtaagaagtacattggtcccatccagaaaggcggggacaacctgaagtagggagggggcttccaggtcactggtaggtgagggacaaatggctgcatttctttcgagtttctgataaacctttccaaaggtgacaatcagctatgcatctatctcaatgagcagaaggataactttgaatagaataggaggcaggttggccctgagaagttgccagcttgactttttcctttagcttagtaattctggagctccaagactttcttttcacagacccatatgcaattttgttataagtatataattgagagtgatcaagtcagggcatttagggtgtctatctcctgagtataatacatttttgtttaacaatatcgtcctccttgcttatcaaatgttgaatttatcccttttaagtaactgtatttttataccctttaacccagttctcttcatctgcccctcctccacttactcatagacatttaaatggttctttgctacttctagatgtcccctgactcatatcccaacccccagtgttaagatggcttcctttaagtcagggatcttatttttctctaatgcgtagtataagtatgctaggagcttttaaggtgttcaataagaataaattaaattaaatccagttaaatttaattagacagagacttcaaaatgtcaaagatgaactgtgaaatgagttttgattcaactaaattgcaactgatagaggatttaatctatattgattaaagttcagttttattacatttattttatctaaactgatgtttaaaatatatgtgattgctttattcttaaaataaaatgtaaacattagaatattcaaatgttcaaaactaaaatgtcaatcaggaaatatttttactataataatggaattggaacttaacatctaattgtctctccgatcatcgaaacatttaatacagatagcttgtaatatatttataacatgaagctatttcttaatcatcacaacatgtagttgccttttgttttcatcaagagttaaaatgtgtgctgtaactaaaaacaaacattgggtcatagtaaatttactactgtttaaacataaattagagaaaaagtaaaaattatactttgtgtaaaatttttacaactcttgtattataagagcaataaaagagatatgtttattggtacatagtaagtctgtttaccaacgcttttttaataacatcataaaataagaggacttcacatataaacattaactccgatatttcatttcagaaacatacacttaaatacaattgaagcttttgtttctttacatcttcccatttttttaatataactgtttcttattttactacatttatgaagacatcaaaatataatcaagcttgctgttgtttatctcatgatattaagtattgtatttggagattaaataatttcaactttatgtaagattaaaaaaaagtgttatatttgaaggtaggaaaataagtatagtttctggtttatggatgtttgcatgccttctgtgaagcgcctgatattgtgtactcgttttacttttgttttctttgtctttttacctattaatttataagacttttgattatagtagtgatataattttttaatatacgtgttgcaaatatgatttttaaatatattgttgatattctcactttatcattcttttattattatggatatattgtttttttctttattgatgtttgctttcccattattagcagtatttatgataagaaaactagtaataattgagtacatactatatgcccatttcatttaaagtacagcaggttcttggactaatatctcatatccattggtttattttactttagtgcctattttatcttcataaaattttccagaactactgccttaagccgattgttttcagttttggtgtttttttgtaattgccttgggattctttactcctttaatttttaaatttttctgacaaacacaaaatgatgaaaagatgaggcaagcctggtctataatttttactctggcaaacctgttctgtaatttttccattacttctggaaaaagcttatttatattcatttcccatgtcataatttccattatctctttctgtcattaattagactgggaatgagaagcttttgggtttgcaaaaccccaaatggatgatgccaataactatcagaattgttgacaacaacataagctttgagtatagtctgcaacttttaaatatagattttatttcttctcgagactgaaaaccatttcatgaaagttggttagagaatttggtcttaatctctgtatcagttaagagagttttggttttatgttatctaaattactgctaatgacttaaacaataagaatattttttatctcacagaaagtctttgagatagatgactttagggattaatttagaaccacaacaaaattacctggacacagaggctcccctgtctttccatcctgtcccttttagaatgctgaatttcttcctcagatttgcacctcaattgttagcactcttccaggcatgggagagcagcactccccaacctttttgtcaccagagatcagtgttgtagaagacaatttttccacggactaggggtgggggatggttttgggatgatttaagagcattacacttattgtgaaccttatttctattattattatattgtaatatataatgaaataattatacaactcatcataatgtagaacctatgggagccctgagcttgttttcctggaactagacggtcccatctgggggcaactggagacagtgacacccgaattatgttgcctatgtccagtctactccataatctcgttttggttactgtcactacagaaaactctgcttcacaaaggtaggatattggaaacaggagcaggcttttcagtgcttttgtggcaatctcaggataatctccaccttgactttaatccagaacatatggggatttgaagttgtctcaaacatacttttaaggccaccatcatttgtgatctcaagcagttgattcgcttctagcacggacaaagtccattcatctggcttactctcaaatgagttgcagatccattccttcccagttaagggctcttttctggtttggaagtaatgctccaactcttttgaaagctgagagaggtgatcacgcaccagctctgagtaagacggccctggctgtgtctctttcaaaatctttactaatatttgaaacatgtcagaaatcccaatgttcactcattgccccataattccagtttggctttgaatgcaattactttatctgatgacttgaacacagttgtcagtctcccctggagtgacagattaaattccttgaccatgttgaatgtgtcacacaagtaagcaagttttgcgatccattctgcgtcactgaaatatgctgccaggggtgattttttttctataagaaatctctggagtggctctcataactcaaaaactctggccagtgatctacctttagaaagccctctcatttctgtatgtaagagaagacgtgtttgctctgcatccatttcctcatagagttacgtgaacagatgtgagttaagggcatttaatgcggttgatacttttaatcacatcctgcaaaatgtttttaagttcaggtgacatttttcagttgttaagttcaggtgaaatggcatttttcagctagccacaatttctgtatgggtgacacggtgcatggactcacattcagaagtgacctcattgacctgagtggtgaaaccagaaagctgtccagtcatggaagccacttcatccatgcatacttacacaaaatgaccaattttcctgatgtgtaatcattcaaagactttaattgttctgcagctgtggtgttgttggttggccaaaaaattgcccataacatattctcatgcacatcctcctgaaaaatatatcacacaaaaccaagaattgttgccttgttgtcaacattggtagactcatcaatctgggttgtgtaccatggtgactcattaatcctctctagcaattgtgcctcaatatcttctgctatttcatcaattcatctggttatagtgctagctgaaaaaggaacttatgccaccttttaaactgcagcctctcctaaaagttcacaatggatgtttttagtagcaggtaggatcaaccttcaccagtagtaaaagacttcctagctttagcaatgcagttagccactaagaatgatgctgtcagtgcagacacatttgataaagtggtggccttcaataattgcttctattctttgtgttcacatttttttcttttgaaaaactgcagaggcttgtcttttaatacagggcgcttgatcgccatgtggagaagcagctttgaaggtctcatggcttcgttggatagcctgttgccacatattatataaagcaggattggagaatgtgaatcacctgttgcagtgaatctgcaatttaagtaggattcttggtattttcttttaaatacaactttcttttgttggcagtcacagagtcttttgatgtcccctcattgggtctttcccccttttcaaagaaatcttccagtgacatttggtttttactcattttggctatggttagcttgtgggcttaccaaaactgtgactgagacaagtacacagtgcaggaaagaggcgtgaacagaagtggtaaataaaataatgagagggccacgtatggactaaactaagtgtcagattctgacttaaagcctgccaccagatgcaactatacaattgaagtatatcaactcactactataactcctgccaccagatgcagcttgtcacttgccactcactgatagggttttgttatgagtctgcaagcaattgatttattatggtctctgtgcagtcaaacctctctgctaatgtgaatctgtatttgcagctgctccccagtactagcatcactgcctcagctccacgtcagatcatcaggcattagattctcataaggagcacacaacctagatccctcccatgcacagttcacaatagggttcatgctcctataagaatctagtgacactactgatctgacaggaggcagacctcaggaggtaatacaagttatggggaatggctgtaaacatagatgaagcttttcctgcttgcccattgcttgtgctgtgtggcctgattcttaacaggccacagagcagtataaatctgtggcccaggagtcagggacccttagggtagaggatgcttcttcatcatgtttttacccctttatctgtggagaaaacatttccacaaaatgcacagaaggcacagactcccatttccatcccattggctagactaggttataggtctatctttcaaccgcaaattgataaaagtgaatataatcaccattattagtttaaagcaatcaattaagattcagtcccaagaactaggttcatgatctatgtgcactttgcagcctaattcctaaccaaatcaggcttctgttagcaagcaaaacaggagtgaagtgctattgagcagatgaatatgtttctgatgcaaaattctcaggagttagtttgacagtatgcaagataacttaatcatccagtagattagaaaggctcattataaaaacaggacccttgaacttaaatataaaacttcaaactgttagaagaaatcattggagaaactctttgggacattggcctgaacaaagatttcttgagtaataccccaaaagcacaggcaaccaaagcataaatagagaaatgggatcacatcaagctaaaaagtttctgcccagcaaatgaaacatcaacaaagtggagagacaacccaccaaatgggagaaaatatttgcaaaccacccattttaaaagggattaataaccagaatttataaggagctcaaacaactcaatagcaaaaaatgaaataatccaattacaaaatggacaaaggatctgaatagccatttctcgaaacaaggcatactaatggccaacagatatatgaaagaatgctcaacataattaatcatcaaagaaatgcaaatcaaaactccaacgatatgttatctcactccaattaaaatggctgttatccaagacaggtaatcacaaatgttggccaggatatggaaaaaggggaactcttgtacactgttggttggaatgcaaattagtataggcactatggagaacagtatgggagttcctcaaaaatataaaaacagaactaccatgtgatccagaaatctcactacagagtatatatccaaaaggaatgaaatcagtatatcaaagatacatccgcactcccatgtttattgcagcactattcacaatagccaagatatgggagcaacatgagtgtccatcaaccattgaatgaataaagaaatgtggtatatgtacataatgggatattatttagccataaaaagaatgaaatcctatcatttacaacaacatagattgaactggaggacattatatcaagtgaaataagccaggcacagaaagagaaatattgcgtgttagcactcaaatgtgggagcttaagaaaaaaaactgaactcatggagatagtgagtggaatgatgtttgtcagaggcagagaaagatagcagggattgggggataaagtgagatggctaatgggtacaaaactacaatgggatagaggaagtaagatgttgtatttggtggcacaatagggtgactataatcaataatagtttattgcatattttcaaataaccaaaagaatggaattgcaatgttcctaacacaaagaaacaataaaagcttgaggtgatagataccccaattacccttatttgatctctgtacattgtattcctatatcaaaacatcacatgtaccccataaatatatattactgttatgtacccttaataattaaaaaattaaaattaaataaaaattataaattataaatacaggacccttgagatcattagtaaaatttcagagccctagtttttgtgatgttttagggccctagttcttcctaacgttctgaatgttggacatgactgttagtaatacaacagtctttcttagaaattggattgaggcctgggtgcattggcttatgcctgtaatcccagcactttgggaggccaaggcaggtggattgcctcaggtcaggagcttgagaccagtctggccaatatagtgaaaccccatctctactaaaaatacaaaaaattagctgggcatggtggccggcacctgtaatcccagctacttgacaggttgaggcaggagaatcacttgaacccgggaggcagaggttgcagtgagccaagattgcgccattgcactccagcctgtacaacaagagcgaaactctgtctcaaaaaagaaaaaaaaaaaaaaagaacaaaaattggattgactacttttgtctaggtaccatttaggatttattccttccaaatgctatggtaccattcagagtcacatgaccataaatatatttcatcacgctatttttctaattgtattctttagtcattttagggccacaatgggcaataggaagtttaggtaaaacatttcattcttcttacactggctgggtctcagacactcatctcttatatgaataattcttctgtatttatctttttaaaaaaatacatgtatacttctaagcaaactttctttgaagaaagtattttttttttctgagatgatgcttataggtagatttgaaacccatcattgtggaatccatcttgattactatatctgatgggcagactcatctattcccacataaattgataagaatttgagtgtttttgaagaaacaacaaacatataaaaacatttaaattagacttagtccctggtgacccttctgacattcatttctatttttccattctgttataatcagaattatattcattattatgataaatatggttcaacagtggtccaagatatactaaatcttacatcagaaaaaggaaaaggcttttccatttttaggtttacttaaatgagaagcaaagtgcactttcccttcatatctaagtatataaaatttgttgacaattgaatatcaaacaatgataattgactctcaatattttcctattgcagtgagagttttaatattattcaaaatcaattacgtttttattccaataattatttttacatgaagaaagacaatttcatatctacactctgtaaacttctttataatcagaggagcaattagttattttacttagagaataaattaattaaaacacataatttatttttccactggtattttagtatggttaacttaaccttaaggaagcacttgagctgtaaactgacggctctgctgagaactgggaaagcaaaaatgaatgcaaccttgatcctgttttcaaatttaaaatctagtatatattgttagtaaagttctgatagatgtcatggggaatccaaaactcagagggattttttcttgcctctaaagagtttacagtctggttgggggcttaaaacatgaaaacatacacagtaagtggcaagatgagttagtctcaattaaagtgctaaattacagggacagatgctacaggatgtcaggggtgggatgagctgcgtggccaaatatgcctactgagaatggggagcttgtgatgcactgtaaaggaaaagtagggcttgactaagtagaaaggagagagggcacatacgtttactgcaaagaatcacgttttaaacaatgatttagaaatgagtaaatgcctggtatgtgaaaagtttgggaaattcagtggacaatgaataataggcaggtctagagagaaaggagagaagagaaagaaagcagaggtcagactacgtcagattcctaagggtagtttaaaaaataagctaaaacagccaagccagtggaaagtttgaatatattctctttttccctttactcacttatcagggccactccccacccttctctcccttgccctttaccccaagactggcccggaggattacgtctaagggctcttctgccttctggcttgcagttagagtcagcccggggagagagggagcaggagaccagaaagaagtaacagagtggagatcatagtgtttcttccctggcatcctctgcagaattgctggctgaatctaagtctgaaggttgcagctcctgtcagatggccctgtccacacagccctctgggtcgtgaggtctagaaagcacgtccacctttcattatttaggcctgcaggaggtgcctgtgccctgcccttagccccaggatattccatctgatttgcctacaaccttaataggtagtttcttcattcgttctcatagtacccaagtgccatgtggtatctcttttctggtaggttcctgactggtagagagggaaataatgaaggaattgttttaagaaggttaatattgtggccgaaatagatagattgacaaactagaactagggagaaaattaaccaacagaaatgagcatttaagtgccaaatcaaggtaaagaaagtacagttgccattgggagattgattagtgaccaaaagtgatgaacaacaaaaacaacaacaaaacattaaacataaactaaatagtcatgaggatttcaagaatataagaattggacgggaattggaatttagttacataaaaaatcaacacgtataggatgaaatttgagtcactagtaaaattctagtatcatacacaaagtagaggataaagatctctaaattagaggagagaaaaagaattttagattgcaagttttagattacattcctatgttcatggagtaatgtctagtagaactttgagatgtgactggcattacagaaataggtcagaaatggagaacagtttaggaatattccaaatagtagtgacaccatgtcatcagagttgatgagttctcaggcaacgcagccacctaaagtgaagaacagagacctgaggacgaaatccttggaaaagactcccactaagcaagcctgagaataaaaagaaggcagtaagaggaactgagaaaaaaattccagagagatagttggaaaaggactcatagggtaacaattaataaagaggctatttcagtgctgtgtagcttatcatgtggttcaatcaaagcatttctgtttaatagtcaataatttgtgatataatttttgtcatgataagtattataacatgattaaaataggaaaaggaatattatttctttggatggcccaacacatccaagtggtatcaactgctcttccctctctgggttttggtttcaatgtagaggattctcatcaactgaatattcttctcagtatagatatgcatgtagagggatggtgctaatgacttcactgtaacaaagatatggataatttggaaccctcattcattattgttttgcaagttcttctggaggaaataagtcaggtggggattttcacgtatcacctgttcaagcaatatgtgaagtgcaatagcacccagatccctcccatccttaacagacactggaccttttaaaactatttttcagcactccttttatttagcgttaggtcagttccttgcttttactctgttttgaggctactgtaatagaaaatggggcaagaagaatgtcattgaaatatttagcttgctaaattaaaaagaaagtaaaagcaaaatacttttttttcctggttatatttcagtgactagttttaattaaaaactctattcactgattttttttaaaaaagatttttactacctgatctttatgcattcagtatggcctatgtgcgaaagaaggggtttgattatagaacataatgatgtaatgatattctgtagaggacaagtctgtctacatgcaaaattacttaatgcaaggttacttaagaccctttgcatttcagttggattatgtcatctaccttatggatttgcaaaaaaaagtcgacagagacaacttgtggaaacttgtggaatcaagggacaattggtgttcagggaagggagtggcatggaagattgagaaagaaccacaggaaacaagatgtagagggtccagtaaataaactctctgcatgtaaaaaaatgtactgagtagttataatttatacttactgttaatagcctgataaaatgatacctgtgcaagaaagtagagctaaggtgtaaaaagagaagaaatgattatagttttttgagaaaagagatcagagaaataacaatataacaatttaacatatacctgccatttaatatatagatttgataatcttaaatatttgaaaaatctatataaatataatcaggtttttaaaaaaatactaaaaataaatatctgttgttataattttttagcatttaatacaaatcttttcctcagtcattctgtatgtgactctaagctcacacagttaacaaaggacaggaattgagtcagctgacacattagagccaaactgcctaacttccaacattgaccctaccagttaccatctgtgtggccttaagaatgtgccttagccttctgggtctcatttttcttattttttaaaatgactattttaacaaactacttcatagggtaattatgagaattcagtgagtcttgagcatggtgcttaataggaagcatattatgccttaaataaaataagacaaaaaagactgatgttgcaagattcatatatatatataaaatactcatatgatttgcagctacaaatatatatatatatatatatatatatatatatatatatatatatttttttttttttttttttttttttgagacagggtctcactctgtcacccaggctggagtgcaatggtatgatctcagctcactgcaacctctacctcctgggttcaagcgattctcctgcctcagcctccccagtggctgggattacaggcacacaccatcatgcccagctaatttttgtatttttagtagagatggtgtttcctcatgttggccagggtggtcttgagctcctggcctcagtgatccacccatctcagcctcccagagtgctggtattacaggtatgagccactgtgcctggcccaaaaatatacttttaaattaagagaactgtactcatatcaaggggaaaaaataattatttgaagttacattattttttagaatgtatgtaagtattgaatccaggtgtcctggttggctctcctattgcctagctatgggaacctgagcagtgaagagcttcactcgtcccaggttgctgtgaagactgatacagatgaagtgcctggcagcagaaggtgttccacaattgccagtagtttatttcttcttcaacaaatccatccctctctaccctcttgggccatgaattctgagtatcaaaattctctctccccatatctaaagatcagtgatttgggggaaatttgtttttaatttgattctatacagcactttttttctttgggaaatgctgttcacatcaaggatgtcatcttttcttgggagaaaccatcctggttagttttcccttaaggtttacaatggatatacagttccaagagtataaagagatctttgtcagttgtgagattatgaatccaaggttcaaggttctgaagttttgctgtagtgtgaatggcaaggacagtctttctatgatgttctcataagatccaatcttcgggttctagattgtgaaggggttgtcctcagtgaaccacaaaaagctttctttacctggtgaaaatatactgtaacataataatctactgttataacatcaacactcttgcatgggaaagcttttatacaatcagaaaacattcattgaaaatgacaattgggctgggcatggtggctcatgcctgtaatcccagcgctttgggagactgaggtgggtggatcacctgaggtcaggagtttgagaccagcctggccaacatggtgaaacctgtctctactaaaaataaaaaaaattagccagtgtggtagcaggcacctgtaataccagccactggggaggctgagacaggagaatcgcttgaatccaggagatggaggttgcagtcagctgagattgtgccattacactccaacctgggcaacaagagcaaaactctatcgcaaaaaaaaaaaaaaaaggaaatgacaattgaatgaaatttctttataaatgtttatgtggccaatcaggtagccaaatgtacctgaagctttgattgtcttcctgggaatatggaaccacacattggttttaaactatttctgcaatttataagtcacctcatcaatatattcaaattggatcattttatattttccatgataagtcatggaatgcagaacctttaatagcagaagctttaaggactcaggaaggacaaggcagccatcctggttctccgtgagtccatgcttaacattggatttatgtcctcttgaataccagttgattctccaatttaggtatatagcactgataactaaggggttatcacaggtaatttgacttagactgtggagttcaaattgtacacctaaacaatttcagtatcagctggtttaacatgaatatctggaaaagtattttcttggtatttaattaatttttgttctacttgggttagcatttttatacaaggaaatttggttacttctatggtgtacaataacataataacgttaattatgattgacagcatatactcagacatattagaattttagaaatcccatacaattttgaaacatatcttaatatcattcactaaaatataacctgaagattaaacattatttttatgttgacaatgcttcccatgtaacttaacttgttaaagaattctgtttacctgtctttgggatgctttaagtgccctctgtatcatcccaaagttagagatcagaaaagaccattttgaagcttaaatttgattttgggaggcctattaaatatgttaaatgtttaaaacacttgatattgtaaactagaattccaggttaccataaggcattcatttagccaaaatgatgactcaaaaattttttaaaaggcaaaaacctttactcattgataaagggaagacttagatttgcaagcagtctgtcttttgtctttcccttctttatttgtgtgtgtagtgtatttaaaaggcaaacaaaaatttttcttttttttatttcttttttttctttttaagatggagtctcactgtctggcacaggctggggtgcagtggtatgatctcgactcactgcaaccactgcaactcctaatctcaagtgatctgccctcctcagcctcccaaagtgctttacaggcatgaaccaccatgccaggccaaaatttttcattatcttttaatattacatgaaaatcttgttgaagagagaaagccaaatttcacccttgcactagtggactattaatgtcaaccccaattttcagtaaaccttgtatacaaatctatccaatcctaatcaatttgaccataaggtgagatttttataaaccttttataaccctttacaaatttttgttaaagagaaaacttgtgctttaagaaaaccctgttgtgcttttatttacatgtccaatttactgaaaaacaaataatatccctttagtgaatattttcacacagagtgttttcacaaggttaatttttatataccttccacaacttgtttaaacctttagtttatttaatttaaaacaatcctttaacctaaactaagcaaacatttacattctcataccttctaataatctcttaccaaaacacatttcattctccttacacaccttgtatgtaaacctattttttcagtagtctcaattacatgttatagtggtaatttttaacaattttcacttttggtgcataaattttcttttataaatcctttcacaacttatacaggctatctacgacatccttggactttctgacttgtcctaaacatccctctttttaaacaacccgtcactttaggacaagaatttaccatgaattatatgaattatcttttctttataactttctttgcatagcaaggaagcatggctaattccacatatccctaggccttatttagaatttaatgtctccaaaataaattgaacaattttcaaaagttaaagcagtttatgaccttaaagcatttagcaaacctaatatctgacctgcataagttagaccaaatgtttttattttactaataatctttaaagctgttcttatttcccaaaggttactaaagttacaactaaaagacattactgtttttatttcactttcaaaatatttgatttaagtgcttatttttgtttaagccaattaattagcacttttttatataaacattacatacacaacacatatgtaactacacagacagacagaacgagattactacaatagttgtaagatttttcatttgcctgtttttaagtttcttaattggttattggctttggggtggggtccttggaagaacagagccaggaaaggctctctggtgcctcctgtttttcctaaggagtccagactgtgagagtttgaataaccgcttttaattaagctgagttttaaccacaggactctttaataaagtccttttaaaatttagtattacctgactttagataggccaaatggctgatatttctcacttttgaactttacgaaaggtaaccttccaggtgctcggagaaaggaaaatttaagacagtccgtggacaagaagagaatcgacaaggatacacagacattaaaccagaaaagactcattttttaagctgagaatcaaacctcgactgccactgtgaaagggaaaaaatcttagctactgagctacagcacaggctggtctaaattgccattgccagttggagtctgtagtagttaattttgagattgcaaaggcttttaactactccagataatttttagagctaattacgacctgaaccctaaaattcctgtaccctggaaggcagagaccaagagaaagtacccccatgtggttacaaggttaagctctcaaagacataaaacaagatggagacctcatcagtttttttgtttatttcagggacctgcagcaaagtttgttagtgaccatcttgctgggtcatcttgagcagtgagcttatgggggcctaagcccgtattttttcctaaggtactcctggacacagaaaaacaaattcatagcacaaaatgcaccagatttattacagcttaagactagcctcagaattcttttttgcattaatcaaaactttacaggggagataaagtgatttttaccattcattccactgtttttgcacagggagagaaaagccagaaatctgactggtaagaaactcttacccttttgccaggatgccaggtttctgggttttctttccttgagcggccctagtgacccagctcaccataccatagccatggaggccaacccacaacacagaagaaaatctttttctttttttttcactgtgttgttgttcatttggaatgttctactataagttatctttagtaagattttgtcatttctgtaagactttactgcctcctaggcctaatgtataagccagaaggaactcagttttccaaaaattgaggatcccattttttatctaaaatattggctttactctcaggttctcttcattaacttagtcaatgatttttcctacctaagcatgcaagaaaaatgacacaaagggatagaacacaaaaatccctgtgaattttttaaagccaaattttataacccctgcaatactactgcttcctaccagtccctttctgacccagtcagaggtaagagacctctaactaaattcaagacagttaattcccaaatacaatttgttcccggacccagtccagtttctatcatgacttgcaaacccagtttggatgagaaatgtgctcaaagaaactcagagagctcaaaacacaaatctgtggagctccaaaatctgaaagggagcttacccacgatccccagctgctctgagagatcaatggacacaaatgggtcctgcaggtaccttgcgggttcagtgctcctgggggttgctagaagctttactttggatcccacttctgacaccatctgttagaagaaaaacttcagctgaattaaatttaatggagtttaattgagcaatgaaccattcatgaatcaagcagccccagaatcacagtggattcacagagactccagcccagccacatggtggaagaagttttatttatagacaaaaaaaaaaaaaaaaaagagaaatgacatacataaatcggcagtgaggtacagaaacaactggattggttacgggttggcatttgccttatttgaacagaatttgaacacttagcagtcaatgggtggttaaattatggccattgggattggccaagactccgttattgttacaggtgcctacttctaagttaggttttcagtcttgtctgactattaagctaggttacaattcatccacagggactcaaatatagtagtacagagtccttctcaggtcatatttagtttgctttaaccgtttctagtaagttccttattaaaatgcaacataggccaggtgcagtggctcacacctataatcccggcacttcgggaggctgaggcagggagattgcttgagctcaggagttcaagactagtctggccaacatggcaaaactctgtctttacaaaaaaaaaaaaaatacaaaaattagcctgacgtggtggtgcatgcctgtagtcccagctactttgagggctgaggaaggaggatcacttgaacccaggaagttggggctgcagtgagcctggatcatgccactgcattccagcctgggtgacagactgagaccctgtctaaaacacacaaacaaaacaaaacaaaaaacacaatataaataattgttgaacattatgtttttattagatgtcgaaatataaaaactagaagcagaatgttaaaaacataagattaagtttcaggataagctttcctcctttgatagaattactttctaattacaggtttctttttcttttctgatgtgatgtttaattttatgtgtcaacttgactgaactaagagatgcagagttagctggtgaattgttttttctaggtgtgtctgtaagggttatttcagaagagattagcatttaaataaatagactgagtaaagaagatcaccttcaccaatgtgggcagccaacatccaatctactgataatctgaataaaacaaaaaggcagagaaaaggtaaatttgctctctctgtttgagctaagacatatatctcctgcccttcagacatcagtgctcctggttctgtttttctggagaaccttgactaatatgcctgctttgaagaattcctagtctaaggcaggaattataaacttttagcttggttctgctacttgagataaattattatgaaaatttaccgcttaggcatccaaaaaatataaacactttaaaagatccttatctgttctgttaagtgattgtattctggtatcttccttatgatcaattcacttttatagacagttttaacatctactatgtgttcatttggcaattaatacaaaatagtttctgtattggagataatgatgatggagtgggaatgggtagaaatgcatctgatagcttcagtttaatgctatgaatagagtgactaaagtaagcaaagttcattgtgggcgcaagaagttggagcagcagacccagattagagagctgaggagagacttcctagggttagtggagctccttttatatgtgttccttgtaagatgtcacctggaaagaatgatcaaaattgtgatggtattatatatagtggtttcaaccttgatgatcattcttccaattaaaaataatgtttatatttactttagtgtccttgtcaactatgatgactacaatttatttctccttataagcttgtcatttgtgtgaaaaccatgcatatttgtatataataatactagcagttgaaacttttttctatttttaagctttttttcagataatttttaaatgaattgtttttgcccacctttagaacttggtatgcataatttgaattgggcaacatgtatagctagttgaatacattattcaaaatcaggacatgctggctggctttggttccttaaagaggtgactaagatgttactcagccaacatgtaaataaatacacacagtcacaaacaaaattgttttcagtaaaattaggtaagtaattgtttttttcaaagcgtttacattatattcacatagaatagtatgacatccaacgaacacagttctgttattcttctattattagtagaaaataaaccaaaaattatttagagcaggaccatgaaattttaccaaggcaaacaaaattcctaacctttggtactttactcctaaaagagcttaatggataacatattttacttatactcaacatataaatataacaagcctggaaatggaatttccaaggccaaagaaaattaaatgtaaaacattagcaggcaacagagaagatatactaagaggaaattaatcaatttttaaaaatctaatactataatttttaaggtactttacagttcacaaatatcaaatcttattatactcttttataccatatattacataaaatatcactgttactttatgttgagtattaaaaagtattttattttatttttttattatactttaagttttagggtacatgtgcacaacgtgcaggtttgttacatatgtatacatgtgccatgttggtgtgctgcacccattaactcgtcatttaacattaggtatatctcttaatgctatccctcccctctccccccaccccacaacaggccccggagtgtgatgttccccttcctgtgtccatgtgttctctttgttcaattcccacctatgagtgagaacatgtggtgtttggtttttttgtccttgcgatagtttgctgagaacgatggtttccagcttcatccatgtccctacaaaggacatgaactcatcattttttatggctgcatagtattccatggtgtatatgtgccacattttcttaatccagtctatcattgttggacatttgggtttgttccaagtctttgctattgtgaatagtgccacaataaacatacatgtgcgtgtgtctttatagtagcatgatttataatcctttgggtatatacccagtaatgggatggctgggtcaaatagtatttctagttctagatgcctgaggaatcaccacactgtcttccacaatggttgaactagtttacagtcccaccaacagtgtaaaagcgttcctatttctccacatcctctccagcacctgttgtttcctgactttttagtgatcgccattctaactggtgtgagatgatatctcattgtggttttgattttcattcctctgatgactagtgatgatgagcatttttttcctgtgtctgtcagctgcataaatgtcttcttttgagaagtgtctgttcatatccttcgcccacttgttgatggggttgtttgtttttttcttgtaaatttgtttaagttctttgtagatttcggatattagccctttgtcagatgagtagattgcaaaaattttctcccattttgtaggttgcctgttcactctgatggtagtttcttttgctgtgcagaagctctttagcttaattagatcccctttgtcaattttggcttttgttgccattgcttttggtatcttagtcatgaagtccttgcccatgcctatgtcctgaatggtattgcctaggttttcttctagggtttttatggttttaggtctaacatgtgagtctttaatccgtcttgaattaatttttgtataaggtgtaaggaagggatccagtttcagctttctacatatggctagccagttttcccagcaccatttattaaatagggaatcctttccccattgcttgtttttctcaggtttgtcaaagatcagatagttgtagatatgtggcgttatttctgagggctctgttctgtcccactggtctatatctctgttttggtaccagtaccatgctgttttggttactgtagccttgtagtgtagtttgaagtcagatagcgtgatgcctccagctttgttcttttggcttaggattgacttggcaatatgggctgttttttgcttaaatgttaaaaagtatttttcacataagataatgggataataattttatagtttttaaaaaattaaagtaaataataggaattatctggggacttgatcaaatgaatgaaactctagatttgaggatggcagtttcaatctttgagctaaatctaggctgcagtctctttttcttaataaagtttttatggaacacagccacatccattcactatatatcatttatgactgctttctgctaaaacagcagagtagaataattgtgacagaaactatatggtctgcaaaactgaaaatatgtactatattgtctattacagaagaagtttgctaatcacctctctaaatggaaactactgaagaaatgagtaaaatattagaaaacattcttgtaaacacattgttgatttggcaataaaacaaaaaattcccagaaacttaggtaataatcagttggataatatcattaattaaaagattctatttaagtagctatacaaaagattgagcacttaagaaaaatatagtacactgtaagccagtacttttggaagaacattatacattttctttgaaagatatcacagaagggttcaatatagctaaattacattcatgaacagaaacattcaatatcttaaagataagtgtcccctaatgatttatacatttcatgcaattccattggaaaaaaaaatccaaacaggttccttgtggaacttgaaaaggtaattttaaaaactataccaaagagcaaaaggctaagaatacactagatatccctaaagaagatacttgggaaagaggagcttttcctattaggtataaaaacacaaaataaagctataataattaatactgggcactagcgactgataggtaagcacactgatatgtaagcaattccaaaaatgaggtccaagtaaaaaaaaaaaaaaatcttttttttttttttttttttttttttttttgagacagagttttgctcttgctgcccaggctgcagtgcaatggcactatgtcggctcactgcaacctccgcctcccaggttcaatggattctcctgcttcagcctcccaagtagctgggattacaggcgtgtgccaccaccccggctaattttgtatttttagtagagaaggggtttctctccatgttggtcaggctagtcttgaacttccgacctcaggtgatctgcctacctcggtctcccaaagtgctgggattacaggcttgagctactgcacccagccacaaaagaactcgatgtagaacagtgacatgaagagcagtgagtaatgtgggttcattcatttgggtaagggcagttggttatacagacagaaaagataaaactgcatgcctactttacaccattcataaaacttaatttaggcatcacatgcctaatgatgaaaggaaagacttcgaatattttaggtgctcttttcttcatggtatcataacagaaaacaccttaagtaacagacttacagaaggaaactatattgatacctgtttaaaatcagcagccatttgttcatccagagatattctaagtaaatgaaaagacaaggcacacactgagtgaagatatctgcatcatacacaaatggcaaaggattaatacctggaatgtatagtgatcaacaaatcaaaaaggacaatataatgaaaattacaaaatatataaattggtctattacagaacagaaactatgaaataaattggcaagtacaagtatgttcaaccactttagcaatcaaggaaatgtaccataaataatttgtacatttaaaaataaatctcagtaaataacaaaaatgtacagtgaatattatttcttacaccaaattggcaaatgaaaaaaaattagacaatatataatgatggagaaattgtgaagaaataaacattggaggtgttcctactgctgatatgaatataagaatttgtgttttggaaaacgggttggtattagatgctctagtgctaacatggcttataacaaagaaatcgtatccatagtcatatattttagagatactattatatatcaaatgaggtaacatgtacaagaatgcttctatcacaattgcttcatagctaaatgctgataaaaatataaatgttcatcaacaaaagaatgaataagtaatttgagtatagcatacaacaatggaaaatgaatggactacattaaacattaacatggttgcatatgctacctttatctaaatgggagaaatttggtttctttatccagatagtgggcccaaagtaattcattttatcattatttttcaatggatatatgattataaaagtagagcatatagttaagaaacttaatctctttaatgaatatggagcaaaaataaaattcaaagtgtttattttaactatacacaaaaattgtttaatttagtctgctagtatttttgtttagtagtattctgtttgcttatatgttttagggtctggcgatacacatgtaggtttaacacaggcaaattgcgtgttgctgagtcttggtgtatgaatggtcccatcacccaggtagtgagcacagtacacaacaggtagccttccaacccacaccctcctcctacccactcaagcagtccccagggtctatcagtcccatatttgtgtccatgtgtattcaatgtttagctcccacttatgaggaagaacataaagtatttggttttctgtttcttcattaatttacttagataatggcctacagatccattcatgttgctgcaaaggacatgattttgttcttttgtatggttttgtgttagttcatggtgtatatgtaccacattttctttatccagtccaccatgatgggcatcttggttgattccatgtctttgctattatgaatagtactgtgattaacatatgagtacatgtgtctttttggtagaataatttattttcctttgggtatatacccagtagtgggatggttgggttgaatagtggttctgttttaagttcattgaggaatccctacactgctcaccacagtggctaatttacattcccaccagcattgtgggaatgtaacctcaccaacatctgttgttttatgactttttaataatagccattttgactggtgtgagatggtatttcattgtgatttttatttgcatttctctaataattagtaatgagcattttaaaatatattcactggtcacatgtatgtcttcttttgagaagtgtctgttcatgtcctttgcccatttttaatggggtttttgcatgttgaattatttaagttgcatataggttctggatattagatctttgtcatatgcatagcttatgaatattttctcacattctgtatgttgtcagtttactccgtttatagtttcttttgttgtgtagaagctctttagcttaattaggtcctacttgtcaagttttgtttttgttgcaattacctttggggacttagttataaattatttgccatggctgatatccagaatgatattttctaggttgtcctctagggtttgtattgttttaggttttacatttaagtctttaatccaccttgagttaatttttgtatattgtaaaagaaatgggtccagtttccattttcttcatatgactagtcagttatcccagcaccatttactgaataggcagtcctttccctatagtttgttattgtcaactctgttaaggatggtggctgtaggtatatggctttatttctgcattttctatcctgttccattggtctatgtatcttcttttgtactagtactatgctgttttggttactatagccttatagtatattttgaagttagataatgtgatgcctccagcttcgttctttttgcttaaaatttgtttggcaattcaagctattttttggttccatatgaattttgtaattgttttttctaattctgtgaaaaaatgatgttggtagtttcataggaatagcattgactataattgctttgggccgtatggccattttaacaatatttattcttgctatccacgagcatggaatatttttccatttgtttgtgtcatctatgatttctttcagcagtattttgtaattctcattgtgaagatcttttacccccttcataagctgcattcctatgtgttttactcctttgtggctattgtaaatggaattgctttccccagactgaactggaagaaactgaaatcctgaacagaccaataaccagttccaaaattgaatcagcaataaaaaacctactaaccaaaaatagtcctggaccagatggattcataattgaattctaccagacatataaagtagagctagtaccattcctagtgaaattattccacaaaatcaaggaggaggaacttcctgattgtatgaagccagcatcattttgatgccaaatcctggcagagctataatgaataaagaaaacttcaggccaatatttctgatgaaatagatacaaagatcctcaacaaaaatactagcaaattgaatccagcagcacatataaaagttaattcaccacaatcaactaggcttttattcctggggtacaagactatctcaacatacacaaatcaataaatgtgatttgccacataaatagaattaataataaaaaccacatgatcatctcaatagatgcagagaaagcttttgataaaattcaacatttcttcatgtgaaaaaccttcaagaagcatttatgaggaatttaaacaaatttacaaggaaaaacaaacaacctcattaaaaagtaggcaaaggacataaacagacacttttcaaaagaagacatatatgtggccaacaagcatatgaaaaaaaactcaacattactaatcattagagaaatgcagatcaaaaccacaatgagataccatctcacgccagtcagaatagctattattaaaagtcaacaaataacagattctggcaagattgtgagaaaaatggaacacttatacatttttggttgggagtgtaaattagttcaaccattgtggaaagcagtgtggtgattcctcaaagagctaaaaactgaactaccattcaacccagcaatcccattactgggtatataaccaaataaatataaatcatcctatttgcattaatgttcatcaggaatattggcctgtagtttctttatttttaaaaaaatttatttatttatttttttggctgtgtcctagtcttgttttgctgtgtgggtaatgctgaccttatagaatgagtttgtaagtattcccttttctttttcttcttcttattcttcattctttttggaaggatttcataagagtttatattagttagttccttaaatttttgttagaatacagcagtgaagctgtaatgtcctgggcttttgtttgatggaggactttttattatggctttgattttgttactcattatttgtttgttgagattttctatttcttcatggttctatcttggtaggttatatgtgtccaggaatttatccatttttttctaggtttctgaatttgtcgttgtatagttgtttgtaattctctctaatgattctctgtatctctgtgatctcagttgttatgtctcctttttcatttcttatttaattttggtcttctctcttgtttttaaattaatccagctgaaggtttctctactttgtttatcttttcaaaaaaccaccatttcactttgttgatcttgtatatattttttttcagtctcaatttcatttatttctactctgatctttgttatttcctttcttgcttgcttttctagttcctccatgtgcatcattatgttctttatttgaagtttttcaactttttgaaacaggtatttacttctatgaacttatctcttaatactgctttttctgtatcccacagatgttaatatgttgcatgtcaattttcatttgtttcaaggaatttttaaattttcttcttaagttattcattgacctattggtcattcaggagaatgttgtttaacttctgtgggtttgtgtaattttcgaggttcctcttgttagaatggcttttataaaaaaaattcagagaataacagacgctgttgaggatgtggagaaagaaaaacccttgtacactgttgatgagaatgtaaattagtatagccactatggaaaacagtatagaggttcctcagataactagaaataaaactaacatatgctcccgcaattctactgttgggtatttacctaaaagaaaataaattagtatatcaaagggatatccacactcctatgcttattgcagcactattcacagtagcccagatacagaagcaacctaagtgtccatcaatggatgaatgaataaagaaaatgtggtatatatacacaatggaatgttaatcagccataaaaaaataaaatcatgtcaactgcaacaatgtggttggaaatggaggtgattgtgtaacgtaaagtaatccaagcacagaaagacaggtatcacatgtgggagctgaaagagtgaatctcataaagataaaatgtaggctggtggttatcagaggccaagaagggtgggggtgatgtgtggtgaagagaggttgattaatgggtacaaatacacacttagaataaataagacctggtgtttgatcagtaggatgattatagttaacattaatagattgcacatttcaaaatagttagcggggaataattagaatgatcctagataaaaaataaatatttaaagtgatggacatcccagttactctgatttgattatataaatgtatgaaatcatcacatgtatctaaaaaatatgtgcatctaatatgtatcaataaataaatgccacattgaaaaattttaaattattttcacattgaatttaggctgacacagttatttcaatttatatctcagcttattcaactgaatcttctttataagactatattaaattcagagtaaatgaaaatgtgagcaattgaatttagtgttatgtgggagaaatgttttcctttgaataagacaggagcaatgtttctagtttatgacaagaaaaagtctgtgatattaagctcccaaaatgtatcatcttttatacaaaattcagatcatatcagagcagtcaatttatacatggataaagcatataacaaatgaatgatggtaatccattaagccaaagggttttataacttcaatagctagtgaacatgtggtgagcagttgtgtatgaatacatataaagtatgcatttaaatgtacactccattaagtttttaataaaccttatgtgctaactttaaaaaatttatgattatttaaattagtcactaacaacttctttaattaacactaaatttcacattataacacagaaatatttttagttcttcatgctcgctcttccaaaaattgttaatatgcttatagttatattttttacagtgtaacatccaagtatggaggggcaattctaccaaatgatatgctgaaataattatttccagtgactgaatgatgttacccttatatatcagacagatcaatttcccctaataataggaaaattttaaaatttcaaataatagtagtactgtagtagtgattatataacagtagtacagtaacggcaatacagagaaccaataatgtttagaaaattatgaaatatagctcaaattattttattaattggtttaatttttaaaatatatatctggttgaattaaatattcaataattcctactgaaattcatgaaaatgctgaatcatgatgggtgactgttggaatttagttaataactaactgggcacataggaagaagaaacgttctgcctctttacgattaagtaagaagcccaaatctacctgaacagaaaagggagactgttgttccagtcaatgctgaaggttttgtttctctgaaacaaattcaaaataacaacaaaccaatgcaaataggagtacttgagatccacttgagattcaattcatggttatcagccaaactgtgctcttggactaataggatgcagcctgagctgttcaggagactttatgttgtgagtaatgtgacacttatcccagtaacttgttttctctaagttctccagttactttatcatgaatatcgttattctttgctgatccactccttttcttgcactcttatctttttataaagtagtaagtgtatagctctttaaaagatttttgaaataatttaattgacaaataagtttttttttaaattattatactttaagttttagggtacatgtgcacaatgtgcaggttagttacatatgtattcatgtgccatgctggtgtgctgcacccactaactcgtcatctagcattaggtatatctcccaatgctatccctcacccctccccccaccccacaacagtccccagagtgatgttccccttcctgtgtccatgtgttctcattgttcaattcccacctatgagtgagaatatgcggtgtttggttttttgttcttgcgatagtttactgagaatgatgatttccaatttcatccatgtccctacaaaagacatgagctcatcattttttatggctgcatagtattccatagtgtatatgtgccacattttcttaatccagtctatcattgttggacatttgggttggttccaagtctttgctatcgtgaatggtgccgcaataaacatacgtgtgcatgtgtctttatagcagcatgatttatagtcctttgggtatatacccagtaatgggatggctgggtcaaatggtatttctagttctagatccctgaggaatcgccacactgacttccacagtggttgaactagtttacagtcccaccaacagtgtaaaagtgtgcctatttctccacatcctctccagcacctgttgtttcctgactttttaatgatcgccattctaactggtgtgagatgatatctcattgtggttttgatttgcatttctctgatggccagtgatggtgagcattttttcttgttttttggctacataaatgtcttcttttgagaagtgtctgttcatgtccttcgcccactttttgatggggttgtttgtttttttcttgtaaatttgtttgagttcattgtagtttctggatattagccctttgtcagatgagtaggttgtgaaaattttctcccattctgtaggttgcctgttcactctgatggtagtttcttttgctgtgcagaagctctttagtttaattagatcccatttgtcaattttggcttttgttgccattgcttttgatattttagacatgaagtccttgcccatgcctatgtcctgaatggtaattttagcctaggttttcttctagggtttttatggttttaggtgtaacgtttaagtctttaatccatcttgaattgatttttgtataaggtgtaaggaagggatccagtttcagctttctacatatggctagccagttttcccagcaccatttattaaatagggaatcctttccccattgcttgtttttctcaggtttgtcaaagatcagatagctgtagatatgcggcgttatttctgagggctgtgttctgttccattgatctgtatgtctgttttggtaccagtaccatgctgttttggttaccgtagccttgtagtatagtttgaagtctggtagtgtgatgcctccagctttgttcttttggcttaggattcacttggtgatgcgggctcttttttggttccatatgaactttaaagtagtttttttccaattctgtgaagaaagtcattggtggcttgatggggatagcattgaatctataaattaccttgggcagtatggccattttcacgatattgattcttcctacccatgagcatggaatgttcttccatttgtttgtatccgcttttatttcattgagcagtggtttgtagttctccttgaggaggtccaatagatgcagaaaaggcctttgacaaaattcaacaacacttcatgctaaaaactctcaataaattaggtattgatgggacgtatctcaaaataataagagctatctgtgacaaacccacagccaatatcatactgaatgggcaaaaactggaagcattccctttgaaaactggcacaagacagggatgccctctctcaccactcctattcaacatagtgttggaaattctggccagggcaattaggcaggagaaggaaataaagggtattcaattaggaaaagaggaagtcaaattgtccctgtttgcagatgacatgattgtatatctagaaaaccccattgtctcagcccaaaatctccttaagctgataagcaacttcagcaaagtctcaggatacaaaatcaatgtacaaaaatcacaagtattcttatacaccaataacagacagagagccaaatcatgagtgaactcccattcacaattgcttcaaagagaataaaaaacctaggaatccaccttacaagggacctgaaggacaaataaattttaaaaatgatacacacatatgacaaatataaccctcacagtaggaatcaatggtaaattcattactctcattactatctaatacgtatatatagtataggcattggagagtctttgttactaatacattgatattagttggcttgcttatcacctacaattaatgtcttcctatctatatgtagaaattatttttccttggatgttaccaatgccttccttttattaagatgctgtcatcttgatccttctttcagtttttattttatttaagggaaaaaatatcaaaatgagattcaggctcttgaggacattttttcctattacaagcaataatttatgtagaaatttttggtttactttaccagaatctccacctttatgagaaaaggcttggatgccatggtctggttgcttgttctgaataattttgttactcacttcataatgcgttgataagggcaagcaagaaaaaacagtccaaacaacagaaatggagaaacggaagtaggtcttgtttaaaagaagctcagttgcttcaatctattgaatgtcagtctgctttataccatggtgaagtagcttgcctcagaccagtccccttgctgagaacaactataaaagctgaataacaccaaattaataacagtttgaaggttttgaagagcaatcaagggaaccaagattagagtggctataattcaagaaagaagggaaatacattatttcgagccagacatgtcctgctgcttttccttagagacatccaacagcttgcaagcatcataaggataaataaatgagcagaaaatagtgaatagaacttacaggaaccttagaatgccagagcaccatgaatctgagtttagtctaccaggcagtcaggccttgaggggccaagatactgagaaaagggaaccagagaaaatggagcttgaataattattttttttttttgaaatacacatctggttgaattaactattcaatagttccttcttacatttatgaaagtgctgaatcatgatgggtcatttatatatatatatatacacatattcatatatgtatatgtatagatttattataaggaattagctcaggtaattatggaggctggcaagtccaaaatctgcagaggtgatgtccaagtttcagtatgatggctgaaaactgctatagagccagaaagagctaatgtacctgttctcaagctgtcaaggaggataattctgtcttattcaggggaaggtcagccttttatgctatacaggcctttaactttttggataagacccacccacagtatggagggcaatctgatttactcagtctatgtatctaaatgttaatctttaccaatttaaatcagaactcatccaaagacatctccagagaaacacacagaaaaatgtttgaccaaatatttggacactccgtgatccagtcaaattgacacataaaatgaaccatcacagaatttgagtaatatgtagctacaaatttaagaagtagaactttcgccagtctcatgtattttatagacagaaattaggagtcctgggtctgtcaagtataagaggtcctgaaaaatatgtcagtctatcagttgaaacccagaaccaaaacactgtcctaaagactgaaaaccagtctcaaaatacctcaattattggttggggccatttagtctgctcctatactaattgactgtgagaaaaataaagtacctcagagaaagatgacatagctagaacaatcaatggttttcatacacaacatccagcattgactaaaaagttatcaggaatgtcaaaacacaagacaacattttttataaacaataaaaaatcagtagaaacaaacacacaggtaatttagatattggagttattagttcacaataataataatatttccaagatcatatctgacaatgaaagaaactagaattgtgaacaataaataagaaaatggaagcttcataacttaaaaatgtaaaatgaaattaataactcaatagatgtagttattagcagattagacactgaagaagagagttactaaactggaaagttgattagtagaacatgtcataagtaaatatgaagaagaaaaaagatgaatgatagaaaagaacataacttagatatgagaaatgaaaaattctgataagtatgcaattaaaagcccaacacaaggataaataagaaatatagtagaaacaatatttagtcctgcctgaagcagtactgattgaaatttttttctgactgtggaaagacatctaataacagatttaagttgctgtatgaattacaagtgaaacaaccacaactagacacattaaaattaaactaatgtaaatcaaaggtagttaaaagtcaaagtagacaaaaaagaaacacactccaaggtaaattttaatgaactcgtaacaaataatgaatgccagagaacaataacatatatttttaaagcattcaggaaaaaaagtaacttctgacctagacttttataaccagtaaaaccatctttttgaatgaaggcaaaataacgttgtattcagacaaagagtaaagaaagatctcattgcaagcaaagttacagtaaaagggatgacaaggagacaaactttggcagaaacaaagttatccagaattcaagtacagaaaagtagaaagaactgaagaacaaagaaacttcttggtgaatatgtggataaatctaagtattagctgactgtataaatcaatattattccttgtgaagttcctacatgtatatagaaataaaatacatcagaagaagcaaaaacagcaatagaatagtgtaaaaaaatttttcaatccttgcctttctgagaagtggaaaaggtaatatagcacttccttcttatctgtggtttcactttccagtttcagtaacctgaggtcaactttggtctgaaaattccattattatgtttaaatttttttctaaatttataatttttctatttaattaatagttatttttgttaatcttttattgtgcctaatttataaagtaaactttatcatagatacatatgtaaagaaaaaaacacatataggattcagtattatctgcaatttctgcatgcaaaaacagtctggaatgtatcttccatgcataatgagggacactgtaatttagggtacactttagtaagacaaggatgcattggtaataactagactaatcaacaaaatgataatgaaagaatatataagttaaaagagaacaaaatatagaaaaatatttgattagctcaaaatttagcaataagtaggaaatgacacaaagaaatagaaaaatagcaaatattaagatggcagatttaaaagcaaatatacattaaacgtaaacagactaaatactttcattaaaaaagattgtcatattgcctaaagcaataccctgtatgattacccaccttattagaaggatacagaaagttgcaaagtaaaataacagataaaccagattatactaaccagaaggccaaagtagctgtactatagtaggcaaagtagattttattgcaagagcatcattaaaaataaagatatttcataatgagtatgaaatgtatatgcagtaaaaattattacctcaaaatatacaagtaaatatgcttatgttttatatcgagattatatatttttatatatatgtataaatataactaaatatgtgtagtgaaaccacagataaaaaggaaatgctttatattaccttttccacttctcagaaaggcaaggattgaaaaataatatatttatatatgtatgagggacataataggaagccatgcttagccaacttttaaagagaaatttattggctacatttacaaactgatttgatttgtaggttttacttagaaagtgcatattcatattatcctgaaagatattttttttctataattgaaaaggtgatcctctttgattcagcatataggtttggaataaatttatccagaaaatttctatttaagcatacagacccatccctcagacaatggaatgcgttaggtccccatcagattctcacattcagttagttccaactttaccttccagatatcagtgtatagtcccacattctcccgaagcatgtgaaatattataaaatgcaatgtctttctaatcttttcttatcatggtttggttttgagaatgcactttttataaaggccattggagtctaaatctttggagaaaaataatttttttcaatctggagcagtgcttattactcttctttggagacttagacaactttgagaatataattaaagctaatagaaactcattcaagaaaaatagatgtacaaataatcacaaactatggaataatatattagaagttcaagaagttcatctattgacgagattatgagtgcctgatctttgtgtttttgttggtccatttcatcagccccttagaaaagaaaaaacatgttgtgcaaagtttagagcaagctactatttaaaaatagtagctctaattttacttatggatcttatttaatgtgtaaatgcctggaggctaaaagcaatggaaaaaataaggacaaaaattatacctatgaaatacttctgtttttcaggaaattgtatttttataaaatgcagtttagaacaaatctcaacattatgactttattcaaaagaaagatttatagatttaccaattcttattcagagggagattgttcgggttatgtattattatagaagttgaaaaaaagcatgagaatacatcatttctcaataaacttagttatcaatttatttttcagtaaaataacatgagaatttacaagtatgagaaactgttccatctgtgcaactctaccaactatccccaccagaagaggattatctatgtagccttaatagatgatattttcaaaaaaattgagagactgagctataaagtaaatagctttatagtgttgtctcatttaagaactgctatatttattaaaaattcagaaaatacagaatataaagtagaccatgattattacctgcagttttcggatataacaactgtaatcatctgctgtatatcatttagatattttatgtatatttttaaaggtatcaaaacaacacatgtatggaagataactcagcattctgtttcaaagtcacattttaaatttctttaataagtgtctaaaatttacaaatgtaatacatactttctatggccattgaaacaaatacaaggaggttggaggaaattttaataaatattctgccagtttagctccatcactatcccctgaacatatgaaccatatcagcctgacatgtatgcttgcacatcttcctctgaattgacgctggcatttaaacaactacatacacatatggattactgtttttctaactgttcattttttaaaaaacgatttttaatatactatctactatttgtttttttcatcagaattcttctaggctaagatatatatatatatatatatatatatatatatatatatatatatatatatatatatatataactaatttttaccagtatattaaaacttagacttggttgaattccttaaaatgtatttatttctacaaggtagattcttaggagatgcgtttctgggtaagacactgcatacattttttagtttattttaatagatattgccagataatttctcatttttaaaggtttttacagtttccagagttataaatgaaagttatctccctaatcctataggttagaggactttaatattttcaatctggtggataaaaaccatgtggtattatgacattaattacaattttctgtctcctactgagattgagcaggtttcttttgtgtgtgagtcatttggttcatctcttctggaaataatttttcttctaaaaatatttttggtatttttcaataactgttttggttattttctttgagtcaaattatagatgtttattagatatttgaggtattattctttacatttgccatttttgtaggaaatatccctcacttcatcactttatttttttgtcattgtactttttttcaacttgtatataattaaatttgtaatttgaaggaaacctatacaatatttttctttcctagcccaagaatataaagattctcaaatattttaattctaactttctgcttgtctgttctgagtgtttgaaagcaatttaaatctctcttattttaaaagagtaccatattagtcattctaaaattattatatatcaataatgctatttacatttaccaatgtttttagctaattatttgccctccattttggattcagtattgttctagctgaaattcatcttttagtcatttgtttcttataatgtctaaaattattatcttgtttctttactcttactctaaattgctatttcaagtaaataaagaattctgggttgaatgttatttttcctgagcacttttaagataaccatatttacagaacaaaatggaaaattataaatattaatacttttaaaaataattcaactaaaataattggtgtgtaaggcgtattggaagttttataatttcctaattattaatattagggagtctgatgatattttttaattaattgagaaagaaagccttaatattattcaaagtcatggatgatttttgctttcataatggcttattaggtaattccaactaactccctaaaacaatagataaattgaaaaaattaaatggacaatatctgcttgaaattattgctagctaatgagatcgtaaataggagatctagcagaggagaaagattaggagaatataccaaatcctgagcaggaatataaaagcaaatgcatctttcagttttgtgtgttgcttggtttggacaactcacttccctcagccctggaaaacttgcagccattatcacttatgtatcaccgttttcccattcttttcagtttcttctagaatttctgttagatatatgctaaatggtctccatctatcttctgtagctattacaacccccttcttatttccatttcttctacattttattccagagtattttcttgtatattatccatgtaatgaattctttttaaaattatctttaatctacaaattattgtgaccattatttacagaagttttattttgttcttttccaaaatacttctttttgcttccatcatgtcatgttctgatttttatagtctacacattttaaatatttgtagtttcttttaggttgttcaatttttttctccttcttcatggacttccctttatagggttttattcatttgtgtggcttgtaattttttttattaagattttgtcatcagcaaggattgctttctgtgggagttcctttctctctgaatttatacataaggttaagtttgtataataccttcctggatcctaggagttttactagttgtgtaccaggctttttattgatttttcagctttgggtcttctactatgcataagtgtatgctctgtactcattcaagttgcagacctaggttcttgattttctaacaattctgtccagtttcatggctagatagccagcttctatgtggctttcgtaaagtactggatgtagttcttcctgtccccacttcacaactggggcaatcctccaagttcctagactttaggcaaggaggcacaattccaggctctcaccttgcatggctctgagtcccatctcctgttcctacatgtacaacaagcctcagaactcagttcttcaggaccttatttgggtttgataggactgtggctcactttggcctcagctgtgactgtttgacattttaaatttcctctatatatttggacttgcagattcgagctcagttatgcatttagctaaaaagaaaaatagtctatggatttgaagtagaaaaatggaagttttcccatatcatcttagataggcatatcgacctgatgttttccctaagaagctcctcagcctctcataaaaatacgctccttatccttcacatgccctccactttttcctgagtaaatataaatgtaggttctctgtgcaactatatataatatcattataacctaataactcatgacatgtattctagtagtaacatttttccatgcctaatatttattgtttacatattaaattaagcaatcatccataaatattaatggtttatatactgtttaacattttattcatttttgttattactgaatactaccaacatgtgataataaaacaaacagaagatcatatatataagtgtacaaaatttcttcattctttcaactactatttattgaatggctgctatattccaagcactctaataggcactttaaatcactgaataaaacagaagattttttatgttattttcttcatgtcggtgaaaaagaatggccatttctcttgccttgggaagtgacatcgagcagaagtagtaggagccatccatgcagagacagtttagaaccccctctttcatagaatgaaagcttgacctacaatccaatccttcactggcattttcatgttgatgagtggtaataaacattaaattgtctctggtatttttacagcttagcaaatggagtacctttgggactctggaagttatgcctcagaatgaatcggaaacacagatgttctcggtggtgacagaagacgattgtgaaattcttaaaatcccagcaaagggatatgcaaagataaaggaggtaagatgatatctaatattttatataaacaaaaattgggcataaactcaagctacattttgattctctagacaaagacagctatatctgttttatttttaaattttaatttaacctagagaccataaaaatgttatttgacaaaaatcacttaagagtgctggtgataggtaggtgaggtgtaaacaaaggtctcaatgaatatatttcaggtaatttttaaataccctttggcttttcattaattttaaactcattaatttattcattcattcactcactcattcattcaacaaatatgtgttttgcatgtccgcagcatgtcatatgctaagaatactagaataataagacagataatagtactgctgctttcccagtctctgtagtctactttaaaaggaaaaatacttgaatgtgattgccatgatatttcataattacaacagatatcaaactcagagctgcatgaataagtgataacaacttattctgattccctaattctgcgtttttaagataacttcatttacttaaagtttaataatttattctcttctaatcaaatccaaattttttcttgactcctatttttcctcctttggatatcagaagaagtttgtataaataatgagattgaggctaggggcggtggctcatgcctgtaatctcagcactttgggaggccgaggagggtgtatcacctgaggtggggagttcgagccagcctgaccaacatggagaaaccccttctctactaaaaagacaaaattagccgggcttggtggcacatccctgtaatcccagcactttaggagaccaaggcaggcagatcagctgaggtcgagagttcgagaccagcctgaccaacatggagaaaccctgtctctactgaaaatacaaaattagccggacatggtggtgcatgcctgtaatcccagctactcgggaggctgaggcaggagaattgcttgaacccaggaagtggagtttgtggtgaggaaagatcgcaccattgcactccagcctgggcaacaagagtgaaactccgtctcaaaaataaataaataaataaaaaataatgggattcaaaggtttccatgatcctgctgtttcatctttttttgaatgagcttaagccaggtgcaggtcctgcagaaagctggcataagccatggttcagtgctcatgtggagtggtgttgagaagacatccatcttcttgggtctccagtggtggggaattcttgtgatttagtggtcccagtgtcagtagtgcaggtaattctctcagaattcaacgttattccaaatccctgatgtttatttgttttgattttcagagtggctagctttaacaaaaaattctttatgttttgtttttatttcccaaatatcagtaccagttacttgattttatcaaacacaactttttagtttaatcttgactatgacagggtttttaaaaacttctaaaacatttatagaagtataataaattatgaaaggtgagcaaatataattttagtaagtagatctgaagattaacattttaatatgtctatgtggccatagagtgatgctcagataaaattcaaatgtattctatactaacttatattcatatggcctttattttacttctctcaccatttatctatttgctatttctttgattttaaattgcctgttattaaaaatttgataatgacattctgttttaggaaaaaataaaacttgaaaatatgcaaaagttgaaattaatccgtatgtgtccttattatgaggaatggcctactttatccatatatgagctaattgcactccttaaatggaaaaaatttcctccaggtcatggtaagtttaatgcaatttagatcattttgtttgcattctgttatattattggaattgaaattcttcatagttgtaatattttatacaatatttcttcatataaatattctctaatttatttgataataacatttgaattggacatttagattatttcctgctttttattaaaaatgatactgtactggcttgaagtgtggtctcaggactaaccttacttttaacatctctctctactccctttaactgttccgcacttgctccaccctgacagttactataagggccaaactgaaaaggataaatactagagggtatagccactcacacaggagaaaaggaaaaaaaccatttttttcttttcctttttcctgggtggataactatttaagcagcaagtttgctaatctgtacttgtgctacatatattagccatggaaaaaaataattatggagaatgagtgaggcctagataagagaaagcagcagtgaagcacctacattttcaatattcagcatagcaaggatgcacggatttcctggattatgtgtacacaaaaagtgtaggtggtattgagtcattttgcatgatttgtccatctatgaaagccaatttaacaagggttgctaaaccaagaggaactgtggtaggatgggccagagctttaggtctcttttggtaaggaaacacaattgctacatgagagacagccacagataacagagagaggatggcgacctcgactctctttcctcacagccagtgaaggagccagaacttagattataatggaagaggaagtgtttgaaagaaatacttctaccccaagtctgcaaagccacaattatagtgagggacatttttaatttaagtttgagattaaagttctaaaacgaatgaatctgattggtaaattctagacagctactattttaataataaaaacatggcagactagttatgaaatctggctaaggtatcctttgagggaaacactgtaacacaggaaaacgaggttcagcataccaggagttcttttactgaaaaaaagtaaatatcattagaggcaagtttatgctttaaaaagcagggatactctaataaaccacttaaatttggtgagaatctaaaacctttctcgtatttcttccaaatttccttctactgcttgcatttatattttatttatcatgtttttgagatgtagcatttaatccatgtttagtcaaataactatttttgctcataaatttgaatatttgtaatattatgtttttgtttatgacatttttttcctaattagttataaatggcatttttttaaccaaaagtacaaatggaaggcaagtagtaaactgacttgtaaaaaatcgggaattgaatatttctaaattccccatgtttattacatagaaacagatgagcatcccagaaccagtttgatacctccaggtcccagtgattcaagtacctgtaatgatgatgcctttttgttccttcattcatccttcactggtctcttttgttttggacaattttttctaacgtagcatattaattcttataataatttttcaccatatttgctatttttcatggttgctttattttttatggttgttttggatttgtcatggttttgtcacaggtttcccactttttatcagaaatatcaaattttgatccttgcctctcttccatgcttttaataaaaatataatatccaatctttgcccatctatcattatattaatatttttgaggtgattagaaaagaggaaagagaccatcataaagatattttaaattaggggatccaaaagaatttgaaatttggaaaggggagaatgattatgtgttttaatatgtttgattactaatgataatctgtctcttgatctaaaatatcaatcaaaagtactaaaattttgcatcaaagagctaaaaaggtactgagacagttaacatactgtttcctagactaatattgaattcaagttcttttttgtaaatatcttgaaaaataaacggtggtgtttgttaaactaccgatagcattggacaatctgtgagtctattgaataagtcaaaataatattgttttctcacctattcccaaacatataaatgtgtggtactttcatagttttagaaaatatttaacctccttagagaagaatgacaatttcatctgataatcatcaaagccctatgagttctgaaagactgtagtttttataaataaatatacctacgtgaagaataagtcctgtcaaattcatctaattttcttttatggtagtgacaaacttgatatatcaaagagaggaattggattataatacttcctgactgtttagtcaagatttagtttgaatttttatcagagaatgtagagaatgtagctcaaattacacttttattatctggtttgaaaattagcagtagtatgatttccaagcataattatgtgtgttttgatcttattttaagaatgtacagtggatagggtttcagagggatttagttaattattcaaaagcttgatagagtttaggattaatccttggcaatcaatgaaataagtaaagcttgtatctgactctatttgctttgttaacttcttacatcttcctacttttgcttcatatgccaagggaaccttattataatgaatatgtacagtgttgcttataatttgggtgtgtccagtttatatcacatcggctaaagtcttcccagttgttattctttcaagatgtggccaacttgaaagcgacaaccagcttaggtcactaatcaacctgttcccatgtgtatcatggatataagaaaaaatggtaaactgacttggcaaacatttaactatttatgcatattttgttgttttcttgcttatgtcagtatgcccccatctttctccaggtaggatttgatatagcaaacatgttaattggaaaaactaaaaaaattacagcaacatatttagtgcagaaagataaagtatgtgaaaatcataataataacagtaatagtcaaaattatatctagttatctcaaaccaaatgtggagtgtttcagtcacaaaatacataggctctacatcccttcaattttttgacatcaatctcttccagttcaatttactcttcagggaatcaaaagtcttagtcccatgagacactcttgagcatcccagaaccggtttgatacctcgaggtgccagtgattcaagtacctgtgatggtgatgcctttttattccttcattcatccttcactggtctcttttgtcttggacaatattttctagtgtagcatattaattcttttaataatttttcaccatatttgttactttttatggttgctttaggtcttaccatataaatttcaatttagcagaatctacttcagatttttactaacttaattccagttttaaatgtgactcatgtagctctatttccatttcctcctttatatgttattattattatacatattgcatctacatatgttacaaatttaacaatacattattattttatataaagttatgtctcaaaaacaaagaaaaaagagatcaaatatatatttatagggttcattatattagacatcatatttaccatttctagtcatttttatttgttcctgtggacttgagttgtcatctgatatgctttccttagttcaatatcagttttctcccacctgctttcttatgctgctattggcaaatatattatatttctatatgttatagatccaacaacattatacacatattatttcacacaatcactctttatgagtaagagaagaatggataagaaatatgcatttctcctaccttttacaattacacatttacctttagtggtactttttgatttttcatgtggattcaaattactatctggggatgcttgtttgcagcctgaagaactttttttagtatttctttgagggagtatatgctagtaacaaatactgccaggttttcttgtactgagaatttcttcatttctcctttacttttgaaagacagctttgcagggtgtaggatttgaagctgaaattgggttattttgtgtaagttaaaaatgcaatcccactttcttctggcttctattgtttctgatgtgaagacagctgttaattttattgggattcacttataagtgacaaggcttttgcttgctggtttcaatattttctccttgtctttggcttaaagaagttttaccataatgtgtctgtttgcttattttcttacctagtactagaattttctgtcacatactttatagccctatttattactaatctctctgtttctgactctctcatatattgttagctatgctaatcagttttaaagtttttcttgttattcacccacttagaaatagtctatgtcctctcattgttattcaggtaaaatgcaaaatctttaatgtagtttgaaaggacatttgtatctgggccatacctatatctcaaagttttaattttaataattcttctctttttgttcatgtttctgccaacctggacttttattagttcttctagtgtcactatcgccattgagggcttttacacatgttgttccttcttcctggagaagttacttacccctcatttcagtatatttactattgttaagataatgttttctggaccaattgagattctattgctctttcttgcttgcagagatgcctctttgtctctctgggggtcaagaaatattttctgctaaagagcagatactaaatattagctttgtaggtcatatagtgcctctgttacatatccgcctccttcttctttttaatgcctttaacagtgtaagaatcacccttagttgtagtgttataaaaaaaaatgggccttgggtcagatttggtccgcggtctaaagttttccaactcctgtcctatcttattttgttaatcgccttattttttggggtgagggggcacaggggacaaggtctcattatattatccaggctggactcaaactcctgggctcaagtgatcattcaacctcagccattcgagtagctgagactaaaggcacatgccaccatgcctggctttccttgtattatcttaacactcattatgctgtgtcataattaatagcttaagggtcaatttgtccactagacttaaaatttctttggaatggaaccatcttattttttagtacccaacaaatatctagaatttgcaagcccttgaaaatattgttgatgagtgaatgaatattttgatgtcagtgtttacccttagaccaaagttatgacttttttcttccaaaagaaaataatttaactctttgctgctcagtacatctgggttgtattaacatttggcattaattctctctgtttgaggaaaatgctgtcattgattcaatcttaaaatatattaatacatttattgataaatctcctgattaaaacacaagctattgctttgctatctttgagtagatgttttacagaattgcatcgttgcaataaatcaaccattaataatgctgaaaggctatactgtcttaaactcacaatcctgagagaataaaggcaatttggatttaaggtgaggttaaataaggaaaacattagcacggcattaaggacagcaatagttaaagaagtttgaaagtctgttctcttcagtgaatcaccaagagtaaaagatttgtagaatctatcaactaatttttatttttggtcatcatgtttaattctcagtatgcatgcggcaagctttctactacatggggtgtgagaaatggaatgatcactgataaatgcaattcaagtataatttccctccttcttattaagtttgtcatcatatgtattgttcttattaatacaactgtaagaaaaaattttggtgaatgatgaatactgtagattatatggctcaatgcctcttccaagcacttctaaccaacctgtgaaagctaaaaacagctaaagactacatgttctagaatcctttgtaaaagttttaattttgattgtggcctccattctgcccagtatatatttctctgcagtatctggaagaagtcaggagcagctctccttgcaaccatggtgatgagcatggtggttctaaagttcatcccctgtttcacacgtgatgagtggcacagagcagcaggagtgaggtttcctttagaagagctctgtgttgtgagtgggcatttccgctggctactctattttcttgctctatagtattgaattctagttttatggccctactagagcttcctaacaccctctgataaacgactttttatttaagttagatcgcaagagtctgctgtctgtacctaggaacaaagggctgcgcactgggtgttcattctaccaatggtctcctttgtgaatacctagttttttcaacattttttcatttcaaaaataaatttttttcataagaaatatgaaatttgtctcttcatatttttaacatctgtgtacagaacaccatgctagttgcttttgttgtggcaatgaaaagaaatacatttttaaatcacttaaagtcaggccggacacagtggctcacacccatatcctggcactttgggaggctgaggtgggctgaccacctgaggtcaggagctcaagaccagcctggacaacatgatgaaaccacgtctctgctaaaagaacaaaaattagccaggcacagtggcaggcgcttgtaatcccagctacctaggaggctgaggcaggagaatctcttgaaccaggaggctgaggttgcagtgagccgagatcgtgctgctgcactccagcctgggtgacagagcaagactccatctcaaaaaacaaaataaaataaaatcacttaaagtcaaatgcttcagtaactacactgtactccttactatgtaggacagtttgttgatctcaaagatttaataattagaaaaatacaaaaagtatgatttttaaacaaatgagatagatcaaaatatgatgtcttaaaatgattttcactatctcatggacatatatattatctaacataataaatatcaacacacacagtggaaactgaataggagagaggattttttggatatggtttaacccaaagtaggactgataatgtgaggcaggaaaaatagcataagccaatatatggttttcagatcttgctttagaatagttgatcaaacagcccaatttaatcagatgcatattcatgaacattgggagatcagtcagactttctgtagtctcaggcattttaaataccatattcatatgcttgggctttaacttacagataatgtgacatcattaaaggttttgaataacagaagagacctgaaaaagtcaaagttttaggggaatagcagagcaatatgagtgatagttgaaaggagagaggtactagaaaaccagaacaattaggagtctattttggtagtaccagaggcaaagagatgagaggcaatggagataagaagtagtggtgacagtaataatggaaataaattaatatgaggaatgttttcattatttgggagtattgtatagaatagatcttttcaaatacatttccacttctttgcaatgctgacagtctatacatgttggggatgttctggtttttcagatctctaccagagtgctctgttgctgcacagatgcatatgtctgtggatgtcagtttaaacacacatcagacactgagaacggattctcaagcatgggttgaaagggacctgtgctctcacccaccacctgcagcattagaacacacatttcctggatttctcactgtctccactccaaagtcttttgtgagtgcaggccactatttatatatgttcagaggagagttgcttttattttcctacccagagcccaagcataaagatagtttccagaatgactcatttcatgtgtggaaagatatttttaattcacattttcattgatagtcttcattgacattattttccctttactcttacttttgtcattaaaactcaagcactttgactactgccatctgcaaatgttcccaaggcttcttatgggcctgtttaccacttttttcagctttatctgtaatatatatttttttactatgaaaggatttatggtgatattgatcatctaaaggtacaaattcagaatatatgtattttattgttttctaaataatatttattaagattacttaaatataatccagtatctcaacatagacttttctgtgacaatttttttttacaattcaagaatcttcaatttatttgccatgaagcttctttttttataactgtttacttatgatttcatagtatacctttttgctagagtaataattagtaatagaaatgtgtgatggctatgtaaaatttaatgatttcattaacagtctctgaaaagagcttctaatattattaccagagaagctttaataatttacctcataactattatggctagaaatgtcattaaaatataatgttatagtataacaatgcactacagaatcactgattttgttttcaatcagttttgactttgacaaagatatttatatctatagaatacttcaaacatactttgtagaaagtatatagtttaatttcttactcagaatttagccttctgattttattaataatatgataaatgtgaacagtatattagttatgtaaagttaaagtactgcttatttaaataattatccagctgctagataataattaaattaaaataaattaagaatttatttaattaattcaaatccctcagaagtagataagataaaattaaacaccttttaataatggaacactcatctattcaaattccccatgagtagatggagcttttcatcagtaacccaggcaactactgaagctctttatagagctcttttctctacctctttctacttctcacaaatgaccattgcttctttattttgtcacaacataaactatatttcctattattgcaattaacttttagtattgtgtctcctgacatttagaaggaaagttggatttctcttcacctaaaaaataaaattgcataatttcattttctcacatttgaagcaaacttaatatataaaaataaatttgaaacttttttctctaagcaaaccaaatatgtgaacatttaaatctagagaaatgctaaattataaatactattcattttaataaaagtaatttctactaaaatttccaaagtagaacttttaaaaatgcgaactcttatgtttcgctatgaatattatttataaccaaactgttaacaatgattattgctgcttggtgctattgattgtcttttttcctgtttttctgtatattctagacattctataataagtacatatgtttatagcaaaataaataggtacaattataatacaatttgatttctaaaaacctaaaacaatatttttaataaagaagcaattcgtattggatgttgtgatccaccattcctgtcttctacccataggagtgcattagcataagtccttgccatcttagatttgacagttttcatgaactttggcaatacatacttttgggaatgccttctgcatggaaagtttcttcacattcggagggataaaatgaacaaagatagagcccaaaataatagaagtagtcagttaggtatgtaggggagggagaaagggggaagaagtgaaaatagaaaagaggttcttacttgcttccaaattctaaggccaggtcattagtgtgtaaaagtaaataaggccaaagggtttctttgtgaatggtgacatcttgagtatgtctaacaagaggacataaagaagcaggattgactgttgcaaaagtaattagtatctatatatatgtctatataatttggtatatatatatacacatatatatacatatatatgtgtgtgtgtgtctatataatttggtaatgctgtcgtgaccaatgaccactgaattcatttcctttgtatatctgatgtctataaaaagagaaataagactttaaatcataaaacaggctataattcataaagtatcatggtgtaataatatatggtttgaggaagtatcttaggctgacacttacagaaatataatgcaagccacatatatcattttaaattttctagcacatacatttaaaaagtaaaaaataaggccagcgtggtggctcacgcctgtaatcctagcactttgggaggccgaggcgggcggatcacgaagtcgggaaatcaaggccatcctagctaacatggtgaaaccccttctctactaaaaatacaaacaaaaattggccgggcttggtggcgggtgcctgtagtcccagctactccggaggctgaggcaggagaatggcgtgaaccagagaggtggagcttgcagtgagccgagattgtgccactgcagtccagcctgggtccgtctcaaaaaaaaaaaaaaaaaaaaaaggaaaaaattaaataatatattttatgtaacacatacacataactaatttaatatgtgaccaacataaaaattactaattagacactttatacctttttcatattttgttttcatattaagtcttcaaaatccagtgttattgtacacttacagcgtatctctatttgatcttgccacattttaaatgctcaatagctacatgtggctagcggctaccctatgggatagcacagtcgtagaacatgcaatactctttctgatactgtaaaacagaaaaagaggcaaaaatattggcataacagatatacgatatgaatttttaaatctgtgtaaagattaactattatttctttttaaaatatcttataaatcactttaataataacttcctaaaaagtggctagagctaagagagtgaaccatgtcaataaaggtttgtttttcttattctgacgtttgaatgtccttaatttgtctgtaatcacacatttacagatgcatttgtgagaatgtggggtgtgtgtgtgtgtgtgtgattatctcaagaaaatgaaaacatatttacctgtaatattttaattttcattttaaaataaactatgttgcactaataaatctgttgagataccaggattatgaattaaatatcttagatcttaatctttatggatgctaatgggcctcatgaagtgatatttatatctctatattctatctagaattctatattttatctagaattctatattctatatattctccctacatattctatatatctatatctatattaagatccttattaatatagacattaacatattaataagagctttattattaatatagatttgtataagctgagctgtattttaaatacatcaggaaacaatatttacagacataataattatttgagaaagtaattttcaaattttttgtaaatctgatttttattattgttattgtaactacattgcttttttttattataaaggtaattttatattccacaaagttttaccccacttgcaaatagactatgcatgtttatagtttaaaaattatatagattcatggtatcataaatttgaaatcttaagtattcccctcccctcaagaaaatagtattaactgcttaggttcccagggcaaagcgcgatggaagacttaaggtatccttctctgcttctgaaaatgaggggctactcctcaccccatgatcactacaccctgacccattgaacaacataaatggatattcctttagcttcaaatgtgccttggtttcttttttccctcttttttttttttttgagatggagcctctcactgtcgcccaggctggagtacagtggagcaatcttggctcactgcaacctacacctcccgggttcaagtcattatcctgcttcagcctcctgagtagccaggattacaggctcccaccatgaagcctggctaattttttgtagttttagtagagatagggtttcaccgtgttggccaggctggtctcgaactcctgaccttgtgatttgccttcctcggcctcccaaagtgctgggattacagatgtgagccaccatgcccggcccaaatgtgccttggtttctttgctttgtccagaagattgggtaagggaaaaatcagcatttattgaacatctgctctgtgtcagctactttctagttactttcacacacattgtctcatttacttctcaaaacctctatcagaaaagtatatttgctttattaatacagaaactcaatctcaaacgtttaccattccaagattagacttttggtaaatgtcatgtttgaaatccagaactgataaatgtgaaaataaatcttctttctgttacattatgaaatttcttcaagaggttttctagtgtttggaaaagtctgaagcaactgcctgtgggtttgcagaggtaagagtatcacgacaccagtcagtacaaaaatctgggttttatttattcatttgtaaactcaagccagttctctattccactttttccaattatttgcttttgagagtctcaggattatccttccttcctctccttccacattttctcccctgtcccttctcctggccatgcttctctagtcccgacggtcttgtttagatcacaatgcggtttgtagattttccttcactctctctttcagaaaaaaatgccaaaatggtgttttaagaagcttttattgctgtaataaacagaaagaaatagacatatggttaaaaagctcctcacagcattccatcttctcctcctgttcacatagatcttccttagttttcatgtaaatgaaataagtctttgggaacatgcagtcctgaattagatccaaatgcatttcccagaaaatcatagattaaatggattttggattgttaatttgataagttaattggattccttgtttgttggagaagaccagaatgagggctgaaaactcagtccaaatacgagacagagtgagtaatagctatgaaaattgtcccagatcatttgtcacctgggtgtatgttagaaaaaggtactactttctcatggcagatgtggccctatgctagggaacacatagtggtaggatcatgagctggatttcagccacaccacaccctgcagccaggtgtccttttgcagtgaacaacctgcaaaatcatgtatatgcagtgatcttccatctctctgttcttttctccttccacatataacattctgaaatcatatacttgagcttggattataaatagggccaatggcctagaaatatggagaaaaaaatgaaaaatataatatagtgaaagggaaacatgaagagttttcttagcccattggacacttggcttaacctggcaaatgttaacatgtggagaacatatgcaaatcagttatccataagtcagcatcacttgcagtttaaaaaatataaatatgatatcaaaactcaatattatagttttatgaattataaagtatttttaaatattttcaaattgattttattaatgttattctcagaaatggaaactattttaacaaaatatttgtgtccatgtatgtagccacagagattagacacagacacagcatgctataatgacaatgaattatatctcgatcaataagtatttacaatatataaaaccccaaaagtctggagagtcaccagaacgagtacctgttactactgattttaaaatccatattgaaaaactttaaaaaatctaaagttatgcattgttcaggtagaaactagacacactaacttctaagaagctaaaattttgtagctatactggtacgttagggccactagctggtcacttaattgaagacattagaaaatcatataaaatgacatatatagcttaagcattttattttaattgaaagtatttatcatggagtcagacacaatggatagtgcttgtagtcccagctactcaggaggccaaggtgggaagattattagatgtatatgtgtgtgatacacacacacatatacacacacattctatttccaatgtttggagggtgaaggcctcttattttagtatggttccactgattggagatctgaatttttttgtgtacttatgaattttagcataaattcatttaaagagggacaacaaataaaatcttttgtgaagactaaaaatttcttttgtacaatacaaaagatgaaacaaaatgttggttctttgaaaaaataaataaaattgatagaccattggcatgattaaccaagaaaagaagagagaaaatccaaataaccccactaagaaacaaaacaggagatattacaactgacaccactgaaatacagaagatcactcaaggctactatgaacacctttacatacataaactagaagacctagaagagatggataaattcctggaaaaaatacaaccctcctagcttaaatcaggaagaattagataccctgaacagactaataacaagcagcaagattgaaatggtaatttaaaaattgccaacaaaaaaagtccaggaccagatggattcacagcagaattctaccaaacattcaaagaattggtactaatccttttgaaacaataccacaagatagagaaagaaagaaccctccttaatttattttatgaagccagcatcaccctaataccaaaaccaggaaaagacataacccaaaaagaaaactacagaccaatagccttgatgaacacagatgctaaaatccttaataaaatatttgctaactaaatccaacaacatatcaaaaagataatctgccatgataacgtgggtttcataccaaagatgcagggatagtttagcatatgcaagtcaataaatgtaatacaccatataaacagaacgcaagtcaataaatgtgatacaccacataaacagaattaaaaacaaaaatcacaactaagagcagaactgaaggaaatagagacacaaaaaacccttcaaaaaatcaatgaatccaggacctggttttttgaaaagatcaacaaaagtgatagaccactagcaagactgatgaagaaaagagagaagaatcaaatagaggaaataaaaaatgataaaggggatatcaccaccaatcccacagaaatacaaactaccatcagagaataatataaacacctctatgcaaataaactagaaaatctagaagaaatggataaattcctcgacacatatacccgcccaagattaaaccaggaagaatttgaatctctgaatagaccaataacaggctctgaaattgaggcagtaattaatagcttaccaaccaaaaaaagtccaggaccagacggattcacagccgaattctaccagaggtacaaggaggagctggtaccattccttctgaaactattccaatcaatagaaaaagagggaatcctccctaactcattttatgaggcaagcatcatcctgataccaaagcctggcagagacacaacaaaaaaagagaattttagaccaatatccctgatgaacatcgaagcaaaaatcctcaataaaatactggcaaactgaatccagcagcacatcaaaaagcttatccaacatgatcaagtgggcttcatcgctgggatgcaaggctggttcaacatatgcaaatcaatgaacgtaatccagcatagaaacagaaccaattacaaaaaccacatgattatctcaatagatgcagaaaaggcctttgacaaaattcaacaacccttcatgctaaaaactctcaataaattaggtattgatgggacgtatctcaaaataataagagctatttatgacaaacccacagccaatatcctgaatgggcaaaaactggaagcattccctttgaaaactggcacaagacagggatgccctctctcaccactcctattcaacatagtgttggaagttctggccagggcaatcaggcaggagaaggaaataaagggtattcaattaggaaaagaggaagtcaaattgtccctgtttgctgatgacatgattgtatatttagaaaaccccatcatctcagcccaaaatctccttaagctgataggcaacttcagcaaagtctcaggttacaaaatcaatgtgcaaaaatcacaagcattcttatacaccagcaacagacaaacagagagccaaatcatgagtaaactcccaatcacaattgcttcaaagagaataaaatacctaggaatccaacttacaagggatgtgaaggacctcttcaaggagaactacaaaccactgctcaaggaaataaaagaggatacaaacaaatggaagaacattccatgctcatgggtaggaagaatcaatatcgtgaaaatggccatactgcccaaggtaatttatagattcaatgctatccccatcaagctaccaatgattttcttcacagaattggaaaaaactactttaaagttcatatggagccaaaaaagagcctgcattgccaagtcaatcctaagccaaaagaacaaagctggaggcatcatgctacctgacttcaaactatactacaaggctacagtaaccaaaacagcatggtactggtaccaaaacagagatatagaccaatggaacagaacagagccctcagaaataatgccgcatatctacaaacatctgatctttgacaaatctgagaaaaacaagcaatggggaaaggattccctatttaataaatggtgctgggaaaactggctagccatatgtagaaagctgaaactgaatcccttccttacaccttatacaaaaattaattcaagatggattaaagacttaaatgttagacctaaaaccataaaaaccctggaagaaaacctaggcaataccattcaggacataggcatgggcaaggtcttcatgtctaaaacacaaaaagcaatgacaacaaaagccaaaattgacaaatgggatctaattaactaaagagcttctgcacagcaaaagaaactaccatcagagtgaacaggcaacctacagaatgggagaaaatttttgcaatctactgatctgacaaagagctaatatccagaatctacaatgaactcaaacaaatttacaagaaaaaaaataaacaaccccatcaacaagtgggcgaaggatatgaacagacacttctcaaaagaagatattaaacagccaaaagacacatgaaaaaatgctcaccatcactggccatcagagaaatgcaaatcaaaaccacaatgagatatcatctcacaccagttagaatgtcgatcattaaaaagtcaggaaacaacaggtgctggagaggatatggataaataggaacacttttacacattggtgggactgtaaactagttcaaccattgtggaagtcagtgtggcgattcctcagggatctagaactagaaataccatttgacccagccatcccattactgggtatatacccaaaggactataaatcatgctgctataaagacacatgcacacgtatgtttattgcggcactattcacaatagcaaagacttggaacaaacccaaatgtccaacaatgatagactggattaagaaaatgtggcgcatatacaccatggaatactatgcagccataaaaaatgatgagttcatgtcctttgtagagacatggatgaagctggaaaccatcattctcagcaaactatcacaaggacaaaaaaccaaacactgcatgttctcactcataggtgggaattgaacaatgagaacacatggacacaggaaggggaacatcacacaccagggcctgttgtggggtggggtgaggggggagagatagcattaggagatatacctaatgttaagtgatgagttaatgggtgcagcacaccaacatggcacatgtatacatatgtaacaaacctgcaccttgtgcaaatgtaccctagaacttaaagtataataaaaataaataaataaataaaaatcacataatcatttcaatagatgcagaaaaagcattcaacaaaatccagcattactttattattaaaactctcagcaatgtcggcaaacaagggacatatcttaatgtaataaaagccatgtatgacaaacccacagccaacacaatactgaatgggaaaaagttgaaaacattccttctgagaactggaacaagagaaggatgcccactcccaccactcctcttcaacatagtactggaaatccttatcagagcaatcaagagaaagaaataaagggcatccaaattggtaaagaggaagtcaaactgccactgtttgctaacaagatgattgtttaccttgaaaaccctaaggattcctccagaaagctcctagaactgatataagaattcataagtttctgggtacaagattaatgtgcacaaatcagtagctcttctatacaccaacaatgactaagtgaagaataaaatcgagaactcaacaccttttacaatagctgcaaaaaaagaaaaaatacttaagaatatacctaaccaagaagttgaaagacctctacaaggaaaactaccaaacactgctgaaagaaataataggtgacatgaacaaatggaaacaaatcccatgctcatggatgggtagaactgatattgtgaaaatgaccatattgccaaaaacaatctacaaatcaatgcacttcccatcaaaataccaccatcattcttcagagaattagaaaaaacaattctaaaattgatgtggaaccaaaaaagtgcccacatagccaaagcaagattaagcaaaaagaagaaatctgaggcatcacactacctgatttcaaactatactataaggccatagtcaccaaaacagcatgggattggtataaaaataggcacatagacccatggaacagaatagagaacacagaaataaacccaagtacttacagccaactgaacttcaacaaagcaaacgaaaacataaagtagggaaaggaaccctcttcaacaaatggtgttgggataattggcaagccacatgtaggagaattaaactggatcctcatctctcaccttatacacaaatcaactcaaaatggattaaagacataaacctaagacttgaaactataaaaattctagatgataacatcaggaaaacccttctagtcattggcttaaacaaggatttcatgaccaagaacccaaaagcaaatgcagtaaaaacaaagataaatagctcggacctaattaaactaaagagcatttgcacagcaaaaggaacagtcagcagagtaaacagacaacccacagagtgggagaaaatcttcacaatctatgcatctgacaaaggactaatatccagaatctacaacaaactcaaatacaacagtaagaaaaaaaaccatcccatcaaaaagtggtctaaggacatgaatagacaattcccaaaagaagatatacaaatgtccaacaaacatatgaaaagatgctcaacatcactaatgataaaggaaatgcaaatcaaaacttcaatgcgataccacctcactcctgcaagagtagccataatcaaaaaatcaataaaacagtagatggtggtgtggctgcagggaacacttttatactgctggtgggagtgtaaactagtatagctgctatggaaaacagtgtggatattcctttaagaactaaatgtagaactaccatttgatccagaaatactgctactgggtatctactcagaagaaaataagttattattcgaaaaagatatttgcacacgcatgtttgtagcagcatgattcacaattgcaaaatcatggaaccaatccaaatgcccatcaatcaatgagtggataaagtagctgtgatgatggaatactgcacagtagtatatgatggaatactacacagccattaaaaggaatgagttaacagcatttgtagtgacctggatgagattgaagactattattctaagtgaggtaactcaggatggaaaaccaaacatcatatgttctcaccgatatgtcggaactaagctatgaggacacaaaggcataagaatgacacaatggactttggggatgtgggggaagagtgggaggggggtgagggatagaagactataaatatggtgcagtgtatactgcctgggtcatgggtgccccaaaatctcacaaatcaccactaaagaacttaatcatataaccaaataccacctgtacccaaataatttacggaaaataaaataaaagtcaatgtaccccaggatatgggggaacagaaaaaaatgtactcaataactatatctgaaataaataaatgacctaacctcaaaaataaataaaatgataggaaaaaataaaataatcgtaaaaatttgttttgtttttcccagactcttatctacatctaaatagaagatattattttgcaactcaatgtttagatctttctaacagattcgtcttagatttcataaaaacataagccctctcgaacataaaataattgttgttttaacatttgattaaatatgtacttacaatgcaaacgaaaattgtataaacagaatttggaacaaacacaactattgtgaagaacacaatttaactggcattaattgacgtacatgaggatattaaagtgtaggacactagctacaggtatttaatgggacataggcatgggtcatgctttgtagagtcaggttatttggcagatttgtaaaatggaatctggttaggaaatttttgctgaaaacttaagtgatcagaacttagcaagggctgcgtgcactggctcatgcctgtaatcccagcatgtttggaggctgaggcaggtggatcagctgaggctgggacttcaagaccagcctggacaacatggcgaagtgtcatctctactaaaaatacaaaaattagctgggcatggaggcacatgcctataatcccagctacttgggaggctgaggcaggagaatcgcttgaacctgggaggtggaggttgcagtgagccaagattgtgccattgcattccagcctgggcaaaagagtgaaactccgtctcaaaaaaaaaattatatatatatatatataacttagcaaggatattgcaagaaagcttcatggattctaaactaatatctttccattttaagtgatggcagtcaaactcaatgaagcaagagaaaaaataacaataaacaaaataatttattggtttatacaactaggaagttcaggcatttatctttcactaatgcctgtatccacaagttaaactaatctcactaggattgtattttccaatcctttgttcttttttcactttgcattagcttccttctccaggaagtttccccatgttatggcaaaagtagctacattgtctttacagccaacaagcgacattatctttatagccctgtgaaaaagtcccttttcctgattgttctaggaaaaatctgttatgacttactggctggagttgggttacatgcacacaatgaacaatttacttgggccaggggatggaatttgttgttcagttattgcttggtaacagacctgcccctaggaattggtaaagtcctttttggaaccctggactaccaagaggatgggtgtgtcacttgcaatttttaccaaaaaaatcatgtttcatccatctgggagtcagacatttcataatctttaaaatattcctgcagctctcagaattagttaataggactgtctccatttgagcttggatatgctttgtcttttttgtgtgattctatttcttctttcatgttgatatataatgtacatatttatggggtacatgtgatattttgacacatgcatacaatgtgtcatgatcaaatcagtgtatttaaaatatccataatctcaaacatttgttatttctttgtgttagaaacatttcaaatcttctcttccagctattttgaaatatacagtatattgttgttaactatagtcaccttactgtgatttggaacactagaatttgttccttttatgtaactataattttgtacccattaaccagtctctcttcaccctctcccctgacccttcctagcctctcatattgataattctactctgtacctccatgagatccacctttttagctcccacaaatgggtgagaacatgcaatatatgtctttatgtgcctgtcttatttcatttaatataccgacctctaattttatccatgttgctgcatatgacagcatttagttattttttatacctcaatcgtattctattatgtatgcatgccacattttctttatccattcatttcttgatggacatttacatagattccataacttggctattgtgaatagtgctaccttaagcactagggtgtaggtatccctttgaaatgctgattttcgttcttttgggtaagtagtcagtaataggattgctggatcatgtgatagttctaatttcagttttgaggaacctccatacatttttaaataatggctttatttatattcctaccaacaatgtataagacttcccctttttctgcattctcatcagcatttgttaattgtctttttgtaatagccattaaaactaggataatataatcggtttcttcttattaccaaatcatctctgcttctccatgccactgtatccccagttatacctgtcatttcttgcatttcttggtacctaatattttagctgtcttttattcgggtcaacatttaaattacagattttcctccaaatttctcagaggcagtaatgtttctagtgctattgctttgtgtatttctatttataactgccttcatatgatttcgggaaatataattccctgtgggaattttctagaattcctaaattgactcctgctcaagacttacgataagaaaagtttttgtagacttccataaacaaaactcatatctgtatatctgtagctgtgtgtctgtatctatatctttatcacttatacctatgaataactatatctacatataaatctgtatttatgtctatatataatcaatcatctcctggatagagtgatacctgtaagtgatttccatttttcaaaagcaagtcatacttctgttatcctctttcttctaaaagtaccatattgaaagtcctagccagggcaatcaggcaagaaaaaaaataaaataaaaggtgtccaaataggaaaagaataagtcaaactgtttctcttcatggatgaaatgattctgtacctagaaacccctaaaaactttgccaccagtccctgataaatgacttcagtagagtttcaagatacaaaatcaatgtacaaaaatcagtagcatttctatataccaataatgttcaagctgagaaccaaatcaagaatgcaatcccagacagatatggtggctcatacctataattccagcattttgggaggccaaagtgagaggatcacttgagcccaggagtgtatgaccagtcctggcaacatagtgagactccatctctacaaaaaagtttaaaaaattagcttggtgtggtggcacatgctatagtcccagcactcaggaagctgaggtgggaagatcacttgaccccaggaggtagagggtgcattgagctgtgatcatgccactgcactccagcctgggtgatagagtacaacactgtcttaaaaaaatgcaatcccatttacaatatccacacaaaaaaataaatacgtaggaagacatctaaccaaggaggtgaaagaaagacctctataaggaaaactacaaaacactactttagaaaatcatagatgacacaaacaaatggagaaacactccaccctcatagcttggaagaatcagtattgttaaaatggccatattgcccaaaacaatctacagttttaacactatttctatcaaatgaccaatgtcatttttcacataatttgaaataagcgattctaaaatttatgtggagctaaaaaagggcccaaatagccaatgcaattttaagcaaaaagaacaaagccagaggcatcacatgaccagacttcaaactgtactataaggctacagtaaccaaaacagcatggaactgtacaaaacagacacatggaccaatggaaaagaatagagaacctagaaaataagctacacatctgcaactgtcagtctttgataaagttgacaaaaataagcaatggtactgggatagctggctagccataagcagacaaaactggaccccttcttttcaccatatataaaaattaagtcgagatggagagaagactgaagcctaagacctcaaaatataagaaccctaggagaaaacctaggaaacagtattgtggacattggccttgggaaagaatttatggctaaatcctcaaaagcaattgcaacaaaaacaaaaattgacaagtgggacctaaattaaactaaaaagcttctgcacaacaaaagaaactatcaacagaataaacagaacctacagaatgggagaaaatattcacaaacaatatatccaacaaaggtctgatatctagaatctataagaaacttaaacaattcaacaagcaaaaaacaaaaaaactcacctaaaaagtagacaaaagacataaacagatgcttcttaaagaagacataaatgaagccaacaaacatgtaaaaatgctcaacatcactaattatcagagaaatgcaaatcaaaacaactaggagataccatctcccaccagtcagaatggctattattaaaaagtcaaaaaataacagatgctggtgaggctgcagagaaaaggaaatgcctgtccacagttggtgggaatgtaaattagtttagccactgtggaaagcagtgtgcagaattttcaaagaaaaaatggaactactaataaacccaacaatccaattattgagtatatatctaaaataaaataaatccttttagcaaaaggacacatgcacttgtatgttcattgcagtactattcacaatagcaaatatatgaaatcaatgtagttccccatcaacagtgtattagataaagaaaatgtggcacatatataccatgaaatagtatgcagctataaaaaagagcaaaatcatgtcatttgcagcaatatgaatgcagctggcggtcattaacctatgcaaattaacacaggaactgaaaccaaatactgcatgttctcacttgtaagtggaagctaaacattggacactcatggacataaaggtgccaactgtagacaatggggactaccagagtggggagggagagaggggagcaaggattgaaaaactaactattggatagtatgcttagtacctagctgacaggatcaattgtaccccaaaccacagcatcacgcgatatacctatgtaacaaacctgcatatatacccctgaatctaaaatgagagttgaaattatgaaaaagaaaatctctaatttaggcatttttcctctgaaaggtgcaaattgtaattttcgcaataaaacatatattcccctccccccaaaaataaaactactatatcgatattttgacataatctatttttaacaaaatgattccttgttgcaaggttgcaatgctttcattttaaccttttgtaacaattgtgtgtgagttacatatgcacacattctctattctcttggggcaattgctgcatgattagtttgatctctgaatattgccactcttgaatttgtgtcagtggcatttctatacattttgggtcccaaacacatgttaattcaaggcttcccaagctatgaattaatgacaaaaatgagctgatcttcagatcctgtgaaatatagtggggtttgacattgcttttataaagagagaaaactaagactctgctagagacaatctatcttttctgactacagcattcttatttcctattttaacttttttgcacttccatatgcaagtaagagccatatgagtaattaattttccataatatcatatattgattttttagctttaatgaaaatagtatttcgaggtgtttttttaaaaaacaaatctagcactttagaagactcagaaatttcagctaggaatattccataaaaatttttttctaaaaacaagagaaatattgggtcagtacagggcagccatgtcaaagacctgcatttctcttttggtcttagattgccaaacttcacaggagtttttaggaagatagagctatgagatttgtatttgctcccagaaaagttgggcatttacatgcagttagtattcaacgatatattgttctgcctaaatttcgcaaacgacatactctaagtgttttgaattattttcattatgtaattttggctgctttgtgagggtagtaccattttctgatgttacttaatattaatccactcttcactcagaaagatgggcaaggatttttactaaaataccatatacccaacttctgctttagaaaggataaagtgatattgaacttgaaaaggtttgatgctttttgcacatactacgttaatatttatttatccatttgtgtttgttggacaaacgttgttttagaaagaattgcagggacttatttggagaaaatatttgtcatagaatgtaaaatgtaaatcaaattggagttactatccaagaagaaatgacatgtgtctgaataatgcaatgagagttagtcaagtattttacacagaacaattttatgtgcttaagcagttacactcaagaagtactgtggtctcatatttattcatgccatttctcaaatatttaagacagtttcaaagagaagaactataatgtatgtaacttgaacaaattcttcaatagtgaaggaactatcaatagtttttaatgcatggaaccatagaatatcatttagcaaactgtctcaaccactcattctgtgtcctgcataacaagggaagtctttgagaagaaagtgatgtttttttcttcttctcaggaagatctgatacattacactgtgttcttatgttccctttactagatagaaaagaaaaagaaatatgcagccttttacaattacttgttcttaaatagaaagatatagaaaataagattaaatgcttatatgcatttaattttttaacattttacctactctttttacataaatgacagtaaggaaaacatgtcagcaacaaaaataatttttataatagtataccaaggcaaaaaattgtgtttacccccattttgtaccttgcattttctagtctaaactgtttttaccttgtgtgttcatcttagaagactgatcacagcagcctcttctggaatattggagagatccctccagagtaccaaagcacatgtaataatagcatgaatgctttacagtgcataagttacttgatttgattacattttcaagaagtagatgatgccaatgctttttttttctaattcagtataatatgggagctaaaactgacaaagataatataaaaaaagattatttatggatctaaaatgtgaatatcaatataaaaatcctaaaaattctatttggaaacataatctagcagcactttaaagaatggcacacccaaaacaaagttcatttattctaggaattcaataaagcatctcattttttaaaaaaaaagatattaccatttttcacttaaatataagtcaggggaggaaaatcatatccttatctttatggcagctaaaaaggatttgaggacagtttcatctattttttgacacacattcttaataaaataagaatagatgaaaactttcatgatatgataaagtgatctaaaaaaagaagtcagctacattcttacagtaaacaccagaaccattgccatgaaagtgatgagcttgctaacatttttaactaaaatagtaaatatgaaatagttaaagggggaggcagtattattattttttctcatgatattatcagatttgattatctatggaaagtcaatgacaaaatttttaagaaatataaaattaagtgaggtaaaatcttgcaagatgaatatgtacacatttattttataatagctctttgtcaattttaaaggaagaagaggttacatatatgatagcaccccaaatactaaatatctagaaaaaagttaccaagtaatataaaggtgctgtatgaaacaaacaagcaaaaaaccctcaaatgatgtaaaataagacagttcagacagaacttgttcttggataggaaaatgctttgctgcaaagatgtcttttatcactaaattcattagcccaacgtaaactttaaaaaatagtagtaggattttttggttgttatattgattctaatgtctacacggaaaatttaacaagcaaaagtacttagaaaatactttcaaaatactgagagattggaacataaatattttagtggacagattaattgaagaactaagtcagaaagaaaaaaatgagaatttggcatacaataaaaatattatttaaagagagtagggaaaatagtgtaacaaatattttgttttagacaaatagtgaatagaggtgaatatattccagctggatcacaaagctctatacaagctgtgataacactgctataaaaaattgacagatttattttcttacctctggtatctctgtttgtttgtgttgctaaaaaggaatacttgaagctaggtaatttattttaaaaatagagatttttttttttggctcatggttctgcaggccatacaagaagcatggtgcaggcatctacttggcttctggtgaggacctcaggttgtttccactcatgactgaaggcaaaagggaaccagagatcacatggtgagagacaaagcaaaagaataggaaggtgccaggctcatgtggaaactagcagagtgagaactcacgccttaccccgaaggatggcattaatctattcatgaggggtcagccctcatgacccaaaaacttcccattaagctcaaccttcaacattggaggtcaaatttcaacatgagttttggaggggtaaaatatccatagcagctgggaatgtaggttggttaatggtttcaaaatatagttagattgaaggaatatctcagcgtttgatagcacagtagggtgataatagtttataatttattgtatattttaaagtaggtagcagagaagatttggaatgttccaatcacaaaaaagaataaatgtttgaggtgatggatttcctaattaccttgatttgatcattacacaatttatgcatgtatcataatatcacatgatgtgccccatgaatatatacaattattgtgtattaataaaaaatttaaaaatcataaaataggtaaaaaacataaattgaaatattcatctcagagtaatatacttgatcttagccaaaaggctgagaagtgattcatctaagaataataaaaaattagtattctacatggcaaaaggtttaataaataaagcataacatacaaacagcaagctgtaatattgttgcatacataaaaaagaaattgttttgtcatatacaaatgactcttaccaacgaatagtaaaatctcaaggaggtgaagagaaatacaattagaatgaaaagatagtttctaaaaggaacaaaaattcctgtctaagtcaatttaacttataattttgaaaatatttagtttccattttttgcttatcacactggcaaatttttgaaattttattaatgtatgaaattttcctagaagttagaaaacaagaatcttatgtaatttaggtaggtgtgtcaattgatgcaacatgtttcaggactgatttaaccaaacctatgaaaagtaaaaatctgaatactaaaacagtgtgtgtctaaaagtttatactaccaatataaacacacttgtttgttcagaggttcaaagatagatgtacaataatttctattacactttttttttgcaataggaaacaagtggccatcaaggcacaggttaaataacttatgaaacattcacacagtgggagattgtagtcaatgaaaaagaatgaggaagatcataagcagacgtataaggatttccaatacatactgaaaaatcaaaaagtgccagaatgtgtgtagagattgattttagttgtgtatcgttatctagtgtatatctatttacaactcctatttatatacaagtattaatcgatatgaatttattattatataaatattcattatataatggaatgcattttagaatgtgacttaagaagtcacaagtactcaagtttgaagtctagttgtattatgtcctatttgtgaggccttagatgaattacataaacttctctaggtctcatttttcttctttgtaaaatggggataataatgatacttatctcagagggttgttataagaaatttttttgtgggggtgaactgtctgactagaaaatatcagttctatttatcttctcaaagaaatagccttggtttcattaattttctccattgatttttctctttcgttgatttctccttttttattatttaaattcttctgtttgtttggggtttaattcactcttatagtagcttaaggaagtagctcaagttgttgatttgagactttttttttattttctaagctagccatttaatgctgttctaagtactgcttttgatgtatacacacattttaatatattatctttttgttttcatctcactcaaaatgccttccagttttcctgtagatttctccttggcccatggtttacttgaaaatatcaattttcaagtaaatttttaaattttattgttatttgaaaatatttagttaccatttttctatatgttattattaattgtgtaattattttgtatttttatacattttttcatttagtggctttgaacttaattccattttggccaaagatcatgttttgtattatttgaattgccttaagtttatttagacttgtgttatggctcagaatagggtctgtgtcgataagtgttccattacacttttaaaaatgtgtattctggtatattggatgaggtattagtttttatcaaatattgggtggaaaaattttggaaattacatcttcaaatgcctacttcctcttttctgagtacactctaaatacataagattaggctcactgaatttgtcccatgtttcactgtttctctgttctaatatgtatgtgtatatacttgattttttttcttctctgtgtcttattttaggtgaatttctattggtgtgtcttcaagttcaccaatattttcttctgcagtgtctaatctactgtacatcagaaccattatattttttatatcagacattttagtttccatctctagaaatttaatttgactcattttatattatgtttttacttaaaatgctatttttttcactaacttcataaacattatgggatatgtgtttgataatgatttttatgtaattgtcttctgattctaatatctctcttatttctggttttctttcagttaattaatttttctctttattatagattatatacccatgcttctttgcatgctttgtaattttgcattggattccaagcatttaaattttactttgttgggtgctggattaaatatgtataagttttcttgagctttgttctgagacactgttaagtactcagcaacaattttatatgttcttgtcttgcttttaatctttctcaggcaggatcagaacagtgtttagtttaggtctaattttccccactgctgaggaaaaactgttctgcatactctgtccaatacaccatacgttttgaaggagcccctgcgtgcacatcagaggttgttccctctaataatgctggatgattattctcagttttgggtgctttcctcacatgcaaggatgctcacccagtacagcttcccagaaacgctggaggcagtcagtaaaggaattagatagaattaaagagaatgatactgaaataaaacctggaagactctcagaggaaggaaggagatggggagggggggcattggataattgcaataaatatagaaattgacacaatttcaaaatatatattgtatcaggctgaccaggcagaccctcagtcagatttcagagacaggaaggatagtcatggtaagtgatatgaatcacaccttagcatactctttctttggaagtagcatcttaacactatctttcatggaagactgatagccaaacttgtaagagttttaggagagctaaggctcatcagagaaaagaatgagcataatgaaataaacttggagcaagaaatttttaagcaacaaaaagaagagtaaataaaatcatgggttcattaaaatgagatcaacataatggtgtgtgtttaatgcaatactagtataaatcaaggaaggagaggatattaggagagaagtggcccctcaatgctgagagcacatgaaggatattgattgataatgtagcacttgatttcacatttagaataacactagttaccttcaacagagaagtttcaggaggatagtattacaggaggaagcaaggaagggggtaataattcaatgcttgatgtggaagtagaactggctaaaatggacaataaaactggggcccaataaaaggcaatgagcctcatattcccataggtatttttacattgttctaaatgccttgcctatagcagtaataaaaccaacaggtaatgaatacaattctcttctcctttgacaatacttgcagaaattttacctcacgtaaatggagtttagatgagtactcatagaataacctatatgaactttatttgaagaataaaaaatgaggaagcaaaaaagtaattttacctcattggaaaatttctactatacaaaaaagttacaggataaaagaacaaaactattactagaattgtgtagcaacaggggaaatatactttctttcagtaactaaatgtgttgttacagaaaagtaacatgtttttacctcaatttaagtttttcctctttaacatatattgattgaaaaataataatgctctataagaataaaattaacagtgaaagtagtagggtttgaattaaccattcaaaaaagcgtttctatatagctcataaatgttcattttatgcttagataagtgataaaggtaatgtgtatgagcctacataatttatttgatacccttgcattggattttgtcctaagttcttgatgttttaacaacaaaattttatcttttcccgtctctttttgagaatggcactattttaaaatgatctgaatttcaaaaagtatgtcccctagcttggaaacttctcagaataatgaattccaaaatcaagtacagacttcacaccatctgaacaaaaatatattgagtgtctgctgtttgcattgcatgacattgtgatagatgttcttttaactccaaaagagaaaaaattaaaaactgacttgaaacaaataccttttaactctcttatactagcttaactttttattgtttgccttatcaagttcattatatttcaggctttgttaaggacataactaattgtgttttgtgcatgataggagttgcatcctaatcacttaattacattaagtgatttacttttgtttctacagtttagttaaaacaagtaataagatacagtttttaagcttgaaaaataacttagattttcaatacctttataaaaattggctgaaaacattactgagactatcttcaatggtttctgcaaacacattatatgtgatgataattctggagtttctgacagaggcaaattattttgccacgagttaaaattatgtgccacctcccttagttcaatcattgattaacaggatttcatgtaatttaatggtcttatttttcaaaagaaagtgtgtgtatgtgcacgtgtgtgtgtgggggggcggctcagggtacatttagatgaagaagtcacaaaaaatacagtaactcaaaggttacaccttaaaacctatgtgtttatttattttttactgtgataaaaaacatgagacctatcctaacaaattttatgtgcacattacagcattatcaactgcaatcacaatgttgctcagcatatctctctaatattttcaccttgcataactgaaattttatattcattgcacagcaatttcccatttcaccttccctgcagcccctggcaaacaacattctattttctgctatcaatatggctattttagacacctcatattagtggaatcatgcagtatttgtcctcctgtgactggcttatttcacttagaataatattctcaaactgcatccatgttgcagaatatgagagtaattccttcttatttatagatgaattaccacattttatttacccattcttttgtcaatatcacttagtttccaccacctggccattgtgaataatgctacaacaggacatagtagttttttgagatcctgatttcaattcttttgaataaatatccagaagtaagaatgctgaatcacatgatagttctatttttaattttttgaagaatcttcatactgttttccataatagctgcaacatttcgcattatcaccaacagtatgcacgagtttcaatttcaacatgtccttaccaatttgtagttttctggtttgtgtttgtttgcttgtttgtttgattgtggccatcccaacacctgtaaggcaatatctctttgtgattttgatttgtgtttgtgtaataattagtgatactgaacatcttttcttatacctgttctacatttggatgtctttggagaaatatctattcaaatctcttgcccattttttaaagggttttttgatttttgctactgagttatagatgttccttatatattttgaatattaaccatttatcaggtatatagtctgcaaatattttctctcattccataggctgcctttttctctattgattatttcctttgctgcacaaaaactttttaatttgatataatctcatttgtctatttttgcttttttgtgcctgtgcttttggtgtcgtatccaagaaatcattgccaagaccaatgtcatcaggcttttttctttttctttttctttttttttttttttatactttaagttttagggtacatgtgcacattgtgcaggttagttacatatgtatacatgtgccatgctggtgtgctgcacccaccacctcgtcatctagccttaggtatatctcccaatgctatgcctccccgctccccccaccccaccacagtccccagagtgtgatattccccttcatgtgtccatgtgatctcattgttcaattcccacctatgagtgagaatatgcggtgtttggttttttgttcttgcgatagtttactgagaatgatgatttccagtttaatccatgtccctacaaaggacatgaactcatcattttttatggctgcatagtattccatggtgtaaatgtgccacattttcttaatccagtctatcattgttggacatttgggttgtttccaagtctttgctattgtgaataatgccgcaataaacatacgtgtgcatgtgtctttacagcagcatgatttatagtcatttgggtatatacccagtaatgggatggctgggtcaaatggtatttctagttctagatccctgaggaatcgccacactgacttccacaatggttgaactagtttacagtcccaccaacagtgtaaaagtgttcctatttctccacatcctctctaacacctgttgtttcctgactttttaatgattgccattctaactggtgtgagatgatatctcatagtggttttgatttgcatttctctgatggccagtaatgatgagcattttttcatgtgttttttggctgcataaatgtcttcttttgagaagtgtctgttcatgtccttcgcccactttttgatggggttgtttgtttttttcttgtaaatttgtttgagttcattgtagattctggatattagccctttgtcagatgagtaggttgcgaaaattttctcccatgttgtaggttgcctgttcactctgatggtagtttcttttgctgtgcagaagctctttagtttaattagatcccatttgtcaattttgtcttttgttgccattgcttttggtgttttagacatgaagtccttgcccatgcctaggtcctgaatggtaatgcctaggttttcttctagggtttttatggttttaggtctaacgtttaaatctttaatccatcttgaattgatttttgtataaggtgtaaggaagggatccagtttcagctttctacatatggctagccagttttcccagcaccatttattaaatagggaatcctttccccattgcttgtttttctcaggtttgtcaaagatcagatagttgtaggtatgcagcattatttctgagggctctgttctattccattgatctatatctctgttttggtaccagtaccatgctgttttggttactgtagccttgtagtatagtttgaagtcaggtagtgtgatgcctccagctttgttcttttggcttaggattgacttggcgatgtgggctcttttttggttccatatgaactttaaagtagttttttccaattctgtgaagaaagtcattggtagcttgatggggatggcattgaatctgtaaattaccttgggcagtacggccattttcacgatattgattcttcctacccatgagcatggaatgttcttccatttgtttgtatcctcttttatttccttgagcagtggtttgtagttcttgaagaggtccttcacatcccttgtaagttggattcctaggtattttattctctttgaagcaattgtgaatgggagttcactcatgatttggctctctgtttgtctgttgctggtgtataagaatgcttgtgatttttgtacattgattttgtatcctgagactttgctgaagttgcttatcagcttaaggagattttggactgagacgatggggttttctagataaacaatcatgtcatctgcaaacagggacaatttgacttcctcttttcctaattgaataccctttatttccttctcctgcctgattgccctggccagaacttccaacactgtgttgaataggagtggtgagagagggcatctctgtcttgtgccagttttcaaagggaatgcttccagtttttgcccattcagtatgatattggctgtgggtttgccatagatagctcttattattttgaaatacgtcccatcaatacctaatttattgagagtttttagcatgaagggttgttgaattttgtcaaaggctttttctgcatctattgagataatcatgtggtttttgtctttggctctttttatatgctggattacatttattgatttgcctatattgaaccagccttgcatcccagggatgaagcccacttgatcatggtggataagctttttgatgtgctgctggattcggtttgccagtattttattgaggatttttgcatcaatgttcatcaaggatattgatctaaaattctcttttttggttgtgtctctgcccggctttggtatcagaatgatgctggcctcataaaatgagttagggaggattccctctttttctattgattggaataatttcagaaggaatggtaccagttcctccttgtacctctgatagaattcggctgtgaatccatctggtcctgggctctttttggttggtaaactattgattattgccccaatttcagctcctgttattggtctattcagagattcaacttcttcctggtttagtcttgggagagtgtatgtgtcaaggaatgtatccatttcttctagattttctagtttatttgcgtagaggtgtttgtagtattctctgatggtagtttgtatttctgtgggatcagtggtgatatccactttatcattttttattgtgtctatttgattcttctctctttttttcttagtagtcttgctagcggtctatcaattttgttgatcctttcaaaaaaccagctcctggattcattgattttttgaagggttttttgtgtctctatttccttcagttctgctcggattttagttatttcttgccttctgctagcttttgaatgtgtttgctcttgcttttctagttcttttaattgtgatattagggtgtcaattttggatctttcttgctttctcttgtgggcattcagtgctataaatttccctctacacactgctttgaatgcgtcccagagattctggtatgttgtgtctttgttctcgttggtttcaaagaacatctttatttctgccttcatttcgttatgtacccagtagtcattcaggagcaggttgttcagtttccatgtagttgggcggctttgagtgagattcttaatcctgagttctagtttgatttcactgtggtctgagagatagtttgttataatttctgttcttttacatttgctgaggagagctttacttccaagtatgtggtcaattttggaataggtgtggtgtggtgctgaaaagaatgtatattctgttgatttggggtagagagttctgtagatgtctattaggtccgcttggtacagagctgagttcaattcctgggtatccttgttgactttctgtctcgttgatctgtctaatgttgacagtggggtgttaaagtctcccattattaatgtgtgggagtctaagtctctttgtaggtcactcaggacttgctttatgaatctgggtgctcctgtattgggtgcatatatatttaggatagttagctcctcttgttgaattgatccctttaccattatgtaatggccttctttgtctcttttgatctttgttggtttcaagtctgttttatcagagactaggattgcaacccctgcctttttttgttttccatttgcttggtagatcttcctccatccttttattttgagcccatgtgtgtctctgcatgtgagatgggtttcctgaatacaacacactgatgggtcttgactctttatccaacttgccagtctgtgtcttttaattggagcatttagtccatttacatttaaagtttatattgttatgtgtgaatctgatcctgtcattatgatgttagctggtgattttgctcgttagttgatgcagtttcttcctagtctcgatggtctttacattttggcatgattttgcagcagctggtaccggttgttcctttccatgtttagcgcttccttcaggagctcttttagggcaggcctggtggtgacaaaatctctcagcatttgcttgtctgtaaagtattttatttctccttcacttatgaagcttagtttggctggatatgaaattctgggttgaaaattcttttctttaagaatgttgaatattgacccccactctcttctggcttgtagggtttctgccgagagatccgctgttagtctgatgggcttccctttgagggtaacccgacctttctctctggctgcccttaacattttttccttcatttcaactttggtgaatctgacaatgatgtgtcttggagttgcacttctcgaggaatatctttgtggcgttctctgtatttcctgaatctgaacgttggcctgccttgctagattggggaagttctcctggataatatcctgtagagtgttttccaacttggttccattctccccatcactttcaggtacaccaatcagacatagatttggtcttttcacatagtcccatatttcttggaggctttgctcatttctttttattcttttttctctaaccttcccttctcgcttcatttcattcatttcatcttccattgctgataccctttcttccagttgatcgcatcggctcctgaggcttctgcattcttcccgtagttctcgagccttggttttcagctccatcagctcctttaagcacttctctgtattggttattctagttatacattcttctaaatttttttcaaagttttcaacttctttgcctttggtttgaatgtcctcccgtagctcagagtaatttgatcatctgaagccttcttctctcagctcgtcaaagtcattctccatccagctttgttccgttgctggtgaggaactgcgttcctttggaggaggagaggcgctctgcgttttagagtttccagtttttctgttctgttttttccccatctttgtggttttatctacttttggtctttgatgatggtgatgtacagatgggtttttggtgtggatgtcctttctgtttgttagttttccttctaacagacagcaccctcagctgcagatctgttggaataccctgccgtgtgaggtgtcagtgtgcccctgctggggggtgcctcccagttaggctgctcgggggtcaggggtcagggacccacttgaggaggcagtctgcccgttctcagatctccagctgcgtgctgggagaaccactgctctcttcaaagctgtcagacagggacatttaagtctgcagaggttactgctgtctttttgtttgtctgtgccctgcccccagaggtggagcctacagaggcaggctggcctccttgagctgtggtgggctccacccagttcgagcttcccggctgctttgtttacctaagcaagcctgggcaatggtgggcgcccctcccccaccctcgctgctgccttgcagtttgatctcagactgctgtgctagcaatcagcgagattccgtgggcgtaggatactccgaaccaggtgtgggatatagtttcgtggtgcgccgttttttaagccggtctgaaaagcgcaatattcgggtgggagtgacccgattttccaggtgcgtcagtcaccccttttttgactcagaaagggaactccctgaccccttgcgcttcccaggtgaggcagtgcctcgccctgcttcggctcgtgcccggtgcgcacacccactgacctgcgcccactgtctggcacttcctagtgagatgaacccggtacctcagatggaaatgcagaaatcacccgtcttctgcgtcgctcacgctgggagctgtagaccggagctgttcctattcggccatcttggctcctcccccttttcttaggttttcttctaggagttttacagtttaaagttttatgttactatctttaatccatttttgagttgatttttgtgtattgtgtaaggtaagagtctgtgtgattttttttttgcatgttgatatccagtttttctttttttaaaagtttagtttaatttctgggatacatgtgcagaaaatgcaggtttgttccataggtatatatataccatggtggtttgctgcacctatcaacccgtcatctaggttttaagacccacatgcattaggtgtttgtcctgatgctctccttccccgtgcccccaatcccccaacaggccctggtgtgtgatgttccctccctgtgtccattgttcgatatccagtttttctaaaaccatttactgaagaggctatatttccttcattgtttatttttggcacccttgtcaagatcagttgacaacatatgtgtgaatttttctgggctttttattatgtttagtcttttaaatataattattttgtttaatcttttaactactttatttaatatttaatactttaattattgtgtataattttttaaattatgtttaatttttttcataatttattgtgtttaattttttttctgggcttttcattatatttaattggcctttgtgctagtaacatactgctttgattactgtagttctccaatatgttttgaatcagaaactatgaggacttcttcttttttatcaagattgttttgactgcttggagtcctttgtgattccatatcaattttaggattattttgtctgtttatctataaaatgctattgggttttaaatacaaatttcatcaaatctttagattactttgggtattttggacattttaacaagactaagtcttctacttcataaacatagtttatctttttatttatttatgccctctttaattttttaacaatgttttatatttttcagtgtgcaagcctttcactttcatggtaactgtattcataaatattttattctttttgatgctactgtaaattagaacattttcttaataccatttatgaattaataaaaatcttgtcaattatttcttgcatggatcatgcttttctttttgtatagtcattaccaaacccaaggccatctagattttctatcttctaggagttattccttcctaggagttttatacttttctcctaggagttttatttttttttattttaaatttaggtctgttatctattttgagttaatttttgtgaaaagtatatggtctttgtctatattcgctcttttgcatgtggatgtgcagttgttcagcactgttctttggaaagactacctactgtactgcctttgttctgttttcaaggatcagttgactatttttatgtgagttcatttctgggcttacattgatctatttatctatatctttttgttaatatcacattgtcttgattactgcagctctattgtaactcttaaagttggctgtgtcagtctttcaactttgttcttcttcaatattgtattggctattctgggtcttttgcctctccatacacagttttgaattagtttgtcaatgtctgcaaggtagcttatgggaattttaattgatattgcatagcatctgtatattattttgggaaagtctaatatcttaaaatattggagccttgcattcatgaaatataatatctctccagttatatagtacttctttgatatattttatcagaactttgtagttttattcatacagaaatacattttgttagatttgtaactgtttcattgatgggaagtgctaatttataattaaataatattatgtttttaatttgaaattccatttgtttgttgctagtatatagggaagaattgacttgtgtatattaaccttgtatccgcaacccttatatattatcccttattagttccaggaaatttttctctattcttttagattttctatatagatgattatgtcatcagcaaagacagttttatttcttacttccaaatccatatatatttttctcctctcttgttttactgcattagctaggacttccagtataatgttaaaaggactagtgagaggagatatctttaccttgttctttatcttagtagaaatactcctagtttcttaccattaaatattattttaactgtagggtttttgtagatattctatatcaattggaagaaggtctactgagagtttttaatctaggcttttaatctagtttttaatctagatggtcaaatttgtgggcataattagtcatagtatcccattatttatttttttaatgttcataagatctgtagtgatgtcccctattttatttcccatactggtaatttgtgttccttctctctttttttttttttcagttagcctggttagaggcttatcagttgtattaatctttttggaaaccaggttttggttttgttgattttctctattgattttctggtttcaattttattaattttggctctcatttttactagttttattttttttctgtttacttggattaatttcttcttcctttcttgatttcttaatgtgattcccctctaagcatggattttgctgcatcttatacattttgataagttgttttcctttcaattagttcaacatatttgaaaatttctcttgagattttatctttgacccatgtgttgtttagcggtgtgttgtttaagtctcaaaatattttcagttgttctggatatctcttagctgaagatgtctagattaattccattctattctgagagaagaaattgtatgatttcttttctttcacatttttaaggttggttttatgggctgaaatgtggtgtatctttgtgaatgttctatgttcagataagaatatgtatgctgctgttaatggattaagtagattatagatgtcaattttaccaaatgattgatgatgttgttgagttaaaatatgaattagaatttaactgtgaaatacatatatataaaatgtacataatagattaatattagatataaattaggtttctcatagccaacatatagttgggtcttgattctttgattcactctgacaatgtctgtcttttaattggtgcatttatatcattgatattcaaagtgattattgatatagttgctctaatatttaccatatttgttagttttctttttttattctttatttttttactttaagttcgaggatacatgtgcagaacatgaaggtttgttacacaggtatacatatgccattgtggtttgctgcacctatcaacccattccttagattttaagtccgacatgcattagctatctgtcctgaggctttcccaccccttgcaccccgctgacaggtccaggtgtgtgttgttccccgatgtgtgtccatgtgttctaattgttcagctcccacttatgagtgagaacatgcagtgtttggttttctgtacttgtgtgagtttgttgaggttgatggcttccagtttcatcaaagtccctgcaaaggacatgatctcattcctttctgtagctgcatagtattccatggtgtatacataccgcattttctttatacagtccatcattgatgggcatttgggttggttccatgtgtttgctattgtgaatagtgctgcaataaacatatgtgtgcatgtatctttataatagaatgatttctgtccctctggttatatacccagtaatgggattgctggatcaaatgatatttctagttctagatccttaaattatcaccacactgtcttccacaatggttgaattaatttacattcccaccagcaatgtaaaagcatttgtctttctccacagcctcaccagcatctattgttggtttactttttaataattgccattctgactggcatgaagtggtatctcactgtggttttgatatgcatttctctaatgattagtgatgtcgagctttttttcatatgtttgttggtcgcataaatgtcttcttttgagaagtgtctgttcatatcatttacccactttttgatggggttttgtttttttcttgtaaatttgtttaaattccctgtaaattctgtatattagacatttgtcaaatgggtagattgcaaaaattttctcccattctgtaggttgcatgttcactctgatgatagattcttttgctgtacagaagctctttagtttaaggctgggcgttggggctcatacttgtaatcccagcactttggaagtctgaggcaggtggatcgtttgaggtcaggagttcgagatcagcctggccaacatggggaaaccccgtctctattaaaaatacaaaaattagctgggcgtggttgtgggcacctgtaattccagttattctggaggctgagtcaggagaatcgcttgaacgcaggaggcggaggttgcagtgagctgaaattgtgccattgcactccagcctgtgggacagagggaaactctgtctaaagaaaaaaaaaaaaaaaagaaactctttagtttaattaggtcccatttgtcagttttagcgtttgttgtaattgcttttagcgatttcataataaaagatttacccatgcctatttcctgaatggtattgcctaggttttcttctagggtttttatggtttggagttttacatttaagtctttaatccatcttgagttaatttttgcataaggtttaaggaagggatccagtttcagttttctgcatatgcctggccagtttttgcagcactgtttattgtagggaatcctttccccattgcttgattttattaggtttgtcgaatatcagatggttgtagatatgtggtcttatttctgaggtctctattatgtttcattggtctgtatgtctgtttttgtacaagtaccatgctgttttggttactgtagacttgtggcatagtttgaagtcaggtgatgcctccagctttgttctttttgcttaggattgcctttgctatgcaggccgttttttggttccatatgaattttaaagtagttttttctaattctggaagaatatcaatggtagtttgatgggaataatattgaatatataaattactttgggcagtatggtcattttcatgatcttgattcttcccatctatgaggatggaatgtttctccatttgtttgtgatctctcttatttccttgagcagtggtttgtagttctccttgaagaggttcttcatgtcccttgttagatgtatctctaggtattttattctcttcatagcaattgtgaatgggagttcattcatgattttgctctctgcttgttgattgttgatgtataggaatgcttgtcatttttgcacattgattttgtatcctgagactttgctgaagttgcttatcagcttaaggagtttttgggatgagacaatggatgtttttctaaatatactatcatgttgtctgcaaacagagacaattttacttcctctctttctatttgaatatcctttatttctttctcttgcctgattaccctggccagaacttccaatactatgttgaataagagtggtgagagagggcatccctgtcttgtgccagctttcaaagggaatactaccagcttttgcccattcagtatgatattggctgtgggtttgtcataaatagctcttattattttgagatatgttccatcaatacctagtttattgagagttttcaacatgaagtgatgttgaattttattgaaggccttttctgtacctattgagataatcatgtggtttttgtcattagttatgtttatgtgatggattatgtttattgatgttaaaccagccttgcatctcagggatgaagccgacttgatcatggtggataagctttttgatgtgcttctggatttggtttgccagcattttattgaggattttcgcaccagtgtttatcagggatattggcctgaagttttcttttttttgttgtgttcctgccaggttttggtatcagaatgatcttggcctcataaaatgagttagggaggagtccctccttttcaatagtttgaaatagttcctgaaagaatggtaccagctcctctttttacctctggttgaattcggctgttaatccatctggtcctgggttttttgtttctttgttttttggtcggtaggctgtttattactgcctgaatttcagaacttgttattggtgtattcagggatttaatttcttcctggtttagtcttgggagggtgtatgtgtccaagaatttattcatttcttctagattttctagtttgtttgcatagaggtgtttataccattctctgatggtagcttgtatttctttgggtcagtgttgatatcccctttatcaatttttattgtgtctatttgattcttctctcttttcttctttattagtctagctagcaacctattttttaattttttcaaaaaaaacagctcctggattcattgatttttttgaaggattttctgtgtctctatctccttcagttccactctgatctcagtcatttcctgtctcctgctagcttttggatttctttgctcttgcttctctagttcttttcattatgatattagggtgttgatttgagatatctctaggtttccgatgtgggcatttagtgctataaatttccctcttaacagtgctttagctgcatctcagagattctggtatgtttttctgtttttatttgtttcaaagaacttgatttctgccttaattttgttatttacccagtagtcattcaggagcaagttgttcaatttctatgtagttgtgtggttttgagtgagttttcttttttcttttcttttcttttttcttttctttttttttttttaagatggagtctcgctctgttgccaggccatagtgcagtgcagtggcgcaatctcagctcactgcaatctccacctcctggattcaagtgattctcctgcctcagcctccagagccgctgggactacaggtgcccaccaccatgcccagctaattttttgtacttttagtagagacggggtttccaccattttggccaggatggtctcagtctcttgacctcatgatccacccacctcggcctcccaaagtgctgggattacatgcatgagccactgtgcccagccaagtttcttgatcctgagttctaatttgattgcactatggtctgagagactgttatgatttcagttcttttgcatttgctgaggagcgttttacttccaattatgtggtcgattttagagtaagtgtcatgtggcactgagaataatgtatattctgttcttttgtgatggagagttctgtaggtatctattaggtccacttgatacagagctgagtttgaatcctgaatatcctcgttaattttctgtcttgttaatctgtctaatattgacagtggggtgttaaagtctcctactattactgtgtgggagactaagtctctttgtaggtctctaagaacttgttttatgaatctgggtgctcctgtattgggtgtatatatatttagaatacttaactcttcttgttgaattgatccctttatcattatgtaatgcccttttttgtattttttgatctttgttgattaaaagtctgttttatcagagactagggtttccacctttgcttttttctgctctccatttttttggtaaattttcctccatccctttattttgagcctacgtgtgtctttgcacgtaagaggggtctcttgaatatagcacaccaatgggtcttgactctttatccaatttgtcagtctgtgtcttttaattgggccatttagcttatttacatttaaggttaatatggttatgtgtgaattttatcatgtcgtcatgacactggctggttattttgcacactagtagatgcagtttcttcatagtgtcactggtctttatattttttgtgtgttttgcagagcctggtactggtttttcctttccatatttagtgcttccttcaggaactcttgcaaggcaggcctggtggtgatgaattccctcagcatttgcttgtctgaaaaggattttatttctcctttgcttctgaagcttagtttggctggatatgggttgaaaattcttttatttaagaatgttgaatattggccccactctcttctggcttgtaggttttctgctgagagatccactatcagtctgatagccttccctttgtaggtgacctgacctttctctctggctgcccttaacattttttcactcatttcaaccttggagaatctgatgattatgtgtcttggggttgatcttctcatggagtgtcttagtggagttctctttatttccttaatttgaatgttggcttgtcttcctaggttggggaagttcttctggataatattctgaagtgtgctttccaacttggttccattctccctgtccctttcaggtactccagttagttgtaggttcagtcttttgatatagtctcatgtttcttgaaggtttttttcattccttttccccttttttcctctaatcttgtctgcctgccttatttcagccagatggtcttccgtctgatattcttccttctaattgatcaatttggctattgatccttgtgtatgcttcatgaagttcttgtgctgtggttttcagctccatcaggtcatttatgtttctctctagactggtaattccagttagcagctcctctaacattttgtcaaggttctcagcttttttgcataggtttagaacatgctcctttacctcagtgaagtttgttattacccaccttctgaagcctacttctatcaattcttccatcttatcccctgtccagttctgcacccttgcttgagaggtattatgatcatttagagaagagccactctggccttttggattttcagtgttttttcattgattctttctcatctttttgagtttgtctagtttcagtctttgaagctactgacccttggatgaggtttttttggtgactttttttgttgatgctgctgtcattgctttctgattgtttgtttttctttcaatagtcaggcccctcttctgtagggctgctgcggtttgctgggggttcacttcaggtcctattcatctagtttactcccacacattgagatgtcactcaaggaggctggagaacagcaaagatgggtgcctgctccttcctctgcgatctctgaccttgaggggcacagacctgataccagtaggaatgcttctgtataggatgtctgataatccctgttgtgggatcttacccagcttggtgggatgggaagaaggacccatttaacaaggcactttggctgtcccttggtggagggtgtttgctgtgctggggggaaacacactcatctgggctgcccggagttatcagagctaggaggaggaaagattaagtctgctggtttgtggggacttctgctacccctccaactaggtcctcagacccagggagatcagagttctgtccctgagcttctagctggagttggatttcctacagggaggccctgcagccacagtgttggctgccacccctcccccaaggagctcagatggcttagactgcaggcagcttcagcagtggtgatggccattccctccccctggcttaggccaattctagctgagtggctgttgagaatctgtgtggctccatggtggtgacccaaggccctggtgacatgggcttttgagtgtgatcttccaatctgttggttgcacacttttgtggaaaaaccacagttttccaggctgggcagcacactcactcattgcctcccttggctgggggtgggggctctcaggtgtcccgtgtggctctcaggtgagctgttgcaccacagtgttctttcttcctcttcgtggatcatgccagccacctagtcagttctaatgacagaacctgaatacctcggttgctgggtgcaggatttgcatgctgctttgtatctttccaatgggattctttgattgctgctgcttctagtcagccatcttgaccccacccaccaatatttgttagttttctatttgtcacccttgtttttctatttttgtcttctatattgtctttgactttcctaattttattattttatatgatttaattttttatgtcctcactgagcatatcaggtgtacttaaaagaaattagaggttgccttaaagtttgcaatatacacttaaacctaatctgattctaatttcaaataatactataccacttcacagaaagtgtgagtacctttaagtaacgttataagaatgaaataatctattccctctcttcctttatatcattgccataatgaattttgcttatacataagcataaatatctattatctgacagtcttcctttcattatatagatatgagtttctgttttatatcattttccttttctctaaatatttcttttaatatttcttgcaaggcaggtctgacagcaacaaattctctcatttgttgataaattaattgtttcctcgttacttttgaaggataatttttcaggttacagaattcaaggttggtgattttgttgttgttgttgttgttttgttttgttttgtttttcaacatgttaaatattttactccaacctcttcttgtatgcatgatttctgagaagtcagatgtaattctcctctataggtaacgtattttttattctctgctttctttcattttttctttgtttttttttttctagtttgaaaagtatatagttagatatgttttgttgttatttggtaggttgggttttcatttttgtttttgcagctatcttgtttggtgttttttgagcttcctggatctgtggtttgatctttgacgttcatttgaagaaattttcagtcatgttaatatgtcttgtaatttttctttgtagcctgacatgatgtactggatagaagacactactataaatagacctttagtaatgtggttgtaaggtgtgtgggtgaggggaagtgctcttaatcctatactcagacctcagtgttttagtaagcccatgtctctgaactgtaaacttcacatgtgcttcacagttttctcttcctttaggtgggaccagaggcctaaaatgggctacagtttggtatttcctttcctccaagtggaaagctagagttagagttgaatatttttcttccttcaggtcaagcagattagagttcgattaaaccatttctcttgagagaagatcttgttaaggagaatgaaatgctctgaagtatttcaaattgttcttcccctcccctcactggaagaaccaagtgattactatctgatacttactataagtacatgctaaaactccaggatgtaaaaactcataaaaattcgagcatcatagtaatgggttctccctggagtttttgtgtctcaggcttgcccacaccaagctccaacaatttgtcagttacaattcaggtttccctacgctcgcgtcatttcccatggaaatttcagcttatgggtttctgctctgttaagttttgattgtctgttttgtgtatcaatctctccaatttctggggcagtggttttctctgtgacctcactttttttaaggatgtatgaagagttgctgatatttcagtttgttcagcattttgcttgttattaagatgaagtggtgacttccaagcttcttatatactggatcaggaaccataaatctcattttgttaattttttaaagtgatgtgctttgatttccttcaggttttcttttctgtatttttaatatatatttccttttttcctttggttactgtggggcttacataaaacaccttatagttataactgtctatttaaaactgataacaatttaagtgcaattacatacaatgagtctacacttttactcttctcccttctcacatttatgttactgatgctgtttatttattaacgtatttctataattataatttttattcattttgcttttaacttctataccaaaattaatagtgatttatgcatcagtgttatagtattacagtattctatttttgtctttatagtaatctttacctgtgatttttataatttcatatgctttcatgttgtggtttagcatcttttcaatttaacttgaaggactccctttagcatgttttgcctaaggcaggtctagttataataacctcgcttagctttgtctggaaacatccctctcgttttcattttcgaaggatagttttgctgcatctaattatatttgttgatggcacttttctttcaacattgaatatgttatatcttcttctgaccttcaatgtttctgctgagaaatctgctgatggtcgtatggaggtttcctagtaggtgataattcatatttttcttgctgctttcaaaattaactctgtctttgacttttgacaatttgcctatcaaaatcaaattgtctttgattctgtgtctgtatgggtgtggagttcttttgatttattttatttgggaggcattgggcttcctgaatctggatgtccacttctttccccaggtttggaaagttttcagcccttatgtctttacataaactttctgtttctttctctctcttctcctttgggaactctcataatgcacatgttggtcaccttgatgatatccataaatcatttaatttttcttcactcttttactctttttctgttgttgttttttttccttttgcttgttattaagcttttctgtcaggaaaatttcaaattacctatcttcaagttcactgattaatttgctttataaagtctgctgttaatcccctctagtgaatttttaattcagatattctattcctgagttgtaacatttgattcttttttatattttctctttatcaaaatttttattttgttcacatattgtttttcttagcttgcttatgattattttgaattttttgttgggtaactcctataccgccatttctttagtgtcagtttctgaagttttatttatttatttatatcttgattcatcagttttcccatttttttcatgtttcttataaatatgtgttagtatctgcgtatttgaaaatacaactatctatctctttaatttttcatacatacgttcatacagggaaggacttttatcacttagcctggcaagagattctttgggcttctcaagccttttctttagatgtatcttcttggacttgtgcttgtaaatttctaattcaagatattttctatttttggtttttccccttaggcactcataacctcttgctctccctagtgtctgcttgttgtagcactggtcctctggagaagcagaatgcttcccagctctttttttctcaatgacacccagatatctagagtatgctgggtctcatcagtgctctgagagagatgagacaatgtctgttcctctggcagctcctgtcttctttaaaagtgtgaacattgaatgtatgtttcagtctttttttccatccctagggggaaactggttgctgggagttttctcttaatcacatagtgctgtgctgggggtagaaacactatgacaagagggtagtgtaaactcttctaatagtcttctgctatggtttgaatctttgccatctacaaaattcatgttaaaatgttattgctgttgtaatagtattaagaggtggaatgtttaagaagtaattgaatcatgagggctccaccctctttgatgggattggtgcaatcataaatgggcaagcccaatccctcttgctctctcttttccttttgctctgatctcttgtgaagaaaagtgtttcctgtcctctggaggatgtagcaacaagacataatcttggaagtagagagcaaaaccttaccagacaccaaactttctggtgctttgatattggtcttatcagcttccagaattgtgaaaaaatgtgtttctgctctttataaattacccagtcttagatattctattatagcagtacgaaacagactaagaatctatgtggtggtttcatgttcactcagatacagaagcctcttaatggatttctgggtttcttacaaacaaaactcatctgggcttggcgcagtggctcacgcctgtaatcctagcactttgggaggccgaggcgggcagatcacaaggtcaggagatccagaccatcctggctaacacggcgaaaccctgtttctactaaaaatacaaaaaattagccgggcatggtggcaggcatctgtagtcccagctacttgagaggctgaggcaggagaatggccagaacccaggaggcagagcttgcagtgagctgagattgtgccactgcactccagcctgggcaacagagcaagactccatctcaaaaagaaaaaaaaaaaaaagaaaactcatctgtgtactcttgttgaattagtgtctccatgggaggagtaagagtctggtgcttcctattccactgtcttgtttgaaaccaatttatttgtattctttaattagagtatatttctctcagttactacattatgaatcagttattttaaaattattttagaaaatgtaattatgttatctaattatgaaaataatgtaaacattatgtatacatttgagaaaaactattgggggaaccagcccccaatatttcaacatagtttctttctgttttccctaagtgtcagccagtctgagaaataaagagaaagggtataaagagaggtaattttacagctgggcctctgagggtgccatcacatattggtagggccgtgatggcgacctcgagctacaaaatcagcaggtttttattagggatttcagaaggggagggggcacacgaacagggagtaggtcacaaggatcacatgcttcaaagggccataaagatcacaaggcaagggcaaaattagaattactgatgagggtccatgtcccactgtgcacgcattgtcttgataaacatcttaacagtaaacagggtttgagagcagagaaccggtctgactagaattcaccaggctggaatttcccaatcctagcaagcctgagggtactgcaggagaccagggcatatttcagtccttctctcgactgcataagacagacactcccagagctgccatctatagacctacccccaggaatgcattccttccccagggttattccttgctgcaaaaagaattcagcgatatttctcctacttgctttctgcaagaagaaaaatatggctgtattctgcccaaccacgcaggcagtcagaccttatggttatctttccttgttcctggaaaattgcagttattccgttcttttttagggtgcactgatttcatattgttcaaacacacatgttttacggtcagatttcatgttgttcaaacacacgttttacaaacaattggtacagttaacacaatcatcacagggtcctgaggtgacatacatcctcagcttacaaaaatgatgagattaagtgattaaagacaggcgtaagaaattattaaagtattaattttgggaactaataaatgtccatgaaatcttcacaacttaattcttctgccatggcttcagccggtccctccattcggggtccctgacttcccgcaacaaaaaacagattataaaacatgtaacttataactatactcttgtcaacatctcctgttaacctttcctatgtgttgtttaggctttcaattaaggagcagagagcttttgtacattttaacaaagttgaatactataaagttagtggaacactttttcattgcacattgaaaagtgagcatatttctatcagtaatcattttaaaaaatattaacttattggcagtataatatattctatgggttttcataatttaatcatttaccttttgattaccatttacattgcctaaaatgtctgaaatacagttttgtatacttaatatataaatatgtagatatttacctgatttttttcctaagaaaattttgtacaattaatggtatttcctcaatgtgtataaatatatcatacttgatacatattataaattacttcctataaaagctctaacaactttttcatgctctttgcttaggttttgatttgagcactagatagtcaatattctaatgtatagaatggtatgtagtttgtaacagaggaagtgtcataaatcagtgggaaaaggccagtaatttttaaaataaaatgtgttagaaaattatctgtacaaacaggaaaaataatcaagttatttaacccaacataatgtgtcaaaaattatttcaaatgaactagttattaatgaaatatcaataggaagaaaatatgggtaagcaatttttattcagtggttctatatacaaaataatgagattaagggtaaaataatagtttcagaataatcaaaaatactattacaaaagagatgtattaagaaggagtttacaaagtctaataagaaaaacatgaacatttcagtttaaaaatagaaatggattttatcatatcattttaagattgtttcaaaaaataatttttaaaaattttcactgttatttactgtcactattgtgtacagaaatgaaggttgggtcaccaatatctgtatgaaatatgattttacatatagtgatcgaattcatttgagtttaaataaccaagatgtaataaaataaatctctttactacaaatggtttacctgcccctgtgtagactactttaatgtaaaccaagcagaatatgtcttgaatctaaattaattattgtgaaattaatcaggtacgtcattatttcacataacaaaaaaattactcatactgtacacttggtacaagtgagtgaatgcgttgcatggtaccatccatgtacttcctttgaccagttcaattaatagtagttattcatctctgaaacaatgctgcttaaataattgaactgaaatcattataggtagttaggcagtgttaggatgaggtaactaatcagtgtataatatttaaatggacagttaccctggttaactagaatgtatgactaaatatgattacagaaactgaaaacatagaaacttctccttttgacacaaatatgaaaatattttccttctattgattttgcgctagttatagtgcactgtgccttacacattaagttagagtatctcttttgatgctctaacaaactctgtgacacaaagtcatttaactacttcagctaaaatagaattttgattcagaatgtcaggctgaacatactttccctagcacacaatatcttattgaaatgaagcatatacacttatctatttaagtacatccttccatgtgtatttagattcaacatagtgctagaaaaactgaagggttatattagtgaatcacacatatttttggaacttggtaatcatacaattcttatgttatttgaaacatttcccttttaatgtttctacttgcttagcatctaatcagtcatttggtactgctatctaaattcttttttggtgctctaccccttctgcatagccagaagtcccccaagtatcagtcacttgacttcgtttattttgactgtggtgtctaaatgcaattgactttgggtcaattgtcagtcttttccttaaaaccttccctctgactacatcaacaagaatcaattttcatttcaggcaatcaataagtcataatttatataatcaacaataattgttcaaaataatgagaagtatcacttaaatggtgtcagaattgtagattcgaaactgaactaagcaagaaaattaatgaaaatgcaagctctttatgaaataaacataaaaaagacttaaaaattaaattggaatatcaaaaacataaaattccaccaaaactagttgtgatttcaacagagtatcaataaaaatcttgatgagtacacccagagtaattaagtctgttgactactgaaaataaaaagaagttaaggagtatttctaccttgcataaagaggtgactaattaatttctaaattttgattaaaataaactgatattcaaatgcatagttctttgaaatggaaatatattggttgtgttacagtttcatggccctgattataatataaaaagtcatgttttgtttaattttctttttttttcttttttttgtgggggggacagagtttcactcttgttgcccaggctggaatgcaatggcgagatcttggcttaccacagcctctgcctccctgatttaagtgattctcctgcctcagcctcccaagtagctgagattacaggcatgcgccaccacgctcagctaattttgtatttttagtagagatggggtttctccatgttgggtaggcttgtcttgaactcccgacctccaggtgatccgcccacctcagcctcccaaagtgctggtatcacaggtgtgagccaccgtgcctggccattatacttaattttcttcataaaatttgagaatccaggtttgatatgtgtttaatattaatttaataatacttttattaattatattttttctaaaatttctatttggttattttttgtaatccaattggccaattatgaatctctttttcttccataagtgtagtcttatatttgctatttcatcattgtgatgtctctatctatgtgtatattcgctacacatagaaagtatacatatatatacacaaaaatgtataatagtgtgtctgcatatatatatatgtatgtagacatgtttttaagagtatagtgactatgtgctgatatactaatatatttgctaatagagcatgtatttcattgagagtttatattccctaaaatagcatcttattatatagagagattctttgaagcttgggataaggttaattcattcagaaataatttattttcctttattccaagcattcagagtcactaaaacccagtatggtttgaaaatgaatgtttagttaaaggattttattgcctcacaggtggtatggactctagccccaatatcatgagtgagaaattttcagagacttgctacctttttgttttttcatttaattcagagccaggaccaagagaggaaaatatctccaggagctctttctctgaggtgggctttttccacttcacccactgagagtattgctctttgggggcttatgtaggaggatttccacatttgatctttcacacgtactttgctactgcctccagggctttcttacccaccgccagacagatacaactgtacactttctttttattaatgttttttgataaattctgttgctgttctgccacctcatatagttttaaatattttatccagaatttttaggaggactacttggggaagggtttcagaaaaatctaagccaccatattctgagcttttccttatgctcaagaaaacctttgtttaatgttgagattcttgagaatatgcattcttccaacaaatatttgttgagtgcctatatgtagatacataagtgaacaaaagataaatatccttgccttgatggagcttgcatcctaatggctagaaaatataatatacaataagtataagcaataaacaaatcaataacttatacaataagtataagcaataaacaaatcaataacttagatggcaacacacaccttggggatagcaacagagaaggatgaaaagctagaaggagcagtatagagtagtcacggtgatctcattgagaatgtgagatttgggcaaagatttaaagttggtaagaaagatgaggtaaatgtatggtttaattggttattgggctggacatcaaatctggataatctcttcttccttgatctgtagatggctccatagacatagcatttgtcttacattgcctgctgagaaggggagaaaggggtaaatgtgggagcaatagatagtaagaggggatctctaataccaaatattgcccttcttcaccttccctattttgcagtgagtaaccatattctgataatttctgtgactaattctataaatatattattttagtaagttctttggaagtctctgaggcatattcaaaatttaattttttaatttgtatttctctagatttcctcaggtttgtctataactgttttccaaatcacacatttctaacattagataagtgtacatttatttttttcttatgccaagtgacaggtacttaatatacaagggatattttgtgtatagtattcattctttaggagaacaacctctttaaatgtgccacagaattcagaaggcattgtataattggaaattaatcaaaacttcattcttctcagatgcacttatctttaagaatttgctctacagggctataaatgctatctatatttatctgcaaataaatatacatttttaataataaagaagtagtgtttaatattgggtaaagtattgatgtttacatggtattcgcattggtatggactgttacagagatgtaaagccctttctaaccaagttatttcttaacatttttaaagcaaactatatatatttggaaggagaatatattcagaaaacattctcaaaagggaaaataaagttcaaagataacattaattggtactattactttatacttttcttcctttagtagtctatctttacaaggagaggaatccattcagctaatggatgtcgtgctcaaagttgcctcggcattgtccatcctgagatatattcctgttccaaacctgttttggtatgttagactagtaggctgaggtttatcttaaaataagaggatgtcctttaataatctctctaatcattagtttctatttaaactgagaccttcactatcccagtgctgatgctaatagccagtagggaattattcttcttatcgtaacttcttctggcttaatttagaattagaataaaatgattttattagacttgggactatttctgggcgtatgataaacaacagaaagaaaaggaacaaggcctgatgtttaatttctgtgaatccttctgatattcttcttttcctttgccttaagataaaatcaagtttgttcttttcataatgatctaatgctttcaggtcttccgagtctgagtcttgataagggtctttaaatattacttttaactacaagttccactacattttgtaaacataaatgaatatgaccttgagataataataaataaaattttgtctatatagttcatgattaagtcttttcatttaaaaatgtgttacaatcctgcagatcatcgtatgttatttgtcattttctatataagggaggaggaaagggtatccaaacaacatttatcttgacagcataagttcttaaaaatggaaaacatgatcagaggctgaatgagtaaaattaggaacaacaatcagggtagggagtaattgcatgattctgtttctagtccaaaatagtaatattaatatttaaatgttcttatttaagtgtgaagatacaatttttttttgaggcggagtctcactctgtcgctcaggtgggagtgcagtgtcatgagctcagctcactgcaacctctgcttcctgggttcaagctattcccctgcctcagccttccgattagctggaattacaggtgcgcgccaccaggcccaactagtttttgtatttttagtagagacgaggtttcgccatgttggccaggtgttctcaaactcctgacctcagatgatctgcccgcctcggcctcccaaagtgctgggattacaggcgtgagccaccgcgcctgaccagaatatatgatttttatatgtatttgaattcaagttttttgcctaggtcaggagggttttgctgtattgtcttcattgagatgaatatttgctatggttatcataaagaccatagacaatgattcgagtagccagttccccctctagggaatgagactgcgtcatagattttgcaacaatggtttgggttttccaattttgtcttgacttcaacacaaagaaaaattcctgtggccttattcctctttgttgttatatatacttctctgtgacctacatagggtttgacttccaagaattatagtagtacaggtctcatagttaaaaataatggatttctttggtacatgtttaagtgcattatttccttatctataacaattgctaggagcttctatgcctttctttatatccttgctgattgactaaaagaagatacatagtttctactatcatatgttttggtggaagagttcctcttacttttaagagaaaaatctgtgagaaaatatttcacataattctacgcatacgttatacttttacattgtaatataattttaatatcattttctgctgtaaaaaaagacaacagaagagttaccataaatttttatttaaacaaaataaatgattgacaacagtagaataaccttttaattttttattataaatattgaagtaactattacatgaggagaaaaagatagactatcctcataattatgccaacaaaattattgaatcccacttcatttatcttgaagtacttattccattgtatgttgatgtttattttttgctggtggtaaattatatttaacaattgttaccgtgttattttagccataatttttaaagaattatgctgtgctctaatttctttactattttggtaacatcaataatttttattatgttgatatatgctcttttatgctagaaaacaaatagggatgccttcaagtgatcaaaaaacttgtttttgatagtttatatactttataaaattatgataaagttgtatatgtgtctttatatttaggttactactgctgtgtttaaagttttcagaattaaatattgatatgtttcagatttcataacgtagaaaatattttgaaatactaattttaatttatatattgccaagtatttaaatcatgatgataatttaaaatgttatgtagatcaagggatttttattttaatacgttgatagttacaaagttataatagaattcaccttcaaatgtatcttggccttagagtgactttacaagtttgaaagaataatgataataacatcgatttattgtaataacatgatattgtgttatactgtgtaccaggcaacatgctaaatactttatatgccccatgtggtttatataaggcttaaagtaaggactcctaattaatttttccattttaaagatgaaaaatttgaagctcagaggggttatgtcatttatctaaggtgacataggaagtagcggagtaggttcaaactgggccaatgtggcctcaaagcccttgttttaactgctactataatcagtagagtgttagtacagcccaagatataggctctggaaagtgaattttcaaatatttatcaatattgtgggtttgttattaaactatcagaaatttcaaatgagccatggtggaaatatttagaccttggaactcagcaaatgctacagatcaaggtttcttctatattcccctttccttcctgcattgtacagtatactagcatatcagtgcctttactgccaaagtcttgtcagtgtttgcaatattacatgtattatgttagagatataaatactgggcgtaatcttttacatcttgtattaagtactgtctataaactggaatctattaagaaacttactattaatagttattgaattaaatacattaacttttgttgctaaaatatctaaaataatttattaaagacaagaatgtgtgaaatgaactatctctcttcttttcagtgatagtggaaagtggaaatataatttcttttgtgggttatattaactctggatgctgtaacatttatagaagtattataggatttgtgaaactacgatcaaataaagtggtaagttttcaacatgtattctttttaatcaattaatctactctaaagaatagtgtcagataccttttcatgtacttactagacatttatttgtattactttgtgaaatttctattcaattttttgaaatttttgtgtttgtttttggtttagttataagatataagaatataagttgtaagatatattgatttgtaagatatacaaatgatcaatgaacacagtaaaatatgcttcacgttcttattcattagagaaatgcaagttaaaaccatagccaggtactactacaaacataccagattggctaagatgcacttaatcatttgacctaattccactccagatagtttctccagagaagtgaaaacatatgtctacacgaagacttatatgaatcctagggctgggcacagtggctcatgtctgtaatcccagcactttgagaggccgaggcgggcggatcacgagatcaggagatcgagaccatcctggccaacatggcaaaaccctgtctttactaaaaaatacaaaaattagctgggtgtggtggtgcacacctgtagtcccaggtactcaggaggctgaggcagaagaatcgcttgaacctggaaggcggaggttgcagtgagccaagattgtgccactgcactccagcctggctacagagcaagactctgtctcaaaaaaaaaaaaaaaaaacttatatgaattcttacaaactaaaaactggaagtagtccacgtatccactgacagttgaatgaatagaaatgttacagtatatttatactatgaaatgccacatagcagtaaaaataattatggatacttgtaagaatctcaaacatactatgtagggccaaaatgccaaacctgaatgagcatgttctatataattccatttttatgaagttctagaacaggcaaaaatatataattactgtggtagaaaagttagaactaatcattagttggtcagggagacttcaatggaattcaattaaatatctaaactaacttgaattctgctgcactaatcatattcagtgtaaagatttgccatttatataggtgcaaatattcaagttatattggatttgactccaggttatttagtaaatgctttagcctcttccaagttcttgccactttcctacctgagggctatattctcttttatatatcttagtggtcatcaactcctagcaaatctccccgcaaaggtaatttgaggtctcaaaattttctccagaaccattcatattgaacatcctgtaggcccttctccacaaggtctcttatttgaaccaaaattatagttccctgagtcaaactcattttccatgtttcttttgtacttaaacagaaaagacagggaataatccctcctttttgacttaataccatcggttctggccctggcattttctgcttattttccttcttccctgtgggttcaacaagagtgccttgtgactagggctgatgtaacaaacagtggttgacaaaacatcttaaatgaaactatgctcacaaaatgatatcctagatccttgaaatgtggaattagttcaatatttcctaaacatctttgtggattctaaaggacaatgctttcaattaccttagatatgcctaagttatctatgaatttactattgctctaatataattgaaatgcttatgtaagtaaatttttctgtaatttaaatacaattgctaatttattttaaatatcatttagtaaaatggtttatgagtgagtttctgataaaaacaatactgattcattatatggaagcagttgcattaaacatcaataatatatttttttaacagaaaagatctcaaaaacttgtttatatggggaaacttaaggagaaggagtcctttggtgagattagcgtccttcttcaagttcctttcacgtgcacaatcattaccaaaaaagaagttgagatggcaatcattgaagataaggacctatttggtaaatgcataaatatcttttaactgttataccattttattggatgagttcttaaattttttaaatttttttccttattaatcagatgcatatttattaaattggggttcacctgcaaaggatggagtatttgcataatctcctccagatcatttctctcttggtgaattttgaaaagggcacatgtttgtagagtgggctggaagggaacttcattttcatcatatagaaagaggtgaggacttgatgccgaggtttgatgcaggggctgcctgaggcttggtctcctggtcctccaggaccaccctgaactgaagttggagaacccagggcaaccagccctgctctgtgtcctgtccttcctgcaacttgctggacctcacagctgaaaatgggagccttgtctcattctctgtgtgagtccttaggataatggtatagtaataataatagcaataataatattagtctaagtcacacaatagtaagtgaaagcattccattgcagcataaactataaagaaatatttatggtaagcattcaggggtacttggtggatcccaggcagggacctgggcctcatgagggtactttaattctctaggatttctttttttttaattttattattattatactttaagttttagggtacatgtgcacaacgtgcaggtttgttacatatgtatacatgtgccatgttggtgtgctgcacccattaactcgtcatttagcattaggtatatctcctattgctatccctcccccttccccccaccccacaactgtccctggtgtgtgatgttccccttcctgtgtccatgtgttctcattgttcaattcccacctatgagtgagaacatgcggtgtttggttttttgtccttgtgatagtttgctgagaatgatagtttccagcttcatccatgtccctacaaaggacatgaactcatcatgttttatggctgcatagtattccatggtgtatatgtgccacattttcttaacccagtctatcactgttggacatttgggttggttccaagtctttgctattgtgaatagtgccgcaataacatacgtatgcatttgtctttatagcagcatgatttataatcctttgggtataaacccagtaatgggatggctgggtccatcagagaaatgcaaatcaaaaccacaatgagataccatctcacaccagttaaaatggcgatcattaaaaagtcaggaaacaacaggtgctggagaggatgtggagaaataggaacacttttacactgctggatgagttttttaaaagagtagagatatttcacagacaaattgggatactcaagtgagtgtttgtatgtatattatgtacaaagacaacatagctatacactgccccttttataatatattctgaattaattgtactggtgttagaatatattagcaatatttcaaaagactttgttttgaaattactaaaatctctctgccacttcccaggttaccattaatagcaatgttcccttcttttctgggacatcttctggctttcatctctaaggtcattgcttttatgtttttggttcaggtcaagtatgtaacatcctcaatatttaattaagatcaagcatatatgaaaatctaaggctggtagtatataagactttatctaaaattttagagctctagtaataataacagaataataatgcagccacctgtattcagccctccaaatactataaatactcaaattggaaatacaattgagtatgaaggagaaatgaatagaagctaataagttgtaacataataggatattaaagaaaattgtagatatgtacaataaaactgggagtaaaggatgaaagcaaagaaatttgtagacattaccatgggtgagaggtatgcttcaacagactaaattgaaagttgttcatgataaaccatataagatttgactgaatactgttatcctgaatttcaattatgttttatgtctctgacatgatttggatgtttgtcctttccaaatttcatgttgaaacgtcatcctcaatgttggagctgcagcctaatgggaggtttttgggtcaaggagatggatcctttatgaatggcttagtgtccttcctgggtaatgagtgagttctcactctattagttcatgaaagagctggctctttaaaagtgtctggcatgtttctcttgctccttctttcaccatgtgacacacctgctcctcttccattttccaccatgaataaaaccttcctgagtcctcaccagaagccaagcagatgttgttgccatgcttgttagaccctggcaaactgtgagccaaataaacttcttttctttataaattacccagcttcagatattcattaatgacaacacaaaactaatacagacgtggggtgttgctataaagatacatgaaaatgggaagcagctttggaactgggtagcaagcagaggttggaagagtttgaaagtctcataagaagacagcagatgaaggaaagtttgaaactacttaggatttgctaaatagttgtgaacaaaatactgatagaagtatggatagtgaaggccaggcttatgaggccttagatggaaatgaggaatctattggaaaatggaataaagtgtatccttgctatgccctagcaaaaatcttggctgcattgtgtccatgccctaaagatttgtggaaagttaaacttaagagtggtgacctagggtatctggtggaagaaatttctaagcagcaaaacattcaagaattagtgtgggtgcatccaacaacgtacaatcatatatgagcataaaagatgacttaacgttggaaattataattaaaaaggaagcagagcataaaatttgaaaaattcacactctagctatgtggaagagaaggaacgtgcattttctagagagaaatttaaatgcactgtggagcaacaacttgctagagggattagcttgactaaaagggagacaagtgccaatattcaagataatgggagaaggtcctcaaaggaatttcagaaatcttgaagacagctcctcccatcacaggcccagatgcctaggaggaaagaatgttttggggagccaggctgaggatactgctgccctatgccacctcaggacgctgctctcagaatctgagcagagccatcctgggctcaaacagccccagatacagcatgggctactgctccagagactgtaagctataagcctttgtggcttccacatggagttgggtctgcaggtatatgaaatgcaagagtgaaggaagcttgctatattctacctagatttcagagaatgtatcagaaagccttccagagagaaggctcctgcaggggccccacagagagcctctataagagaagtgccaaaaggaaatttgggattggagctaccacacaaagtccccattggggcactgcctagtgaactgtaagaagtgggctgccaccctccagacctgagaatggtagagccatgggcagcttgcactctgagcctggaaaagctacaggcgtttaactccaacccatgaaagaagccacgtgggctgcatccagcaaagctgcaagggtggagctgcccaaggccttgggaacccatcccttgcaccagtgtacccataattagagtcaacagagacgattttggagctttaaaattttaatacctgctcttctgggtttcagacatgcatggggaatgtttcccctatcttttgtcttatttctgtcttttggaatgggaatgtttacttgatttctttagcaccactgtatcttggaaattaataacttgtttttggtcttacaggctcataggtggaaagaatgtgtcttgagtctcagatggaactttggacttttgagttgatgctagaatgagttaagaccaggggactgttgggaaggggtgattatatattgcaatgtgagaaggacatgagatatggtaggccagcaacagaatgatatagtttggatgtctgtcccctccaaatctcaggttgaagggtgatcctcattgttagaggtggggactggtgaggggtgtttgtgttattgaggtagactcctaataaagggcttggcttcatcttcatgataatgagtgagttgtttctctgtgagttcacatgagagctggttgtttaaagaagcctagcagctccttttctctctcttgctccctctctctccatgtgacatgcctgctccttctctgccttccaccatgaacaaaagattcccgaggcctcatcagtagccaagaagatactggtgccatgcttgtacaacttgcagaactatcagtcaaataaacctctttcctttatagattacccagccttgggtattccttcatagcaatgcaaaactgactaatagtctcttacagaatgtgttaccaatacttgcataacactaactcaaaatgaaaaaaattaattcaaattcatatgtctaattttaaaagttgtaaatctgaaatgacatttgttaattttattttcttctgtgacattcaaatacaacctccctcaaggtaaacattgcttaaaaataattactaaccaccaattaaaatgacaatattctcacttaatattttttcttttcctatataataatatgttttttcttttcctatataaatgatgttaactggtgcaaggcaaatacactgtggactcttttatgtaaaacaacatttcacacgttgtattatacaaagttcttcaaaaaaaacagaaccaataggatatatataaatatacaagaggcgatctattatggggattggctaatgtgattgtagagtacacaaagtcccatgatatgctttcagcaagctggagaatcagtaaagccagtggtataattcaggttgtgtctgaaggtctgaaggggaactgagggtgtaactcccagtgtgaggccaaagccttgaaaactggagagggcagacaggaggcagttgtattaagtcctggagtctgaaggccagagcaccaggaatcctggtattcaagaactgggaaagatggccatcttagctgaagaagagatagacagaattcctctgcctttttaatctattcaggcccgcaatggattaggtgttatctgtttgcattggtgttggtggattttccttaattcatctactgattcaaatgctaatctctctaaaaaacaccctcaaagacacatctggaaatgttttaccagctatctgggcatcccttagcccagtcaaggtggcacataaagttaagtgtcacatacaaaagtgtttcttttagtcacttaatagaatctcctttgtcatctggcagcctaacattcaaatacttggcattgtatgggatttagtaatgtttgtgtgtgtacaaacattttaattcattccatagtctgttttattccatagtctgcatacatcagactattccatagtctgaatttcattttaaattcattccatagtctgttcatttgagagtgatgttctaaagctgctgacatgatgtgtgcctaattgaatattctctaaatagaaatgtgcttgaggactagattttgcttgttttttcaaaatttacaaggaaataaaatattgtgtttatttcagaaagcattttatttctacattctaatatttcatattctattccaagatagttaaatgtacattttaagggctagataattctaatgaaaaattaatggttaattttgctgaaataattttcacatatgaagaacaatgatattaatttgcatttaatctgctatatcctatctccatctacttcatttattatttgaaatatagatccacctctatgaaataacataggacaggactcaagagaaagtaaaatgagtcttaaatatatcaagttgaagacaaatgaaaatgctgtgctggaaaactcagcgtgagcaaactctatgttatgtcatcttgctatcaagtgttattattagctgttatattacataggtgttaggaataatttaaatttgagaaagtccactaaaaataaacaaaaataaataaaataattatgttccaatagaatcctcaattattagttggttatgttgccttcactttctaatttttcaagaattgttaaaaacagcaattcttttagaactataaaggtattactgaaaaaataaattaatgcttatctttctccaggtatatgggttatactctctatttggtcttatgtaaatcatgtaaagattcagttcatcttgaatgaatcaacaatatttggtaaatacccaaagagagcaattcactcactgtacctgtacttcaagataggtagaatagaatctagagaatattaaagacttcataaatgttaaatgctctactggagaattatatatgcaaccgtctatatataaaatatagtaagatgtatgcagcaattagttttgtaatatttaaaaggacttgaggagtggcttatttgttccttttggtggttaacttttggaagttaggaaatatctttttttaatctatatgcatccttctcagacattgccttgaacatctaaataagaatgagaatagcattattaagcttaagcaaatataaatttcctctgtttttcacatgctactgagaatgtagtttattattatttttataaagtcaatatatctttgtccagatgcagagcttattactcaagtcatttaaggtaaagataattgcaagtcaatataactattttaattttactgatgtcttaaattctcattccaccattagaacaagtgtactacttttgtaatgagaaagaatttctttttatctataaaatgaattactgatgttttttattatatctcattcaacaacttatgattgaaaaataaggaatagctaatgtgcttaatttgccataccgaaaaggaaaatttcaattccaaggtgttattggtataaactatctgaaagtttctgcttgtttttaaaaaggaagaatgcctaaagactatctctcataatgcttaatacaaagcacaggaggtcagagtttttactgcagatatatctgttaagcatttcaggggcaataaatatattcatattcaaaaacttcttcccaacacatcagcatttcaccttaatgatgagataagttatagccaagattatccttgttaaattaacaaaactaataaaaaggatttaagctcttgaacagtttgccacagggaatacacgactctttccccttttgcgtttttgcattgtgatttaaaattttgatatatgcaattccaagttaaaaataagatagggcacttatttttaaatcagataaaaatgcttaaaagcatcttctcctcttataatttgttattccttactaatacatgttaaattttaaaaatgtaagttacaaagttgagtgaaatgttttttgaggaaaaaataatattttatttgcaaagcttgacaaaatgctaatatctttaatgataaatgagctcttagaaatcagtagaaggagattaacattacaagggaagtgaaaataaaaagaacagaggaaaatgaaataacacaaatgtcttacaaggctatgtgaagatgatatagcttaccattaatagatgaaaaagcaatttcactataaattacattatcaatgcttacaaatattgatatctaatgtttatatagttttaggaagggaaaatcctcaaatactgggaaaatttactccagttataggaaatttactcaaagtatagattttgcatatactttgccccagcaattccagttcatggggatcattccaacaaaatagttggatgaatatatatatatatatatattcttgttcactacatagaaaatctttggctaatatgtcatcccccaagaaactacttatgtatcaattggtttataaagaaatagatgggggggtagaatttgaaatataaaaagcattgaagtaaaaatacaagatttcacaaaattctatgttccttgaattcttgaaaaagaactttctttaaatgaatcagttttatatttactctgtgataagtgaaaattataaatgtatacacttcagacttatggaagcactgagatgaaacacttttaattccactatcctggcttctttgtttaagaatgtctgtcattccatgtcctgagattgagtccaatgacaaaccatgaaaacaattaccatgcttacttaaaatctacttcaatgacactctttaggttacttttcaaaaatgagctttctcagtcaagtttttctgatctgcaaggaatgtccactgcaatgcctgtgaggagtctccatacatcatgaagaccatattttggttttggtgaagatgatattagaaacaagggcacagtctccctctttcagtcattaaaatcatattgccaagaatgcttgaatgagaatactgcaacaggtcattcagtgataactgaggtttttcaataccagatgtgtttatccaagttcaggaggaagtgttagctattgtacacactgccccttgttcatccaacagacagtccaaggcaacttgattatctacaaaaaaatttagcaagggagtttagaaaagtttgttgggcacctatagcctttgcagtaaacttagctattactatagctaatgcttgagacagatttttaatcataaccttatttacatttgtgccaagccaataaagttacattctaccaaagatggccattaagaggaatttacaccattttgtctactccatggcaagtcatggactgcagtttttagtaatggaatctttaaggactcagaaaagaccaggcagccattcgaaccctctgtgagtccacgcttaacattaaatttatatccttttagataccaattttgcttttccaagtcaggtacatataacactgcttattaaataggttattataggtgatttgacttggatcaatcttatggagttcattcaaattgcatattctaactttttttttgtactttaagttaagaacgtgcaggtttgttacatgtatagacacatgccgtggtggtttgctgtacccatcaacccgtcatctatattaggtatttctcctaatgctatccctcctctagtacgccccacccaacaggccctggtgtgtgatgttcccctccctgtgtccatgtgttctcattgttcaactcccacttatgagtgggaacatgaagtgtttggttttctgttgttgtgttagtttgctgaaaatgatggtttccagagttatccatgtccctgcaaaggacatgaactcatcctttttttatggccacatagtattccatggtgtatatgtgccacattttctttatccagtctatcaattgggttggttccaagtatctgctattgtgaacagtgccacaataaacatactacatgtgcatgtgcctttatagtagaatgatttatcatcctttgggtacatacccagtaatgggattgctgggtcaaatgatatttctggttatagatccttgaggaattgtcacactgtcttccacaatggttgaactaatttagactcccaccaacagtgtaaaagtgttcctatttctccacatcctctccagcatctgttcatgtaagtttcctaactttttaatgattgccattctaactggcatgagatggtatctcattgtggttttgatttgcatttctctaatgaccagtgatgatgagctttttttcatatgtttgttagctgctaaatgtcttcttttgaggagtgtctgttcatacttttcgcccactttttgatggggttgtttgtttttttcttgtgattttgtttaagttccttgtggattctggatattagccctttgtcagatggatagattgcaaaatttttctcccattctgtaggttgcctgttcactctgatgatagtttcttttgctgtgcagaagctctttagtttaattagatcacatttgtcaattttggcttttgttgtcattgcttttggtgttttattcatgaagtccttgcccatgcctatgtcctgaatggtattgcctaggaaattttggtttttttttttttaaacgaatgaaaaagttttagacaaatctttgacaaccatttgctggctcaaatgttgttgttttctaaggtgtttctcaacatattgttttattccattaggtattttatagaggtattatactgttttgttaatgagaaaactagctaaacattttgaacatcttgctgacatttaaaattaatttttacttggagagattatctcaaaaaatattgtatatcacatatatttataagtatctatatatatgtatatatattcacacatctaatgtgtggaaaagataacattactcagaaaacaatgatgaccttgatattttagcctgacaatatgtgtttgaccactcataaactttgtaaatgtttgtttattttgtaagaagaagttaatgtttttgctcgagtttggcttttagataattttttctctatcaagtgtattaaactgttttactttttaattcttttaaatccaatttgtctttttattttattttttaaatattttaaattttattttatgttcagaagtacatgtgcaagtttgttatataggtaaactcatgactcagtggtttagtgtatagatttttttgtcacctaggtatcaagcctagttcccattagttatttttcttgatcctctctctcttcccaccctccccctctctgataggccccagtgtgtattgttcccctttgtgcattcatgtgttctcatcatttagctcccacttacaaggaaaatatgctgtatttggttttctgttcctgcattaatttataaggataatgtcccccagttccatccacattcctgcaaaggacatgatatcattcttttttatggctgcatagtattccatggtgtatgtgtaccacaatttctttatccagtctattgtagatgggcatttaggttgattccatgtctttgctattatgagcagtgctgcagtgaacatcgctgtgcatgtgtctttataatagaactattcatattctttttggtatatacccagtggtgagattgctggatcaaatggtagttcttgttttaggtctttgaggggttgccacactgctttctataatggttgaacctaatttacactcgcaccaacagtgtataagtgtccccttttctccacaaccttgccagcatctgttattttttactttttagtaattcagtcaaaatggctattctgactgatgtgatgtgagatgacatctcatttaggttttgattttcttttctctaatgattagtgatattgtgctttttttcatatgcttgttggccgtgtgtatgctaaagtatctgttcatgtcttttgctcagtttttaatggtttttgttttttgcttgtacatttgtttaagttacttatagattctggatattagacctttgtcagatgtgtagttagaccattttaacttgtagatggcagagttgattttagcccataaaaaagccacagtaaaatgttgaatatcatgttttcattttcagatttgctatacttgaaaccacttgttccactgtaaaatgtaatcctttatgaattttatatttattgattcaaaggttctatgtttacattgccatgccatgtctaacaataaggtccacttgtaagtagatttatttgttattggtaacaataatctcacacaattttgatgtattcaggttaaaattttaagtatgataactttgctttcctgttgtagaaagattttaaaattaacattaatatgggtttatgcatgcctctattaaaatataatcagaagcaattattagatttccaataaataactggtttattgaataattacaactcacaggaagcatttacaaaggaattttataatgtctcccacattctttattatttgttcaagttggagaagttcttttcctgctctttgaaaactcaatgtaatgattttacgatcactcttaagtcataaaatgtcctataaatcatttttagttgccaaatattctcagttgggataataataaatctagcctggtaagaagccagtatccagacttcattgtaggttgataggccagctatatgtgtgtattaatttccttttgctacataacaaattaccataaatttagcagctttaaacaatactcatttatcatctcacagttttgtaggtcagatgtctgggctggttcaactgcgttctattcttagagtttcacatggctaaaatctaagtgttggccaagctgtgatctaattttagggctgtggagaagaggtcacctccaagtccattcaaattggtagatttcatttccttgcagctgcagaactgaaattcctgttttcttgcggtttttacctgagggtcactctcagccatcagagcctgctccatccatctggccctctccatctcagcaatgaagaattccttctgctgaccctctctctcgttttgaatctttctcttccctgccagctgaagaaaactctttgtgtttaaacaattcatgtgattgggctaggcccacccagataacctgcctattttaaggttaactcgttagtatccttaattacatctgcaaaaatccctgtactgtgtaatataacataatcacaggagtaacaccatgggctgaaggtcgtgggggccactttagaactctgctaccatagtgctggaggtcagcagtgggtaaggagagcatgacaggtatctctgctttccactgccatccctaagctttctatttattgttctgatttctctgctatgaggcagcatggggtactggggagaagaggatggcaaacaaataagaaaggaagtgaaaatgttcttaattgttactgttataaactgttttttcactatgtgtttgacagttgtttcaagctaagcctttctagtgagcaccttcaaagagttttggatatcccttaatattggggaatatttgcctgtaattccttaataaggtagtacattttcctccctgggaatccagagataacttcagatttcctctgctgagggtactttactcccagcctcctctctcactaatataccattgggactttatcctggctgtcttttacacatgagattatatgtggcctacataggaaagtctacatgggaagacactcctatattctttgtcctgacaaactttgagagggcaggccaatttctgagcagccacttatgtagcttgtttgtcaactgtcaactagcttttctcttaccttcacaggtctcaaggtgtagtcagacaatagtgtactctactgtggcttttaaattctcagaacgtatataaagctctccaggtgggctttttgaagatcccctctttcagttgaggtgatgaagaggtatttctcattacatccccttgcagatggtgaagcttagaacagaactcttcgagaaatctgcttcaaaaatcttctatcagtctctattctcaacatttcagtgtgcatgaaggacttgctttctgcttctccacatctattaaaaaaattggtacgttgttatgagatgtactgccttggattctgagctgattctcccactttttaattaccttgaagtattcactgtgttccacacattattctacatactttatatgttttatctaatcaaatgttcacaacaacccattgagaaatatgcatttaatagccctattttgtggatcaggagaataaagtatagaaagattaagtgatatcaatgctctctatcgaaaggtcatgggggacacttctgtggttgactgaattgggtttgttactcattgggatgagagagaactatggggaaccatagattgtctcagcaaaaggacattaaaagaatatgttggccgggagtggtggcttacgcctataattccagcactttgggaggcagaggcaggtggatcacgaggtcaggagtttgattaccaacatggtgaaacccaatctttcctaaaaagacaaaaattagctgggcatgatgatgtgcacctgtagtcgcagctactcaggaggctgaggcaggagaattgcttgaacccaggaggtggaggttgcagtgagcctagatcacaccatttcactccatcctgggtgacagagcgagattccatctaaaaagaaaagaaaagaaaagaaaagaatatgttatagaatttgggttttggttgggtgatttgggaagtagcctaagaatgtagaaatttgttcttgattgaacgctgtcaaaaaacaatatatcccaataaatcttaagttttggaagggcagactagagtgaagataaatatgtaattaataaaaaagtagattgggcatggcagctcatacctgtaattccagcattttaggaggctgaagtgagaggactgtttgaggccaggagatggagactagactgggcaacatagtgagaccctgtctgtacaaaaaatagtaaaaagttagctgggcatggtgcctcacacctgtagtcccagctacttggtggactaaggcaggaggatcccttgagccaggagtttgaggctgcagtgagctatgatcaagccacttcactccaccctgggtgacagaacaaaaacctatctcaaaaagagagggagagagagtgagagagagacagagagagaaagagaaagatagcacctgcttctattagccaaaagaggggtatttggtattttgtaggcatcaagctgaccttgcttttgtctgtgcttagacaaaattatgaaatgaccttgcttgtctcattttatcatgctcatggacaacatatctgagggttacattctgtgcaaatctgccataggagaattatgtggccaactgaaaatgccaggcccgcttccaaatgtcagattcggcttccctcccctccttcttttccttctcatgacttgcttaatattacagagctattaaggggtgcaaccaggaatcaaaccctaacactctgcctccaggatccatattacaacaactatactttactaacagtttaactgataactcaataatttttttaatccattatccttatgtagttattttattccatatattttagccataattgtataaattttggctagatttttggctaaatgatatttaataatggccttcaatgttcacatgtatttaggaaggaaacatatttttcttttactaggattcattacattgatatagctaagaagccctgaactcaagtgtaagatttggtttcctaggtcaattctaccattccgtacatgctgtttgagtcatctatgttcttttttgtgattgaaaagagttccagtgtatatttatattgtgttttatacttacctatgtaattacctctgctcatgctctttatttttcatgtggaactgaattaccacattctatccttccttttctgtctgaagatcttatttctcatacagcaaatctgcaggtgacaagttctctcagtctttatttatctggaaatgtctttatttctttttcatgtttgaagattagttttgttagatttagaattcttggctgatagtctttttctttcagcactttgagcatgttattcctccttcttctggcctctatagtttccaatgagaagttgctgttagtaccattgagtatcatttgtggatgatttgtcactttcctagtgctgctttcttttttttttattattatactttaagttttagggtacatgtgcacaatgtgccggttagttacatatgtatacatgcgccatgctggtgtgctgcacccattaactagtcatttagcattaggtatatctcctatatgctatccctccccactcccccgaccccacaacagtccccagagtgtgatgttccccttcctgtgtccatgtgttctcattgttcaattcccatctatgagtgagaacatgcagtgtttggttttttgtccctgcaatagtttactgagaatgatgatttccgatttcatccatgtccctacaaaggacatgaactcatcattttttatggctgcatagtattccatggtgtatatgtgccacattttcttaatccagtctatcattgttggacatttgggttggttccaagtctttgctattgtgaatagtgccgcaataaacatacgtgtgcatgtgtctttatagcagcatgatttgtagtcctttgggtatatacccagtaatgggatggctgggtcaaatggtatttctagttctagatccctgaggaatcgccacactgacttccataatggttgaattagtttacagtcccatcaacagtgtaaaagtgttcctatttctccactactctccagcacctgttgtttcctgactttttaatgattgccattctaactggtgtgagatggtatctcattgtggttttgatttgcatttctctgatggccagtgatggtgcgcattttttcatgtgtcttttggctgcataaatgttttcttttgagaagtgtctgttcatgtcctttgcccactttttgatggggttgtttgtttttttcttgtaaatttgtttaagttcattgtagattctggatattagccctttgtcagatgagtaggttgcaaaaattttctcccattttgtaggttgcctgttcactctgatggtagtttcttttgctgtgcagaagctctttagtttaattagatcccatttgtcaattttgtcttttgttgccattgcttttggtgttttagacatgaagtccttgcccatgcctatgtcctgaatggtaatgcctaggttttcttctagggtttttatggttttaggtctaacgtttaagtctttagtccatcttgaattaatttttgtataaggtataaggaagggatccagtttcagctttctacatatggctagccagttttcccagcaccatttattaaatagggaatcctttccccattgcttgtttttctcaggtttgtcaaagatcagatagttgtagatatgcggcgttatttctgagggctgtgttctgttccattgatctatatctctgttttggtaccagtaccatgctgttttggttactgtagccttgtagtatagtttgaagtcaggtagtgtgatgcctccagttttgttctttcggcttaggattgactgggcaatgggggctcttttttggttccatatgaactttaaagtagttttttccatttctgtgaggaaagtcattggtagcttgatggggatggcattgaatctataaattaccttgggcagtatggccattttcatgatattgattcttcctacccatgagcatggaatgttcttccatttgtttgtatcctcttttatttcattgagcagtggtttgtaattctccttgaagaggtccttcacgtcccttgtaatttggattcctaagtacttctaactcattttatgaggccagcatcatcctgataccaaagccaggcagagacacaaccaaaaaagagaattttagaccaatatccttgattaacattgatgcagaaatcctcaataaaatactggcaaactgaatccagcagcacatcaaaaagcttatccactatgatcaagtgggcttcatccctgggatgcaaggctggttcaatatatgcaaatcaataaatgtaatccagcgtataaacagaaccaaagacaaaaaccacatgattatctcaatagatgcagaaaaggcctttgacaaaattcaacaacccttcatgctaaaaactctcaataaattaggtattgacaggacatatctcaaaataataagagctatctatgacaaacccacagccaatatcatactgaatgggcaaaaactggaagcattccctttgaaaactggcacaagacagggacgccctctctcaccactcctattcaacatagtgttggaagttctggccagggcaattaggcaggagaaggaaataaagggtattcaattaggaaaagaggaagtcaaattgtccctgtttgcagacgacatgattgtatatccagaaaaccccactgtctcagcccaaaatcttcttaagctgataagcaacttcagccaagtctcaggatacaaaatcaatgtacaaaaatcacaagcattcttatacaccaataacagacaaacagagagccaaatcatgagtgaactcccgttcataattgcttcaaagagaaaaaaatacctagtgctgctttcaagattttgtttctgttttttgataatttatgatgggccctgttgtagatatcttttagtttatcctacttgcagttttcactgaggttcttaaatgtatactttgatgtttcccatcaaatgctagttttctgtcattatttctggttcctcactggataaaaagtaaatactttataatgtttgttcccactccactgatttccaaatttcttcagaaactctgggttgattttctgttttagagtcaccataaacgtggtctccaagattaagttcttagaagattatgataggtagaaaagagtctatgctgttataaacattgatgacattgaaaatcaatctagtaatagcttttttgttacataatactttatttgtccacaaataagtggcctcttttctgatgctcttacctatcaatgattattaaaattctcaaacttttatgtggcaacgttcttaataatttaagttcaatcacctcatatatggcaaattttcactagatgtctagaacaaatttatttctgtatgtaaactatgcttcctttttatagatggtataagccatggtattttccactttttgtgggctcccaggaagagcattgtcaactttgcatataactgtggtagcttcctttacctaagtaaactcctgtgatttttttcttcctgtttctgtctaccttacacttctgttactttaagtagttttaattacatacttatatgatattttttattatagtagttagattataacttttaaaaattatgaccatttcaagtatttggatgggtgaattcttccagtaataaataaaggcatagtttacatatttttaaattggaagttgtgggtttaattattggctcttatttttctctcaagaaaaaaagcaaatgttattgaaaagtagacttttctgcaaatgatgattaatgaccaatgatacttctactgacccaatgatacttctactgatacttctaatatagcggtattagtttaatggtgaagccaccaatcacttaggtaatattgaaatatattgttgaccctaaccacaagtaacataatttggagtgctgctaggcagaattttttaaaggcattatcacaaacccttgctgcatctctcgcttacctaaacatgaaacattttgagaccaataattagttaagttttaattcttaacattcacaggttttgattttatactcttgtaattatgatgccttaaatgtaacttgtttttcagcaaggactttagatgactggtatgtaaagttgtaggttgtatatcttcatttaggaaatagtttgtatgctccaaaagtctaattgtctgtagatgaaagaaaattacaataaatgttggcttataggaattgccaattcaggccaaaaagcctaactggtttagcaaacaatattagtcagatatcaagttcaaaacaaccaaatgttatatgaagaaaaagtgtatttttaggataagtttatataaaatttcaggccaagtttctgtgtaaaccttaaacttcaatatttttagatagaacccaagtctatgcctgtacaaatgtaattttataaacttgttatcacattctatttcatgattaatttaaatatttgtattgcaaaatattgcttaattgttagaagctacaacagttttcatctgatgaattcagtgttacagctactggtaattacaactaggcttttatagtatatacatttctctcctttggttgattatattgtttggcaaaactaatcccctaaaaaattccttacaaaataattcatcataaaaaaagaaaatcagaatgtaggcaataatgtgccccatcaacatgtatatgacagctctttccaatatatagcataaccactgaaatataatcatcattgtgaatatttaccgtgcacttcatctgtcttttactgtgcaatagtgtttttcttgggtatttctgatatcaaatccttgtggattgctaaattttgattttcactcaatttttaggaagcctgtaataaaataaaatgtgtttcctaagaaatttgataaaatttacagagttatgcacaaatgataaaaaataccacatttaagatagttccttaaatcaagatcctaataagggcaactttagtataacagactattactgaggattttcattttcattgcccgtctttacatacccagttgggttctagactggtacaccttgtatggaagagattagttagagactgaacaactctctcttttgtcttcattagtactggggcacgttaaatttcccagcctctctagcagttaggttggagccatgtaactggctctggttaatagaatagagggaacatattattgcctggccatgaaatatatgatttttccatgatctcactcactgtctggaagtcaagtactccaaaatagcagcatcacgtgatgatgagaacctagaccttggaattcttttcttggatggaattgctcagaaaaatagcttagctagaaacatctgtattggactttgtgtaagtgacaaataaacatttgttgaattaagcaaccaagattttagtttgttatagcaactaccaagtgctacactgagtcatacaactggcaaaaatgcaaggttttctgaggagttctcaaaacaagtaataatttctggattagaacataaaataaatatgctttttgtgattattcttttgtccttaacatttataaatcttccactcaaaaataattatacagtacatttagaaatgaaaatatatgtgcataaagaagatatacactattgcatctaagttttagtatggttttgaatagtactattataagaacaaatgtacatgaattcagctcttagttttgtaattaatgcactttcacaatctctgacaacactgtttttaaaaacagctgatagtttagttacaaatttccaggaacttagcaaatgtcatagggtaagctgtgtgctgtctgttaacacagagagaggtaagtggaatttagcacatttcaaagagaaagcaaaaagttagacaaaccaataatcaaaattaaattttgtaaactatgttagataaatgcccaccaagagttaatagaacaaggcttagaaatatctgtagataaagttatcagtgactttactgagaaagtttacaataaccatcttttccgaagccatagcattccttataagtttttatatatagtttaggtatcacacagattctattttcttaggctatcataggaaccgaatcaaggttattagattggaatattggtatagaaaccattccaaagcttcaaagaaatgaatgaaattcattatgtcttgcaagacaaaacttccatctcttatttttaaaatgtctgcttaaatgaaatccccaaaaattacttatagttaccttatatgagaagttaaatttgagttaaagttttcaagttcttttgcaaaggtacactgaattccgtcactaaatactttcctaatatgcttttggaaaatatattcaagatcctatgtctgtcttttccttttttcaggccttggatctactcagactatgttgataaaagataaatagatctcttgcaggaagaattgtactttctgcgataaaaatttaatgggctaatatttaattatgttggttggcaaatttaaaaattatgcaatatgaaggattataacatcaaataaaagcagagatgaactttttagttcaaagattcagcagcttgttctatcacttactgtagactgtgactgtaaaggaaatatagtttagatgagctctcagttcatactgcttcaatgcattaccatgggctgggtggcttaaacaacaaacgtttattttcccatagttttggagggcaagaaatccaagatcaagtccctggctgatctggtgtctggtgagggtacattcctggtttgcaaaaatagctgtcttctccttgtattctcacatggctgagaatagagagcaagctctgacaagggtactaattcctaagggctcggccctcagcacctaattacttgccagaagaaacctactaataccgtcacattggacgttaggatttcaacctatgaatttttgagggatgtaaccatttagcccatgacacatgctaacttttttaacagtaaaaaccggcctaaaaataattatcttctgaaaatatcctgacagatgtgaaaccacatagcaacatgcttcgcacacatttggacatatgtattcatagagttctatatttgggtacttccatagaaatctttaatagctaaagcagtgattatttactatattaaagtgtttttctgcattatttcatttcatcttaatgaaaatcttagttaagtttattaaacccattttataggtaaggcaacaaaggcttataaagcataagtaacttgcacaaatacatagaaatttgtaagtattggagccagaattcggacccaattctgtccaaatcccatctcttactcaagcttcttattttatagattaaaaatcagaaccttagaaagaagaaataatttacttgaggacacatgtctaaccactgttagagcacatcttggaacccaaatattctggctcatatacaatactaagtgttgatatttgtttgttaaatttattttttttcttttttttttttacatttagaaaactccaatttttatttttatttctttattttattttattttatttcttatttttatttttcgcagataatttttgtaattttattttatttatttttttatgattattatttatattattattatactttaagttttacggtacatgtgcacattgtgcaggttagttacatatgtatacatgtgccatgctggtgcgctgcacccactaactcatcatctagcattagatatatctcccaatgctatccctcccccctccccacaccccacaacagtccccagagtgcgatattccccttcctgtgtccatgtgttctccttgttcaattcccacctatgagtgagaatatgcggtgtttggttttttgttcttgcgatagtttattgagaatgatgatttccaatttcatccatgtccctacaaaggacatgaactcatcattttgtatggctgcatagtattccatgttgtatatgtgccacattttcttaatccagtctatcattgttggacatttgtgttggttccaagtctttgctatcgtgaataatgccgcaataaacatacgtgtgcatgtgtctttatagcagcatgatttatagtcctttgggtatatacccagtaatgggatggctgggtcaaatggtatttctagttctagatccctgaggaatcgccacactgacttccacaatggttgaactagtttacagtcccaccaacagtgtaaaagtgttcctatttctccacatcctctccagcacctgttgtttcctgactttttaatgattgccattctaactggtgtgagatgatatctcactgtggtttcgatttgcatttctctgatggccagtgatgatgagcattttttcatgtgttttttggctgcataaatgtcttcttttgagaagtgtctgttcatgtcctttgcccactttttgatggggttgtttgtttttttcttgtaaatttgtttgagttcattgtagattctggatattagccctttgtcagatgagtaggttgcgaaaattttctcccattttgtaagttgcctgttcactctgatggtagtttcttttgctgtgcagaagctctttagtttaattagatcccatttgtcaattttgtcttttgttgccattgcttttggtgttttagacatgaagtccttgcccatgcctatgtcctgaatggtaatgcctaggttttcttctagggtttttatggttttaggactaacgtttaagtctttaatccatcttgaattgatttttgtataaggtgtaaggaagggatccagtttcagctttctacatatggctagccagttttcccagcaccatttattaaatagggaatcctttccccatttcttgtttttctcaggtttttcaaagatcagatagttgtagatatgtggcattatttctgagggctccattctgttccattgatctatatctctgttttggtaccagtaccatgctgttttggttactgtagccttgttgtatagtttgaagtcaggtagtgtgatgcctccagctttgttcttttggcttaggattgacttggctctgcaggctcttttttggttccatatgaactttaaagtagttttttccaattctgcgaagaaaggcattggtagcttgatggagatggcattgaatctgtaaattaccttgggcagtatggacattttcatgatattgattcttcctacccatgagcatggaatgttcttccatttgtttgtatccgcttttatttccttgagcagtggtttgtagttctccttgaaaaggtccttcatatcccttgtaagttggattcctaggtattttattctctttgaagcaattgtgaatgggagttcactcatgatttggctctctgtttgtctgttgttggtgtataggaatgcttgtgatttttgcacattgattttgtaaactgagactttgctgaagttgcttatcagcttaaggagatttggggctgagacaatggggttttctagatatacaatcatgtcatctgcaaacagggacaatttgacttcctcttttcctaattgaataccctttatttccttctcctgcctaattgccctggccagaagttccaacactatgttgaataggagtggtgagagagggcatccctgtcttgtgaaagtcctgagtgacctacaaagagacttagactcccacacattaataatgggagactttaacaccccactgtcaacattagacagatcaacgagacagaaagtcaacaaggatacccaggaattgaactcagctctgcaccaagcggacctagtagacatctacagaactctccaccccaaatcaacaaaatatacatttttttcagcaccacaccacacctattccaaaattgaccacatactgggaagtaaagctctccccagcaaatgtaaaagaacagaatttataacaaactatctcttgtttgttaaatttaaaaaaaatccatgagaaatagatcttgatgactagagaactgcattcatttttgatgaagaaataaaagggaaaacattagcaaataatgtaatggtcataaaagtgcatattaaattaatgatgaaacattattgcactgtcagaataccagtaattttttttaagaaatacgtttataatatttgtaaaattacattgattgaatctgattgttttatatataaaaaatgaaataattttctaaaaaatgaaataaggaagttgaagtagaattataaaaacacaggtataatacattatctagagcttagtagcaaatcctaagcaaaattctgagtaaaaggaaaatacacgagaaatacttaaatatgaccaaatgatttaccagaaaccagttagaaacatttaccaagtggtaaaatctagattatgacaaaaatttcagacatcatccactggtgccacttgggaggttttagataatgcaagacaataatataaactagtaaggataaacttagacaaaggaaccaaatatctgtgtttgcttattataattacatacacaaacaagagtatttatataattaccagctaaaagattaatataatttaataatttgtgctaatatttgaatattaaaatgtcaaatgtcaagatagaaatgcaaaatgtaatagcttctctacctaaatagtatacagttagaaatggacatgataatacttaaaaataagatcattcttggcacccttgttgaatatcagttgatcatatatacatggatttatttctgtattttatattgtgttctattactctgtatgattgtctttatgcaataccatactgttttgattactgtagctttgtaaggtattttcaaagcaggtggtgtgatgtctccaacttcatccttctttctgcagattgatttggttatgtgtaattttttatggttccatatgaaataaaaaattgttttgtctatttctgaaaaaaagcaccattaggattttaatagaagttttattgaatctgtaggtctcattgggtaatagggacattttaacaatattgtcttccagtctgtgaacgtgagatgtcttttcatttgtttgtgttctttaatttctttaattggtgttttgtagttttcagtaaacaagtcttttacctccttagctaagtttattctaagtattttattgttttttaggactgttgtaaatggggttgttttactaatttaatctctacaaaaatagcattggaaaattggatatccacattcaagaataaaattggacccttaccttgcactgtacttaataatcaactaaaaatggattaaagacacaaatgcaagaattgtaactgttaaactcttagaagaatacgtagttaaaaatattttcacatttgtcttggcaatgacttcatggatgtgacaccaaaagcacaggcaacaaaaacaaaccagtgagaccacatcaaactagaaaacgtttgcacagcaaaggaaccaatcaccagagcaaaggcaacctatagaatgggagaaaatatttgcaaaccgtgcaactgataaaggattaatctccaaaatatataagacaatattccatttcaatagctaaaaataataactcaatttaaaaataggataaagacttgaatatacatttctctaaaaaagacatacaaatggccagcatgtgtatttttaaaatgtccaatgccactaacaggaaaatgcaaacaaaaccacagtgaaatattacctcatacctattagcattgcttatatttaaaaacacaaaagagaagtgttgacagggatgtggagaaattggactttttgcactctgttaatgggagcacaaaatgatgtagccactatggaaaacagaatggaagtcccttaaacaattaacagtagaccatatgatctagcaggcccagttctagatattttctaaaggaatttaaattgggatctcaaagagatattagcagtaccatgttaattgcagcattatgcataatagctaatatgtgggaaatctattgacagataaatgaattaaaaatatgtacataaaatggaatgctattcagccttaaaaaggaaattctgcaatatgtaataggagagatgagccttgaggacattatgctacatgaaataagccagtcacagaatccccaaacctgaccactcatacgaggtatctaaaatcgtcaaatttataggattaaaaagtggaatggtggttacgaggggttgaggcatgggaaatgggaacctactaatccatgggcataaagtttcagttacacaagatgaataagttctatggatctgctgtacaacattctacctatagtcaacaatattgtattgtacacttaaaaatttgtgttgagggtatatctcatgttaagtgttcttaccatgataatataacattttaaaaaataaatagaagagtgactcaaccacagagagccagtctatattaaaaaactataaaaatgttattaaataatagaaaacaaatatagacatataatttaacatttgattaaaaaatgtcaccttttccaaaatgttcatggaatttaatatagctctgttcagcattttggcatttcctatggaattctagctaactggttagatacaaaataggtaagatgattttacattcatatgaaacaatgactgccaacaatttagagaaaataattatcaatttaaaatatcagcaagaaacataatattactacagaaaacataatttggttagaagagaggatcaaatcactccatataattatagaattttccttgtggaaaaatgatcactctcaaatgtcattagagggggtgtaaagtgttacattatttctagaataagctctgacaatattatttttttcttttaaagcataacccctctgactcagcaatgtaattttagggttctattctgtaggaaaataattaccaaaaatgagtatttattatgtaacttcttgtttgtttgtttgccttttgcagtggcctagatctagaaacaacctcagtgaacattaattaagaaagtattgactaaataatggaataattgcattctggaatactatcaaactaccagcaatgaatttg

SEQ ID NO: 2343 - DNA, 462269 bp, Homo sapiens
tcaactgcagatgttgtggatcgttttagatgctaatagaaatacctcatgggactgtttcctggggttagaggaaaaacaaaacaatagtgcaactctaagaccttgaactagtaaaaggcctgacacattttataggctggtggccataagctagtgaagagattcttcatttaagcaacttcatttaatcacgttaattacaccctgtggccctgctccagaattcacggtacatattgctttacaatttcttgggtgacaaacgtgtttttaagttccttagaagtttatttacgatgctatgaaaatgtagccatgccagagaggtgagatctgtaagcttctgagttgctgtgtgaggagaaggatggggcagaatgagaaagcctccggcagctctgaagtggaatgtgagaggaatggcaaaaggataacaaggatggatactatttttatgtcctattttggcatgctccatgaaataatcattagaagtaatatattattaaattatcatcacaacttaatgaggcggatactgagatccacatttgagagagaaggaaactcagagaggcaaagcaacttgccctggtagggcctgcaatgtcttagccttaggatttctcagcgtggaagattcttggatcgggggtgaggataagtggtggttaccttactgcagccccaggagcctccaaatggccaacagttcttctcttgggaatggatctgctgcctccttttcttcttcattcttgggaatgcctcttgctttccctgctgtcctccaatccccccgctaccctgatggctgctcaccaagtctgagcagacacgaacctgtattccttgcctttctcccagacagctactgctcagtcacactgtattcatcagttgttgaagtttgaactcgtatggggagaaagcagtgacaattatttggtctctcccattgactagttagaatgacttttgtttctaactgatattttatctgaaccaaagagaagatatgacctatttttttctcttttctttttctttttttcttttttttttttttaaagagatggagacttgctctgttgcctgggctggagcgcagtggtacgatcttggctcactgcaacctccacctcccgggttcaagcaattctccttcctcagcctccagagtagctgagattaaggcacatgccaacacacctggctattttttttttttttttgtagttttagtagagacagggtttcaccgtgttgcccaggctggtctcaaactcctgagctcagtcagttcgccctccttggtctcacaaagtgctaggggatatgacctattttctaaatgcaccttggtagagtctccaaataatctcaatgtgtggcctcagtaggctgactcaggatcacattcctggaacacttacataacaaggcctcttagccaccttgtacttgtggttccatgctaatatgttactgatgaggtcatcaggaggaccagaatgggaaaggggcatgcccaaaaacacacaggacagcaacccgacctaaccctgagttactatgtatccatttccctcaacaaacataattatgctgtgagcaagatgttggccaaggtgctgaaggaatcaacagccaaccctaatagagttttgagtccagcattaaacattaaacaatcgcacaatttgtcattgttcgccactctaattgcacagggagtggggagggactattaacatgtgtaactgggagacttggtctagtctggaggtcagatgaggctatgttgcacaatgatgttgagctctgaaatatgaatagaaatgacattgagctcagaaatatgaatagaaatgacattgagctctgaaatatgaatagaaatgacattgagccctgaaatatgactagaaatgatatcgagccctgaaatattaatagaaattgattaggggaaggcatgaggagaagggattcctgggaatccaggatcggaacagcacatgtggagccccaagaggagaagcagcacatgtatttgaggaactaaagggaagaccatggcttcggtaggaggagtgaaggggaaatggctgggatggttggcagggccagggatgcagccttgaatgacacaggggcttggctgttctgttacagcagtgggaaggagtcagccaagcaggagaatggctgcgcctatttgctcttgagagaacatcaccagctgctgtgtcccaagtccagttccagagcagcgtactgggcccctggtctacatgcactgaaacttatgctgccatcacggacatgtctaaaataaaagagcttttcttttatttgtacttcttttcctgctttgctattgtggattaataaaattacatgcatgaaattactaaatttgttttaaagaagataaagctattcattatagaacttttcatgtttaactattagcttcatagaaactgaaagtagaagcaattctatgaaagatactgaaatatgaaaatattgtccccgtcctcaaaaattatcccgttagatctagatagaaccaggatacctataacaggatcacaaaaagactgataggtgcaatgcacgtttctaagcattgagcagcttgttttcttgaaagatacatttctttaatgaccactcaaaatgtcacctacaggagatgcagggacattagtttgtgacttaaactgaagtctttatatagtgcgttgcttactgggaagcgttgggaaacttgccaccctgagcactgatccttcaggaaaaccattgcctcctacctgaatgcagatggacatacccttcagcccgtggggcctgctgcatcctgaaggctgggacctcagacagtcatgtggttatcaagcctggaatgaacccgccagggtgtggacacagcatcacggaccagtgcaactgcaggatcaggactccagggttcaagcccaattcttttggggaaaatggggctgatcctgcctgcctatgggaagtctgtacggttcaacaagagtttcaaatttttttgttaggggagattttccactggactagaatcttttcagcaaaaataacccatagacagttaaagtgaacacacacacagatactaagcgagagttgtttatgtgagctgcttttatgaggtctctattgagaactacctgaatgttctctttggcagggggctgcccttggggcggagggctggtattccctgcagatgcacccccctgcctcacctgctcccctcttgcctcccagctggtaagatctgtatctgttagagaattgagtccttcccgccagaggtctgctgagtttgccaacacaggcatatcttaaaatgttttattcactttgtctgtgactcagaaggttcatttcatccctgggaaaccacttaccatgaggcagagaccctggcatctgctggcttttctgcagcacaccagcaatactacaggactctgatgggaacttactaaagaaaaaaaaaattacagctcccaagatatttagatcctacagagatggcttgaattcttcttccagaatttagaattgatttcaaaaatcagaaatacaaatctgagtttatgcaatgctcaggtgtgagttaaagaaatacagggaagggctgggtgtggaggctcatgcctgtaatcccagcgctttgggaggccgaggtgtgcagatcacatgaggtcaggagttcgagaccagcctggccaacagggtgaaaccctgcctctactaaaaatacaaaaattagctgagagtggtggcatgtgcctgtaatcccagctacttgggaggctgaggcaggagaatcacttgaaccagggaggcagaggctgcagtgaggcgagattgcagcactgcactccagcctgggcaacagagcaagattccatcaaaaacaacaacaacaacccaaaacaaaacaaaaaaccgggaagaaagaatcaagtactcatttttaagtatttcagtaccagaaatgctggcagtttgcagaggccaccactgtggtttctttcctttagtctttcagggggtcctgtaagcaaaccaggtcctagaacaggaaggaaaagtgctttctggaaaatataattggccacatttgaacaaatggtaacccatttttcctgctctgctgtttcctgcctagattcctttgtgggtggagtcatcggcctcatttttgcatacatttgctacagacagcactatcctcctctggccaacacagcttgccataaaccctacgttagtctgcgagtcccagcctcactgaagaaagaggagaggcccacagctgacagcgcacccagcttgcctctggaggggatcaccgaaggcccggtatgaccagtgtcctgggaggatggacactaagccctgggcacatctgccaccctgacatcataacacaatagaaatggttttctgtagtgtatttttcatcagttgtttctcaaagtcatcgtacttctgcttctgtttcactgatggtgttcctgctactttaaatgtctacttccaacatccttgaatttgcaagtgaaggacaacaatctctgagagacgtgtggaagaggctgtgaaggtggggtttggggagcttggccgattcgtctatctgaaatgtttgctgtaacagccaccttcctatgttttcatggttgtaaaacataataaaacctcccacgtggaagacttggtgttggccacccagcgcaacaagtcatttggagatgcagcaggtttctcagagacccaaagccagctctgtctgtaggtcattccaggtgctgagcttggaagcaaaggctcagaacctttctgagccatcagcttctcatagcccacgtctctaaaatagatttgaaacttggagtgacagcttgagcatttccagggcttttgaatcattgaatctggaagcaaataaaattaataacttcatgcacagacttccaccaaacacaatgagcatgaagatgcatgagtgcatgtgtgggggatgaggtcacagcagttgcctgagggttcatgggcacaatatccttcccatcttccagtctaagtttatggagccacttctgtagctctgcctcatacagtgaatttttggggcacgggggctttacttggctcttctgcaagaagtgatgtgaccgatctcacagatcagaaaccgcatgcctggggctcatctcaagggagtggctgagtggccattggggataagaagcaacttcaggctgagaatttttcccctttaggatctgagttttgcagagctctgctctaaggattctccaagtggtggtgtgttcctgttcctatctagctggcaatatttcagcatgataggactctggtagaaggtacaagaacagaatcaggaatgtgctgtgtctctcgctcagctctttgcattgttgaatacagccagtcaatatgaacctttttcagtctgagtatagagcacgctgctccttggccagctagttttttcaaggcaaggagcatccccttcatccaattctgattggatgtaccatgtggttgttcagattcctgggcctgggtgctacgaggtgatgcatctttgctatccagagtgtcacttttttttttttttttttgagatggagtctcgctgtgtcgagactgcactggagtgcagtggcgtgatcttggctcactgcaacctttgcctctgggttcaagctattctcgtgcctcagcctcccaagtagctaggactacaggtgcccgccaccacacctggctaatttttgtatttttagtagacacggggtttcaccacgttggccaggctggtctcggactcctagcctcaagtgatctgcccacctcggcctcccaaagtgctgggattataagcgtgagccactgcacctggccaagagtgttgcttttgggcagttagcataacagactgcattttgagagactcaggtggctgcctaaatggtcagcttatcagccctgggctgcgtgtgcaagttagaagcatcagaatatctttgatcagccatttctgttaagctccatgggcttaagcttggagtgcatgtaccactgactatgctccatgagccccagtgcagccctctccagccctggtccttccaaactggctttggcacggtcatgtgattgtcccctggatggagtgggagagggggaggcttgaattgactttcatccaaagtcaagccattgattttttaaaaattatagcagttacattggcaagcaactttgaagatgaatgtgagatattttaagagataaatcatagcaattgaaaagacataattttaaattctgagctaaaattcatttaaaattagaaaattaaacaatactctaatttaactaaaaactctataattttcaaaaataaagcccaaaatagaaatgtaggaaaaagatcctttgctactgttaaaaaaaaaaaccccatcctgatgtggcccacattcttatttgattctagttttatctgagcaagaggaaaggaaaagggttgtacttcagttaataaagacttaaaattctggaccatcaagtgtaaatttaatataaataattttatttaaagataaatggccaggaagtactctgcaaagtaacaacagagtattactaatgctgataattacatggaaaatcctaatactggccatgtaaaagctttgattaaaatataattcaaattacagatgatgtaataacatgaagctggtggtaggatcctcaggagccataatgaacagtgtaagccagttcacaaaaggcaggcatttttacagatccttatgtttcaatttcatgctctattcacgtgaagtaaatataacatcacagtgtaccaattaaatggccataatgagaacgtttattcctcaacccctgatttttttttggatgtggggttcctaattcagtctctttggaaaagcaggttacacacagtgtgaagagtccgagcccaccctgggagctgtgggatgtcggaatttcttcctctttgagtaaacttactcagagtccatgttagagatcggcagccacaagctcagataccttgaggtactaggaagagaatacagtgaatgaggcaagtggggtcattaaggaatagtggagactgtggaagactaaaagcacacaccccagggaagtggtgctggagtgcagtggcgcgatccctgctcactgcaagctcggcctcctgggttcacgccattctcctgcctcagcctcctgagtagctgggactacaggcacccactgccatgcccggctaattttttgtattttttagtagagacagggtttcactgtgttagccaggatggtcttgatctcctgacctcatgatccgcctgcctcggcctcccaaagtgcctggattacaggtgtgagccacagcgcccagcccaaacacatattcccccaagagaagtcaagaatcttcattttatatgagattgtttgattttaccttgggcaactgtttccattgagatacattagaatgcaaccaacaatacaccccagtgaaagaagcttaatcagtaggggtttattaagattaaaaataataagaaattgagaggttggtggtctcaaagcccccaggctttcccatgctcttgctccaccatcttcagtatgccagtgattctccctcatgatcacaaggtggctgcagcatctccaagaatcacatcctcatcccatcatgctcaaacgaagaaagaaaggagcccagtcatgtgacaagataactctacttgtcggtctgtttatcagggaagaaaatgtttcccagcacccctgagaaatatcccctttacttgcattggctagaatgatgttggatggccacccccagaagtcatgggggcttggaagagtgaatatccagcattttcagtctctttgcaggagaaagattctacctgcttgggaaaagggttaaacaatggccattgggttgacaatgaacagcatctgtgacagcaccaaacttgtttaattaaaacacaaaaatggcacatcagtcacataaaaatgtagagcaggctgtttgcagtctcctttagggctcacatgtcttcttagtgggttagaatttgagcagaagagccagctctttagtcaatctatttagccctattgaattgcccttctcctaaagagcttttctagctaaagccatggtccttgttgtctgggcatactccatcttcctgaagcttctggcacgttcccctcagctttaccattttgaagatactgttcttttccttaaactcaccgttttctcacctcccatgacttatcacttaagatatgtcccattctttccggttcagaacaaatgggggtcacattcatagttatctgcttcctcttcacatctggagttgaccccacttgggaaggttcttctttccttagaaaaaatcctcacacacaggactagggttccagaaatgatgactggcaaacttcccttccccctccccactcaaaagggagacccccagcctaggtgagccaatctcatctcactcctaggagctagaacagagctgagccaccttaatggcagcctcttagagaagaaaaacataagcccctacttccagatgccccagagtgccccatttcctgcctgcctgaaatggttgctcagctcttctttcagtactgtgagccacccagagcctgccaatgcaagcattttttcccccaactagagctgctttctgtttcttacaactgaaacatcttctaaagaagagctttaatttcatctgtcccagctctccatatgtggaagagttatttccaagaggtgtgcagagcactgcgttgatgacaccgggcttcaaaattccactcccacctgtcaaaaccgaactttccaaaggttggttcatccaccgtgcaaccccaggtggaaatttcagagaatgcctggcaggtagttaatctaaactggcatgttccccaagtcttcagcatttagtgattccaaactctggcactctggcacacacacgaaacatccagctacagtagcatttcgagggaagcctgacacagtgcttggatctttctgtctgtccccacttcaaaacaaataaaagcaaaacaacaacagtaacaacaacaaagcaaaaccattttcctaagttttaaaaagtaaaatgccaatttcagtgtaaaatttaccatgaattttaaagatgtgtgcttctttggggagtattttttcccttgcacgtgtgtttgtgtttatgcctttagaactttgatgggcatgtcctatctcttctcagcacgtcacgtgcttggggacatgtgtacctgctttggtcaagaagaactgttaatatattagaaaatggctttgatagcccctggctataaccatcccaggccaaaggagttcagtgtcaattaggataaatactttaatgtaatttgcaccattgctgctgtctgggagtagaggaaatgaagaactagaaatctagaagcagtttttgtttgtgtgaaggcagaggaaaagaagagatggcctcacaccagtgtttctcaaagggaatttcacagaactggtccagctttgtgaaaatacaatacaatacagatgtgattaatagattctaaattatcctcttacagatccaaatttaaaatagcatattaaaggctctgaaaagtactgccgtgaagaaacatgcccctttttattctttttttttttttttttttttttgagacagagtctcactctgtcaccaaggctggagtgcagtggtgcgatctcggctcactgcaagctccacctcccgggttcaccccattctcctgcctcaatctcctgagtagctgggactacaggtgcccgccaccacacccgactaatttttttgtatttttggtagagacggggtttcaccgtgttagccaggatgatctcaatctcctgaccttgtgatcctcccaaagtgctaggattacaggcgtgagccactgcacccggtgcccctttttattctttgatgacatcttttcatcccagtgcttgcagtggtgctgccatgactgcttgccagtggattctgtaaatgatcaggaataataatgctctcagtgacagacaatgagagtaacatcttaacacaaaatatgctgtgtgatgggtggcgtctcttcttgctatgtggtgtctcttctttttttgccctggaaagatccccagactgacatagaacacagtcacagatgccctggggacatcatacactgtgatgctaaacacctgctttcatccacatacagagtgctcttcaaggatagcacggaggaaagaaccacttagaatggggccaggcagccctgccaacatctctgccacttaaccttgagcaaactgcttcacactcgtgagcctcagtgtctgcatctgcaaaacaggaataacaccaaccttataggaccttttacaatggtttagtgatttagaatgtattaggttggtgcaaaagtaattgtagttttgccattaaaagtaatgatcaaaacagcaagtacctttgcgacaacataataagatatcagaccatgatagttgtgattattgcagagctcctggggtatctgagacatgaataaagtaagcacctggcactaaaactctcttgtcttagtctgttcaggctgctacaatagactatcatagactggtggcttataaacaacaaaaacttatttcttacatttctggagactgggaagtccaaaaccaaggcacctgctgatttagtgtctggtgagggtgtgcttcagggttcatagacccctgtctttttactgtgtcctcacatggtggcaggggcaagggaactctttggggtccctcatatacgaatactaatcccattaattagagtcctacccttatgacctaatgccctcccaaaggcccccacctcttaataccataacattggaagttgggattttgacatatgaatttgggaggagacataaacactcagtctgtagcatctctgaagagtaaatagcaattctgatacaagcaggagaatttcactggcaacactgttatggtaatcaggtattaaaaccctaattgaattataatccctctaatcgctgctgccaccagtaggtaatgatacaatttatcctcttagggaaccagattccccctataagaaggttgaattaataatacagcaaaattcactatgttgatttttagaaacattaatatgtctgaggggtattcaacctaagtcagatgttgctccaggcaccagctatttgggagaaaaaggcccatctgagccaaagccaggacaagacaagcagctttaggggtgctaaggagtgagaagcctccatacaccagggctcactccttaggaggcctcctgaaagaaggggagcaggagaggggcagggagaacctgcatctatccaaggaagggggtgagctaagctgatggatacttgaattattggagaaaagtgtgaaattagaaaaacccatgaaaagacccagaggcttgtgagcctcttagggattgcagaatgttttcgttcacatggaaaccaattgcacaaaaagtgctcatacctgtattccaggagccagcaaggatagtgtgtatgcaaagagagcttcagtgaaaggggagtttcaggaaatgatggacccagccttccttaaaaagaggagtcagatacctccttgcacgcatgtgcacacatgtgtgtacacacatgcagacacacacacaatagagattgtctaaaggtgggtagtttatatagctctccctggatcatataaactgtgtttcacttggacttgccattgactgaagcagactttgcagaacattccaatcttcagctggttatcctggactcccagtcagccccatatctacaccctggagctctagaaagatcccttcctggcacagtggttcacattgtaatcctagcactttaggaggtggaggcacgaggatcacttgaggccaggagttcaagaccagcctggacaacatagtgaggccccatctctacaacaaatttaaaaaaaaaatagctgagcatggtggtgcacacctgtaatcccagctacctctgaggatcacttgagatcagaagcttgaggctgcagtgagctatgatcatgtcaccacacttgagccctaggcgacagagagggaccctgtctctaaaaacaaatagaaaagaatgatctttgaagtcacactcactgctgataacttgagggtgaacccccaaggcaaagcaggggctgccttttggggttgatctgatgaatatcatcaaaatagagtgattttccaccctcataatggacaagagcaaactcagccatgcttgggatcaaatccagctcagatactttcttgagcaaattacgaacctttcaaagattcagtgtcctcatgtgtaagatgggtttttttgtgaggattaaatgaagaaagcatgtatagaaagtgcttagtacagggcttggtacacggtaagtgctcaataaatgttagctcttgtgattggtcaatgtgagctgtcactgtgttgtgaggcacgggctgttctacatgaatgcatttcccagaagagtcgtgtcttgagcctctctcacatgctgaccattttgtttaaaatatttgatagatgaattctacactccctggccttccttgtccagaggcttcttcctaagaactcagtgccaggattttgagtagcactggatattctgtgcaatgggttcgttcatccaatttccaccactttacagatgaactggggatcagagaaggcaagccacctccccaaggtcacacagcttgtgagagcaagacaacagcatcgaggcctatgtaatagcagagccattgcttctttggctctgcggaagcttgtattgtggtatatctgtggtgtagctttgctgtctcctgtgtcaatgtcaggaggacaggctgagctcctgggaccagaacccctcagattccaggaggagcagagaaagcacagatggcctggagagtcccaggggtgaggccagcaagtactttcttcccccaggtgctcagagcatcctctgagttgccaaacagactcccagaggggtcaactgtgggccctaaaccagacagcagctgggaagcaggctctcaggggaactggggtctcaccagctcaggagcaggccaggactcctcagcacagaagctgggaatcttgagtgtccagatcagcctgaaaatctggacttgggaaaagccatctggctggggccacctgcatgccgctgtgactggggcatcctgctgctctcctctctcacaaggtggtgccatctgccttgtcactgctcctcaggacaagcctgactgctctccctgcacctctggccattgagaatccggctgctccatcgtggtggaaaatcttccatgctcagagggacaccttccgacactggggttctggagagcctggtgccacgagacaaggagccatgtgacaagagggggaggggtaggagtgggagacacaagtgtggtttgggacaaaatagggcctgaggctcacgtgttataaaaccccctttgctctgcctgtctccttgaattgtggccagtttcacatgggaagcaacgtcgagggacagggagactgcaggtgaggcctcagggctctgcattcccatccccaaaagtcaccagcgtgtggccttgtgggtgtcactcccctctgtggagtcaactttgtgcagtgacatgcagaggctggactgctgccacctcatgcccctcctggcatgatggtcgcatgaggctgagtgatttgcaggtctatggggaaacccgcctcagagatgtggaggagaagccaggcagagcgctgttcattccatttctttctttttttaatctaaaggagggaaagagctttattaactcaaacaaagggatgccatacaacttcccaacgatactgtgcagtgatggtattagcttccacctgttcttccattctgggggcagggtgtgaggactggctgctctgggagacgctctgagctgagagagaagaaatagctatgctaatagctgccccttactgagtgctcactctgtgtccggggctacaccgagtgcttgcagcgggttctcaggcgcacttagaacagcactgtgagaaaggcacttttgctgccccttgtgtacagatgaggacaaagagggacagagaggtttagaaccttgacctatatcacacagccagtgagcagacgaccggaatttgaatcctgcaatctctctgcagagcctgcgcatttaataccacacacagttctggcctgcagtgaatttggttgttcttcctgcctggggtggtcagtttccaagcctttccagatggacttctgcagcccaaagctgcgtgctccccgtgcaggcccttgtcagagcagagaaagatggctgaagttgttgtccatctagatttttatcttcaaaacattgctgaaatcaatctctcttctaccgtctccgatttcctttgtccttatgggtggtctacaactttactatcattttagtggatgcaagaggagtggagataaacacgtgttcagcctgctgtgaatctctgcagtggctatgttgtttcttaaacagatgtaatgaggcatctattccctgtgtgccatgtgccccttgagtaggggacatctgttttgtgttgtctgtgtctccagcattagaatggaacctggcacacaatagaggctcaattagtatttgttgaataaatgaacattaagaaacagaaaagagccttgttccttccttgtgtctccttcttcatgttttgtagtctgttggaatctcattactagattattgttccagaaacatgttccaaggacaggcatgtgcaggcagaatggaactgggaacgtaaacgggaagcttgaacctggaaagtcacaagggggatggagatttggggagaagtgggagctgggagagcagcagcccaagctgaagatctaagctgggggtcaggagagccagctgagagctttctaggctgcagctgagcaccctgtctatgggcctcccagcctccaggtcaccaaccttgtggggaggtgggagcaggtgggagcataggtgctgggccctagtggacatcgaggtgcacaggtggccagtgaatgtgggatccatgggggcagagggaagccctaggatgctgcagaagcctgaggccagcccgaggccggctctgggaagagggggaggcagctgccataggtgaaggctcaggagggcactcagagatggagactgaaggccggcttgcttctgcttcctctgcccagaacccctgaatttcaggaaacagagaggatggaaggacttagggactctggatgatgagagtttctgcagtccgggacttgcagcatgcgtttcctctgtgagcctgctgtgcagccagctcccttctccccctgctctgtgctggtgcccacagaggtggcactccctcccaaccccagcacaactgccatctcagcagtcccccaaggaagaggctgagatcctgcctcggggcaccctgaggggtccacttcactctcctgaccaccctgccagcctggactccccaaccccatttccaacctctgcacactcccagcctagagtgggattttctgggagcctgaagtataggctggactgggagggcttggctgcagcctcagctcaggaccaccccctggtggcccccttgggtgggagcccatctcttgatggataggtgagcctgtgtcctcagcagtgacctgagctgctagttgggggaagtgactcagcaaactaggccgctgccaagtggcatcaggatccaaagcatccccacccagtggcttcaggttgttaaattacatttagcctaaagctgcctccatacatattttaagttcagcctaaaagtttctacatgcatagtgaactgtaacctaactgaatgcgtaagcagactatcacctgctcttttgccaatcagagttcagccaatcacaggcagccaactgttcaaaccacgttcaaataaggcaaacaccgagagctgtaactaatcggctgtttctgtaccccacttcccttttctggacgtcactttcgtatttttgtccataagtcttctaccatcacgtggctgcgttagagcgtctgtgcatctgctgtgattcttggggctgcctgattcacaaatcattctttgctcggttaaactctgttaaattgaatttgtctaaggttttttctctatacaaggttaagacataacctgtgtctgacccagggccaactgtgggctgtgtgtggcgggtggcaggggcgtgttattccctttcttccagaggctgtgttctcaaagttgagttctcaggttgctcgcgcacaggtgccatggtgtcctcattcatgggattatcgagacccagataccaccccagagctactgagttagactctggggatcagaactgggactctgtaatgagcactcacccacatggatctcaggctcacctggtgtgggagcttctgccctctgttctgcctgctggacacaatgtagaagagacagttttaccaggctgttcttggggtatgctctatcctggaaagagggatctcgggaaatgatgacatttctttatgtttggttggtatttcacagtgtattgtgcattctgggaccactatcaactcacctgcttaaacctcaaccctagggacctgccttgattggtccttttcttgattctcttcttctaatccatcagcaacccctctggctcctaccttcaaagtggactccacacctaaccacaccccccagctcactgtggccaccgtagtccacccctgttgtcacccctgctcacctgagctgctgggatgtctcccacccatcagtgccacattcacttcccccaaatccattttccactgcagcccaagtgtgtatgtgtgtgttccttttttattaaggcactgttttcagagaacagttttcacttgttttaagtgtacggtgtttgaattgtgatccttgtacataataactatgtaaccaccaagaccgaaggcagttccctcatcctcaaagctgccttttgctcctttgctctccatccctggacccaggcagccctagatctgttttctgctgtctgatttttgccttttctaggatgacatatgcgatggttaatactgagtgccaacttgattggattgaaggatgcaaagtattgatcctgggcgtgtctatgagggtgttgccaaaggagtttaacatttgagtcagttggctgggaaaggcagacccacccttaatctgggtgggcagcatctaatcagctgccagcaaatataaagcaggcagaaaaacatgaaaaggcaagactggcctagcctcccagcctgcatctttctcctgtgctgggtgcctcctgccctcgaacatcagactccaggttcttcagttttgggacttggattggttttccttgcccctcagcttctgtccctctaaagaacgctgactaatacataactgtgtaaccaccaagatagaaggcacttccctcatcctcaaagctgcttttgcttctttgctcttcatccctggccccaggcagccctaggtctgctttctgctgtctgatttttgccttttctaggatgtcatataaatacaatcatacaagatgttgtccttgggtttggatttttttctcatttaagattcatccatccacatcactgtatattttcatctggactctctctcttttgcacatcaaactgttgctaaactgccgggttcaccagcccactgtgcagcaataggccaatactcagacagcagggtttgcggcagagaaagagtttaataattgcaaggccgctgaacaagaaaacgggaggaattcccagcttcaaatctgtttgctgaggagttctgggcaagagtttttaaggggattgtggaggatgaggggctggaaaatacggggtaaatacggggtcatcgattggtccggtaaaggagtgaaattatcaggatgtggaaactgtgtcttccaggagtcagctgcttagtgggcccttcagaggagggggatggatagttttgtcagtttgcagaatctaaaggggaaacgcttagattttatccgtagaacaaagagccttgtgaggagggctaccttattctggggttgtgagcagcgaccggctacaaggaagtgggccaaagggcaagctggcttagtgatttctgctgattgtgttgctagtctagttgaattttttcttttttcctttaatcagttttataaagttttttggggaacggtttcaaaaccagctgagcggtttctgaccatgctgctgtgcctctgcctggatggctctccctcacctagttctttctcctccttcaggcctcagcctcaatgccacctcctgagccctgccgtcactgtgacggctcccccctcccccaacacacacaattagtttttattgtattttcctaagttccttcatgtcacagttatattattcatatattcttatgggtcaaattgtccctgtcccaaaaatttgtatgttgaagtcctaaccttcagtacctcagaatgcgaccttatttggagacaaggcctttacagaggtaatcaagtgaacatgaggtcattagggcaggccctcacccaacatgactggcatcattattcagaagaggaggtttagacacagatctgcacagaagcatggcgatgtgaagacagccatctacaagccaaggagtgagacctgggacagattcattctcctcacagccctcagaaggaaccaaccctgctaacaccttgatcttgaacttccagctccagaatggcaagacagtacttttctgttgtttaagccacctagtttttggcactttgttacggcagccctactgtactaatacatatatatatatttcctttctgccctctctagagtgcaggcttcttgggagcagggatcccctctgtctcattcatagccctgtccccagagggggccttcaatatattaatatttccgcattaatgaatgggtacatcatgttattttgttgttgccattatccctataaggttggcttgccaagtttaggctccttacccaagttgatggctaaaagagagaactcttgatacctggggccgcatcattccaattatgctacagttccctgagggccttcttatgttagataaaatctggaaacaaattctactgtcttttccttcttataggatacagaagacttgttcttctaaaagtgtttcaggaagttcaaagctgtctcatttgggctgtggggagagaagcaaaaacaacaacaacaaatcaaccaaacccagataccttgaatgacatttttccagtaaacaaagcaaaccaacaaaccaaacaaaaaccttctttattttttttaacctaagtattggctatcatactcatttataaagcagacaccccaatccattctcatatgattatttactccaatgtgatttgcaaagatctttcaagaagctgtcagttgcacacttggagctgtaggcccattgattaaaacacacttgcaaactaagagacatttgccagaatggccagaaaaaaagaggccatggcagcttttaaaccaacaccagacaggttctgagagaccaaatgcatgcagaggggtgtttggggatggagggtgggcaacagatagtaaatatattactgctttgagtggccagatacctacctggaagcaggtttgcaatatgatagcccactcaattaatttttttttccccaaggggcctaagtagtatagctattctttaatttgaaatgagttaagtttggggaatgatagcatatttaatgtacagctgggcactggtgcattctaactctggctatgttctcttttgtggttttgccttggtctctatgtccttggggtgtcttttctctgtctctatacatcacagtgtgtttctgacttctctgctcattcttctaccagcacctctctgcctctctgtttgtctgtcactgttgtctctctctgtcgtcctgtcatattatcaggctgcctgtttggctacagtaaaacttcatcagcctcccctacactgagagcagagcttttttgtggaacacaatagcattcagaagagagaaaaatctctttaagtgtgcaaatgctgtctcattatcctgagactggagggaggaacctctcaagctttgtcatttcagtaagaaacaaaaacctttgaaatttttacaattatcttcacactcatatctccttgtcccctacaccagctaaaagatgagtgaatagcgctgagtgctcgttggctggtccatggagggaaggatcatttattgagatattaattcaggttctatctttgctgctgaaagagaatcaaaaagaatgagaagctttgctgtcctgtgctctgggtctctccctcccccaggccctcagctgggcaaggaggcagggagggcctattatacatgcttttatacacacacacacacacacacacacacacacacacacacacacagaaatacataagcttaatctcttcttttggttgaaaaagtatagctgagtgggtgagagtaatagctccagaattatgcaaatcatagctcaaacacaggttcatacccacagatttacatcccagctgtactatgtggctttgggtgagttacctagattctcttaccttcagtttgttcatctgtaacatggtgataatgaggaagttactatgaaaatgaaatgaatcaattcatttaaaatatctagaaaaagtgcttggcccctggcaagtacctgagaagctggctcttattttcactattacttactgactaatcttggagaaggaaattgttagtgattacccaccgtaaagctttgaactggatgacttctgaagttctatacttctctaaacaccatggacacgggtttctcataaggccttatactcttctctacttttgactaacaatgggtaaaagccatgattagaaattggactgaaaatacagtggcttaacactttaaaaagaaagatctagggctcacagaagaccaaccaatgatctgagtcatgtggcaaagagcacgtagggcagggtttgggttaggtataccgtagcattattagcacagttcacaaactcttcttcctttgggacactagtggccccaggagggaatgcaatttacctccgagagagtgactaactggacaaataaacaagagaagaaaaaagtgaagacattgaaacaaaaaaattggcttatctgatttataaaataatctgctagagggtggctgatgtcttcacaaagcctttcacttgcatgaactccgggctgctgttgggaggagcatgttcaagggctccctggctactatatcttttgactctttgggagagagaagaggcaagggcttcaaatcagcctagagtttgagactgagctatttgaaatagtgagaggaaagaacagtagctgtcctgaacatgcagaaagtcttgactgatcagtatctgcagggcagattttcaatccttttaatccctttgagatggattccacaggctctactgggtagtggatccaagatggctgtgtgatcctggacaagcctcatctgtaaaatggcagcaatacctgccctatctaactcatagagtggctgtcagactcagagaagacaacaagtgaatgcttggggacctgaccagttgtaatggcacaagtgggaaaatgcttcccattctcgttctttttctctctcattcacttatgtccccatatctgtagtcaggcatttgtggtataaatagcttggttaggagtagagtgggtagccatgagcagggtgtggaagttaaaatggcacctttgccaattccagccaagcctatggccaacagccaggcctggcctcttccacttgacactggcctgctggtgagactcacaagacctccttgctttgtaaacatcatccaaaattcttccatcagttgacatcaccatctagtggggtcttctctcatgggaacttctgctcagagagcgaattgctatgagtcagtaggaatgactaacagagattccagagagaagacactgccagttcatggcctcttaaagaaatgaatacatcagttaaaaggctcttgtctgctgtctatgactttcagaacaacttctcccagttgtctgacattgagagtaatggaacccttgggagaagtatcaacgtaattaacaaacttagacataatgatccctgatacttttaacaaaacataaaataaccaagaaatgtctaccactttataagttcacattggaaacacacctgatataaataatgagtcagaacagtggtttcactattaaaagtcagcaggtttcattattaaaagtcagccaagaaaacgtgaaaacttacaggctgaaagaataattaaaggcgatcactatagattttaagcattattagttctcaaaacttctgactggctgatgatgaagacaaattcattctaattgtccttgataatttcatgcttttaaaatctcatggcaagaccaacttgggagccatagtcctcaacagtgggcatggtcagaatgatggctggtaagagcagagccctaatccatgacagaatctgttagcctgcatggatacaagtgggatgatgactaatgaagccactatttagcattgtatctaggatttccttgccatctgtaaaccgtgacccctcccttcaggcagttttttaacctgaggtggttacctgtttttgtttgctgtcctacactcctggccccttgatagaattcaactcttctttgataacgattcagtcttcccctgttcaagtgatcaatgtggggctgaccccacctcagcttcagagatgagcatgtgaccctgcctggccaatgagaataccatatctctctgaccatagtgattggttaagggatgaacatgtggcccacagctgaccaatcagagctactgagactcagttctatggtttcaatggaaaccactgaaaaagagaaactctcttttggctagagttgctgtgaggatggaatggggaacctggacagctccagcaatcttactgcagaaggtgcttctgggtggatcccaggcagaggaatcagaggcaaaacatggagggagtgaactcctgaaatcacttgggttctgaatccagccaagcccgaaaccagccctgccctgggcttttcaggtacttgagccaatgcattctcttttcctcttcatcaaggtttgtttagagtttgcatcccacgtgactgaacagaatggacattgctcttagcaagggacagtaaccatgagtccaagtcctgaaacagagatggggtccccttcctcccttctcactggtttccttcctcctgagtggggtctatctgagcctggcatttccttcgtgacagtttcatttgctcctggacggttcccttgctcaccatcagccctcgggccagctctaacactcagtttgtccagataatgttaggaacctgtaaagaggaactctatgttgttcaactttttctctcattagcacactgtttttctgtcccgggtgatgcaggctgaatgcaaagcagcaagatgtgctggtttgaattccgtggccttccttcatcagcctgagtgtttgtgtacacacagctgggctgcaacgtcagtttctgtctgatggctcagagccacaattttaccctgttattgatgcccattatgtcattttagaaaatgtagggatgtggctgtccaacttatctgaatatctgtatataaataaataaatgtacatttaaatccatcctaactttgacgtgatctgagggaaaaatgaggtctttgtgttttcccatagaaataagaagaaagtaggttaataaaccatcagtatcacaagcaataatgcaacacatgaaatatcatttgcaaattatttttgcaattacaatgttggttttccatgaagagttgtagcagctgcctcctctctcaaataacatattcacctgtggacagatggggaattgctaagatcccagcttatgtttgtgaaaagagaagcaccacagtttagtgagcaaggaggttactaagcttggtgtgcactcaaaggccatgtctgcactgtgtgtgatgaagtggaggctttggatacccatcagcaagttttatgttaataaaatattttttcttctatcaaatgctaagaccaaaaagtttgtcatctgaatgtaatcgcgtaattgtcttgactctcagctccattttgtgctcagaagaaagcagttgtgtcacgaaatggaaagatgaggtctaggttcagtagaccagtattggcattctgggaaaaataagaccccaaagataactttttaccatgatttcacagacaaataggacctgagattttctttttatggagcaagaaagcaatgcttatgaggaccagatctgggtctagtactaccaaagagactgcagagacttgtggaggcatgtgatggtgtttctgaacaatgtttttaaattgtatatgttttgtaacaggaagagagagatagggaaagggaggcgggaggaaggaaagaagaaaataagaggaaggaaggaagaatggaggaaaatttctcttaatcagagaaataatgagagcaaaaaagaaaaagaaacccagagagtcagaattctattgcagcatcgttggctagagaaaaggacactcgggatttgacaggtcgttgggagtggctgctgggtttgagcagagtataacacatcaagagctatgatatacgaaactgagtaggcttatttcttgcatggcagaggaaggattagaaccaatgagtaggaaagagactttggttcagttttaagaactttcttaatagagaaatgggcttgccagtgagtagtgagtttcttgtctggagactttccagcagagaccaaacacatatagggtacgttgacaagggaatttaaacattgaggaaaatgttagactaactactgagattctatgtttcacattcgactcttggaaattaagcagtcatcttaatagaatacctggaagaatctgaagccactgggaacaaataacccttagactcatgcagagttcagaggaggaaaaagctatggcagcaagaacaaagcacaaaccaagttaacactttgcagcaatgaggcaattacttccctccaaaaactccacagggaacaatagtaggtagaagttaaatcacaaacacttcccctcattatctaggaaataacttgagctgcccttctaattagcatctgtaagcagccctgtgctgtcagttctggataactctcagaacctagtaagatgattatacaagatgctcaatcccatggtcattgttggccagaacactgccacccacacaatgacatgagtaagaggcactgcagaagccacttaaactcctggacatatgggcataataacatttggagctattgtatagttctgcaattcagtgagcttcagcatattctgagaatgaacaagcttccttcttatggttagagttgctttggcacctaactctccatgtaaagagccttgtgtgcaggggcagagatgattacatttaaaataaaggcttacatttgcattaatcacatttattaggaagctaagcaaaatctaagctactgtttaaaggttctgatggaaaacattttctccttccacctgttcttggggcaatatattctatggacatggtgacggccactttcttcaggttgtcctaggtagctatttataaaatcatagttatagaatgttgggtcactttttaatgtgcttattaaagccaaggaaataatttggcataactccccaggcatactagagaaaaccaaggcatgatccaagtaagagtctcaattttgcatttctctactttcttctgggagcttgtcaatatttgctatttggttttcttacttttttactttgaaatcactataggtgtgggttggggaagtgaggatgagatacactttcaaaaagttcatacgggctggaaaggagatgggcaccttaagtccctgggaggaattcatcaagtattagttattttcatgtgtcatgggtgagaagcttttctcctctcatccaagcaagcccagcctttggtttttccaaggcagagaccgtctactggtctctaaggactttctgtaaacatcttgttaattagctgttaagcacattaagtgagaaataaacatgagtgacttcatatttatagagtttgacaggggtaaaatcaattgctaattgagaagaagaatttgaaaaagagacaaaaatatacctaaggattttggttttgagtctctgtttctatagcctaatttttctcctggttgtatagactatcatttcttgtttcttggcctgtacagtaatttttatctgggtgctgaacactgtaaattttactttgttgagtatttggattttgttgtcatcctttaaagagagttagactttgctctggcagaaagttgttatttgagcatcaaattgtttttgttttgttttgtttttgaggtttgtttttaagctttattagagtggtcctaaagtagtctgtagggctagtacaatggcatggccctcatgaagtctctactaaatgctctgggattttaaccaggtctctctactctggctggttggagctaaactatcttgcatccctgcgtgagctctgggaattgctcagctcacagcttacaggtagcagttctttgaccagttctatggagttttactctgaaaatacacagctcagttttcagtcagagacccatagagacacccatgcagatttctggagctttttctttgtacgtttttttcctctccagtatactacctcacaaagctgcctcagtctctctaaactatgatccctgtcttgtcaattcacaaagactgctgtgttctccttggcatcgctttgggcactgaggtctggaaggtgcctccaggcagaaatctggagtggttgtggggctcaccttgttatttatcttctctcagggactatgttcttaatgctacctgttgtccaatgcctgaaagcagttttatatattctatttagttttctagtaatttatgatgggaaaatatatcagcttccagctactctgtcatggccagaaatggaagttcttcatttcctagtctttgcatacacatgttgcactgtttctgctgccaacaattcatcaaacattacatagttgaatagaaacaggacctggaggttggggttggagaggagattgtaactcagtggcaagacattcatataaataagtccaccatggggaagaataatagagacgtgtagtctgggcatggcctggctttccctgtctaggactctcacaccgataaccctctaagctgggcttaaacacttcttccctttcccattatcaatactgactcatccttgacccagacttacttttgtttatttgttgttttgaagcagtcttttattcttttttattttaaacttttattttaagttcaggctacacgtgcaggtttgttatataggtaaacttgtgtcgtggaggtttgttggacaggttgtttcatcacccaggtattaagcctagtacccattagttatttttcctgaccctctccctcctcctttttttgagggatgacgacagttgctaatcttgatctagtaaatgaatatggactgtgtaatttcctcccaagatcctggatccttagcctagacatgattcaaatgaataatgatatctttatgcagcagggaaggacaataggaatgactggtgttagatgagacttgtcaaattatgccaagcaagcaattgtctatggctagtgaacaccctcaaccctagctccattgcttttcttagctaactccttccccagtcccccattcaggaagatcctacttgacttctccatcagcttttttagccttcaagctcagctccagcctatctcccctctaggcttgttatatcatgtgtgccaggatgcttacttggatgtatggcttcttgccagcatatattttgttcttgaggcttattcttaagtgggtgggccactgaagtgtcattctctctatgtaagctggggcaggaacttgaaaattgtttgatggaggagaataaagggaagtttgctgaaaggattaaaacaagcctgaggaaaagtcatgaagcagtaaaagtaataaatattaattacagtcaaatggaattgtatgatgactattagttgtttgcagtttcagctacaaatgctggattcctttgatctttctgaggaaggtaagtcctggttccatctctaggttgtatttgcaattctcaaggctgattaaagaacgttatagcatcttcacattaagaaagcttgccaaagcttttccctgttcatggggataatgcctgtattttcacaaggtctgatactcagctaatgtggttcaaaaatataactgtcctgagtttgaaaccacagaagaaacagaaaagatcccagaattttgcttaatattttgtattccacccagaaagaaaccttatgaagataacatctgtagcagttaatttgattttagcaattctgactttcagaattttgatttaataagcctcatagggtccacccaaatgctgtatctacatgtttgctcttgactaaagacatcatagagataccaggagaatgtctgaacctgaactcttgaaggaaaactagacgcaggttaactggctatgaaggctctgcgtgattctaatttctgactccagattttccatcctaagaagttggttaaaatgcacatgcacacattcacacacatgtcacacaccaccaccaccaccaacaacaacaacaacaaaattctcaacttttgtagctaaaggaatagtttggtcttgctggactcttctttttccccagaacaatggagacacctgtatgcccctaatccatcatcagccatccacactgcctctgtgaaatacccactttgtttctcagggcccttgtgactgagggttgagatgttgcctttgcacttactctattgctcaaagtatatcctctaacaccatgagttttcagtcactttatttctttgaaagatgttgccctgttctaatatgccctgcaggatgctagctgcttgctggaaggggctggctgaggctgctggggctgtatgctttttcagcatgactcatttgcatctgtcttttctttggcagttatattcttgctctaggctgtcccaatgggaggagaatttattaaatcaactttattgaagtataatttataccaatgaaatgcacagattttaagtatacaatttgatgagtcttgacaaatatatacagctgtctaactgctactccaacatagaacatttttatctcttcagaaagtcacatgcactccttcagagttaatctgtgtcccacagccaaccaatgatccaatttctatcaccatcataagttttgctggttctagaatttcatataaatacaattaaaggcatacattcttttatgtgtgacttcttttgctcaacatgtctactaggatgatcttggttgttgtgtatattatcagttattttattgctattactttttatggttgagtgtattccattgtatgaatatataaacagttctccttcgcctgtttgtggacattgagaagtttctaggttttggctactataaatgaagctactatgaatgtttgtttttaagatttttgttgaagtatgtttttatttctctttgaaaaatagagtagaattgttggtcatagcagaagtatagtgttggccttataaaaaggaaaaaacttccaaacagtttgcaaactgtatcatttcacattcctactagcaacgtatgagaattcaagttgccgcacatccttagcaacactttatcttgacagtctttttaaattttagttctcctagtgggtaggtattggtatatcattgtgttgttaatttgtacttccccgatgaccagttatattgactgtattctcatatgtctactggccattcttctgtgtgtgggtgttttcaatattttaccagtttttagttgtgttgtttcttttcttattattgaattgtaggagttctctatatattttggttacatgtcctatttcataaataggtattgcaaatactctttcccagtctgtcatttgacttttcattttcttaacagtttccttcaaaaaacagacatttttaattttgataaagtgcagcttttcatttttttgtcctttatggttagtgttttttgtgttttgtcaaaaaaaaattgtctttcctaacatactctttattatatgttgtttttccttagaagttttggtttttgcttttgcatttaaatatatggcccattttaagttgctttgtgtatagatatatattatatattgtgtataaacatatatattgtggctttatgacataggagaaatgataaaacaacaatactggaattggggtataagaatacacagttcttaggttatacttgaagtagtgtaatgttgagcatcctgtgatgagttaaagacatatattatacatcttagagcaatcaccttagaaaagggctaaagataataaactaatagaggaggtaaaatgaaatgctaaaaatactcaatccaaaagtgggtagaaaaaaggacaaaaaagaaaaacaagatggtatatttaaacccaaccatgtcaataattacattaaatgtaaatggcctaaatattccaactaaaaggcagagattgtcagagtggatgaaaatataaaactcaactatatgctgcctttaagaaattcactttaaatataaaggcagataggttaataataaggtctgtaaaatatatatgtaaatattaatcatgagaaaaccgaagtggtcatgttaaatagaccaatgatgaaagagttaattcactagaaagacatgccaatcttaaatatatatgcacctaacaacaagtttaaaacacattaagcaaaggcgatagaactgaatggagaaatagagccacaactataactggagattttaacactcctctttaaataatttatagaacaaattgaccgaaaacaaaattaggtatgaatattggataaaggagatttgaataacactgtcaatcaactgactcaattgacatttataaaatactcaacccaacaatagtataatacacatccttttcaagtgcacatgggacatttgccaagatagactatatgctgggccataaaagaaatcttaataagtctaaaataatcaaaatcatggagtatgttctctgaccaaaatataattaacttagagattactaataaaacatatctaaacatttttcaaatatttgcaaatttagaaatacacctctacataacccatgagtcacagaagaaatcataagaaaaatagaaacactttaaaatgaatgaaagtaaaaacacatcatatcaaaatttttagtagaaagctaaagcaatatttagagggaaatttatagttttaaatatttacatttaaaaagaagaaagatataaaatcaattatttgttttcaacttaagatacagaaccaagagccaaaaataagtagaagaaatgtaatgataaggataaaatactaacttattagtaagattttaaataatttttaaaggttcatctatgtctataaggccttgcacatactaggtgccttgtaagtatttttttccagttggaataaagccttctactttctaatatagggttaaaacagtgtggcttagtagaatgaacataagttaaagagtatgggcagtctagagtttaaatatcagctccctcatttaataattgcatgaccttggacaagccatttaatttctctgagctataacaatagctacatttattgagtacttattgatggtatgcaccttatatgtattaactcatttaattcttataacaactccatgaggtaggtacatttaacatcctccttttaaaggaaatagtatctcatatggtttagaagcccctctgagatcacagagctagcagatggtagcattgagattcaaagacaggctcatctgacagtaatcttatgtactattcctgaagatccagaaaacttcagtttcttcatttgtaaaaataaggttattgatgcaagattgactgaaggggaacaacaggaatggagaacaacaatacacagggtctggctgtgtacagggagagagggagtggaatgtcccccaagtgctattcaacagagcagttccaagatgcatttcagcactagggcctgcagggagagaggtcaggaacatattgtattgcccattggtgccatctactttgctgtgtctggcttgccaggcccaagcaggtcatgtaaatgagtacagtggtaggtaaggtgggccgtgacaatgagtgatgaatcttctaaagcgtcagcagccccttgcctcagactccctgaggccacactgaaatgtgcacccagcatcaccagagcttctgagttttcaagagatgccagtaatctggcttttaagtactctcaattcttaggtattgactcttaaactttttaaggaaacactgtaggggctaaataaaatacatttgatggctggctttagctcatgatgggcagtccatagtcttgggtttacacttagtgtgttttaaaggatattccaataaccagaacgaaagtgtttttcttatcttctaagttcttttgagtaataattccaaagtactatatggacatcaataggttgggattaatatttatgttggaatgaaaaaagaaaactgtgtgtgtgtgtatgtgtgtgtgtgtgagagagagagaatttcttaaaagacttcaaagcagaaaactatgtggctaatcttattagtggaaaaaaaaaaagacttagcatctctgggagatactcctttactcctttggttggagtcacccttgtcaggcgagaaaggaaaggtgatagcacagttttcctcttagctacaaggggggaatagagaacttagcagatgaatgatgaccaactgaagaaggctcagggtaacatcacaaatccacaatgcataatgttgctgggaagaatatgtgactaattgccacctgtatttaaagcagtggggagagaggtgtttccctttctttgaaagaaacaccaaagaaggaaggaaagaaagaacagattacatctgtgcttctctaaatttcatgtgcacacagatcccccggggaatctcattaaaatgcagattctgaatcagtagctggagggtagggtagggcctgggaatctgtatttcttacaagttcccaggtgatgctgatgctgctgggtccagggccacattctaaatgacaagaaactagctgttctattaaagtgagtgcaaaagtaattgtgattttcccattgttggaatttgctgtttgatattggaatacattcttaaatcaatgtggttaagttatacatcattttaatgggcatttctctatttttttttgctaatgacttattacttgctgtttattttaaactatggaaatgatgttagacaaaaagcaaattcaagcaattttcttatttgagttcaaaatgggttgtaaagcagcagagacaacttggaacaacaacaatgcatttggctcaggaactgctaatgaacgtacagtgcagtggtggttcaagaagttttgccaaggagacaagagccttgaagatgaggagcacagtagcttgccattggaagttgacaatgaccaattgagagcaatcatcgaagctgatcatccttacaactacacaagaagttgctgaagaagtcaacgttgacccttctatggtcatttggcatttgaaacaaattgcaaagatgaaaaggttccataagtgagtgcctcatgagctgagcaaaaatttaaaaaaaaaaatcattgttttgaagcgtcgtcttctcttattctacacaataacgaaccgtttctcaattgaattgttacgtgtgacaaaaagtggattttaaatgacaactggcaatgaccagctcaacgatcggactgagaaaaagctccaaagcacttcccaaagccaaacttgcacccaaaaaaaaggtcatggtcactatttggtggtctgttgctggtctgatccatacagctttttggatcccagcggaaccattacatctgagaagtatgttcagcaaatccacgagatgcactgaaaactgcaatgcctgcagccagcattggtcaacagaaagggcccagttcttctccaaggcaatgcccgaacacacatagcacaaccaacacttcaaaagttgaacgaattgggctatgaagtttcgcctcatctgccatattcacctgacctctcgccaaccaaatatcacttcttaaagcatctctacaacttttttctagggaaaatgcttcatggtcagcaggatgcacaaaatgctttccaagagtctgtcaaatcccaaagcaagattttttacactacaggaataaacaagcttatttctcattggcaaaaatgtgttgattgtaatggtttctattttgattaataaaaatgtgtttgagcctagttacaatgatttaaaaattcatggtctgaaacagcaattacttttgcaccaacctaataaattctgaactctagtgatagaagaacatttagagatcatcaaggatgtccaaactgaactaaagagttccttccatcctctgctccccttcctcccaggagctccttgtttctgtgatggcgcaaaccccaggcctctctggttgaaacctgggacctgtttaggctcttgcttgtctctcactcccagccctagccccttcacatggcagcccaagtttaaccccttacctcatttgtcagttctacttccatagggtcactctatccacccttatcctcccctgccttccctcgactcctgcctctaacctgggttttgtgtttcctaaatggcctctttgctgcctgtatcctccctatactgtttattctatgcagagcttcccacatgcccttcctgagtgctgctcactgcactctcttgctcaggagtaatcaatgcccaccttctcctctgtctcttctacctctgccttgcacaaacctgcacccatctcctcccaaacccccttgatgaacctactatctttgcccaagctttttttttttcctctagagcacactctaccctctcagctgtcaaaatcacacctcaaggactagctcaatattgatgagaactgagaaatacattttgtacccttttttcgtagttttaagtttctgctgaatatgccttaagcctgtggtgttttcttcatgctgaaccattacctagaaatttctctgtgacctattgttactgccagccccaggagatgggcaggtgcccattttgatagctagaggcatgctgcttagaaaattcatccttccctgggcctctcctttccacttcctccccagagcctgttcgtttgatcacccagcaggaagtgataggtacaccccctttataattatagcctttctccttctatcccctaaaataatagtttcctcatttccatccttgtctgaaacacagagcaacagccctccattcatcttccaaaatagcaatacttgttttgtttttttaaaacttgtcctcccccatgtcttcctcagcctactctttctctctcttctcctcccatctcctcttctaaatacagccaatagactcttcagtttttcttccaaatgtcttcagtccctatttctcagaagaggagccactgtgtccctctggaatgcctccttctaaaggagcttatgtcacttcttatctcccctgtaactagtcattaacctcagtgttcaaccaacttctgatagcagctcctgctaataacctgaacttcattaatacccactatgtgccacgtgctctgcaagcatctctcattttgttttcataacctcacaaaataaatattattactatccccattgtacagaacagaacattgaaaactcacctgtctaaggtgtacaaatagaagatggcagaggtacaattcaaatccaaatccaggttactctgatgtcaaagccagcattcaatgccactccccaaaccatgtcaccagttagcctgcgtatttattttctttggctgccataacaaatttccacaaactgggcaacttaaaataataggaacttattgtctcaaagtcttggaggccagaagtccaaagtcaaagtgtcagtaggactggttctaagggaaaatctgttccatgcccctctcctagcttctggtggctgctggcaatccttggtattccttgccttgtccactcatcactcaaacttctagctctgtcttcacatcatcctctcctctgtttttttttttttctccaattctcttctgtattgagtatggtttccccatactgttctcgtggtggtgaataagtctcacgagatctgatggtttcataagggatttcccctttcacttggctctccttctctcctgcctgccaccatgtaagatgtacctttcagcttctgccatgattctgaggcctccccagccacatggaactgtgagtccattaaacctctttttctttgtaaattacccagtctcaggtatgtgtttatcagcagcatgaaactggactagtatacttgtcattggatttaggactcatcctaatctgagataatcttatctccaaatccttaacttaatcactcttgaaagacccttcccccaaataaggccacagtcattggatccagatagacatgtcctttgaagaaaggagcgtttatctcactacaccatgtaaagaaaaatcagcatgagaaatcaactctgatggagatgtacaaggagattaatgttttcatgcctgttaacacagcatccattctatagcctgtggatcaaggagttatttttattttcaagtcctattatttaagaaagacattttgtaaggctgtagctttcagtggatagtgattattctgttagatccaggcaaagtaaattgaaagcctctggaaatgattcaccattgtaggtgccattaagaagattcatgattcatgcaaggaggtaaaaatatcaacatgaacaggagtttgggaaaagttgattccaacactcatggatgactttgaggggcccaagccttcagtggaggaagtcactgcagatatggtagaaatagcaagagaaccggaattagaagtggggcctgaagatgtgactgaattgttgcaatctcacgagaaaactttaatggggtatggagttgcttcttatggaggagcaaagaacatggtttattgaaatgcagtctactcctagtgaagaggctatggactgttgaaataacaacaaaggatttagagtaatacatctacttagttaataaagcagtggcacggtttgagaggactgactccaatttctaatagaatttctaatactataggtaaaatgctatcaaacagcattgcatctgcagagaaatctttcatgaaaagaggaatcaattgatatagcaaacttcactgttgtattattttaagaaattgacagggccacccaaaccttcagcaaccagaaccctcatcagtcagcagccatcaacattaaggcaagatcatccacctgcaaaaagattatgactcactgaaggctcagatgattgttagcatcttttaacaataaaatatttttaaattaaggcatgcagattgttttcttcagatacaatactattgcacacttaatagactatagtgtaaacgtaactttaatatgcactaggaaaccaaaaaaaatgtgtgactttctttattgcaatatttgctgtattgcagctgtctggaactggatctgcaatcattccaaggtgtatctgtatttttccatgccactgttactgcagctccaatgactaatttccaaatccctgcatggaagtcacagccagagtgtaccctggctgtctgtgctgttgacagaatgctctctgccacatgccatggcagccagaggagggttgtggcccactggggatgttgtaggaaatatatccctccccagctgcgtgctgctgctggattgattcttccagtttaactatagctggagtcagtgccttatagattgctatgaagtcaggccctacagaaacgtctaagttcggtggcagaacagagagggactcagcggcctgggctgcatagtgaagctgttcccttaaaggtgtcatggctgtgttctgtgggaaggaaaattgcaagtggatattgttatagggttatctctagacccttcgtcacctcctgaggagggcagctctactcctgaaggctacaggagtctgagtttgcaggagccaaactgtactcccaagaaggagagaaagatttgggactgacaatccattggtaagaccctaccagggttagaacactgaatactcctgtaccagtgggatgccagtaaacagtccccagaactcaccgcctgcatatcattcagccactagtggctggacctctgacccagtaggggtccttggggaccctgatcatgtgttctggagggcacctgttagactagttggtgctctgtagttgcttcctaaatattttaatatcaccctcgaggaacaagagaaacaggaaccaatgaaacttgaggttccctgggcaggaggcaagaaggagaattaccacggggttccagcatagagctgtggggaggaacaacatgttgatggcggtttctgagcttgcgtgccatttgatacagcttctgttaaacccatcctgcttgaacaagattcttgctgggagctgtgagagggctgagcccttggccaaggcaaagtcaacctgcaggagcaaggagaacagtgtgcatttgtgatagatgtctgtgtgctgaggtgccaggatgtcactgggctcacagccccacagccctgcttgtcctgggaagggatgtgttcctgctggtgagtccaggggtcagtgggtacagccggacacaccagggcagagagtggcaaaatacaacttgtgcttatctcctttgctgtgtggctcatcgggaagagggcaggtgtcgtattagccatgctttcttataaagaggcaaattctctgacggtcgcagggactgaagcagtagctatttggaatgctctctccactgaacagcctaccctttccataaggaggacttcctgtttctgcctgtctctggtttccacagtcaacaatgttttgcccaggattggatttttctttgcttctgctttgagcacaagctcagagactataaaggtgaattagacactgcctgtggctatcccagcctagttgtgggcatcagcaggttcttcagggacaacccctatgtggctgagggcattctgttcctcatgctcagtttctcttccatacgaggggtttatctcatctctgttttgtacctgtctatacactgggctggacttccttccccaactcacagaagagcccctctcccaaatgtgacttagaatgtgttccctgtttagtggtcaagctctccttgaagtgtaataaattctccctttccatcccaagttttctgtctacattagatgttgaacccctcatagttacatttccagagttccttggacctccattttctaatctgtaaaacagaaggaatgaggctagatgaatttcagatattctagacattttatcacattttacactttgttaataagtgctagtccacaaagcacatttatgcaagttttaattaaaagcatcttcctccaagacagagactattccaggaccatggcttggtgagcagagcaatggctagattcagcctctccttacgcttttggccaggtacccttgtgtagtgaataacctgcacaaccatactgtatgagtctgttctcaagctgctaataaagacatacccgagactggatgacttataaaggaaagaggtttaatttattcacagttcagcatgcctggggaggcctcaggaaacttacaatcatggcagaaggggaagcaaatacgtccttcttcacatggtggcagcaaggataagcgcagagcaaagggggatatgccccttataaaaccatcagatctcatgagaactcactcactatcatgagaacagcatgaaagtaaccaccccgatgattaaattacctcccaacgggtccctcccacaacacgtggggattataggaactacaattcaagatgggctttggatggggacacagccaaaccatgtcacatatacatcagccttgttttccaagtatcaggaggatatacaattgctaaaaacaagtagacaatagtcatagtctatattcagaacagtggttctcaagcaggggtgattttggcccctttctccaggggacatttggcaaactctgaagacatttttggttgagaaaatgaagggatggggtggcaggggtgctaatggcacctagtggttagagccgctgctaaacattctgtaatgcacagcacagccccacctaaaaataaataattttccaaccctaaatatcaacagtgccgaggtttaaaaaccctggatgaaagtactagccatgataataattagacattgcacaaacaaaaataaaaacttaagcgggaagtaggaggaaaagtttaaattcggagcaactttaacagatatttctgaataatggttttgaatctgtctctttttatgcctgtttgaactacatgtctgcttactgcagtagctccacctttggcaagaatactgaattctcatttgagaaataaagaaaaagcctgaagcttatagcccctaagggtggttccttcagtactttgttgtacctttccaagcttatagaaaccccttgctaaattgcaggttcgaattacaaagaaaaatttaaattttcatgcagtgaacttaactataaattaatctacaactgagtctacaatttgaatgtttattctacacaaaagtactaggtaaaatgttatttaaaatctttattatgtctttagctttaaacagtgatgcaaaagttattgaccttcagaagatactaaagaggcagtatgtggtattttattattgaaattacatatttacataaacagaaatatatattaaatagaaattccaattgtaaaatggaaagcaggttaactgcacactagttttgctgctgttggtcttaacttgaaagaaaattaagaatcagttttcgtttaggatgtggaaacctacatataacaatgagaaaaaggcagaaaaatctatagcaattgttaagttttcttgagcccatcagagggctgaaatccaggcaatcaaacaaaccaaattcctaagagggacaggctctattaagggctgaggagacataaaaacattcaccttacacagaacatgggagagagaggtggctgccatacagatgtgtaaaaagaaatcagttaaaagatgttaaaactattaaaggctataaaagaaaatacaatttcagggctctctaaatttattatgccaaggggggatgttaagctctggagactgagtcacatagcatgtttgctattcttcttcttagattatggactatttctcttcctcattgttcttgttctgtaaatgactaggagaaaccagaggacagacccctcacctcctaatcatctatctttgttaaagattcactgcctgctttttttgtccttacccaactcagaccagatggggcaaaagactccaggactgttagatctttggtgtggaatgtcaaatataccttttcttaaagaaaaaaatcaccttgactgattagatcataactatgcattaagccttacatagaatgatgttgaaattctgttaagctttcctaaactttgtttatgtaaatgatcccaaacttctacattttggaacactgacttccattctttggaatctctgctttgtagctggctgtccttaaactttgtgcttgtgtaaactctctttaaactagattatgacccttttgattattttaggttgacaaagccacatgtgggctagaatgtcagtttggaataactgggggcccagacacaaaggaagtcagagacacatgctcttctccacatggctccaccagttactgagagaaagatgtagggcaggagcctggagcaagccccccttggtggggtaggtgttggggagctctctgtagttgtagggagaataaacacgatcctctccccaacccttccctcctaggagagaagccttgaactgtcgggggagaggcagcagactgtctttccccaaaggcacaggcaaaagactggtgtgctagggagggtcaaagaaaaatctccaacccccagtgaaagggcaggaagctgtgctgggcccaggatatcttactgccagggaggggcaggaaactctggcccaagtccaagctcagatccaaagcagtgtttggctgccatggggaggagggatgagaatgctgagaaagcctcacccccaggcccaggcacatggtgcctgcctaagactaaggctaaaccaaaagaactgagaaccacctctcttcccttgcccctgtatcccaaaataggcccagcactgaataataggccagagtcatctgccactgggataggggagctaaaagcgtggacagaggattctctgtggcatgtgtaagccaggctggctgtgttggggctcagagaatgataccctaaagtacgattctttggcatgctgagtactttttcattaaagggaattggaaggtcttagaatctgcctcagaaccaaagaccttctaaccttctcctgtttcttccctccaccctgaaaccccaagcacagtaagggacattctctagaagtttcctcatctgaatgagaaaaaattattccaaaagaaatgcaattgtcttaaaactccccccctagaaatctcatcaaatcaccaggaaagatgaactactagagaagagaaaagactaaaagtcatcaccacatccaggcagatttttcatctattcttctgagggcagctctgagatattacctggaagatgttatctgcataataagacaacctttgttcacagggaagtcccacccctcaatttcccaatacgtgttgccaccttccccacagctcagaggaactttgtcccaggccattgtctattctttgcgctcgttggttttccctaaaaataattcactacccctcaaaattgcctacattcccccatcttcctccccctatgaagatgacagtatttaagcttcagccatctggcctgtccttgaatctcatattttgtatggctcccatgcatacttgcatattaatgaatttgtatgccttgtctcctgttaatctgtctattgatagttcatttcaacattcttgacccttcagagagggaggaaaaattctcttcccctctacaacagaaagctgaggggcaagcaggaaacctgggaaagagtctagcaccttggccctcacactaagcacaagataacacgattcccacctctagaggaatttgaagcctgtggtctattgaaggtaacagtggcaacaataaaacccatacccacctcaactactgactagataacctcaaactctgacactaatgctctcacagaacaagatattgggatgatttatagaataaataatatttaccttcatctctgctgtcctatacagtcacaaattatgagatatacaaaaaagcaagggaaaaaattgtaaagagacaaaggcgatcaacagaaacagactcagggatgactcagatgttgagactttgagatagagaccataagaattatgattaataagttaaaagagtaatagaaaaggtagatatcatgcatgaacagatggagaatttcagcagagggatgaaaaatgatagagttaaatggaagtgctagaaaaaaacacatgatatcaaaaatgaagagagtcaataagtttttttaatccatggggacatctgcatatagattctttaagggaattggagcttcactgaaatagtcttatgacataaggataattatatatatattagagtcttagagttcagctgacaacaaataattttgtatctccaaaggatttgagatattaaaagtaattatagttctaaataagccttgtaattagaactaagattctattgtagcaatgggagggaactttcataacctgaatggacactaatgagagtggagatctctgaggcataacactcaggacagtcagaatccgatagaatcacaaatggaattgaattggctccataattttataggaagaaagaaccaacttttaatatatgtgtaaaccaaaaataaaattctaagcccttcaaccaactgatggaccctctccttggcccagggcattctaaagttaacctgaaaagctaattcaggccatgatgagaagtgggggttgaacattcttcattataccttcctccctttggaattcaggcacagttgaccagtattaacattaaaatagagatcttaagactagcaaaacgactttttttgtagcaataagataccaaattccagcctgactctagtatagcattacatcacagatagcaggccctgaaaataaatcaaactattttaccccaaattatattctttgacatattttgaaatggccttgcaaagatgactcttgtgggggaaaatctacattctgtagagaatccccatttctttccaggtcatttccctgatccaagagggaattaactaagactctggcccctttttaggtctgaaaagagctctgaagcctactacctgaaggctccatctatatgataaaaccttagtctctgaaacccctaattttttttttttttttttttttgacaaactctggttctactctccaggctggaatgcagtggcacaatctctgctcactgcaacctccacctcctgggctcaagccatcctccctactcagcctcctaagtagctggaactacaggtgcacaccaccatgcccagctaatttttgaattttttgtaaaggtgggttttgctatgttgtctaggctggtcttgaactactgagctcgagcgatccacctgcttcagccatccaacgtgctgggattacaggcatgagccaccatacctggcccaaaaccccttatcttaacccagacactcctttatattgattataggtctttatataataattctttcaaacaactgccaatcagaaaatctgtgactccacctatgacccggaagcccccacttccagttgttctgcctttctggaacaaaccaatgtacatcttctgggtattgattgatgtcttttgtctccctaaaatatataaaactgagctgtagcttaatcaccttgggcatatgttttcaggatatcctgggactgtgtcacaggccattggtcactcatatttggcttagaataaatatcttaaaatattttacaggctttgactatttttgtcaacatacgcacacccaacttaaaaataagcaattatttctacaaaattgtagaaatattcattcatttttgtgaaaaacaaatgatttcaaatatagacagaggtgatcattgataggtttgggacacctccaacttatacattcaaaaaagaaaaagagagatagaaaagtgtaacctgtggtcccagtcattaagccagttgtccagaaaagggtataaaatttcctttgattttgctttaactttttattaacctataatttacatacatacacataggatatgtatctgtaacctatactttacatacacatatcctaagtgtgcagcttacataactttcaaactgaaaacacttttgcaacaagttccaaaatcaaggaatataacaccagcttctttgaattctccctcatattcccttgaagtctctatcttcttccaaagctagccattatccctatattaattagcatagattacttttgccgttttgctcatatgaaaatggaatcatacattggtactattttctgtctggctttttttcctcagcatgtttgtggggttcattcatattgctgtgtgtggttatagtttatttgtgctcattattggtatagtactgtattttcttgttgacaggcatttgggttgtttccagcttagggttatcatgaataaactatgaatagccttttaccaggcattgtgtaggcaaatttttttttccccttagattaatacctatgggttgaattgctgagtcataaggtatatggatgctgccaaagtgtttataaaagtggtcataacaatttacatcccactagcagtgtgtgagagtttgctgctccactagggatatgaaattttaagcagcagcaaaaaccacaagcaaatgtaaaattcgtattgttgcacacagactgtgagaaccataactgttcagaaagaataagaattggtgagagcaggagtgtgggagaagttcttcctggacagaggatgggatggatgggctgaggggcacctgtgagacaccctttggttcaaggccaggttccataactgaccagctgcatgaccttgggaaagttactggatcaatccgagcctccgttttatcatccgcaaaaaggggaaaataagaaacctgctcttaggctgaaatgacaattgtgcatggaggacactgagtatagtggctaacacatagaaacttgctattttattactattataaataacaaagtggacaagaattgggctttgcaggatggctgggactggctcagtggatgggcagaagagctctttggaaaggggagaacaggaaagaacgaagcagaggattagcttggtatcttcacaagcttaacagaggcaggccaaacacacagggacaatcccttctcctgcctgtttgtgtttgtgtttagcacagggtggcttactcctggaagcctctgtgaagtctcccacctcccagcatccattcataggggactcatttgagttagcacccagagggtacttctctggttgtacttaactatcttaactgaaactgctggcttattggcctctctttgtccaggaaagggttgacctccatgaggacaaggcttggtgactcactgaaaaccatgggcctccgtccctggaagaggaatattgtttcattccaacaaaggattattaaaacacttaccatatgccagtcattatgctaagtgacctacagtgtcgatgaggagacctgttgcagtgtttagaggtcagcaagaagaaattcagtgtttgtatccaataactgaccgagcacaggaacttgtttctcccatgaagtcatgaaaacttgcattaaaagaacataaagaactgaaccaaatcaagaagaaaagtttcaatgacatgagtgatgaatgataacaaagcgcaatttatacctttttgcagccatgatccaggttaaagtccacccaaaataataatttctaagtaaaaattaaggtaataagcatgggtcagattagatactctggctttgtaatacaatttatacttctgttgtatgttcttctttagccaccttagggtagaacaaatggaatcatctccccacccacagtattcatttgactccacttttcattcctggactgtacttcggaacagttgcactgcctgagggtgaggaggaaggtgtgatttgaagggaaggaatggatttagaaatgatgcactcccacacatttgaaaataaaatattcggtaacatcacaaaacacctgatatttaactttcccagggaacaccctcaaggaatccagaaaactcctgtagatctttaggtcaccttgggaatcaggacatttttcttagaagcttaaaacaaccttggaatagtcagaaagcaccaaagaatttcaaagaaggaggagaaaaggggttattgaagtcagagaaggaggcgagactagtacaggcagaaatgagcaactgcaggacagggccggaggccagccagatgccagcaactcagaggcacctgccttggcctgcatttcttaggaggccaacctggaggaagatgtctttgttgtgtaaaaagtagccttttctctgccaggcacggtggctcacgcctgtaatcccagcactctgggaggccgaggcgggcggatcacctgaggtcaggagttcaagaccagcctgatcaacatggtgaaaccctgtctctactaaaaatacaaaaaattagccagacgtggtggcgtgcgcctgtaatcccagctactctggaggctgaggcaggagaattgcttgaacccgggagacaaaggttgcagtgagccaagatcacaccattgcactccagcctgggagacagaggagtttttttgaaactccgtcacacacacgtacacacgaaaatataaaaagtagccttttcttttactaaagaactgacctcttgatttataaagcatgacaccaaaatattccttagaattgaatgtcttcccacagaatattttgccaggtattctagttggtaattatgacggccttgacagtgctcctctcagatccccaatttctaggagcatagctggtgccggtctcagctgaggcccatccctccattagcatcacgctccacacgctgctcactgccaatgactgggcttggtaggaattctaaggaaagttcattcgggagaaacaagaatcctccgaaaacagacttgggctcgagggcgccccctgggctttgccaatgtcttagaaggactctgccctctaaggctctccccagcctgcctcggtccttccctgcatcctccactcaaaccagacctgcatctgatccctcagctctgctagactcctccggcttcccgcctccgcctcccatttcccccgcaataaatctcttccacatccatcctatgttgatacctgctcctcggaggacctgaattaacacaacaatgaactttctgaaagtatctttgtttgcatttgattgtgcatgaggttctttatgagggaggctggtgatgtgagatggaaaaagcttcattaggagctggggcttggctctggctcctcccagctacgtggtcttgacatttagccttgctccctagttagacctcagcttctttatcagaaaaatggggataataaattacctgcatcataaagttattgtggagattaagaagatagtgaattcaagatctcagtgcacataacaatagctgctatttactgagtgctttccatgtgcttttgatataactcacttaatcctagcaatttccatatgagatatgtacttcactcgcaagaaaaccaaggcatagagtggctaagaggtagagctagaatttgaacccttcagagcccagagcttcagagctcaggctctttaactaccaccctatgattttccccaaatagcacatgctcgggaaatgactgttgggattccatcaataaatccaatatgtttttttccactttctacccctgtgactgtggcaagggtcttcaactgaagacaatcttgtcattttgtgaaggtgaagtgaggaaagggatgtaaaacagctgtggttggtgcttagtagctgttcacctgaatttcagctaggattaaaattacaattattattagctttgaaatgctgattcctctttctttgtatacttaatgggtacagtaaaggagcaatgggttgtttgttcccagctttcagatgtgatgtctaaatgagaattgaaataaaccatgaaggaactgagttgcaaacacttctctgatgactacagcaggtgaataatcagctctgatatttgatcacaccctttacaagcctgaacccctttgtaggtcctttgccatatcctctacttgtttctctgtagctcaacctactgcctgcccagggccatcaataataaatgtccacagacagctgaaggacattaaagacagatggtgatggatcagagcactcatcagccactgggtgtagactgtataaaaagctgagcccagaggccaccatgatcaacctgcaacctggcaagaaatggactcaactccacagacagcagttgtcagggagcccaggtgagtgcacggctgcttcatctttatgtacttgttatagcacaaatgagtctatttccttccttcctgaaatagcaaggagaaaataggaaatgcatggtgcatagtttcttttttttttctcttctctccgtctgtgtcatactttattaacaaggtcaaaccaaaatcatacagatgttctgggacatctcaggtgaaactgttaacaggctaactttgttcttgccattgtcatcctccactccccttgtcatttcctgccccccaatccatacctgtcaataccctctttctgaagaatgtgtctcaattcttacttccctgctttgcttacatcaatagtcacctgggttttatgactcaccctttcagggttccatttgattaatacttaatatgttaatcttactcatacaatttcattgtgcaaacatatgaacacctgtagtgctagacatattgaaggacacaaagaaataaaatgtggtccttgccttgcagagactaatgctgcagaccagtgattctcactaagtgtacatctgaattacctggaggatttgttcaaacacaaactcttggactccacagtttttgattcaattgacagggagtcaggtctgatcatttgcatttctaacaactccccaggtgatgctgatgctgctgatctaggaaccagattttgagaacactgagctagcctgagacacacatgtccataggtattgagataattggtacaatagtggttgtgttgctatgttggtggaggccagtttcttaatgggtcatcccagagaagatggaatcattgattgctcacaggtaacttctaggcatgcaacaatggagagaagtggttttcatgaggcacatcgaggcactgtggcaaatcaaggaagaggggtctggggatgggtagcaactttggcatccctgagaaccacttgttgactgaccccatgaccttagctggtacttgccctgactcagggcaagagagggatgtttacaccagaaaatgcttggtctcctcatgttagggaataattcattttgtttcttttttaagtgaatgtttcaaagacatttgtgccatttgacagatctttcaataaataatgacaacaccaaggtgaagacactcatgttcacacaaccaacacataacaagtcattgtccagaggaggtgtgaagaacaaggggaagagatggtccttgcactctggagctctcatcagcctcattgaggggcctctaaggagccctaggatccacgacacaaggaagcagctgagccatgcctcatttattcatttgtttcttcatttcctctataaacaagcattgtattattattttaggaacattattgagcccctgacagaggaattgggaataaaaatgaatgagactcattcctcttatactgtaattcagattaagcttctgggtaaatttggtgagtttttaacatgcatctatgactattccctcttgaaacaacactaaaatgacagaaaagggatattttgaaaatataaaccctcaaggacagggaggatgagagagatgaaaatagcaataacaatttggaagctgggaagcagacagacaagggtaaaaacactaatctggatcctaaacctgcaatggaaaggctgaagccaacttgctttccagaataccctaaaggacctggaattactgcaatggtatatctgtaagtggacgttaagggaaggaactaaaataagaacgaggaaaaagtggcatcagaagtgattggttcccaggtttctcctctcccttctggaagactagttttccctccctctggagaggataaaacaggatttcacgaatggtttggcacaggagtgccatacccaaaatagaaaaaataagcactgaatgctgaatgccaagcgtccagccctcttccccaagttgacctcacaatgctggtgattaggaacctgcctccccgcaatcctcacaacaaagcagaaaatgaggagagacctaaatatccgttcatcagacattctacaaataaaagatcccaccagttcacagctttgaagtctgcaatcaaccagctccacacacatgctcagaggctccagtcccccacttttaaatataaacagacaactagggatggccaggcagctgaggaaatcctctaacatggaagatggaattacaaacaaaacaaactttgaagaaacaagctacgaagggaaaaggaaatttcagaaaatctgtactaggtatcctcagagatacaaaagaagacattgtaacagtgaaataagaacaagatgtcattagaaggaatattctgtcaacaataacagtgcaacaacaaaaccattagatatttaaaacgtaagaaaaataaaatgtactataacacgtggaagatgaaaacctcagaaagtagagtgtaaaaagacaaacaaaaataaggaagaagggataagaccccaaggaccaacctagaggtgcaacatctcaataacaggtctaggaagagaaaaggaagaaaacaggaggcaaccatctttttatgaaattattcaagaaaatgtagcagaacctgaaggggcccactgagtgctcagcaccatggatgaaaatagacactcactactgtacataatggtaaacatttcagaaaagtaggaacaaaaagatcttacaacttccagagagtaaaggccgttcatatgtgaagggtcaggaaccagaagggctctagcctctctaaagcatcactcaaagttagaaagtaatggaaggacctttaacaatcccatagggaaatggtctccctaatagatgctgtcagtgtccacttgtattcccaatactccctgaatctgtgcacgatgacttgatggcttccaggacaagcatctataactctgggctgaggactttcttgggacactctgaaggaaagtgaatgccccaggagcaggagtagccacagtcttcaactgaggatgggctctcttgcccttcaggtgaggcatctctgaggtgtgctctatgcagtctcccagagttccccagcaagactgaggcccagttgcccacaatggtaacctgttccttcctgtccctgtctcaattcctcattctcctcttgatgctcccaggatcacctcccaaatacaataattaccctaacttccttgtcttgggatctgttcctgaggaaacccaaattaaaacacctgctgaactatcaagtgtcaggttagaacaaagacatatccaaacatgcaaagtttcgaagtttacattccagacaccctttctgggaaaatatcagagaatgtgctatacaaaaatggggccataaatcatggctataggaagaagtatccactgcaggacagaggtgaggggattcatgaaaatgatggtaaaaggagacgccagggcgacagctgggtactgggtgcacagggccactggtccagcctggagcacagctgaaggttctgggaaagagcttcctcaggaagatgaacttgaaagagtaccaaatgcatctaaactttttgtgaggatattcagacaattgtttatgagtttgatcttagattactaataagaacatagtgtactatgcaaatttttaaaaagcaactccagggaataaacaacttagttatgttacgatgtcataatattgtaaacgctgaatattgatccaattaaaataacaatatggctctactgggagaatgggaagtagaaggacgcacatgggcagggactaaagtcctatcttccctagtgtaaaatcaattaaaaatgccttaaactggttgggcacggtggctcatgcctgtaatcccagcactttgggaggctgaggtagggcagatcacctgaggtcgggagtttgagaccagcctgaccaacatggagaaaccccgtctctacaaaaaatacaaaattagttggatgtggtggctcatgcctgtaatcccagctactcgggaggctgaggcaggagaatcgcttgaacccgggaggcggacgttgcggtgagccgagatcgcaccattgcactccagcctgggcaacaagagcaaaactccatctcaaaaattccttaaactgaaaaaaaagaggttaattcaaatctgctatataaagacatgaagatgaaaatgaaaacactgagcagaagggggtcaacgtggcttgcccagatgaacaagaaatagtagaaaaacagggatgaaaggctttctacaacaaatcttgaacagtttggctctttacactgtgcgtttgcctccatgcaaacaacccaaacctacaatacaatacagaagagaacctcagctgaagaaccagctttcaggaagctctgcttccagagtctgacttacatgctattttcttgtgcctgccccgtgtgagggacattgaaagtgtaaagctcatcttgggttttctggttggtttctccagttagattctaagctccttgaactcagggacccagggacttggccaatgcagctccatgtgccgagtgcccacagtcccagggcctggcacacaaggggtgctgcactgatgttcattgaatgcagtaaaggaaagaagggaagatgtccaactagagagccgcacaggcagcggtgatgcagggagcaagggctcagatcaacctgagggcagtctggtggttttgcaggaggactgggtgaactggtaaggtggggaggggcacacccaggcaggtagagtagctgtgtaagtgtgaaaaggcgctgtgtgcaagcgtgtgtatgtgtgtgtgtgtgagcacatgcgtatgcttagagagtggagtagtctgaaatgagactgtgcttgtgagctgaggtcaacagagactctttggccactccgtgggtcttagaggccagttggcctcttcacgcctaaagggattccttaagctgattcctcatcagaatcaccaggggagcctttttaacatagtctcgagcctcagtctgagagatcatgagccgtaggtctgtgactggatccaggaaactgtatttgtcagaagactccccagacctgcgcagacgagccagcctttgggacaggcttggaaagaggggaaggtgatgagggagggagtgcgcaagggccaaatctgggctttcgagtccagagtcacattggactgttcctgaaatccaaagtgaatgcattttaacctatttgaataagaacagaataaataatgcctttgtgttgatttgaaaacaaatactgcaaaagagttactctgtgagccttttattgccaaatccatggacttattgctgaaatgaagtgcattaaatatgaaaagttaagatcgatttccagatggcctactttcattactagaatttaataggttctctaattttctttcttctgtttattagtaacagtgaagtaagtcctaaggtgagctaatgtatttcacacctaatatgtgacattggtaccattcaaaatatacaattttaatgagggagaatgctttaaaaatactccaaggaaatgccattccctaatatgcatagtgtgattcctgtcatgatgttcatttatttcagtcttatcttacttcagaatcaaccgatatccactgagttcttcctgtctgcaaggcctgggttggggaacaggaagctgaactgctgtagggaatataagaaaacatgagccatgagccctgttcaaaagaaatttaccagctggctgaggagataagactaaaacacatgaaaaaattaataaggacttcaggctatgatcaagtgagaggtataagcaacacaagctataggaattcagatggggggcagggagagctatgggctcaactggtcagggaaagcttcatggagaaggtgtgatctgggctgggcttgaaggctgggtgagattttactagacagagttgagaagagacactcctggggcagggggtaggagagaacctaagtcctgatgggggaggatgtaagccacattcaagaagaaggctagatagaggtaaagtccttatctttgaattattcaaggtgaaactgtataaaatgattagggggtgaacttgggagaccctggatgccaagattaagaccagtaggcagtagggagtggttgatgatttttgatttggttagagaagaggcagatgaacatagaattttgggaatgctaatttggagaagtgttcaatgaattagaaaagcaatgagaccagttatgaggctgatgtaacaggtaagtccaagggaatgagattctgaattagaccatgggattggcattggttttttgtttctttttttaaaggaaggtagccggaaacgttgcaatgaacaactaagcaggctctatagcaagctatggttggcagaaggaagaggttttgcatgggagccattggaggagtgatggtgttgctggtaaaaataggaaggtctggtggggatgctggtctaaagagaaagaagacttctgttgtgagcatgttggtgtaagcaggcagcagaggaaaatgaaaacaggcaactggagatggaattttattttggagaagatttgcaactagttatccccatggagacaagctgaagttgaagagtgaagaagattcattcatttattcattcacatattatttagcaaatatctattgtgcgccagccacttccaaaagtgctggggatcctgcaaagcagatgaatctcttgtggagcttgtattttgctgtgggaagctgaccataggcaattttacaaaggttttgctacgattcaagtatctgtcccctccaaaactcatgtggatgtttaatcctcaatgtgacagtattgagagatggggcctttaagaggtgattgggtcatgaagattttgccctcatgaatggattagtccatttgtggattcatgcatggatcaatgggttaatggattaatgtgttattatggaaaagggactgttggttttataagaaaaggaagagagatcagagctagcaggctcagccccttcattctgtgatgccctgcaccaattcaggactctacaggcagaccccactagcaagaagcttctcgcctcgtgcagccccttgaccttggacttctcagcctccataacagtatgaaataagttctttttctttataaattgcccagtttgaggcattctgtttttaagcagcagaaaatggactaagaggactggaggaagaaaactgcaagagtgagtgagcaagcaaaggagcttctttctttagggtgtgggaaaagaaagcagaagcatgatgcaagccagaatgattctgaactttaaaacagagaagaggaatcaagagcaatctaaactgttgcctgcccgggacctctctggggccctgcctggttgtccaatgtacttttaggcacagaccatgtagtttcagaggcagctgccagcccacttattttgaggcagttccaaccttagattgtgaattaaccaaggaatctgcatgacagctctccatgcacgcctcctcaaaggagctggaaaataaaatcactgaagggcaagcagtcgatgttaccctcgtgcatttaagggaaccagttggaaaaataaatcagttagtggtgttctcacattaattccccatggggtccagtgatttctttagaatgcctgtggatgcttcacgatgagagccaagctcatgttcccattagctaaatgaggcctctcattacatagttcctgttggagggggaatgagtgatgttgatgtgactgatacatatgcattggctgatcaataataatggcagtgagctgaggtccttgtatgaattttgcatgaactcataacaatgtgaggaatcagtgatggattgcaactctccccttagttggccaacccttaccaagctcattgggcacactgtgtagcagaagagaagggattcttgggggcttccagagtttccctctctgcagcctgtgtgtcagttcttccccctacatctctcatatggtacgtggcccacagtaatacaatgattactttcctggcttccctcctggtattggagttcttgaggacagagactgtttttatcaaactctatgtcctcagtacttagtacagtacatagcacagagcacaggtgttcaccgaatgtctgtggcatgtggagctcatctggatgtccctcatgaaggggaggggtgtggagcagctataggtactgttaagtggtcaaacccaccaaaggaatcctggagaataaagaaccagttcttctttttaaattcaagaattacattccagcccacctggaggaataggtgaaagagaatgtgcacacatgtctaggaaaatctcaaatgctctgcagacctgagataactcagcctgcaaagtcctgtctggaaaggagtagaaagaccagtgagtgaataggttcagccatgcatggaataggttcagcctgctgggcatagcaggaccaagcaccacatacaatgcagtgacaccagggatggtgcaggagactgcaggatcctctaactgccctcttgtttgatactctaactcccttccctaacacaaaaatagccttgcatgaactgtgtgcttcccccaccctcaacaggctcctgagttgcaggagattaatgaggatggtgagaagtaaaaacaatggagaccttgtggatagaaggcagcagctcattcttggcaccagctagagaaaagcaagaggacagtaggggagagccctggggactgggggaaggcccgcctagggagtgatagcaggactgcttaggttaccaaggagatttcacaggttgaggtatagaatcatgttttttattttctgtattttgtgttgctttaacatcttggggccttgcagacctgaggagggactgcccctcccagggttagctaattcctagagataacaaatgacttacctgtgagcacatctttgttatgaaaatcaaccaatctagagctcaaacccccaaccagctcctttatctaactcacacacaaagctgatattcccatggccctaaatcaccctagagcctggtactggataactagagaccacccctatatccctgagcctgccaacattattcaaattggacaaacctgagttgtttaccccaccttggttttccacggaaaccacaataaaagccatgcttataccattttgttccttctgcctccagacacaccctggtgcctccctacatggcctgtatggtacgggatgcccctgtttctagggatccgtgagaataaaaacttttttcacaattgtcatttccatgtctgcatatcttactatacctgattaaggatttgtacattttaaagcatgtggcaaaacacaaagtttcctgttagggatttagcagaaaagaaaaagaatcacatgctctttctcccaaagtatcttccactttgtgtcttgggctcagtaaagatgcaggccaatttactgtgccttctgtattcactttgaggcaccccagattttctcattaagtaatatattgacatattcagagtattgtatgtaacgaagccgatatgtggatgctaaaggttttagaaattatttttaatggttgatagttaaaaacgaaacaatggattcctgtgtaacgatatgatgcatagtttggattatttgcttctaagttaaaaaaaaaattaaataatatgaaagaaggaatgggttaggagcttctatacttctatacactggaaggagggcattgaaggacagtggaacaaacagccttcagagggacaaagggcatagctcaagggtctgggagtaggaatccaggggtggtcttttgagggtctgttcatcagaatgactcagccccaactgctgtcctccttgtggggttttgccccaaagtcaggacagagctggtggcttggcttaggttggatgtccctctctttgcccatggaagaggccattgtggttgacagttccctgggcccatgtcaggaagccgtcctcccaatggagagcccggaggaagtgtgagggtgtgtgttgcaaggcgggggagctatggtcctattgccctgggtgcaaaacctagatctgcactgggtggctatgggtatgtggtttttgtcttcctgtgagatgaaaatgctagccatcccacagggtaacaataggatatatagtttgtaatctttgcttatatgtaagagaaaccaatttaaataaattaacatgaaagaagaaatgggctaggagttcctagcccatggccaccctgagggttagtgtgaaaattacgtgaagaccatgcatgtaaaatgcctgctctagttcctggcataaaacagacattcgaaaatgaaagcttttaatcataagataaaaatcatccactgagtttggcctcaattaggccgaactcctcattccatatgatttctggccaatcaggaatttttacttttctagcttgttttaatttttagagtttaattgtagcttccaagcacactcagggccacaaataaagcattttaagattcttctaagtcaaaatgtttaaggtaataaaaaggcaaattgtactctcctagtcagagcttggtctgtttttctggccactctcctgagccctaaccctcagggtggctcttgccactctcctgctggtgacttcaggcacatcactcccttccctgggtttcagtttctttgtctgtaaagtgaggggtgttaactgtatagctccaaataatgaccaacatctttacgctattttgagattgcaaagttctttgatatctattatgatatttatttaattcttcaagtgtaatgttcagtcgctgtgtaaacgtgatagacatctttgcaacccaccattgatcagtggaaacagctgcgcagctgcagtcttgctgttctgatagtccatatggattagtgctgttcttctccatagatctgcagatacaacagcctcatctcaatctcttagaagagtagctgaggcaaaaagaagccaagcatgaagtcctagagaatggatctgaactaattagctttccacgcatgccttcatcaggaaacaaggcacagttgtaatatcttaggagcaagcctcttccctctgcccccataaaaagtaatattaatggattcattcacagtaggatctggttcattctctggggtggagggcatgtagcacctcacttcttgttctccaccaaagttagactgacctagtagctttgtatgttcctaaattggcttaattgtactggtggtgaatggtagtgtgaacttgcccttggagaccatcaatatcggattcgcacagctcatagaatgccatagtggacaaatatttcctcctttgtgatccctggtgtctgagtgcttcattcagttcttcatattaattgattttggttttacctatcattattgtttgaagacatttctcattctcctacttaatttggtgtgttttgttgggggctgggggctgcaagtgattttagagataatccactgttttattgacacaagttagttgaatcccagagaggttaaatgaatgactgaaggttgcagggctctgaattcagatttctgacactcatccagagccctttacacttcaccagtctgcccagaagaaagactgcaggaacattcttttattacctcaggtgtcattattgtgaacaaatagtgacaaagagccagagatgcaagagtggaacagtggtgggagggagtgggaaggagggtaacattacaaaactagatgcaggttataaatgatagtagggaagtcgacagtactctacatgaaggcttactttgtaaaactgagttccctaaacagcagcacgggataaaaagaacttcagcctcaggtttcttaaatttcatcaatgcctttctatctgcttctggatcccaacaagacatttttaggcacatatgccgtttaaaactagctagcaagacactaggctgagtttgtgtgagctgctttcctgacatcctcatagagatgtatttctctcctgagctagcatgcgggtttatcacacagcatgcaggaaagctccagcagtctctgtgctagtccttcaaaaaaaagagacagacaaagaagagatggggctggaatgtctttctctacgcaggcctgtctgagtgctctagctcagtggggacatgctttggggaggaaggcaaaggaagaaaacgagaacaagtcctcagccgggcatggcagctcacgcctgtaatcccagcactttgggaggctgaggcaggagcatgacttgaggtcagcagttcgagaccagcctgaccaacatggtgaaaccccgtctctactaaaaatgcaaaaattagccgggcgtgttggcaggcgcctgtaatcccaactactcaggaggctgaggcaggagaatggcttgaacccaggaggcggaggttgcagtaagccaagattgcaccattgcacttcagcctgggtgacagagcgagactccatctcaaaaaaaaaaaaaaaaaaaaaaagaacaagtcctccgttttgtgcccaagaatagcagggtgttgcacatgggaaaggtcctgaatggggctctgataccttcactatgagagaaatctcgccacccaggcaaggtctcattcccattccttcctgaatctgctaaagcccctggggagtttagtgatcctgggcacctgaaatcaatcttggcaccactatttatgatgcattgttttacagtgactacctgtattttactcgacttctattttgttatacagcatagaaaattaacctgatgtgaaacttcaaagattttgtgtctctgaagaacatgccactgacaaccagaccatatgtggtacagatagtgacacagatagtgccccaaacgttggtcccaaactcaaaacaaaagaaacctccttcacctcccctatgccccagaaaaagcgcttctgggctgctctccctgagcccacccaaggcagagagatggtttaagatgggttccagagcaagcttttgccagaggatttgggcctgtccacctgcctgcagctaatggtttactgttcttctcaatgactgcccataaaaacagatgtgattatggtgaagaaatgcctggtgatgaggtgagaagctgcacacccttcagttgactgtggtccctcggatctctaaactggccacagaaggttggagggaggaagaggaagggaggtgagccagccccttggaaggtgggattccctaggcagtaaaggagcaggaaatctgaggcgctcccattaccctctgctggcttaggggcagcatgactttctctctggggcaggtgctggaagtcctcctttaagagctgtggtgtgaccacatctggtcaccccaatgtggcttctttctgtggggctttttttccttttaggaaatgcagaggaacccaggcttaaaaaagaaataaattacttttacttttcacaaagtataaccttctacaaccaacacaaatgcttaaagactgaaatcatcaagaagcgctgaaaatgaaactctttacacttgaatactagattcctgcctggacaccatttgaaacctccctttaaataaagccatttgtttagggtgatccagcctgctgatagggaggcaggcaagatttaggagaggccactcctacccagcaaggccctttccattattggccgtttttcattattattatattccattaatggaaataatattccattatttccaatattcctttctagccatggacatcctctacccagaggtgtctacacagggggcacaattgacatcaggataccttttcttcttcccaccctctcaaccacagccagtgcaatgtggtccactccaggtggcagtgtggcctgctagagggatcatcagatttggagttccatattctctactcactgcctgtggaacctcaggcaagtcaccagctctccttgaacctcagtttcttcctctacaaagtaggagcaacatatgtgccttgcagtgttgtgaaaattaaatgtgggccgggtgcggtggctcacgcctgtaatcccagcactttgggaggccgaggcgggtggatcatgaggtcaggagatcgagaccatcctggctaacaaggtgaaaccccgtctctactaaaaatacaaaaaattagccgggcgcggtggcgggcgcctgtagtcccagctactcgggaggctgaggcaggagaatggcgtgaacccgggaagcggagcttgcagtgagccgagattgcgccactgcagtccgcagtccggcctgggcgacagagcgagactccgtctcaaaaaaaaaaaagaaaattaaatgtgatcatggatatatggatattaaggcaggcacaaagtccctgctcaatgattggtaattccaattgtaattgaaagatcagggactggtaagctttttctgaaaaaggccggatagtaaacgttttagactttgcagattataccacctttgtcatgaccactcaactctcccttgtagagaaggcagccacagacaatatgcaaacaggtgggtgtggctgtgttccacttaaacattattcacaaaaagaggcagccagaggatttggctcccataggccacccctgacctggaagacgagagtctaggaagggagaagactaggaagggaatgtcggattatcagtggcatgttctttagagacacaaaaccttcgaagtttcacatcaggttaattttctatgctgtataacaaaatagaagtcaagtaaaatagagttagtcattgtaaaagaatgcatagtaaatagtggtgccaagattgatttctggtgcccagctagtcctcagccccgtgcaggaggccaccccaggtcatcctccaggcaataccacatgacacaggtcatccctatcatacctgctcaagttcctcacccacagaatcatgagtaacggtatgagtgtttggggcattacttgtgtgtttgtttaaccatgcaatagataactgactccatttattgattgaaaaaatttacctaaaaatccaaatttccagcttctgttgaaaattcagatgctttggccaaatgaaccactatttccacagggctacaatttcctggacccaagtatcactggtcatctgtagatgaggtctacagtctccaggtggtctagccccaccctgtggtctccttggtgtcacgtgttgcctgtcctcacacttacagagctgttctcctttctcttggcctgcctcattcatttatgcaaactgattggttcttaaaggcatttgagtgtgctacccctagcttagatggatggctttttgggggccatgggtccccttgatctttttgattgccacctgatctgctcctgcatgcctggccttgggctaagcactgtggcaaagacaactagctgtcgtcaaaaatgtacactcctctctccatcctgggaggcagctgacctggaatgcatttcccagcctttcttacatgcaggtgtgctcatgagctcagtctcgtcaatacaatgagctgggtcttatgtgccacttccaggaccagggttttaagtgagtgttcctggcccactatttctttctccttacaaggtttaagtaccgactccctagctcctaaggaatggcaggatcatagctcagaaagagactgggaacttcattgtcacctggagcaatgccgcctactgaccacacactcccacatcggggtgatgtgtgagccataaactttcgctctttggacagtaacatgttggagtttgtttgttacggcacctcatgttaacacttcatgcatgctatcacacttagtcttcacaataagcctttttctaggaaggtgtttcctccccattttacagataagatgacgaagtgggaaagcaacttgcctgagtccctagtgagaggcagagaggcagaagcagggtttgaatgtaggcaaaagtgaattcaccatgaaactagtgaagcttcagcttcagggtcccttgcttatactacttccaaaactctggaccatgttaatgtggtcatacatttttgtaaaatttgcacaagtaaagtatcttgtctgcaatcagttaagattactgtctctttccactccaggttcccctccatctgcttcactctttcttactggtttgactttgcagtggctgttggtatgtctggggtctaactaaggggatgatgaattgggtagcatttggtttagttagtggaagatttgttcatggtttgcaaccacttctgtatcaggttattgtttgttctcgagatgtaagcatgacttccaggaacattcctaccactaactgtgccaactcacctcaaatcaggacaggttatatctggtattttacaccaggaataaagaagagaagaaatgaagctttacctgtatgaagctatgaggtcgatctgtggagaattcttccaaaagttacatctcaaatacaaaaagaatatgatggacttttcccaaatttaacaacaatcctaaaacttgtatggcattaccgatgacaagttgtgaacacaaatgtttctaagttatcaacaaatataaaacaaatattggtcaatcatgttagaggaaaggctcaattagcttcctattttacttcatccaaaaatgttaaaaaggaaatcagagagtaagtaaacaaaaaaattatagaaaaaatatagaaaccagacagtgattaataaaattatcgtattattttatggagatcttgactgcaatatttgtcaaatttataaaatttgaaatttactgtagctcctttttgcattctaaataagctttatagtcacattttttgttctttttttcttgaaggaatctcaaagattatatgagcttttgaccccatgaaacttgtactgcttgtaatctaggaactctgaatataaagtacatattgttgatagcagggctgtgccacaccagagctgatcacagttgtggagactgcccctggaaaaaacacacttgctaacactcacctgcaattctccatttgatttcatatttacagacaagcctctgtctctgaggctaattcaaacactgctggctgagttgactgcacactctgttcctacgtttccaaatagtgcattacaagattattaattttttaacacaactttgtttactatctccagaatttatgaggtgctcgctagaagaaatttgctcttcatgaaggggattgccttgcactgtctggaatttgtgcaatctcagggctgttcaggcagactcaccagcagcaaggaggcctctgggaacttcctactttctgcatttcctatgcctcgagcctacctggaacccccaggttctgctgtcgctggtcatctcaattgcaaaggagggtgcggcagaggaggtgttaggcatgtgggcccaagctagctttcccatcgtttatattttttcttttcaaatttatgattactgaagtattttttgtgtgtttggtcataattttgtcatctttcattctagctttcggggttatttttcgatggggagagattctgtttggttttacttccttgctatgaccttggttttctcatttccagcatgaatatcatggtggtttgtttgccttcattttctagggcaaatgaaagttataaacctgattttaggtatttttaaagaatattgaaactacaatttctgtaattatcaaagtcaagagtgaaatcgtgccttctgacttaatctaatataaaagaaaaattaaagatgcattttctcactccatttaggttttgggaatatagcgtagagattaaaactcctgttttgaaggatatttgtattcaaacttctcacattcattctttgagaaaagttgttttcataattacttgagccacttgtctgagttttccagagttcatcatctttgcttctatctaagggcctgagataaagcacttttaaaatctaggtttctagaaatctctttctcagctccaagaactcggtggcatcataatcaggattgtcattttctgtattcatcctgtagctgtatgttcgtggtctcccccagggaaatgggtattgtcctgctttttaaaggactctttaaaaagtatagtcacaataaatgtggcacttaaagttttgggatccaacttacgtgagtatttagagtagtcaaattcatagagacataaagtagaatgggggtgccagaagctgggggagaagagaaggggagttgtttaatgggtgcaatttagcaagatgcaaagagttatgtgcatggatagtggtgatgatagcacaataatgtgaatatacttaataccactgaactgtatactcagaaatggttaaaatggtacattatatgttatgtctattttactacaattaaaattattttaaaatctttataggatcaaatatctagagataatacttattgaatttgtgttagatttttttttttacctcatttttcccccccaccaagtctattggtgacttttatcagagttggatccagtaggtctagagcggagtctgggcatctgtggatttttaaaagtgatttgggtaattctgactctcttcattgatatctctgttctattatccgattgcaaatggtacctttcactgactttgtctcttacccaatggtcaactctttgagaacagataaatattctgctcacccctgccctccctacagcatctagcaaagctcttgtaaacagaagatgttcaataaatagctgtttattgagatgagaggaaaacctaaagtataaatattccatgcacggtggtgttacccattgacttatcaaaggctaccatcctctctaagctctagaaagggttacctgcttctgatttcctgtaagacactagggaactgtgctctgtgaccagacttccttggactctcagcatgagttctaattgacccaatcatcagatgctcttcttaagtgtgcaaactaacatgaaagaatagtttttgttctataaaagtttagaaaaggtaaaagaaaagaagagtcttctcctcttatcaggttcttcagtaccttggttctctctagtctaaacaagaaaggtaagtgccatatgatgaaggtgtcagataagcacaactcctactgaggtgtcctatgctgtgtgagacaaccaagggccctggatgcctggggacaatgatgaaaccagcagcataaagccagatttatggacaagtaaattgtttatatcaggatttcccctgttcgttgtagagaagatattttccaaaaataaaccaggacttatcagttcaaaaaatgctcctttattagtctgtattcccaatttttctgtgataaacatgttatacttagaaacagaaataatcattatttacaaatcaggatccctgatttcaaacctataagacatttgttatgagttggaaggttgcccatcttttaatgcccaactgcgaataaccaacaggattctttaaaaattattagggccattgactttgatttgaccatataagaagtaataaagatcaaaaccttacctgactagggactagttcatctattaattcattcagctaataattattgcatgcctactgtgtgccagacactagatgagatgctgcacatctttcagtgaacaagattaccccaatccctaaagaccttatgtttctgagagagagagacgctaaataatttttaataaacagcctcattgagacataactgacatataataagttgcacatatttaaggtgctcattgtgatgaaatttgacaggaagatacacttgtgacaccatcaccacaattaagatagtgaacatatccatcacctccaaaggcttcctcttgtccgtttgtaatcttttccacccacttgtctccacttccccattctcaggtaaccactgatccacttttggtcactatagactagtttgcatttttaaggattttctgtaaatagaatcagagaatatgccctcctgttgtctggcttcttttactcagcatagttattttgagcttcaccactgttgttgaatatatcaaaaattcattccttttaattgctgagtagtatttcattgtatgggtatactacagatttttgttccttcaccttgatggacatgtagattgtctttagtttttggctattttaattaaagcttccatgaatattcatgtgcaaatctttatataaatatattcttccatttttcttgggtaaatgcctaggagtagaatggctggattacattatatatgtatgtttaactttttaagaaattgtttttcaaggtgctttttactgttttgcacccccaaaagcagtggatgagtgttccagtttttccacatccttgtcactaattggtatggtcagtctatttaattttagccattctaatagcatgtcatggtatttcattatgatttaatttgcattctagtggctgataaacatgactaatattacaaatattatgagtttgtgtaagtgggaagcaaaatctcaactacgtgagtgccttttctcgagaatactgattattatacaattcccaaagcctaatacatatctttccagtggatctagtttttgtgtgaatctgacagtcacttgagtaataatctgatatttggctactctctgcctcttctgtaggctaataatctctgtttggatatggatatgcctgaatatttccctgaactgggccattttcagctcagtgaatttatgggtgtttaataaatgcctaatctttcccagccccaatcctacccctcacattccacttgtgccaacctttcccaaggaatgagttcctctacaagtgaaatgttcagagcctttttctttagcttgcacaaagataaaggtgaaatcttgcttttgtgtcatttgctgtgtggttacataacaagatcgctggccccaagacagagctgaagggagtgaggaatagaatacttgagtcctaagtcagggaaaaagaaaacggatgcagatatggctcatcctgccagaagcctccaggcccacactgctgtcttgcaaagtggctcagcaactccgtggtgtagggccttggctgcttatgagagggagcagggtgggatgactttgctttttgagtctgaaacaaggaaccagattgcttggcaccctgggtgttcctttgctccaatatgagtttctacaactaagaaagagaaaaaacaaaatatagcagaaagcacactctttagtttactggttttatgtttctacttaatcttcatagttgattattccttggtcaaaatgaaaattccttttctcatttcctcaaatatttaaaataatgccttagttgtggccaaacagattaaaagaaaaataaacattaagtgaatgtcccttggtgatatttgcaggaaaagtgaagacattgaatattgccaagagccattcccagctacctcatgaagctaagcaaaggttctcagcaatcagggaaattaaaacacttctctgcagaattatcagccctcaccttttctttgtaccaggcagtttagtcttgacaatcccttgcgttgtaccttctctgctccccctagccctatattgtcttatctcttgtaccacctgaatgtcaatgacaacactgattttattggctttctatatttaggaccctttatcactgatttaatgttgcaatctctttgtcatccctaagaatattctactgcaagtacttgttaaagttagaagtctaaattaattttatttggaacttactgatacgtgttgtgagatggcttgagacaatatcgcatccagtcatgagacaaatttttcctaaaaagaggatcaggttggcctagtgtgggcttggggtctgtcactagtctcattgagtagccaggaggagcagggaggtgtggcacaaatatgaccacagggaccacctttgcatgtcctcgaagaaaggggaagagcacatagtggacactccaaacctgtctgctatgtggagaaaaagagcaatggatcctagctccactttccaaataagactagctcacctactgacttgcattcaacactattctgtgacagcagtgtgtaccactggcatcatcctggttaccataaatgtttattgagtgacaggcctggtgctaagtatctatgagcattatttttttcaattctcatgcaaccctaagagacagatgctatcattatccaaatatcatggatgaggttaagttacttgcccaacatgatacaactggttagaggcagaacaattctatccaagtccatcttgctccaaagcacagtcttgaagcatcatgccagggtacctctcatagttttctgatgattcctttatagatctgttacatcctaataagccaaatgtctctctccagctggctatgataatcattcacggcaaatttattacacgtggcttcaactggcttctctagttcttgcttctctgccctaagcactgattttctaaggaccgtaattctcctagaaagattttgcaaatcacatgatagtcttttcccaaggttcaaagaagtaaacaaaaagaaaagaaatacccaaagctgctttctaagactctgacaataatctgcaggagatgtaaattctaagtgactaccatcttcagcaatttctagcacagtctctgggtgtttagccaattcaaaatattatagtgtcctcactatgttataattttttcaaaataatatcaaatgccaaagctttcctttccatcttgatttgtgttgtaaatagctctatttaattgtttgccattatctttactgatatcgcttttaaaattttagtatcattttagggacacagcttggtattggctataacacaatatgttctctctctgaagagagaccacaattatttgagatgtgttcaggcgtctcccctcattttacattatgaggaatattcatgagtatgctatcaatattcaaacaggacacattaaattttgctcctggggaaaagctgtgtaacggtcaaacataaaattaagatcttgcctgctctttagaagaatgatgtttatctcccccctgcaagaaagactccagatggtaaccaagatttgcaaaagatgaaactgctccccaattcatttcttccaggctgatgttcagctctcattaagtcctaaaatgttaaaaaagatgcttgttttgattccttaaagacttatgatactactggctgatgtccaccttcccctcccccaaatctgagagaagtaagtgaatattttctctgctgaagcatttagaatgggtaattgctttcatgccagacatttttgtgaaatcaaatagtaaacagggttttaaattctgtttccctcaagttgcatgagcttaaaaaaatttctgtggagaattttatttcttgtgctgcaactttaataactccattaaggctcctgctttctttctgatccccagctgtgtatatttgggtgtggaatgtaattttctctggctacagctagaaggaagcttcttaaaatgttcaatttcttctaaaatgtgaaacacaatcaagtttctcctgggaaaataatgagcatttattgactaattcaagagtctgcagactttttctgtaaagggccagatagtaaatattttaggttttacagattatatggtctctgttgtaagtctcttctctacctgtgtagtgtgaaagcaggtatataatactaactgaggatggctgtgttccaaaaaatactttacttatggacgttgacatttgaatttcaaataacttgtacatgtcattagtattattttgcttttttttaatcaaccatacgaaaatatagcaaccatgttttgctcaggaatgacacaaaaaacagacagcaagtcagatttggcccatgggtccatttgctgactcatgtactaattcattaggccaattttttttttgaacatctactatgtacagtgagaaaaacagacataatacttgcccttacattgcttatggaagagaaaactatttggaaatattgaaaacaaggacattttcaagtttgggagaaaggacagcttgcatttacttaatcatgtcccaggcaatgcctccaaaaatcttgaccataggcagttctgtacagttatgtctgagtatcgctaaaagctgaggaatatttgtctcgagttggcttatagccccatgtggcaggaacagaagccatttctcagtctgtgaaatgcagggacttaatttccctcaataaattcacactaaagatggtaagctccttgagagtagaacattgtacttgatctgtatctctgctgtgagcacaggtcagcccagtggaaaaaggttatgtgtaaaagcactcagagttccttagaactgcactgtctaatatggtagccacttcttgtggtgtctatttaaatttagatttaaattaaatgtaattgcgtttaaaatttattttctttttgcattagccacattcaagtacgcaataactgcatgcattggacagtgcagatgcatgtttccactatcatagattgttcccttgggcagagatgctttagaacatagggatacttttcttccctctgctgttgcacccaagcaaattcattgtgaaactatgagttctgtaatctcatcctcccttggcaaatggtgaagaggtattttggagtacaagaatgaaggtggttgtactatcggatggcagcagcattgtgtgatagtcattgaacctccctgaattcccacataaaaagagataaaagtaactcaacaataattgagaaactcatagtcaatatttacaaaaacattaaatgattaggtatccctcacaaaatccaagatacaaataggtggggacaaacctccaacagccagggaacctctatgtggaaagaagtggagggaagtaatggggcattagaagccatgaatgaggaacccaaatacccagaagatattcacagcaaaacaatcttactaatttttgaacaatgaataaaactgggagtaagtgaatggaagaattccttagcgagttctgaaaggggatgaggcagtccacataaatttgaatttgaaactaactggccagggctcctttctgggacagaaattcataccaaggacaaatatctcagaatggaatcattctcagctaaagtaaggtaggaaacaacaccagaaaaaatttagagagtgagctatcatatttttgcacacttgaaaacaacaacaagaacagcatcaacaaaagcccagaagaggaaactctgaggagctagaaaagttattctgaacattgcctccttcaggataaaataaactcatataaaaataagcagcaaatctaattccaggtcagagttataataagaaaaaaatgagaataaagagatgaataatatccataagacagtgaaagcatgctgaaaaaccaagcccagaaaactaacctactttcaaaatgaacaaaaagacatttgaaaaatgatacctaacatgaagaaacaatataaattaaaatcacaaaaactcagagtggatacaccaaactccataaagaattagaagtaaaattttaaaatatactttaaaaatgaagactaaactttttaacccatcgatggctagtgttcctgttggaacgctaagtttgtagtagttatttatatcctactgctcaaggtcatcgccaagttctgatttttcacacaaaaaatttgcaacctccagcataaatgggttaaggaatacaaaactgagtggtttttaaaaccaaaaagaaacaaagaaagaaatcaagagaattcaagtgaaggtcgcagatattgaagatgggcaaagaatatccaatatgcagacaacaggctgcttagaaaagaaagcaagagagcaaaacaaatagcaaacaaaatttggaaatcatttactgaattaaatatctaaagctacatagttttgtaaaaccccacctatgtgataatatcaacacagaatgatcagtgtcaaagtatacaataatgaaatgactagacttttaagaaaaaaataaaactttgggcatctagacaaaatgaataagtgatttagagagaaaaatgaataagtaatttagagaaagaaaatgaagtgattatcatacttttgacagcaatgctttatgtcagaagaaaatggacaatatgctcaaagaaaatgtgagccaggtgttatatccagcaaaactgacttcaaagtatgaaacgtgcaatgtattatcaacaagaaagaattcagtttatgtgattcttcctgaaaaatataaagtagaatgtgaacttcagaccaacatattggtatctgcatattggatattctttgcccatcttcaatatttgttaccttcatttgaattcccttgatttccctccttgtctgtttttggtttttaaaatcactcagttttgtatttcttaataattttagtcttcattttaaaaatagatttttaaattttacttccaatcatttaccgaagactggtggtgagcagtaagtatatagtagtttgtggaactataaaactacataaagttaaaaaagagagagtatagtgtgcatagctatctgtatctgtacatatataaagtgtttgtgtgtatatatatatatatatatatatatgctatggcaatgtagatatgatacaactattttttaaagggagagaataaagagagcatatgtaggaaattctttaataattttaataaacatattacagttgtaatatttgtattatcattgttattctgaagctattaggcaatatattgtaaaatgaagcaaataagtcatcccttggttttgagaatttcatcaggattctcaagggtggaaaagaagagatacagatgtgatatacaaaaggaccctatagccctgcatttaaattaaaaatatcttattaactcatgagatttgtattaataaaacttaaatacatacatataagcaggaacatagaaatatacgcatacatatatcccagctctttgcacttaaaagcctagaaacaatgtcctatctgctgatagttttaaaataccattttctatcaaaagaaatcatggctgatcccaggtctggggtagaaaaagggcaatgtcctggaacttattgacacagcagatggcaagaaagttatcgaagaccactagcatcatatcaaaagtcaacttgactgggttcccacttgctagagatagtacagttattactccaatgaggataataattgcaatggattaaaactcattaaatatttgagttcataagtttataataatagttttaaaaaaactaattggttcacttcacagattttcattatcttgcaaattgaaaaataaagggaaagaatggtgcttttttttttttctgtaagaaccatactactgggtaaccaaatagtaggtgagggaaagcatctctgtataaaaacactccaattaaaagaaaaaaaaagatgaaattagaaaaacaccatttaaaaatccccactcaacagatctaggcattatgaattaatagccactaacatcacaaaaagagacaactagatattgtttgcctcccaatgacagaacacaacatacctttagtcttatcaatgggatcaaacttgagtctgatcaagcctttggatcccgctgcagtttgactgaaatatttaggaaagagggacatatggcactgcacaacgagtattcagtcaacaagatttaggctgctggaaactataggttacgtggcctgtgtttttcaacacataaatgtaaggaaaagaaagggatgggggtaatcctggatattaaaagacatttaaatgacaaataattttttaaatgggaagatgaaactagtgtctagggatacacactggggtgaaaaatctaaaaagaaacccaaggaagtgactactataaaagtcagaatggagggaggtataattgggaaggggctcaaggaggagctctgggatagctgaccaagtttgatttcttgacttggcggttacaggatactcaccatagaaaaatgcattgattctagacccagcaatcccattactgggtatatgcccaaaggattataaatcattctactgtaaagacacatgcacacctatgtttaccgcagcactgtttacaatagcaaagacttggaaccaacccaaatgcccattaatgatagactggataaagaaaatgtggcacatacccaccatggaatactatgcagccataacaaagaatgagtccatgtcctttgcagggacatggatgaagctggaagccgtcattctcagcaaactgtcacaggaacagaaaaccaaataccgcatgttctcactcaaaagtaggagttgttaaacaatgagaacacatggatacatggaggggaacgtcacacaccagggcctgtcaggaagtgggaggcaaggggaaggagagcattaggacaaatacctaatgcatgcacggtctaaaatctagctgatggattgataggtgcagcaaaccaccgtggcacatgtatacctgttacatggcacatgtatatctgtgtaacaaatctgcacattctgcacatgtatctcagagcttaagtaaaattttaaaaagaaaagatcataaggaagaaaaaagaaaaactcattgaattgcatatttgttttatgtatttttctgtatctgttttgatttttttaaggtgttgacagaatttagttcagagaggctggtttagctgatgtcaggacagggtacactgtcttatttagtcccagttaaaacagacactaggggaggcgctcaggtttactatgtcttaaaagatcccccaaagattctaatgcacagtccttgttaagaagcactagccacatggtagttcttgaagcattggaccagcagcttcaaaatcagctgggacgactgtaaaaaaatgtattttccttacctgagaacttgctagaaatgtaaattctcacactccactttgtctactgaatcagaaactctggggcccaaccatttgtatttcagcaaaccctcccagtgatgctgaggcaagctctagtttgaaaccctctgcactaccccaaacagagccactttctccagtttgtcaaaggctcaaacccgtgtgcggatgaaaagagcaaaggctctagaaagtgctaggagtggccataattttagactgaattcatctatacagagagggcccctcatcttctttccctggacagtaactaccagaggaaatgcaaattcatgtttggactatttttcaaattttgacagtctgataggtcctctcagctctggtaatgcaatatacggagatcacgattattactttagagcaggcatatcttcaactgtaagctggttccattgtcaaaccttaacaaatcttgatggtaacactgctgaactctctgtgtaaatttaatatgcagaaattatccttttagagccactcaacaatagcagcaacaagaaagaaaaaaaaaaaccatgaatctgtgtgtgtttatttgagttcttagagcacagccatctctcggcctgtcaggaggtaagcacagtggaaatacattccccacaagcttagggactcatccaagaaagccatttctttcttatttgtaaattctggggcaggttttctgcaaccttcatctgagcaatatgttaaaagtctaaaaattgctgttctcaaagtaccttttggaagacatacatggctctaaaactgggaaacttcattctatatgattatttgcaaagggagatattttagaagtgatgtcaggggaaaagtagaattattcctcctggatggccttggctctcggtagtggttcactagtgacgattagacatgctctgttgaccgtgcaccaggcgggcacaggtttatgctgtttctccaggacagagagagatttacattcatccatcaggaggcaagaactcttctgagttgcagctctctttccctagctgtagcctgagtcagagcacacccaggctgcaggttccaaagctccatttggtgccagtgacttcttaacagcacctaaaggccctgggtgcccattccagaaaggatcataaacaaaatctgggagaaaagtgactttcttcagaaacacccacacttttgttttttgatccctgatacagggacacaatggcctggagtgctaagattccactagcatctgtgaatataaagatagacagagacggtttgtggccacaggtatcttgcagtctagggaatagacagacagatggtgaacaaggacagtacagagtgatgagtagtcagtggtgacgcatgccttagctcagaaagaatgtaggagaaggatcctttctctgaggaaccagagcaggcttcacagagaaattagactttgagttgaagtgtgaagaatgagggatttttttggagggggaggggaacaggcagacagctagtgggaagttgctccaaacagaagggtcaggcttggcaaaggtttggagacgtggagccgcatataacccgctggctgtgtattctccattgtcactgtaaggtggagaccagtaaagacaatggctgagcaggtctggagctgagtcggagttaaggtttaatccagcttgcgaggagagagcctttgaaaaattctgatcgagagaagagcgtagaattaatagttatctcagcgttattattactatttacatctagtgtgtgctaaacactgtactcagggattccgttgaatcttaaaataactatgaaataaacattggtctcttcattctacacatgaggaaataatttcagaaaagggaagcagctggcctaggatcacacagtaggaagtagccagctcctgactgagactgaggtgggtctgactcctggaggctgagctcagaaactctttggaagtttggattatagatggagggggagaggctgcaggaactgctccagagggggatatggtagaactgaagatgcctgaatatagcatttttcaataaaaagtacatgtgtctgtgttcctattttgtttgagttttggtctttaattgcctctttaggatcaaaacaattctgtagatgaaatctacccatgattacattggatatttgctatagcaatgttccagcaaccctggaacaaactcaaaatttagattcatattcatttcaaactctgccaatttggaattttctttctttctgcctagacgctgatgagcggcatctaaacttctccatagccaactccgataccagagccttgaaaatatggatcaatcttcattctaggctttataaggtggccccttataaataaatttaacccagagagagctacttgctgccaaaattataatttagtagtgaaaaggggattcaaaaggcctggggcttttgcagtcctgtatctgcaagcaaatttgaaactctttgagcttgtttttttttttttttttaccttcaaaatggagatgagggcccttgtgaaggtcaggtaaagtcacattcatggacatatttcttggtcttctacagctgtgccaggtcacctaattcttatacattatcagtgccttgctttgtccacttccacagagaagggaagattcccagatggcctgccctcatttatccatggagtgagtagcccatagcctacatcacagatgtgaatttatagcctctgcaaagacaatggaaactggcaaccaaatgcctaattgaaaaaaacaagacaaaaacccaaacaatagcccatgaagtaaaagaacagggtaaacagcagtcaggaaggaaaaaggaatgaatttgaggttattagactggctgtttttcccagatcacagaaaacaattatgccatgttaaactatgcagaaattacatctatactgctcatttattcattcatttattcatctaaccatctaatctaccatatgccaggcactgtgctagtgctggagactcagtatgaagaataatctaatggaggattcaattgttgatccagtaattacacaaataaggtttatataagtaaccatgaattgtactgtcatgtcaagtttttctgagctttaagtgcatgtgaggaaagtgggaggaattcaatctagaccaggaggactgagaaagatctaaagagtgggaagtagctgaaaggtggcttggtcaggtggagagagaaggatgttccttgcaggtggaaccatgtgtgccagtgccctgtgatgagagggctaacagtaattgagaaacgtaaagaaagcttgaatgcaaggacagagatagggaagactgggatgggagaggagtctggaaggcaggtgggggttattctatgagggtcttgtaaccatgtaagaatctgggtctttggattaaagcattattctcaacctaggtgcacattggtgtcacctcgcaagctttaaaaatcctgagtcctgggccctgcccccagagattctgattttaattggtgtgggagctgcctgggtatcaggattttaaaagatgctcaggtgattccaatgtaaagatggatggataaatgaatgagtgaatgaatcagtgaatgagtagcatggatgtaatttctgcatagtttaacatggcataatatttttgaaaaatgctgtttgtgaatcttcagttctaattcagttctgccataccctctatgaggcagtacctgcagttctctagcctctcccgctccatctataacccaaactgccaaagggtttatgagctcagcctctgggagtcagacccacctgggtctcagtcaggaattggctactccctagctgtgtgatcaatggcttgagagccactggattaaaacgttttacatgcatatatatcaactgatttccactttgaaagatcagtctggctgtggtgtggagaatggatagacagggcagggtagatgggacgggactctagtgagcagagtagtgcagtgtcctcagcccctggtttaccaggctctgcaagggcgtttcattgtctatcatggcagccatcagtttgtctagaactgttagacactccaaagaggtaattttgctttttttttttctttttctccttttattttaaaaataagcccaatctggtttcttaaaacggaaacaaattggtctaatttctgctccttgggacaaggcagaatgagttttctcccctttctacatggcagcctatcaataatggaagatgatgattgtggtgccctaaagatatcttttttttttttttttttagacagagtctttctctgtcacccaggctggagtgcagtggtgcgatctcagctcactgcaacctccgcctcccaggttcaagcaattctcctgcctcagcctcccgagtagctgggattacaggcatgtgccaccacacctggctaatttttttgtatttttagtagagatggggcttcaccgtattggccaggctggtctcgaactcctgacgttgtgatctgcccacgtcggcctcccaaagtgctgggattacaggtgtgagccaccgtgcctggccaagatacctttctttaatactagatgcgtggacttataaactatttcttatgccatgaattctagatctctctgctgagtatatcctaatttgtcattaacatgtcctcttaaaaatctgttacttttttgctaaatatggcttctctattttcttttattaagtcattttgattattacagaaaatgctaacagaaaatactgtgccaaaagcaaagctttgatttataaaaagtgtccatttgtcttctaaaacaaatgatatttaaatgacatataaaaaagcacttaaagttttactctcgggcttggaaacagttgaagtcagcatttgaaattcaaactttcttatttgttctgttggtttaatggatataacttctttttaggaaaaaagtagaagctacagaggactttcccttttatgtttctcaaaaattttaaatttttccattgaagaatttgagaatttgacttagcacataaacaatctttcttctgtctctaagtgttgaaaagtaagatgaatcagcatcactaccatttattaagtggtttctacagctggtatggagctcatcagtttgcatgttgggcatctcatttaatccacatcacaattcaagagagaggtatgatcgttatctctgttctgtagatgaaggatgaggagttaagagctggtccaaatcataccagtagcacccctgatttctgcctctacagcacagcatggcacccttttgactcccacattcaaaagcaagtttatgccttgactaaagagtaacggccgggggaggggccaagaatggctgactagaaacagctgtggtcagaggctcccactaagaagaatgaaaatagtgagtgaatcctgcaccagcaactgaggtatccaggttctctcatttggactaactaggcagttggtgcaacccaagaaaagcaaggaaaatcagggtggtgatggcccgcctgggagccacagggagcaaggggagctcccatcccccagccaagggaggcagtgtgtgattgtgctaccctgcctgggaaaccatgcttttcccacagatctgtgcaacccgtgggtcaggagaaccccctcatgagcccatgccaccagggccttgggtcccaagcacaggcctatgcagattctcagcagccacttggctggagactgcttaagactacccagttcttatccagtgatggagggtcaacctccatcactgaggttgcctgctgcctaagacaaccaagctcccagggagaggggcagcagccatcactgcaactgcaatctgccattttttccctgctggtgccagggagattggatggtttggacccaggaggaattccccacagcgcagcacagtggctgtggcagatggtggccaaactgcctctttagtccagagcctgaccaatcccacctcactgggtggggcctccctgcaggaatttcagcaactccagccagggatttagggacagaactttgatctccctgggactgagcccctggagggaggggtggattcagtctccatagatagcagacttagtttttcctcctgcgggctctgaggaatctcagcagtctggatgagtgggattccctctagtacaacacactccctccaccaaggggaagccagagtgctccattaagtgggtcctggatcccatgccccctgactgggtgagaccccccaataggggttgccaggcaccttatacaggagcattcctgctggcatcaggttggtgcccctctgggacagagatcccagaggaaggagcaagcagtgatctttgctgttctttagcctctactggtgacacttccaggtgcaggagggactcaggaaactagggtctggaatggacccacagccaaccgcagcagccctatggaagaagggcctgactgttaaaagaaaaacaaacagaaagcaacaacaacagcatcaacaaaaacgtccccacaaaaatcccatccaaaggtcagcagcctcaaagattgaagctacataaactcatgaagatgagaaagaatcaacaacaaaaacactgaaaactcaaaaagccagagtgcctcttctcctctagatagttgcaacacctctccagcaaggacacaaaactgggtggaggctgagatggatgaattgacagaagtaggcttcagaaggtgagtaacaatgaccttcactgagctaaaggagcaggttctaacccaatgcaaagaagctaagaactgctatagagcaatacgggagctgtttaccaatatagccagtttagagagaaacataaattatctgatggagctgaaaaacacaacccaagaactttacaatgcaatcacaattatcaataaccaaatagaccaagcagagaaagaatttcagagcttgaagtttattttgctgaaataagacaggcagacaaggttagagaaaaaataatgaaaaggaatgaacaaaacctccaagaactatgggattatgtaaaaagactgaacttatgactgattggggtaaccgaaagagatggggagaatgaaaccaagctggaaaacatacttcaggatgtcatccaggagaacttccccaacctaacaagacaggccaacattcaaattcaggaaatccagagaaccccagtaagatactccatgagaagatcaaccccaagacacataatcatcagattctccaaggtcaaaaagaggaaaaaatgttaagggtggccagtcagcaagaaaggccggatcacctacaaagcaaagtccatgagactaacagcagacctctcaatagaaaccctacaagccagaaaagactgggggccaatattcaacattcataaagaaaagagtttccaacccagaatttcatatccagccaaactaagcttcataagtgaaggagaagtaaaatccttttcaacaggcaaatgctgagggaatttgtcaccaccgggcctgcttttcaagagctcctgaaggaagcactaaatatggaaaggaaaaaccaataccagccactgcaaaaacacactgaagtacaaagaccaatgacagtatgaaatggctacatcaacaaatctgcaaaataaccagatagcataataatgccaggatcaaattcacacataacaatattgaccttaaatgtaaatggactaaatggcccaattaaaagacacagaatagcaagcttgatacagagtcaaaacccatcagtgtgctatagtcaagagacctatctcatgtgcaaagacatgcataggctcacaataaagagatggaggaaaatttaccaaacaaatggaaagcagaaaaaaagcagagatgcaatcctagtttctgacaaaacagactttaagccaacaaagatcaaaaaaagacaaagaagggcattataaaatggtaaagggatcaattcaacaagaagacctaactatcctaaacatatactccaatacagtagtacccatattcataaaacaagttcttagaacctacaaagagacttagacacccacaaaataatagtgggaaactaatgctccactgtcaatattagacagatcattgagacagaaaattaacaaggatattcaagacttgaactcacctccagatcaagtggaactgatagatatctacagaattctccactaacaagcaacagaatatacattcttctcagcaccacatggcacttactctaaaactgatcacataattggaagtaaaacactcctcagtaatgcagtacaactgaaataacaataagtatctctcagaccacagcacaatcaaattagaactcaagattaagaaactgactcaaaaccacacaactgcatggaaattgaacaacctgctactgaatgacttatgggtaaataatgaatttaagacagaaatcaagaagttctttgaaagcaatgagaacaaagagacaacagaccagaatctctgggatgcaactaaagcagtgttaagagggaaatttatagcactaaaatgcccgcatcaaaaagctagaaagatctaaaatcaacaccttaacatcacaactaaaataactagagaaccaagagcaaacaaaccccaaagctaacagaagacaagaaataaccaagatcagtgtggaactgaaggaggtagagactcaaaaaacccttcaaaaaataaatgaatccaggagctggtttcttgaaaatattaataaagtagaccactagctagactaacaaataaaaaaagatgaaagaatccaataggcacagtaaaaaatgataatggggatattaccactgatgtcacagaaatacaaacaaccatcaagaatactataaacacctctatgcaaataaactagaaaatctagaaaaaatggataaattcctggacgcatacaccctcctaagactgaaccaggaagaccttgaatccccaaatagaccaataacaagttctgaaattgaggaagtaataaatagcctaccaacaacaacaacaaaaaagcccaggaccggacagatttatagccaaattctaccagaggtacaaagaggagctggtgccatttcttccaaaactatttcaaacagttaaaaagaaggaacttctccctagctcactttatgaggccagcattatcctgataccaaaacctggcagagataccacaaaaagagaaaacttcagaccaatatccctgatgaactttgatgcaaaaattctcaataaaatactggcaaacaaaaaccagcaacatatcaaaaagcttatccaccatgatcaagtcaccttcatccccaggatgcaaggctggttcaacatatccaaatcaataaatgtaattcatcacataaacagaactaaagacaaaaaccacatgattatctcaatagacacagtaaagacctttgataaaattcaacatcccttcatgttaaaaacgctcaataaattacaagcattccccttgaaaattggcacaagacgaggatgccctctcccatgactcctattcaacatagtattggaagttctggccagggcaatcaggcaagagaaagaaataacgagtattcaaataggaagagaggaagtcaaattgtctctgtttgcagatgacataattgtatatttggaaaaccccatcgtctcagccccaaaactccttaagctgataagcagcttcagcaaagtctcaggatacaaaattaatgcaaaaatcacaggcattcctatacaccaacaatagacaagcagagagccaaatcatgaatgaactcccattcacaattgctgcaaagagaataatacctacaaatacagctaacaagggaagtaaaggatatcttcaaggagaactacaaaccatggcagaaggaaataagagaagataccaataaatagaaaaacattctatgctcatggatagcaagaatcaatatcatgaaaatgtccatactaccaaaagtcccaaagttatttatagattcaatactatttccattaaactaccattgacattcttcacagaattagaaaaaactatttcaaaattcatatggaaccaaaaaagagcctgtatagtcaagacaatcttaagcaaaaagaacaaagctagaggcatcacgctacccgacttcaaactataccacaaggctacagtaaccaaaacagcatgctactggtacaaaaacagacacatagaccaatggaacagaatagagatctcagaaataagactacacatctacaaccatctgatctttgacaaacctaagaaacacaagcaatagggaaaggattctctatgtaataagtggctctgggaaaactggctagctatatgcagaaaattgaaactggacccctttcttacaccttatacaaaaattaaagatggattaaagacttaaacataaaacccaaaactataaaaaccctagaagaaaatctaggcaataccatttaggacataggcatgggcaaagattttatgacaaaaacatgaaaagcaattgcaacaaaagaaaaattgacaaatgagatctaattaaataaaaaagagcttctgcacagcaaaaggaactatcgtcagagtgaacagacaacctacagaatgagataaaagttttgcaatctatctatctgacaaaagtctaatatccagaatctacaaggaacttaaatttacaagaaaaaaaaactcattaaaaagtcggcaaaggacatgaacaggcacttctcaaaagaagacatttatgcagccaacagacatgaaaaaaagttcaacgtcactgctcattagagaaatgcaaaccaaaaccacagtgagataccatgtcatgcccatcagaatggcaattgttaaaaagtcaagaaacaacagatgctggtgaggctgtggagaaataggaacactttcatattgttgttgggaatgtaattagttcaactattgtggaggatagtgtggtgattcctcaaagacctagaaccagaaataccatttgacctagcaatcccattactgagtatatatgcccagaggaataaaaaatcattctattataaacatacatgcacacatatgttcattgcagcactattcacaatagcaaaaatatggaatcaactcaaatggccatcaataatagactgaataaagaaaatgtggtacatatacaccatgaaatactatgcagccataaaaaggaacgagattatgtcctttgcagggacatggatggagctggaagccatcatcctcagcaaactaacacaggaacagaaaaccgaacactgcatgttctcacttacaagtgggagccaaacaatgagaacacatggacacaaggaggggaacaacacatagtggggcatgtcatggggacattgggagaaagcatcaggataaaaagctaatgcatgtggggcttaatacctaggtgatgggttgataggtccagcaaactgccaaggcacacatttacgtatgtgacaaacctgcatgtcctgcatgtgtatcctgaaacttaaaattaaattaaattaaatttcaaaaaaagagtaagggctagcttgcatccatattctttctaggaacttttctcaatgctccagcctgagtgaccatgcccttctctagatttcataacacctgtctatattagaggaggcaattatgatgggcctacgatttccaacattactcgtagttattaaccactaaattattatttaacttcttatctctgtgtggattttttgtctctccacatagactctaagtttcttggggaaggattgtctattacgagtctttgctttcccatagtgcctagcatattgctttgtccatatgcaaggcaaccaatttacttgagttaatgaataaataaactaataaagacccaccagttattttggaaaatgcaaggtataaatatcttttaaaaccctgaaaagctcagagcaaggaggagaagggcctaagtgcataggcacaggagatgcacacttctgggctcatgttccagctctgccactggccagctctgtgacctcaggcaatgtcagtcacctcatctgtaaaatatggataataacttaatacccagactagaggattgtcgtgagtgtcaaatgagatgatatgtgtaaatcctttaacctaattcgtggcctatttgcataaatcgtagctattatagtcagactagctcttattattgaatcatgctttattatgtatcaagagcctttctgtacattgtcttgtgtaattattgacagatgtttactgaacactatgatgtggtgggtacacagtagcaaatacataggcatagtccctgaccccatagagcctttgtcacataaacagtgaaatacataagacagctatatttctccccattctaccaatgagaaagaaggactgaggagcatgactcaggcttgccatttggtgacctgatattcaagctgtgctgtttctgcctgctatggttcgaatgtgtcccctaaaagttaatgtgttggaaacagtctgcaatgcaacagctttgggaggcctaatgcaaggtgtcattattgcgagagtaagttagtcatcacgagagtgcgttgttatgaagcaagtgtgacccctaatgtctctctcttttgcatgtgctctcttgccctcccacccttccaccatgggatgatgagcaagaaggccctccacagatgcagctgctcagtcttggactgtccagcctccagaaccatgagctaaataaacctctattctttatagattactcagttcatggtattctgttatagcaacagaaaacagactaggatactgcctcacaagacgttcttgccatgacaaccaggtggattgtgagaggaatattctgtgagcagggctgtttccaaaccagggagatggtgttcattttaaatatgttcatgtgtatggatgttaatttagctatagctattagctttgatttgtttgatgttaaataaacctgaacagacatgatacagtataaaattaagtactgtttgattcctcagtatatttgctattaatgagtaattatgaatataattcataaggactgcaaatgtataatttgtatgtacatgtgtatgtcaggattggtagaaaatgtgaaatattaaattacactgcttaagatagcctactacaagcctacttatgaggtcatttagtgttaattgcctttaagaagaatctcactaccaacttcatctccccatcaccatctgcccataagatatgccaagtatctatttgaatcctttctttttaaaattcttattttaataatgaatcaaaggtgtctgtgttcctatttggtttaggttttgatccttaatagcctctttatgatctatacaattctgtagatgaaatctacccatgattacattggatatttgctatagcaatgttccagcaaccctggaacaaactcaaaatttagattcatattcatttaaaactctgccaatttggaattttctttctttcagcctggactctgatgagaagcatttataacttctccatagccaactctgataccacggccttgaaaatatggatcaatcttgagtgaacattcattctaggatttataaggtggccccttataaataaatttaacccagaaatagctacttgttgccaaaaatataatttaatagtggaaaggggattgagaagacctccagctctggccctggccctgtcctttacccgtcctgtaactgcaagcaaatttgagcttggtttctttgccttcaaaatggagatgatgtcccacagggcccttgtaagagtcagatagagccacattcagaggaatatttcttggtgttctacagctgtgctggattacctagttcttacacactaccaatgccttgctttgtccacttccatagagaagggaatattcccagacggcctgctctcatttatccaaggagcaagtagcccacagtctacatcatgaatgtggatttataatctctgtaaagacaatggaaactggcaaccaaatctcaattaaaaaaaaaaaaaaaaaaaaacaccaggccaggcatggtggctcatcctataatcccagcactttgggaggctgaggtgggtggatcacctgaggtcaggagttcgagaccagcccggtcaacatggtgaaaccccatctctactgaaaatacaaaaatttgttggatgtggtggcgcatgcctgtaattccagctactcgggaggctgaggcagaagaattgcttgaaccggggaagcagaggctgcagtgagctgagattgtgccattgcactccagtctgggcaaaaagagcaaaactctgtctcaaaaaaaaaaaaaaaaaaccaaaccaacaatagtccatgaagtaaaagaacagggtaaacagcagtcaggaaggaaaagagaatgaatttggaattatttacctggctcttttcccaaatcacagaaaacaattgggaaagaccctgagaatcgaaataccctcctccttcccaactctctcctgtgtgtggtgagatttatggatttaaaggctgtgtaatagaacatacacggtcaagtcttcatgggcaaaccgtggcttcacttcatgacagcagtagggttggcagtgaagtgaaaacatcagcaaaacatttcccttaaaatctattcatggggacactaacagggccattccacatagcacattcttctatgtgtggggcaaaggccacagattgtgaggccacagcgtgagcatggctgagaccctggcaagaaagagtgtgcacaggtcagaggattcaggcatccttgatcatcaaagaccaatgacgtttgtctggggttaacccagagtgaggctagcactggccacgtggagcatcctgagccgttttgtggctctcaggctgtggcctagtttgttatatgtctcaaaataagcaccttgacctcttctccctgtggtgttttattttgatatggtagtttaacagttattaatatgaaagtataatatatggaggaaaattttaaaactatagaaaagtaaaaaaaaaaattatttgcattacattataagcctttcagcattttgttctcttttctatttagcctttaaaatatgcagagattttaaaataaaactggactcagtttgcatttttggttttctgttttgattttttacttatcattatgtcatggacatttttctaagtcattaaacatttttaagaaataacatttttaatgtatcataggctgtcccatggttggctgccagtgtggattatgaaagcattgttcttaggacaagactatttccaaaccagggaaacgatgtccattttacgcatgttcatacgcacagatgttaatgaaactgtggccattagctttgacttgtttgatgcatagtatgagtcggatatcccttacctgaaatgcttatgaacagaagtatttgaaattttggatttttttattttggaatatttgcattatatttactgggtcaacatccctaactgaaaaatccaaaacggcctctggagcattacgtcagtgctcaaaaagtttcagatttttaagcatgtcacaattttgaattttcagatttgggatgctcagcctatagtccattgcataactatactgtatttttattaatcatttctctctatcattagttgcttagattccttcatctgtttctgtacaaataaacactgctatgttttatttaatattataaataaaaatgaaacagattagttattgttatttctaacagtggcacatattttaaatatgaaaagtagtaacagtgtgacttgatgcaaaaataagccaacagagtaaggaaacagaaaagacagccaaggaaaagatcctaatatataccatgtattgaatgataaaaaaaaaatgtatcacatcaaggttaagagttaaagccagtaaaatttttaaaaaatcacaaatcagtgggggagtgattattgaacaaacattgctgggaaagcctaacctcatactacatcagcagaataaattctacatggaataatgagttagatcttaaaattgaaatcatgaaaatactggaatagaaccttagtgactaattgttcttagagtttaaaaagattattaaagcaatgaaagaaatgagggaaaagtgatacatttgcctccataaaaatatgtaacttaggccaggcgcagtggctcacgcctatagtcctagcactttgggaggccgagtgggaggatcacctgaggtcaggagttcaagaccagcctggccaacatggtgaaaccccatctctactaaaaacacagaaataagctggatctggtggcatgtgcctgcaatcccagctacctggtaggctgaggcaatagaatcactggaactcgaaaggcagaggctgcagtgagccgagattgcaccactgcacttcagcctaggtgacagagcgagactctgtctcaaaaacaaaaaaaaaaaaagtaagttaaaagaaacaaatgcgtatatattttttgcttctgtatgtatggtggatgagcagtagataaaacaaattcactcttctaaaggagctcacattcgaatggaggaaggtaggcaaaaataaatatattcagaaaaataaaatagggtactggaagagagaatgagcatgcttatttttctttctcagctgtaatcatctgacaggtatacatcctgactttaattgtctttgtagctaccatcaagttttttcagactttctttaagttatggtcctgtaatgatcaaaggcaaaaatgaagcactaccttttgtttcctttttgctacacttattccttctctctattgtcctctgttaatataagttgtgattgtgtacatagattccattataaaattattgttttatctttccttccagtaaatatatttgaaaattttatttttgtaatcagattttcttttgaatttaacttttaagctaattttaggatttactatagacacatttataccaggattttcccattttaagtacttagcttttattcttatcatgcttaaaattgatgtacatattcaagtgttcttttttcaccaaataagtaaagatatatttttttctgaattcttgtctttgtggtaatgtctttcttctagtttttcacataaccagcaacttggccttggaaaatccctgggaaccagtcctttgtcctcgtgtctccttagctgttacttctttgtgttttagtctttagcattatagagggaaaaaaatcataccagtttttaatcacttatagataatctatttttctttttgcttttatttctaatttgatttgttttcttgttttaaacacttgtacaattttacatttgttcttgcaattcaataaagggccagggtatttttagacatgagtctaattttattaacattacctgttacatggcaaatcttctgtatataagtatatattgtcttgcacctcaggaaagtttatttctttttatgtctttattattttagttttaggttttttttcttcctttggaaaacctgtaacactttagttcagtcttcttcgttatcttctgcatcttgtatctttccttttattattttggtgtctttgccttttcctatgctttctggaagagcaactcactttcttcctgaatatccttgatttagtttttatgtaaattttgttctttcttgcctccagttcaggttttaattagacccttccatttccttcttagtttatctgattcccttgcctcctgcgcttatccttccctgcggcattctatttctgtttcaaaaggccaagtaattttataaatcattaaatatgtctgataaatttctaaaaaggtgttttgatatctggagtgaatcagagtgatgcatttcctttgggctttcagaatgatttttcttcttactcattttatagcttaaaaaaattgttgggtcttactgcgtttcttaatttttcctaaaacagagagctatatagggctggtgttctacagacaaggcctgtcctgtcttgtctactcacctggtatcccccgcacagtacatggcctgacacatagtaggcacacaacgattatccattgaatgaatgattggctagggaaagcaattcaactagttttcatcttagacatatgttttaaaaaccttgtataacagaatcaaaataaagaaagggagttttattgcttgggttggaaggaatttatccctcagctgatggctcagtgaacacagcaaaccgggtgagctttcaccatcatcttgctcagatgtatttttctatactttcccctgccagttgccaagagacattaatgaatcttacaaaagtctggaccatatatatcttcagaagtgtctgccctgctcagcctgtggacaattattcaagtcattggagatagctggcccagtcaggaaggccgtcttcctcacaaccaaggcttgggtttgacaccttgtacatcctgcataaacaaactctgtttgattcaggccccaaggcagacacaaaacaagcgttacccacaaagtgcagctgggaggaagcttgtctgttatctgggaggaggacagaagctcaagctacgcacaaaacttgcttggctcattttattagataacccctgccccccgccccccgccccacttcctgactctctctctctctctctctctctctctctgtctcacacacacacacacacacacacacacacacacacacacacacacacattcctcatctgagcccagcccaggaaggtccagaaggaggcatacacatgcctagtgggccttgtattgtagtgaccattacaaagaaatgttttaaaggaaagtaaaggattttgcagaatcccatttgcagggaaagacctgttctgtgctggcacctgctcctatgtttcttctagccacatttgaaggagtctctagagcccatgaagaaggcacatccgatgtgtgggaggaatcagagtgcaagaggatgcagaggtctgggaggagcctccagagggaaaagcaacctgcatcctagctccacagatgcgcagtctcccctgccccaaatcctggagctggcttggcattttgtctgatgaataacgcagggttctccaaaatagttttgctctaaagatcgatttcctcagatatcaaaacagaaaccatgagcagccctctctccaactaaagataagacatttcagaatacgagagggcacacgacccccaagactgaaagagagagacttgttgatgccacatgggagtatacttcatttggcaattatcctctcccatttttaccctcaatggatctggaaatggagtctgcagacactctggctgatttcctaatgggatcaaaggagtaatcctgcagagctccctgtggacgccacagcaggagcgggagggtctcctggcaatgtttgtaacacctcctttggatgttgattctgccctaaggtgcatgatgttctgcagtggaaatgggttggctcccagttctgctcagactttcagacattaatctctcagacagttcagaagctacagtcaagtcagaatgggagggaatgtgtctgggtgccaggtccagccgttagggcccttctcagcatgactccacacttccttctggccttaactcccaatgttcctttatacatcgccttaaactacagtaaaactcagcagctaagcacaaccttacttttcaacttccgttttgagtagggtggagagacaccttcacttgttgtcttggcctagaataccctctacctcttccctgcccacacatcaaaatattttctttccaccattacaaactttagtaaatagcctgggttttcccagaacagtctaacctgcatacagataagggcttgttttcctcattattggtttcctttgggaaaggcttaatacagaattttaaattctgttctgctcatattttacacgcagtggtgtgtccatccttgtcattttcaccctctcaatacaaaccttatgtacttagagacttaattaatagcaagctacatctaaaaataagagaaattaaagctcaatattagaagactttaggaataagatgacccttttaatagcatattgctgagcttttactaaacacctattattgtgttattatttgtgttatttttctaggtaggattcataaaaatgctgttatctgtcctgacaagagcagagggaagagtgtatgtttgaaccatctttatattaacagcacaataaaattcacggcttatagtttccaaaatattgccatgctcattctatgaactgattccataaacaagtctgttgctacctacttcctcatacctctagctccaccgctggctcttcccctcctttcctaggccaggcccatttctctccaactgttcttacagttgtgacctccttccccaactccatccattttctcattgcagccagggtgacttcccaacatgcaataactctgtctcctgtatggcccgcctcgtgttaatacagctctctactacaatacagtgaatcagttttttctgtgcggcaggcaggaagaacctgttgggcaattacagtgccaggtacacagttggtgcttaatatatacttattgaacaaaagggtgcatgaattaatatataaatatgtcaaaaatagcttcctggctgggcatggtggctcacgcctgtaatccctgcactttgggaggctgaggtgggcagatcacctgaggtcaggaatttgagaccagcctggctaatatagtgaaaccccatctctactaaaaatacaaaaattagctgggcatggtggtgggtgcctgtaatcctagctactcaggaggatgaggcaggagaattgcttgaacccaggaggcagaggttgcagtgaaccgaggtcacgccactacactccagcttgggcaacaaagcaagactctatctccaaaaaaaaacaaaaaacaaaaaaaagcttcctgaggtgggcaaagaaaatgctatgatttctagtctactaacccacaaccagcagaccaggggttttgctgaatgtcacgcaacttctatgaacaggagaagccttagaacccaagatttaaacctcttaagattggtgagtttccttccacatcttcttagatcagagcaacatttacttccacttttctaccttggatgtatgtttctcccagagtgaaagaaggacactggaaataattctaccctctcctgtggagacagcatcaaagttgtcaggagaccaaattcatgtaacatgtgatcagtcaatgagttatctctactgtttagggacagcatcaacaatgacacactcattccaatgcatcatttttgtatgtctgcaatgcagtgtaccaagtctgtgctttaaaatcatgtttttaaaagttgtcactcttttctttcttaaagttgtcattcttgtctcacttgtaagacttttgcaagtgtcgtttcttctgcttgaaattcagcctccctattgtatattttggcttttgagtatttttacatcttatcacatcagtgtcaatgtcttaacaaagcacatcagccagagggtgagtagttgagcatctattcagagtcaatgccatgcccactgttgcaaagaatgtgagaaatactgagatagctttaccatcaaatattggactgcccaggagtggaagctaactaatttctaagtaatttctcaaccagagatctataagaaaaagaaaaaaatgaccaattattgaacacatttgcaaaggtcttacaagtgagacaagaatgacaacttttaaaaacatgatttttaagcacagacttggtacactgcattgcagacacacaaaaatgatgcattggaatgagtgcctcattgttgatgctcttcctaagcagtagaggtaactcattgactaatcacatggtacgtgaatttggtctcctgacaactttgatgctgttttcacaggacagggcagaatgaccagttagaattccctttcattggcttggcatggtggctcatgcctgtaatcccagtactttgggaggctgaggcaggcagaccacttgaggtcaggagttcaagaccagcctggccaacatggtgaaaccctgtctctactaaaaatataaaaattagccaggcgtggtggcatatgcttgtaatcccagctactcaggaggctgaggcaggagaatcacttgaatccaggaggtagaggttgcagtgagccaagatcgtgccactgcactccagcctgggtgacagagtgagactcctctgtctcaaaaaaaaaaaagaaaagaaaagaaaaaaagaatatccttccaccacaaccaccactatagacttgatgtgacgagggcccttcccagtgatgagaggaggactcaggtctataagagaaatgggtttcacaggaggcacagcaggacttggtgatgagctgcaggtgcagagctgaaggacagggaaggtctccgttgtctgtcaggctgcaagctctgtgacagcaggaactgagtcatttctactgaccattgcattcccagtacctggcccaggcccactgcataaggggcactcaatatatattttccaatgaagaagtgattaagtagagattatggatgagaggggtcccagagggctcttatgttctaaatatgtgtaatgggaaaaatggtggtgctatttactgggaagtagaatctgggactggaattgaaatggagctggctttggaggagaaatgacaaggtacacgtaagacttaatctggtgatgtcagtttatctgtgtaaccaggacttctagtctccaaacaaggtagacaagagggagataacaagtgaaagaatagaataatcagagtaacacttgaatgaaagtcaggaaacccaagtttcatttctgtcttagccaccaatttacttcacttttctggatgtttgctcatctatacaataagaaggttatatcaaacaggtgctaaggaccactttaggactagaattctagattgtagaggattctatgctaggccgggctatggtgagtgatgctcaagatgaaccttcagaagtaggtgatggatgagttagacaggtgagtgtaatggtgaccaatagcaagctcaaactcacacatggtgggaccatggacagttccctcccctggctgtttcttctaggcagagagcatcatggaagccctgaaggctacagatcatctaggccaggatttttccataaagtatgttctagaggtgaggtgttaatggatgtttatacacacttaaatgaggttctatgctcaaatacattgaaaaacactatgttaaaaggcttctttttactggactttaaaaatagcccttaatatgctcattttccctctaggatgctgatatactggatacacttcctttaaaaaaatgaaagatattgtaatcaggcaaatctcagcatgcaggatggggcagctgactccccgcaggcttgctgagagcccttgatgactcttgtcagtgcagtgagatggctcttggtggagtcactgaggatgaagatcaggagagaaaaccacatactgtctcctggagaccaagctcctctcaaaggctaaaggaagcttccgtcattctggtgtgcacatctgcccctgtatcccaagaagagatctgagcacgtgggtgttccggcttccaaacatactgggctcccactggtgagatgatattagctacttacttatattcacctccacacccatgtccttctcactgccaaactgcctctttgctcatttctggttctgtgggcatttgtatttttgtagcatgaagtaatgaggactctgaggacttccactttccagagccaggattaatttaaaagttttgtcagcaggcagcaaattccaaaggttactgtccacttgcattcagctggaggcatgctcagaaagcattcttttgtgcctttagcatgtgtggcaggggcgctggttgaggctggacatttacttgctgtttgattgctgactgtgtcactggttcctgatgatttttggcatgggataaatgctgttagtcagaagcaaaacttcctctgtgagagctatttgttaaatccaatcaacaagcattggtcaggcacttattgaagtggatccctgctaatttgtccctctcccactgtatgcaattccaatagctacttatcataattcccatagaactctgagaggggagaaagcctatggatacaagattttctctctgaaagtgaaaattgcatttttagagacaagcagctgtgacatcctgggtgggacacagagggtgggtggaggactgagagaggaaatgatatgcatgccctgaaatggtgtctgatgttgctcccgaatagtgagaggatttgtattagacatggctcctactcacaaactgtggtctccctgacatgatagcattgtctggttcatctgtgtcccctagccccaccacatagtaggtcaatcatttttttttttttttttttttttttgagacagaatcttactctgttgcccaggctggagtacagtggcgccatctgggctcactgcaagctccacttcccaggttcacgccattctcctgcctcaacctcccgagtagctgggactacaggcacccgccaccacgccaggctaatttttttttttttttttttgtatttttagtagagatggggtttcaccgtgttagccaggatggtcttgatctcctgacctcgtgatccgcccacctcggcctcccaaagtgctgggattacgggcgtgagccactgcgcctggcctggaggtcaacaaatatttaaagcacctatagctaaaccaacagttagtaattaccactcctcacatagtctatgccaggcccagtgctgatgatgtgcatattaagcacacctcctccttgattttcatcatgaccctaagcagtagatattggcatcattctttctgtgatacaagttaggaaagaagggccaagagacctgatgtcacctgctggggatgcaacagctgtagacttcgtgatccgcccgcctcggcctcccaaagtgctgggattacagagcctgagcagagcccaggtgtctgagcacagcccaggtctctgagcacaaggtatgtgctctggaccacaggctttagggagggaaggggagcaggaaatgtcgacacatagggttgggggcaggggtaagtctctccctcaacctaggttagaggtcactagcaggaacacaatggccagtgggaatttctgtcatgaggcatacatctgactgagtccctgtcctcagcctgccttcctgcccctttgcagactgtctgctcatcctgggtcccttgggcatgctgcacacctttccccacgtgatattcgtgcttaggcagccgaggctgtgagacacagtgtagtgttacactctgccttgatttgtcacaggagatagtgtcccttctggagctcaggggcaagatcttcccagaaggaaagctatcaaccacatgcctgttggaaatactgatgaatgtgttcattcaactttgatgtagtatttttaaaagtcaattattttcagcagtgaatatcaaagcaaaatttaacaaagctaagattgctacattcagctttaatacttgtcagctggcgaatatctctttaattacacaagcacaaatccagcaactcattttactctgctgaaaatacaataatgacaatcaaaaaattctcacttccattttcactgagtttatatgagggtatgaggtcattcaaactttgccaaaagatgtacgtactgtcgatgggtccccctgcctttgagaaatgtcctcccaattgtctttcagttattattttcactaaaacttttagtttcacttttagtttcatcaaacaaaataatcttaaataaaaagttttattttagttctattaaaactttagttcattagaacttttaattaaggaattcccttccacaggggaaaaagtagtcaaaaatgataactaaagcccaaaagatgtaacaataaaatgattacctggaacgatcctcttgtaggtaagtctaagatataatgtggatttttcttctcttttagaaggagttggccacagcataccaatgtgaagtgttgagtttttcttaagttttatttaaattttaattcataaataacaatcgtacatatttatgtgggtacaatgtgatgtttcaatacatgtgtacattttgtaatgatcaatctgggtaattaacatatttgtcccctcaaacatttatcattgctttgtggcaagaatgttcaaagtcctcttttctagctcttttgaattatacactatattatcattaactgtagtccctttactgtgcaatagaacactagaattcttcctcccatccaactgtaactttgtatctgttaactaacatcttccttctctccctccacctccatctccatcctctggtaagcaccattgtactcctctctttctacaagatcaacttttttagattccatgtttaagtgagatcatgtggtatttgtctctctgtgcctagtttatgtcacttaacataatgtcctctaggttcattcaagttttagcaagttacaggattttattcatttttgtgactgagtagtattccattgtgtttatataccagatttttaaatccgttcatcctttgtttcctaagtgtccatcaacagatgaatagatcaaaaatggttgaatcttggctattgttaataatgcattagagtgcagacatctcttatgcagaatgatttcaattcctttgcatgtatacccagaagagtgattgctggatcacatggtaattctatttttagtattttaagaactccccatactattttccaaaatctcctaagaatttatttatttatttgtttatttagagacagagtctcgctctgtcacccaggctggagtgcagtggcgcgatatcggctcactgcaagctccgcctcccgggttcacgccattctcccgcctcaggctcccaagtagctgggactacaggcgcccgccgccgcacccggctaattttttgtatttttagtacaaacggggttttaccgtgttagccaggatggtctcgatctcctgacctcatggtccgcccgcctcggcctcccaaagtgctgggattacaggcgtgaaccaccgtgcccggcctgaatttataagaaaaccaacaatgtgtaagtgtctccttttcttcacattctcaacacttgttatctttcatctttttgataatagccaatctaacagatattatgtaaaatcttattatggttttaatttgcaattctcttatgataaatgatgttgagcatttttttttgtatatctgttgtccattcttttgagaaatgtctactcaagtcctttgctcattaaaaaaatttacatttgagggtacatgtacagatttgttacatgaatatattgcataatgctggagtttgagagttagtcaatgcagagcctaacaggtagttttccaactctttccccacccttttggagtccccagtgtttattgtttccatttttatgtccgtgtgtgcccattgtttagctcccacttgtaagtaagaataagtgatatttgattttctgtttctgcattaattcacttgaaataatggccaccagctgcatccatggtgctgcatagaacatgattttattctttctatggctgtatggtattccgtggtacatatgtaccacattttctttatctaatctactgttgatgggcatctagttttgttttcttgttattgagtagtttaagttccttgtacatttcaggtattagcttcttgtccagagaataatttgcaaataccttctcccattctgtggattgtctcttcactctgttgattgtatccttttctgtgcagaagctttttagtttgttgtatccccatttgtctatttttggttttgttgcctgtgctttcgaggtcttacccaaaaagtctttgcccagacctatgtcatggagatttttccctgttttcttctagaagtttcatagtttagtatcttacatttaactccttaattaatagagtaaaatataagggtctgatttcattcttctacatgtggatatccaatatttccattacaatttatcaaaaactttcctttctctgttgtgtgttcttggcacctttgtcaaaaatcagttggctgtagatgcataggtttatttctgggtcttctattcaagtccattggtctatttgtctgtttaaatgccactaccatgctatttggattactatagctttgtagtatattttgaagtcaagtagtttgatgcctacagttttgttctttcaaaatttctttgactttgacttttcaggacattttgaggttccacaaagttttggattattttttctatttctgtgaagaaagttattggtattttaataggaattgcattgaatctggaggttttggggagcaccatggatattttaacaatattgacttacctaatctgtaaacttgacacatctttccatttatttgtcttcttcactttctttcttcaatgtttaatagttttgagtgtagagatctttcacctcgttggataaacttattcctaagcattttttggtagctattataaataaaattgctttcttgatttcttttttagattgtatgctattagtgtatagaaatgctactgaatttgtatgttaattttgtatcctgtaactttactaaatttgttcattagtgctagtaggttttcagtggagtctttagggttttctatatataagattatgtcatctgcaaacatggaaaattaacttcatcctttccaatctctcatgcctttccatctctcatacctaagagaaagaaataaaaggcatttctcttgctctggctaagacttccagtactatgttaaatagaagtgataaaagtagacattcttgttttgttctagatcttagaggaaaagcttatagcttgtctccattcagtatgatattggctgtggggttgccatttatgatctttattgtattgaggtacattctttctatatctaatttgattagagtttttatcatgaaggatgttgagttttgccaaatgctctttctgcatctattgaaataatcatatggtttttcttcttcattctcttaatgtggtgtatcatttatagatttgcatatgttgaaatagctttgcatccattggatgaatcctatttggtcatggaaaatgatctttttaatgtgctttgggatttggtttgcttgtagagtcatgcattgcataataatgttccagttcgtgatagactacaaatatgacagtggtcccataagattataataccatatttttactgtacctttttatgtttggatacacaaatacataccattgtgttacagttacctacagtgtttatgacagcaacattctttgcatatttgtcacctaggtgcagtggactatatcgtgtagcctaaatatgtagtgagttataccatctaggtgtgtttaagtacactctatgatgttcgcatgacaatgaaatcatcgaactacatatttcttagaatatgtccttgttcttaagggatgcatgactgtattttgttgaaaatgtttgcatttatgttcatcagggatattggccaatagttttcttgtattattgtgtccttgttaggttttagtatcgaggtaatgctggcctcatagaatgagtttgaaagtattcattcatctttaatcttctgaaatagtgtgagaagaattgtattagttttacttgaaacgttttatagacttcagcagtgaattcagaattctatcaggtcctgggcctttctttgatggaagactttttatcactgattcagtctcattatgcattgttagcctattcagactttctatttcttcatgattcaatcttgggaggttgcatgggtccaaaagtttatccactcctaggttatccaatttgttggtatataattgttcataatagtctcttattatcctttgaattgctatggtattagttgtaatgtttcctttttatctctgattttatttatttgagacttctctcttttttcttagttatttagactaaagtttgccaattttgtatttgcaaataacaaattcttcatttcatttatcttttgtgtagtttttcatctgttttatttatatctgctcatatcttcattttttcactttttctcttaattttgggtttagttttttctagctttttgaagtacaatgttaggttgtttatttgaaatctcttttttttattgatatcggcatttattgctataagcttccctcctagaactgcttttactgtatcttacaggttttggtatgttgtgtttccattttcatttgtttgaagacatttttaaatttcccttttaatttcttcattgtcccattggctgctcaagagcatattgtttaattttcttgtattcataacatttctaaagttctcccctgttattaatttctagttttatactattgtggacaaaaagaaaataaatgatatgatttcagtcttcttaaatttgttaagacttgttttgtggcctaacatataatctatgctggataatgttccacgtgcagttgggaaaaatgtatattctgcagctgttgaatagaatgctctataaatatctgttaagtccattgcgtctagattgcagtttaaatccaatgtttttttgttaattttctgtctggatgatcaatccattgctgcaagtggggtgttgatgtctactgctattgttatatttcaatcagcctatcctttcaaatctgttagtatttgctttatatatagactgttcctgatctacgatgatatgacttaacaattttttgacattatgatggtgtgaaagtgattcacattcagtacactccttgactaatgatggaaagtattgtaagtaaaaaacacactttcagcttacagtatttccagtgtatgatggttttattgtaaccccattgtaagctgagaagcatttgtatttaggtcctctgatgttggatagacatatatttacaattagtatattctcttgctgaaatgactccttttattattatgcgatgaccttctttatctctttttacagtttttaatttgaattctattttatctgatgtaaatatagctacttctgctcttttttggttttcatttgcatggaagatctttttccatctcttcactttcagtctgtgtgttccgacaggtgaagtaagtctcttgtaggcagcatatatttgggtcttgtttgtttatccattagccactttatgtcttttatttggagaatttaatccatttatattcaaagtaattattgttatgtaaggacttactagtatcattttgttcattgctttctagttgtcttgtaaatcttttctttcttcctctcttactattctcctttgtggttaagtgattttctctattatcatgttttgatttcttaccttttacttttagtttatctattgtaggtttttcttttgtggttataatgaggcttacaaaaaccctcatatagatataacaggttattgtaagctgatatgaaattaactttgagtgccataaaaaagtctacgtttaaccccacccactgcattttgatcttttactgacacaatttccatctctttatactgtataccacttaacaaatcattttagttttaaaaatatttatatcttttaaccttcatactaaaggtataagtaatttaaacatcattgttacagtattagagtattctaaatttgaccatataattataggtaccagttagttttatactttcaaatgttttttgtattatgcattagtatgcttttctttcagcttgaagaactccctttaacatttcttgcaagacacatcctgtggtgatgaacttactcagattttgcttgtctgggaaaaatctttctttctccttcatttctgaagaacagctttgatggataaagtattcttggtttgaagttttgcttttttattttgtcttcagcactttgaaaatattattctattttctcctggcctgtaatatttctgctaagaaatttgctgatagtcacattgatactcttttgtatatgatacgcttcttctctgttgctgctttcagaacatatcagatttttttctttgagtttgatttttcttttttttgagacagggcatgcagtggtgtgatcatggctcactgcagcctcaacctcctgggctcaagcaatcctcccacctcagcctcccaaatagctgagactacagatgtgtgccaccatgcccaggtaatatttttatttttattttttgtagagatagagtctcactatgttgctcagtctggtcttgaattcctgggctcaaatattcctcctgctttggcctcccaaagtaataggattatagtcataagccacggcacccagccctggctttgatttttttaatttttattttttttattgtatgtcttggtacactggtcttttggttgaatttgattggagacttctgcttctcatttctgggcattggcatctatccctcaattatggaaatttccatccattatttctctaaatatgctttatggcaattttcctctttcttctctttctgaaactcctattacacacaggtttggtctcttgatgttgtcccataatttccataggctttactcattcttttgtctgtttgctcctccgactggataatttcaaatgttctgtttcactgctcgcaaattctttcttctgctagattgagtctactgtagaagttttctattaaatttttcagttcagtcattgttttccttatctccaggatttctacctggttcttttttattgttcctatttctttgtgaatcttcccactcttttgcatattattttccaaatctcactaactcttctttctgtatattcttgtagtttactgaacttctttatgaatattattctgaattctttgtcagtcatttcatagatctttatttggggaagcatccattattgcagctttttaagtttcttttggaggtggcatgattctctgattctttgtaatccttgtgcccttgtgttattgtctgtgcatttgaggaaacaggcccctcttctgacatttacagatgtcctttggccaggatagagcttccctacttagtctagcctgtgattattggaagggcctgctgatgatgaccccagacaggcagaacttgttgtgggttctctagatggctgggccactgcctttgctctgatgtcaaatggagctactggctgggttccaatgaccagtgagaccacccactggctctactatcaggcagagctgctggctgggtaccgtgatggcctctagccaggcctgtcacaagatgtatttcctggctcagcaattccagtatttgggatcttcagttggacagggctggaggttgggcttcaggcttagaaaggatcacttctctggacaggcagaacctggggttatgtttctttgagatatgcagttgaggattgtgtctttgtctatgtggagctgtggggtgggcttttgactgagttgagtagctgtttgacctcctggatcaagcatgactggcctctacatttcttaaaaatgcatggaagtaggaatttccctatctacatcaggttgttgagccaggtttttggctgtgttgagccactgcttatctttccaggtcaagccattctaggctctctgcttctctgaaatccatgaagttgggaatctccctacgtggatggggtcactggggtgggttatgaggctgagtgggaaaactagcagagtaggggctccagcaggattgtgcttcctaccatgcttctgcagacaagttgctcagctctatggggtacactgtgaggtgggctgataccttttatcaagtgctacatctggcagaaacacagaggtaccaccaagatccatgtgctggtcactttcattgtttctacctgacccctgagcaatcaagccatgctttccctagtgtttcccatgaggtgagaggacagtggacttcctgggaagtgcctcagaattctagggaggctagatgactgcctctggttctcctttccctttgtagaaattatgagcccagggaaattctctccatctggcattgtgctgactttagggagggggcaggagtggcatggtcacagtgaactcacccttctaatttgaatttgctcaattctgcctatgatgtggatgtctcaggcttttttccagattgaggttgaggttttcaaaaggaagagaaaatagaataaaatttactctaagaggatgaacgatctgatgctaactccttcctgtggttggtttactattgcagttgtcaatctagatgccttggtcagaaggatctttatgcaatttcaacatgtcctctgttctcagagctgagataaccagttttatatcttctatttcacaagaaaagtggaagaggtttgttgaagttttcaaaaggatattctcatctgtggatagttgctagttgaactttctgtggaggaggagtggagcccgatactttccattctgccatcatgctgatatcattcccaaggtgccgatttttttttttttaagacagagtcttgctctgtcacccaggctgtagtgcaatggtatgatcttggctcactgcaacctttgccgccctggttcaagtgattctcctgcctcagcctcctgagtagctgggatttacagacacctgccagcacgcctggctaatttttttttttttttttttttgtagagacagggtttcaccatgttggccaagctggtcttgaactcctgaccccaagtgatccgcctatgtcagcctcccaaagtgctgggattacaggcatgagcccagcgccaaagtgctgctcccagtgccaaagtgctgaatatttttactggcatcaccttctgagggtaaaggttctctggtcatatctgtgcagcaattatctgctttagcgggatgaagaagaaattttgatacacatatatctctgcattttaatttcagagcttatatcctattcaattcctacttcaaaatgtattttattcaagcaaatgctgccaaaatgtgttacattaatttatctttctggatggaggtgtttctaacagagcaattatatatttgcctagactaaacattcatttcatttccatcacgagcctcttccactttgcttgtgaaatagaagatgtaaaattggttatctcagttccgagaacagaggatgtgtttaaattacaaaaagatccttctgaccatggcatctagactgacaactgcaatagtaaaccaaccaggggaaggagttagcatcagatgattcatggtctcagagaaatcttttattctgtttcctctttctattataaactttctcatgaaaatgagtttactaaatcttaatgttaaatgtgccctccttctaattatctggcattttcatgacaaaaaattaacaaaatgaaacataagtcaagtatatactcttgtttcttaaaataataaggacagaaaatagtataggttgattcagtttttgagaccttttgaattacaaacagaatcatgaatagaaaaattttacataaatggtaaaataaaattagttaggggaaaaatataaaatctccatttcatagttgtcatacagttggcgaattgtttcgtaagagtaacaaaattaaactcaggaaagtagttggcagtcaatatttctctgacccctgcaagttgtgactacaataaaataaaatttgactttttctgattactgcttaaagatattgaatacaaattgaatatcatctgtctttcttaagtgatgacacttctcaaatatttaagcccagagggcatttggatgatattttagtcaggaatttaactacgtactcaaatgtaaactaaaattgtgaagaagccaaactcatacatcttctacccactttctaagtctagggcaacctaagccagaattggaggacattttaaattgggtgaggttctggaatatttatattggaagaagttcaactttttattacctgttggtaatcagaaaagctgtgggtccttcccaagctacaatgccatccacaaagtgggaagaaatgaatcctaccacagtactcagaggtagtaagtagactaaagaataaagttgcttttggcttgtttttaaccaagtctggctaattaaattaatccgctacacaggcaatttatttaacacagagtcaggcatatatttaatgatcaataaggtttagcgattgttatgaacacaatatagtatatatctcagtagctctctaggtggtttttgtttgattgattggtttggtttttgttttattttgttttctataaccagtgggttctggggaaggaggcacagttcatactcttattagtcaagacaatgctcaggtatgtggctgtaacaaatgatatcagtggcttaagccaatttcatttctcactcatacctgccaagcgtgggctggtaggaagtgtaaaggctcccctgagtttctcagagactcaggttgacagaggctccaccaccttgtgacattgccagctgacaatggcttctagggtctctgaggaaggacaaataaggtgctggagatctcacagtcttaggtgcctcaagccagagaagacacctgcaacttctcatcacagcccattggctggaagcattcacttggcttgggcatatccttttcatgttcccaggaaagagagaagaatcaggtggaagcaaactctagaagattcaaatgcagtgtaatctcccaatgaaaagattcccccaatttttcaagtgttatatcttatgagattggaatcccttcaatagcaaatatttcttttgtttcttccaagagaactatttaacttatatactgtttaggaaaggaagtgatctccttctactaattgacatggcttaattctgtggatctgggataaagctcaggcatttaaatgtctcatcgggaaggtgtttgctggatactccatttaaagggtgtcttccccataagccccttactgttgatctctttcttagcaaccgatttgcttctttcatagcaacatcacaaagtgtgactattttacttcattcgaattttaagttttgactgttttcctcatgatactgaagtttccaagaggctagcaatgatgtctgccttggttactcttttcctcttagctctttagactatgcctatcatgtagaaggaatcaatatgttatttgcccaatggatgaacaaataaatgactttttttaaacaagctttccaggtaattctgatgcaatttgtccattggccacactttgataaataaatactacagtatatttgcttgtccctttttgaaaccaataatcctgaagttaattcaattttatttgatttgattcaatccacatttacagcagcaccagagggcaggcctactactctgtcaacctcctcaaaagagaggatctagcctctctcccccaccccaacacactcactcatgcaatagtcagggctcaagcacatatactccaactcatgcaccagcatgagagctgtgaatacttgtgatttgtggctacttggcatcattctcctttcctaacagtgacatggagttttggggataggaaggctgcgctctccacacctgtacgacctactttgatgggaccatgaaggcaccatttctgtaacctcagtgcagcctcttcatccaaatgtggccacttggactcccttccctaggcctctacatcttgagctgagtaatgcgaggacagaaagaaccagccaagaccctccgttccagcactggtgtccagttgagatggcagaggagttcttcctgccttgtcaccaagacttccctgcttcacaccttggccctgtgctttttactaaacccagacttccatctttcatccattgtgcctctctctttctctctggcaggggtttctagctagccactcagtatccttctgcctcagtcaccaccctgatttaattgggagtaacaatatgctccccgaaagtgacatttccctacttcgcctgccacatgccacagttctaactgatgggacataagccagagttattgagtatattttctagtcaagtttctagacctgcctctcttgagtatttgctactcagcctaattaaggaagggaccctgggcaaggatagatgctatttctccctcccagccatggccgcataggcatgttccaacatgagaaatggaattgaaaatattaatttatgcaacagataatctgattcatcacattacaaagttgtctcattttacccaaaatactactcatttggtttctttaaatatcatgtatccctccctaactcagttacatttaaaataaaatttcaaatactttttatttcagtgctccatagtgattaagaactcagctgtggacacaggccgggctggatttgaattttgtatctgctattttccccaggcaaataatacagccatgctgagcttcaggctccttattgagaaaatgggaagaaaaattccatcactttaggaggccctagtaaggatgaaatgagataatgctcataaaatgggaaataatgctaaccatcattataatcagtattattgatcacaaaatgcaaactatacattgattcagcctgatgcatgcactgagagattccatccaacgggcaccaacaaggacagcattaatggtgattttcaagttcctatatgtattttcagaatcagacttgagaaataaagacattttaccgctactgctttcaaagctttaattctgactgctctaaaattctgcaaacatctttgtccatagaacttcctattaacagtattgtagtcctggggaaaggtaggtttattatttttcacactgaaatacaaatacaataaaatgtaccaactctaagtacatcagttcaatgagttttgacaattacataaatctgtgtaaccacaatccaaaaaagatataggacatttctatcatcctagagaattctatcgtacctctttccagttaattttctcccaaaggtaacaaatttctgatttgtacttttattgattagttttgactgttcttgaacttcatataatatgcactcttttattgtctggattctttcctgcaacacgtttgagattaacccatgttgtggatgtatgtgtcagcagttcatttgtgttgttgttgttgttgctgagttgtgtccaattgtcggggatatgaaacaatttgtttattgattctcctattaatggacatttgatttatttcccgactttgactattatgaatgtatttgtacaagtctcactgtgttcaaatgtattcatttctcttgagtaaatacccaagaggaaagttttgagtaataacatagatacatattgaaccattttaagaaacatccaagtcgttatacaaagcacacataccattttatatttccaccaggaatgtgtgtgacagttgcttccttggtcttgacagccttagctttttcccaagacattctagtgggccaagctgttcttatctttttttttttttctctttcttttgtattaatcaaatatttttattattttactttatcttttatattgacttactagctatacctttttgtatgttttttcaatgtgcatctctaacttattacagtctatcttcaaatgataatatacgaattcacaatgtaagactttataaggatatcatttcacttattccttcttgtattatgtgtccctcttgtcatacactttatttccacatgctttcactgccacaatacattgttattattttgctttaaacagttgatggtctttttttaaaaataaatatgtatgtctgggtatatatcttaaaaattttttaaagttttaaaaataaatatcagatgtttatgctctctgaagctctcttcatttctgtgtgctgacaggagcttctatgtgtatcatttcctatcaagctgaagaaattcttgtagtttaggtttgttggagacctctcagtctttatttgtttgaaaatgtctttatttcataatcatttttgacaaatagttttgctggataagaattcttatccttatatatggacaatttttctttgttgttttgttttcctttgcttcttaaaaccagagctttaaagatcttattctttgttctgacctctactgtttctaatgaaaaagcagaaacaacacagctcccatttgtattgctgttcccctgcatgtaatgctccttctgtttttttctagctgcttttaactttctttttatcttactttttagaagtttgatcataatgtgcctagatgtagtttgctttgtatttatttatctttcttgagttggtaagctttttttttattattatactttaagttttagggtacatgtacacgatgtgcaggtttttaaattaattggttcataccttccatcaattttggaaaattatcaattgtctatttatctatcatccgtctgtctgtctgtctgtctgtctgtctgtctgtctatctatctatctatctgcaaaattttctggcctattctctctctctctttctgatcctgccatgagatctctgttggactatttaatattattccacagacacgggatgctccctttcaggtgttttatttttcctttccttttctctttgtgtttcattttagaccatttctatggacctatcttgagtttcactaatcctccgatgtgctcactactgtcaaacctattgactgaatttgtcatttctgataagagtatgttttttccttgagaccatcctggctaatacggtgaaaccccgtctctactaaaagtacaaaaaattagccaggcatagtggcgggcgcctgtagtcccagctactcgggaggccgaggcaggagaatggcatgaacccgggaggcggagcttgcaatgagccgagatcctgccactgcactacagcctgggcgacagagctagactccgtctcaaaaaaaaaaaaaaaaaaaaaaaaagagtatgttttttcctttctagtatttccatttttaaaatagttttcatctctctgtttatatttagaggaaaaggtaaacacctgagtgaactgatggaggtttacatatttgtcattgttattttattttattaattaattatttttttctgagatggagtctcactctgtcacccaggctggagtgcagtggcgcaatctccgctaattgcagcatccgcctcccaggctcaagcgattcttatgccttagccccgccaagtagcggggaccacaggtgtgcaccaccacgcctggctaatttttgtatttttagtagagatggggtttcaccacgttagtcaggctggtctcggactcctggcctgaagtgatctgcctgcctcagcctcccaaagtgctgggattacaggcatgagccactgtgcctggccagttattttaaagtctttccctgagaatcccaacatctaggtcatctctgtgtttactctgtttctccgctgaccacgtgtcatattttcttttgtgtgtgtgtgtttctcataactttttattgtgtgctgaacgtttttgtagaagaacaatagagaatgaagtaaagaatattcacccacagagaagagcttctatctctgtcaggccccttgttggatgctaagtcagactaatccacagttgagctgggtccgggctaggcggcaactttaatttgattcagttcacaactggtttcaaatgtttggagggcacaatcaggactttctcttcctccaggacggaggttctaatgctggggagattctagggatcccctttatggtttcccatgaagctgccagatgttggagctttcagagattcctttgctgcttttgacgttgctgagcattcgacgtctttgcttttcagcgccacctctggctttctgcacctcagatttctctctgcccttctgccgagcttccactgttgcaggactattgtacttactaatgtacagggtgggtgggtaggttcttattttattgtgactcaaaaattttattttgcttgctttattatgatgttcttaatatgtgataaataagagaaagtgatacaagaagacagcagtgtctagaataaggaagacaagagtaaatctgaaaaatgagtccctagattcatttccacccatctccagcaccttgttgctccagaccctccctggggctcatagtttcaacctttctctctttttacattgcttcctctctgcctagaaatatattactctcttgttccaaataaatctctctctttgtgtgtgtgtgtgtgtgtgtgtgtatgtgtgtgtgtgtgtgtgtgtgtgtgtgtgagtgacagagtcttaactctgttgcccaggctagagggcagtggtgccatctcagctcactgcagcttccgcctcccaggttcaagtgattcacctgcctcagcctcctgagtagctgggattataggcacgcaccaccacacctggctaatttttgtatttttagtagagacggggtttcaccgtgttggccaggctggtctcaaactcctgacctcaggtgatccacctgccttggcctccctaagtgctgggattacaggcgtgacctaccacgtctggccccaaataaatctcttgaactatatctgctgtagttaccgtccaatctgtctctttcacctccccaaagaggagtctttacttcttcagcctctgcctgctcctcagcacacgacagtctgacttctgcccccaccagatcaggtctccataacaggtggctcttgagactaccccacaagacgaggtcttgtttctgcctgagacttctgaagaccaacttcagggggcagccacccttttgccctgccaagcccaagcacaggagatagacagcaataataccaagggtatcttgggctacatgtttcctcataaaagggccagatagcctgtaatgggaggaagccccactgctccagcagctcagatgcttgtgaggagggctggacctgttgataacttggagggggagctctggtctgtgctttgcttacacctaggtggccttccctctctgtctctccctgaaaagaacatgggcctattccaggaggctggcatggtccctgcgggatcagctggagggaggatgagacccactctcctgcttggggcttacgtccacctcactacagctgctggtgcttgtactttccacttgctgtgtacaaaggctggatgcaaatatgaaatgttaagagtaaacatataaagttggccagtcacagtggcttatgcctgtagtcccagcacttcgggaggccaaggcaggagaactgcttgaggccaggagtttgagaccagcctgggtaatagagtgagaccctgtctatattttaaaatagataatataaaaattatatagggagagatagatcatataaaattagatacacatgtatactttttttaagttaggcaaaaaagttagaaagataaaatggtgagtaaaattgtataatgaaattaatcaggccgggcgcagtggctcacacctgtaatcccagcactttcggaggccaaggcgggcagatcacttgaggtcaagagttcaagaacagcctggccaacatggtgaaaccccatctcaactaaaaatacaaaaaaaaaagattagccaggcttggtggtgagtgcctgtaatcccagctgctcagggggctgaggcaggagaattgattgaacctgggagatggaagttgtggtgagtcaagatcgtgctgctgcactccagcctagatgacaaagcaagacttcctctcaaaaaaaaaaaagagagaaaaaagaatttaatcatgtgacaaaataaaagttaaggctaagatgaccaaatggtggaaaaattgaaactactttttatgttgaacactatgagatgggctcaatacaagttcattgactgttcattcacaagcctggccccacgagagctctcatttccttcactgactctgacttgatctaattcaggattcatgtcctacaaacttctaggctggtgcgaaaggcgatcttggttattttgaagactcaacccactctgcctccaggtcctgacaaggctctgggactgtcttcaatgccacggacggggataaggggagtaaggtgggaggggtagtcattataattttctttttacagtggcccccttcagttgtagggctctctactgaccctgggccactgtgggataagggtctctttgttgaagctgggagccctgtccttggatcctgtctatctggacaccttcagaccattcccctcagctcccactgcccctgtgggccctgcttttacaggacccagaggtttctttctttctttctttttcatagacaaggccttgctctgtcacctagactagagtgcagtgatgtgatcacagctcactgcagcctcaaaacctcctggggttaaatgatcctcccccctcagcctcccaagtagctaagactaaaggcacaccccaccatgcctggctaatttttaaattatctgtagagacagggtctcactatgttgcctagactggtctcaaattcctggggtcaagtgatcctcctaccttggcctcccaaagcggtgtgattacaggtgtgagctgctgcacctgactgaaaggcctcttaatatcaatccctttctgcctttatccttcaagacttccttccacctggtgtcgccttcagagttgccccacctaaccccttcagtggtcttggacctctagaaacaacacccaggacagaaaatgttttgttggcagcttttttctctctggccatagatgggtcaagaaacacagagtttatcatctgcttaaaagggttggggtcaggggtgggaggaaagaacgggtaaataagggagaaggaatctatattaatcttttcaaatattctccagctgtgtgcattatggtccatataatagcagatggtcattaaagctaataacacgggaagatgttcacgatttataaactgtaaagagcaggtcaaatgagtatatggaccatgagggcatttctgatatctataaatatatgcagacagaaatgatagggaggaaaaccactcattttctataagtaataggagaacagattcatcttcctttttgatgtatctgtgtgtgtgtttttttttaacttttccatagtgaacctgctttagttgtgtgagcaaacagaacaaatgagaacagctagacagatatattagggatcaaagagaaaatagccttacgatattcagtctctttcttctgtgccccccacacagtctttttaggaaaagatgcaggaggctgggcctggctggcagaatggctgtccccaacggacctatgtcctgtgggcccaccaaggctctgggcacttgcatagatgatttctgcctactttggaaaacatctctgcacccctgagactctgcagtgaggttttccctgtgcacaaggcccggtggggtgtgagtgggagtagactccgtctcccccagtggtgaggacttatgcgctgagtcagctgaattgtaaaaaataaatgtgtggcagccagcatttggcttcatgcatgtttaaaatcagcctgtggctagcctttgccacctgggcagtgagcttgcttggggcttgcagcaggaagcctgctacacagctactcctccacttcacctggtgatctcaaaaagctacgcagggaagcaccagctcctgcccagcaaacacccttttttctgctaaaaacaaaatgagcgctggaaatcataggcaaatctttcttatgctgtgccttggagcaggagctacgaatgagtggaatccatccaccttccagacgccttagctatctgcaatgcccccctcaggagacaaagcccacgcagtccctctctttggacgtccactcatttgcctgcagctccatcaaattcagctccccagattacatttcaaatgatggagcatttcagagtgctctctgcaaactgaaccaggctttgtaaatgtgagagaagattgtggttgacatccatcattcagggggtgcattaccaatttccaagattctctgtgtttcagttgaatgttgtgctgctgtgctgcaccctggcctctgaccacagacatcatggcccgtgggaagttctgatgggaaatatttcacccagaaatgtcggggcctctgcagcctttatcttggagaaaagtgcaaagagggcagcagctcacttgtagtttgtgtttatagtttaggacatctgtgatctctcagcattgattccttttactttaaatcctgtcctatgcctaatgagtcattttcaagcagaaatctgcacagtgtgtgatatggttgcccactgtataataaccatgggttagagtctaggaatcattgtagctttaaggtctttgttaagaatgcaaaaacggaaatgaaaattaactccatagtagggcagctggtctcagcaaattcagttgttaaaaagaaagaagtggattcataatggattcctcagtcagccgggaatttaacaattacttctggaatgtttaagattgagaatttctgcagattttcaaaggaagttctgatagttatatcatgggctccactttatacatcactctgagttcaccctgggtaagtaagcatggtgtctacagttctgtgtatgagatggtccagatacgatcttctgccccaccagtttttgacaggactccctggagcagctagaatctgtgagaataaactgagcatcaccagactacatttttactgcagtcacactaggtctggctatataggtaaagaaagcattcaggtgtcttcatgtgttcagaacaagggcccccatcttgggcaaattccaggctctcacattcttcatacgtcccaccatacatttagcatcttttcttggaacttgatttgttaagttccaaatttcaggtgctcaacctgtgcccattgaaaatcacgtggtaaatttaaaacagcttattttctaacatagctttgggcctgccagagcccattatgattctgcttgtggctacaccaactcatattacagatcaagtcattttcaccaaagcactccttgtacaatcagagggaatggtggcacacagctgcctgggaagggcttagccatcatcttaatattatgggctgttggtagcagatcactctactgagccacagataagatcattttagtgacatttgtggtaaacatcctctcgtgggtgacaagcctcaaatcaaacctatcacttagtctgatgaaggcaggacaaagcagtggggaagagaacacattaaaacaggcattcagtgatgagcttgtaaaggtcaagaaacctaggacaatgagaagggagtgctggcaatgatgggctggctggggacacttgctgttttgcaaactgattactcagaggcattagtgatgcagaatgcctaccaagcaacttctgaaatagcaaaagccccttcctggtcatataccactaaggggatttttttttcgcctattagaggcaattgaattaatgtttccatttggggtaggacaaaggagagagaatgagaaacaatcagatagaacctatttgacttttttcataaaattgtttctattttgcagtttatgaccaaaggaaaaaatatatatgtccttaatgtgtctagcaagaaaataaatccagtacagaaattttttaaactttctgaaatcagtttccagagggtgattttaacaaagcaacaacaataataataataatagtccacttagtaccttgaggacctaaatgagctaatacatgcagaatgctttattaaactctaaaacaccattagaatgtgaaggcatcttactaagccagaggcatgccttcttcttcaacgtgcttcggtgtatactaagaaacaagcaaaaggtttttatgtttttcaagaaagtacactggcgtttctgcacaggcagtttatatttgtgtgtttgtttcctgaacacagaacttcactctgacatgactctagtggttaattccaagtcactcccacacgggtagaaaatcacagagcactggcctccgtctttgggtttcatgagcaggtgactgtgtccgcgtatagcagcggttttcaaccaggaacaaatttgtccacggggacacagcaagatctggagacatctttcatggccacagcttgggggtgggggtgctactggcatggagtgggcagaggctaggggtgctgctaaacaacctactttgcaaagggcacccccacaacatggagttatccagtccaaagtgtcaatagtgccaagatgaagaaaccctatcttaaaacatgaagttttttattccagtcaccggcctcacaaagaagcagagcacaggaggatcaaacctcacctgagagcagcctggttcactgtgctgtgacagagtaagagccaagaacaatgttgtggggaaaaacaaacacgaagatcaataagagcccttcagctgacaggtgtgacaagccaagccagccagcagggagtgagaaggcaccaacattacttaagagagatgccagcttcagaggaatagatgtgcacagggagcttattgtggccaagaaggccctctgagccggagggcacagcattccctgagctgggggaacaatcattggcatgtggcacaaagtggaagggggtgagatgtcaaaaagccaaaatgggggcagagagtggatattcccttttaatagagtatctgatgcattcgcaggaagaagaggagactatttcaaaagaaagaagttacagtcagcgtagcaagttctgcattttagggctaaaaatatttcttctaggagaagctgcaaagttcatcaaagggggaagttgtaggcatgaagtactgtagagatacctcagcagctgtggaatctcagctgaatcttgaaataatagtaagttttacaaaggagaatgttgaatgtgatcttcagtcactcatttgataaataacgtttatccatctcctgagcctcaatatcctcatttataaggtggagagtgttggacgatttgattcagaaaacctgttgtgagcatcgaccttatacaaaggaggttatgaaggatgcataaacaagttagaccctctctctgcacttaccgggcttaaatctacatgatcttaaagatcccagctcctaaaagtccctggggaagtaaaactcccttatgattctatggtaaaacactctaggcaatttggaattcattagttcagatgtttagtccttaagaaattggaaatctagaacttgcaaaaaggggaagaaatggcaatccaaatccaatagtaatagagagtgaaataacgaatgtcgaccaacagaaagcaaagaataggctgttattgttgcaagagtgatgtgcaaagtgatgtgcagacagatcccattgttaagagctcagacattcaaggtactgcacccagcagccctcagtgaaatgttcccttatgtagcaaaaggtctgtgcaatcaccacacagaatcggatggttggtctgaaactgtaatcacctgtcaagatggaaaggacttatttattcttttaactttggcttttgccctctgagctgtaaggtctgtgtactcttccaactattcctagagcctgaaagccaatgtcagtgaaaaagataatgggaatttagcatcagaaatgagtgaacgacgttgggagctcctgtttttgttaaaacaaggtgaatcacaggtggtccaggagacctgcagtcaatccccttgataggcctcttagcactcatcacaagattggtgagttttcccttctatgagagacaaattgaaatagtaaattgtgaccattgtctagatcttaagtaagtctcgccaggacctgtgaatacctttctctgaagtataaatttctcattattctaccaaagacttgtgacgtttctatgagaaatctttgcccctaaattgagccagttgtttgccaggaaaaatagagcaggacttttcttttaagtgccttcaatgaagtaatgaagttgtctttacgtcatgctggccaggagcaccataaccctttgtccattctctaaaaaggtgaatcagcccaattcttctgggccatgtaaaaaaattgacctgactagcaaagggctggaacctttgcaactgtctctagaagttcaattatatagtgtttatttaaaaaacaaagagcagcagaataatcctttgccagttctctaggtttcctagtgccatggaacttccttctccttgcatgtttaaaaagaaaagaaaaaaagtaaactcacctccgggaaggaagtcagctctgattttatcaagtgcctgatacaagagataaaaattcaaagcttctttaggctgggatttccaaaggcctgggtcagggccttaacacccttgaacctcctcccctttgctccatcatagtgtctgcacatagaagatgcagaatgcattgaggggtttttttgtttggtttggtttggtttggtttagtttggtttggtgtggtttggtgtggtttggttcggttttaataataggaaatgtctggggaaagggatgaaagcctgtagagaaaatagttgtctgttatccatactaggtacatagtgaaaagccatgagataacgtgttatatgtggaaaacttcaagtctctaggaagtgtctaaagaaggattgagtgatgtgtcatgatttctaatgacagttggtcagataatgatttatttcaattgtagattttaatatgtctctgtaagactcttctcccaaccggagtaacactagaaggcctttaaggttccttataactctgggattttatggttgttcaaggcctgataattaatgtgaagtttacagtgatgtttaatgaaagcgaatatgttttaaattccatctacaaattatataaatattaaaacaaataccaagatagaagacttaaagacagtcatatcaaaaattatattaaatgcaaatggctaagcattctagttaaaaagcagagatcatcaagtggatttaaaaaaataaattacatgttgatgacaagaaacatatttcaattacgtctaagtttgaaaatatgttacgcaaacactaagcattagaaagctggtgtggctatattaatatcatataaagtagactttaaaaaaacagtattggcagacataaagaagaacatttcttactgctaagagaatcaactcttcaagatcaaatgaaagctctcactgaagcaagatgactgagtgggaactcttcagtgaattccaaagcaaacagcatttttaagcacaatgcattagaacgaatatatattcaattgcttaatcttgaaagtgaatttgcactgtctgtaattcttatatgactagacgacatattgtcttggtaacaaggaattctttcaacaaaagagtataaataagcaaagaatgttttttagttcatttcactctgaatgtgacccctatgatagatataaaccaaaaataaaattttaagtcccacgaccaactgagtggaccccccccttttagccagaggacccaactaaacctggaaaactagttcagatcatgccaggaagaagagtggtcagacatacctcaattactctcttcccttgtggttaagacacacaactgaccagcattaacattaaaacacaggtcctaaaactgacagaacagactttttgtaacaataagataccaaattccaacctgactctagtatagcatcacatgatagtgggaccttgaaagaaaccaaagtattttactccaaaatatatttctttgacatattttgaaatggccctgccaagctgtttcttgtggaggaaatttacattctgtagagaatccccgttccttaccaggcccttttctaatcctgaggagattagctgagagcctagcactttttaaaggtctgaataggaaacacttgctatctattgcctctgggcgtggccacctttgagaattcatctacataataagaaccctgatctccacaactccttattttaacccagacacttctttctattgattccaggtctttagataataactcttttgaccaattgccaatcagaaaatctttgaatctgcctatgacctgtaacctccccccaacccccgctttgagttgtcccacctcatttgtattgattgatgtcttaggtttctctaaaatatataaaataaggctataacacaattgcctttggcacatgttctcaggacctcctgaggctgaggctgtgttacaggttgtgatccataaccttggcaaaataaacttctaaattgattgagatctgtctcagacactttttggtttacatagagaagtaaataattgaaatgaatgaactattgctcatctcagaaggaagactttgatttagtctctgtgtgtggtagaggagatgggttctccctgcagtctagagatacttaaagaggcagaaaatatcagagagaaagaattccctctccctaatccaaacatggaagatgagaataagcagaatgcacttaggggattgctcaaatctgatattttccagcctaatttatatgattttatggaggattaatagacatttttctcaaaaaaagaaagttaatgaagttttctagaacaacaacaaaacccagagtagctaaggtagaaaagaatgcagcccaggaggagattctaatagacccacacaggcaggacaagtgagagctcaggacagagaatgcagaagcagaagagagagatggaaccttagagctaaggagaaagcagagaaagtgaaagtgtcagaaggtgaaagaggttctaagagagaaaaggctagtcatggtcaaagttaggcagggagcatgagaccacagtctgaccacatttacaagaaacttcaaagccttcaccagctcaggattgatgaggaaaataaaggagtggtatgacccagtggaaaaaaaacccagactgacacctaaacccaagtgtcaccaggtatattggcttcctgtgactattgtaacaaatgaccacaaactggtttaagacaacagaaatatattctgtcctagttctggaggccagaagtcccaaatcaatgtattggtaaccttggttccatttggaggtggaatccattccatacctctctcctaacgtctgaaggctgtcagcaatctttggcgttctttcctttacaaatgtacctccctaatctctgcctttatcttcatatggtcctcttctctgtccctctgtattgcaaatattcctctcccatctcttataaggatgccaggcattgggttcaaggcccacccgaaatctaagatgatctcattttgagatccttattttaattatatctgcaaagaccctttttcagaataagatcataattcgaaattccatgaatttggatggttgaggggatattattcaatccaccataccaattaactccaaggtgaaaggaattgatccaaactacattacactccaggggtctcaaatttgaaggtgcatgtgatcatctggggattcagcagctctgggaggtagctgacaatctgcacttctacaggttctcaggatgccagtgcttctggtctggaccataccgagtagcaaagatttagttgtctatgtggaaaggtatacaattagttggctttgcttaacataactcccagtagagctggtatggccacagggtgtttggaaaacaatttaaaatgcttatgggtgaaaagtaagaaataaagataaatctgagtgtgagccaaactgttttccctgggtgagaaacagcaggtggggagacagctgtgtgatctctgctgtgcccttcaatcttcctaaaaattactagactgacacacaccttttgctagtgagtcacatggaaagcttgaaagcacagagttttgagaccagattggtgtagagaggaacaaatgtctatgaggcaaaagtccctgagagtttgcagaaattgagagagaggaggtattagggctcatgtgatttgtgatattgaaggcttaaacctttaataagtaaaagaaatatctgagaaggaggaaagcatctgcggtatctaggtaatatctgctaagatcccacagaaatggccctctgtgtggcagaatataggcaattctgcctctagcttcatcacagtttagagtcttttatctgtaagtcagaaaagaggtagcatgaaaacatggactttaagtagtcatttgaaagaatggactttgtagtggacagtgtagcttgagtctcaatattacaaaatatttcaaaatcaatatcccatctcaattatcagaagggatattgcagtcacctagccaatttttagacttggttcaatccaagaaatcttacaaaattaattttccttcttaaaataaagcacttttcacagagaaggttgtggggtagggaaatgaggggttgattgtcgaaatgataacactaaaggcctcattttactctggcgatgttgaacttcaactgagcttgttatcctggaaaatggtgacaattaagaaagctactccccctgcccaattcccttatgctctggaactggcctactgcagggaaccatccttccccatatgacttaggcaaaaatcatggatgacccccttgttcacccatggcaaagccaggcagacaccctgcagattttcattctttggccccgtaaatgattagctgaactgtctgtgatcaatccagacaaaatctttgcaaaccaatctttggtgaagattctctccttgccccagatccctgaattttgacctcctcttagcctgagccagcacacatctccccactaatggactctcccaaggaatagactgacctctgggtaagacattctgtgatccactgaccaattatgtcagccttacatcccccttcccacacttggctctttccagatttgcttactcctccctaggaaaggaaagccctttactggctgaccttggagatgcttgtagatgtcgtggtcagagcattttctctattgcaatggtcccctgatcctcctgttatgccctttgctgtaatccttccaataaagtttctccttatacagatccggattttttttttttcacagcaagagaaataaagggaaacttgtgcatgggtcattgtttccctaatgattttgagttagttaagtcagtgcaatctttctccccctgggttcctgaaatgagcctttgatcctaatccaagagccccctgaggttagcggtggcaaagtcaagagagcatggagctggaaggcaggacacctggtctgtgttcccacatccaccaattacaagaaactgtgtggctgtgggcaagtcccaaggcatccgggacctcagcagtaataataccttaaagaaaatcttgagtcttttctttcagttctgacagctgtaacgttgggattgactggagttttctgaccagtaataccctgaactctaacagcagttttggtccgaatctttcacctagagtcatatcaataagttctgctgctgtttaactgttctctgtgtggtggtgtgtgcatgagtgtgtgtgtgtgtgtgtgtgtgtgtgtgtgtgtgtgtgtgtgtgtgtctttgcctatgtgtgtatgtgatggccttaggaggccggaagtgtctatggtgttctgaacggtgcatttgattttccttcttccagccaaagccttcagctaagttgatttgctttcttctggctcctttgcttatggtgatgaatagatatgggtgtgttacataaccatatccactattaatgtggatctatagtgaagttctctatgattttcccagtgtgcttagtgtgtgagaagcttctatttttcttatttacatcccaacattgtccacaaagtgtctacacatatttcagtgaaatgtcagagcaaaagcctcttttaagcaaaagagataaaatgaccaggccaactagtttttaaaatgtaggttttccagtttaatttaatgtaatttattttttagtacaggaaccttcagacaaacaaattcatctgttggggcctgtcaggatcacagaacagaagacagtatcacctctttgcctatgaggcacaagtctctgagagtttgcaggtatttggagagaggaggggcccattgcatcaggggcccattacaatagagaaaattgggacagggttgaagggtgggaatagtcctcatcttgcctctcacaccctccatggctcccaaggggccaccatagtgtgaccattgctgctctaggccagtcactcattttggcagggaagctgaaactcagacaaagtttctcatccatggccatgcagccggtgaggacagggctggggttctcggccttggacaacctccctccctccaaggaactcccaccttcgctcagctcacctttgtcacatggtccccccaccccccgccccactggaaattagtaaaatagtagttatttccagggatgttttccttatgtgggctcccaacctcattcccttttggactgaattattctggaaggaaagaatgaagggagggagggagggagggagagaggcaagaaagccaatcagtcagccaaaaattcagctatctgtggctcccgaacatttttaagttaagaaatatgacagtggtgcttgctatctgctgattgacattatacattatttattttagggcagagcagtcagttttaaagctggagttttgttttagagaaaataaatcctgtttcaaaattatcatgacctgtccaaaaaataccagagcctagatatgtaagaatctgaatacaaatttgagctctaaatgacatcattagtagtgtaaccctgcaggccaccattaattggtggcaagacatacatcactgacaggagattatgaagtgaagaaaaggcaaatattttgcagcccagtggattaaagaaatctatcaggctgacgtaatgctgtgctcaagagagatcagaagccctaactatttaagcttctcgtatttggctcaaatgtgctggttttacaaaatggtcacacaaaattcactattgcttccaaaacccgattctccatcagcttcttggtgcttcctgcttcccatgtagttagtttgggaccttggaaccagtgtcagccaatgggctctcacaggaaatggcaggtgttacttccgatctgaggcattgaagagcatgagtctccgtgccctctcttcctgaggtgctctggaagttctgcgtaagtgaagaccacagagataaagtgccattagggttcaatctatcaacatgacttctcactgtagatgttgatgtggtttgcctggctgagaaatgtttatcaggttcctcaacagttgagttacttaggttactgtttttctccctccctttccatgttctgtgctttgaaaggaaatcactagattccgtccacaattaaggactgagcagttttatttctcaaaggtggagcaaccacataaattacttggagttcttcttcatgggaaatttctctcttctccctcaattatttattaattcgatcatttatttgtgtcagtatagacttgtgaatatttatgtaatactttgggctataatctaatactgtcttatttatgtagctagttttgctaaaattcttagctttagccattgagagctctttcagttggcttctgtgtccctttgacataccccttaattgtggggtgttttgtttgtttttgagcttttccctacattttggcatgataagagatgttccaggctcatctcgtctatttactgcctcagtcctaccatcagcatttctccatggagccctggttcctttaattgaagaatagttttagaatccaagatctggccaggcgcggtggctcatgcctgtaaatctcagcactttgggaggtcgaggccggcagatcacaaggtcaggagatcgagaccatcctggctaacacggtgaaaccccgtttctactaaaaatacaaaaaattagccgggcgtgatggcgggcgcctgtagtcccagctactccggaggctgaggcaggagaatggcgtgaacccgggaggtggagcttgcagtgagccgagatcgcgccactgcactccagcctgggcgacagagcgagatttcgtttcaaaaaaaaaaaaaagaatccaagatctggagttaggtatgtgatatggggtttggctctgtatccccacccaaatctcaccttcaattgtgataatccccacgtgtcatgggagggacctggtgggaggtaactgaatcatggggccagtttttcccgtgctgtcttgtgatagtgaataagtctcacaagatctgatggtttgataaaggggaggtctcctgcacaagctctctcttgctttctgccctgtaagatgtaacttgctcctattcaccttccaccatgattgtgaggcctccccagccatgtggaactgggagtcaattaaacctctttcctttataaattacccagtcttggtgtgtttttattagcaacgtgagaacggactaatacaacatgcttgttgctactgaggtatcattgcttctagactctgtcagctaacagagcagggaaacatctacatgtatgtaacccatgagtatatacatatagtatctataatatttctatgtaatgcttctttagttttaattgtttggttttaaaaaataacttgctgaaatggatgtttaaattcttgattttaaaactttatctttttaatgtctgtattaagggttatgaaatctctaagcataccattagctgtatcctacacattttatatgcatgtttaattactataccatacaaaatactttataatttttattgtgatttcttctgtgacccatgggctatttagaattacatttttcaattttctaatgtatgcagcttttatagttatgtattttataattaatttatagttttatagcttaattgtattaaattgtattatactcagagaacatactcaatgattgcaatcatttgaaattgttagatatttgctttatgatacaacttattgtcaattttggtaaacattttgtgtgtgcttgaaaacaaatatgcattctgtggttcttcaatgcagtgttctatgtgtgcatattaatcttgttttccaaagatgttattgaaatattctaaattcttactgaatttttatctgcttgttctatttgttatcaacagttatattaatttctctcttgtaagggtgggcttgtctttttctctgtggctctgtcaagttttgcattatattttgtgagactgtgctattaggtatatgcaaattgtgaatagttatagcttcctgatgaattgaagcataatattacaaaatgtcttttttgtcatttgtaatgctttttggtcttaaagtttgccttatctgatatgaatatagttttctttttatagtgtttgaattgcatatcttttattttcattcttttcgtcaacttatattttatttgttcacacatttttatatttcatttgcttacccattactgagcttttctcctttcctattctgacagtatttttcttttaatcgggtcatttacccatttatataaaatatatttaggtttaaccctaccatcttattcaatgctatttgtcctgtctgttttatgttctcttttctctcctttctcactttcttttagattaattgggaatttttattattccatcttccccctttttagcttccatattacacacctttaaacaattcttttaatgtatatcctagaattacagaccgtgggacaaattcagcccatcacctgttcttgtatggcctataagaatatctcatggcatctgaaaatttaattaaattcaaacgtcattgcttataagtaaagttttattagaacttttgttgtcttttacaactgcataatctgtatatatcaaagattttccagaacaggaaactaaagcacaatatagaaaataattgaatagaaattataaaaattctgataggcttgtacaaatcctaatttcagatatttctattaatcaaatgatcttttttgttccattgatcacccttataataaatgatgttatgcattatacattatacattaaatattgcatactaattatgttactttaatacataaacatgtgccaaaaaactccactttagtttttgagtttcaggagattaattttgaaaataggatttacatgctcaaaagtatgcaaatgaatagatgaatctaaccaactaacttgagctaaagaaaaaaaatgatgttgatttcatatgttagcactccaaataacccatgaacactgtattgtaagccttcctgggccttaacccaaaacaaacatggatacgaatttcaagataatttggggtgtattcagcaatccttaaagcagagtaacttgtgggtcagatacactttgcctttacattgtgttaagtcttcctgtgtttgttgccagcatgtttaaattgggatgttttatatggaacaaaatctacatttctgccttctcttagaacacgggcagaagtgagccagcatatctcacatagcaatactgggttgaagcttagtagatgttgtcctctgtattgggtcttagggctgccatagcaaagtaccacaaactgggtggtttaaataacagaaatgtatcatctcagctctggaggctagaagtcccagatcaacatgttggcagagctggttcctcccgctggctgtgagggagaatctggtctatgcctctctcctagcttctgatgctttcctggcaatccttggaattccttggcttgtagttgcatcccgtcaacctttgcattcatggttcacctggcattatccctgtgtgcatgcctgtgtccacatttcccccttttattttattttttatttatttttgagatggagtctcactctgttgtccaggctggagtgcatcggtgcagtctcggctcactgcaccctccacctcctgggttcaagtgattcttctgcctcaacctcctgagtaggtgggattgtaggcatgtgccaccatgcctggctaatttttgtattcttagtagagacagggtttccccatgttggccaggctggtctcggactcctgacttcaagtgatctgcctgctttggcctcccaaagtgcgggaattagaggcgtgaaccaccttgcctggcctacatttcccctttttataaggacaccagtcatattggctaaggagtccacccccctctaccatgacctcatcataagtaattacatttgcaacaaccctattttctttttttttatttttttattttttatttttattttttattattatactttaagttttagggtacatgtgcacaatgtgcaagtttgttacatatgtatacatgtgccatgttggtgtgctgcacccattaactcgtcatttagcattaggtatatctcctaatgctatccctcccccctccccccaccccacaacagtccccggtgtgtgatgttccccttcctgtgtccatatcttctcattgttcaattcccacctatgagtgagaacatgcggtgtttggttttttgtccttgcgatagtttgctgagaatgatggtttccagtttcatccatgtccctgcaaaggacatgaactcttcattttttatggctgcatagtattccatggtgtatatgtgccacattttcttaatccagtctatcgttgttggacatttgggttggttgcaagtctttgctattgtgaatagtgccgcaataaacatacgtgtgcatgtgtctttacagcagcatgatttataatcctttgggtatatacccagtaatgggatggctgggtcaaatggtatttctagttctagatccctgaggaatcgccacactgatttccacaatggttgaactagtttacagtcccaccaacagtgtaaaagtgttcctatttctccacatcctctctagcacctgttgtttcctgactttttaatgatcgccattctaactggtgtgagatggtatctcactgtggttttgatttgcatttctctgatggccagtgatgaggagcattttttcatgtgtttttttggctgcataaatgtcttcttttgagaagtgtctgttcatatcctttgcccactttttgatggggtgcaacaaccctattttcaaataaagccacattcttaggtattgggaatgagaacttcaacatataaatttgaattgacacaattcaatccttaacaccccttttagaagggacatgcattccctcattccccacaattgccatttgatagagtattcattcctggcccactaagatatttaagtttgtgatccttgtcctaaatcccataggcttaggaggctgtatacctgacaggtagacctaaatattaggaaatcataagatcataggatgtcagagaagggaagaacctctgagattaactgttgtcaccctcttgccctattgcagaggggcaaatctaaaaaatgctctcactggtcttttccaaaatcgttcccgtaatagtacctaagattcttattatttacctaagattaaaaaaatccattgcatcaaatttatttgaaaagggagataagtttgacaaaactgtcttttcagttccacaacacggcatacaaatccctttccttataacttttctcagaaactggcttgtggaatttggtttatcctgtagggccttagtattattttttgtttgtttgtttattagagtttttgcactggatgctctgttccttagaaaataaagaggctttccaagtaaatagggccattgtgtacaaattagagttcaggaaggatgcttctcaatggttcagctgtttcataggctacttaacatacagcatgggtaaacatgagttcccatgtacaaagggtttttctaaatttatagcttccaaacagccattaattttgctgccatatgggtcacaagaggcaggctgataaatctttcatccgcagtggattatgttttcccatatgtatgtttattttcagaatccatgtgtatttcagctagggtgcagctgatcttctacaaaaactctgcaagttcataagaaggaatcaataatatactgtacccgcctgctcttgataaactctgactccttaggtattcagaagagaatccagggagatcctgattctgcatatcatcccatattacaaatgactataaaagttggtgaataataatgcttgacctttaagaagccagcagttttcaaccaagtcagtcaatagtgacgaggccttaatccaaagccattatgaaactccaatattccccccaacctcagaagtttgtctttttattctagaactacattgggagtaaatgatttttcatcattatttaataatagcctaaatcactgccttaaggtatttgccaatttagatctgttacatggtaaatattaaatcacatagttttctgctcaacatattcatcactgactataatttgcatggcataacttgaatgtaatttcaaataatttggtacaataaatataatgagaattagattatacctgcctaaaggacagcacgattcatataattgctaatgtactgattcttccatgtattttgacattcatattaggtggctctctttttttgttattaataatgaatttaaaatggcttgcagttcaaatttgatagttttccaagtgctttcatgttctttgtttcaagatttttcaaaatgaataggaactgtaggaaatagtttatgttatttccattgtctagaagaatctgaggatcaagccagttagtgacttgtctatgggatacaatctataaggacagagctgggctcaggcttaggttttgtgccaagtgcaatgttctttcttctttttttttttttttttttttttttttttgagagggagtctcgctctgtcgcccaggctggagtgcagtggcgcgatctcgactcactgcaagctccgcctcccgggttcacgccattctcctgcctcagcctcccgtgtagctgggactacaggcgcgcgccaccacgcccggctaatttttgtatttttagtagagacggggtttcaccgtgttagccaggatggtctcgatctcctgacatgttctttcttctatactttgttgcttctgaaaatattgtgcttgggtatttgttttttaccctgtagttttaacaagccccactcgaaagcactctaaaaccctggcatgcactgtgtttgcagtccctgttgtactgtttcaaagtaacccattctattgtgtgctgagatttactctatgataactctaactcatacaaactagtagctgggatattacctccaagggccactggtcgccaaagacttatgtactctgtccttgatcaagctgagagtttgatattgagttccagtgagaaagaagctaccctttctttatctgtagctcaggacacttccaaattgtcttgctcatctctgtacctttcctctgcagcttcttcaaaaggataaattaaattcctgcaagaacatctttaaataaactatacttgtattggcacccttgcatttatgtagaaattaaaggaagacatatttttattacaaaaataacttcttaataatagctgggtatgaactaattgctttcaaggctttgcacatggtggcaggaattattacattaaatgtacactgtggcttttggcttgggcatacttggatgagggctcagccaccaggagatccccacagttctcatctttccagatagatgaacttgatgcctcctttgcattgagtatgagaatggtataggccctcccccaataaactggtaggatttgcatttagcaatatttaacaataaaaactatgtttactgagctttgctgtgccaagcactgggctaggtgctttctatgtaataatgcacggactctgatgcaaaactaccttaatttgaatccttccccatctactgactagatatttaaccatattgagttgcttaactttgttatgcctcagtttctgcatctgtaaaatgagaataaggagagtacctactttaggtgttacggaagtgaatgagttcttaatgtccagtactaagaacagtataggtatgcaatcagaacagaagaaagggtagttattgttgttataataatgataaggaggaggatgctgaactctaaccaactgagagttaaaaagtatattttcttttattgactttattctttaaccccaacttcaggaaactgaaggcttggacaatatttccatgactcattcaaagtcagatgtcaaacagctagtaaatggctgagcttggagaggaacaggtttctttgtctatgactaacacgttaattgattaaatcatccaatccactggccaaactagtcaaacagccagcaggtttatgatatagaggtgaggggaatgagcttgatggtgttataggatggacagtggctttggaatcagaaaatcttgtcctgaatcagccttcactaactcaagtcagttgacttctccaagtttctattatttcatctataaaatgattcccaatctaacccattcaagatgggtgttcagagaagcaaagaaatatcatatttgagagaattttgtaaatcaaactgccataaattgtgccatttattaatgtttgatattttacaaaatgatttttacttgttttacacagttgttaattaaaatgaccaaatcacttggttattgcttgtaatatatgtggaatccaacagtttttttaacctacaagtacatgaatcagccttgaaaacaagcacgatgattaatattgagtgtcaacttgattggattgaaggatgcaaagtatttgttcctgggtgtgtctgtgagggtgctgacaaaggagattaacatttgagtcagtggactgggagaggcagacccacccccaagctgagtgggcaccatctaatcagctgccagcgtggctaaaataaagtaggcagaagaaagtggaaggagagagatttgccgtgtcttctgcccttcatctttcctccatgttggatactcttaagttcttcagcttttggattcttggacttacaccagtgatttgctaggggctctcgggctttcagccagactgaaggctgcaccatcagcttccctatgttagaggttttgagactcagtctggattccttgctcctcagcttgcagatgccctattgtgggatctcaccttgtgatcatgtgagtcaactctcctaataaactaccctttatatatatatgtgtgtgtgtgtgtgtgtgtatgtgtgtatatatatatatatatattctattacttcccttcatatatataaatatatataaaaatatatataaatatatataaatatgtataaatatatataaatatatataaatatatataaatatatataaatatatataagtatatataaatatatatataaatatatataaatatatataaatatataaatatatataaatatataaatatataaatatatataaatatatataccaatatataaatatataaatatatataaatatatataaatatataaatatataaaaatatatataaattatacatatataaatataaaaatatataaatatatatataaatatatataaatatatataaatatataaatatatatataaatatatataaatatataaaaatatataaatatatataaatatatataaatatatataaatatatataaatatataaatatatataaatatatataaatatataaatatatataaatatatataaatatataaatatatataaatatatataaatatataaatatatataaatatatataaatatataaatatatataaatataaatatataaatatatatataaatatatataaatatataaatatatatataaatatatataaatatataaatatatatataaatatatataaatatataaatatatatataaatatatataaatatataaatatatatataaatatatataaatatataaatatatatataaatatataaatatatatataaatatatataaatatataaatatatataaaaatatatataaatatataaatatgtatataaatatatataaatatatatatatataatatactactactctccttcagatagatagataaatagatagatagatagatatcctattagttctgttctgtccccttagagaaccctgaccaatacaacgttgggaaatgtcctaactcataaaaatggagaccctttctctctttctcccaggaaatgtacagtttacattcatgctttgattcatactttgattgattcattcatccattcattcattcattcacttttcttttttctatgtgccaggcattatgatgggtaatagaatgaataacgtacaatccttgcccttagtaggttaagcagcctcataaacacatcattataatccattgcgttaaacgtagtgctaggtaattgatctgggaaggaaattcatagaagacttcccggaagaagtgacatctaaattgagtcttgaagaaaaaaaataagttattagcagctaaatacatggatctcctttgtgaccctccaagggcagatggcaagacttggtggtgatggatggacttcactgtgaatttcaggtctgaaatgactgaagaaacttgatgacttggctgagaatgtccttcaataatctgctatatgcatagggcttctctattgggtgtctttgggcagatgtttgcaaacctggcttatttaatgtatgaagtttctacaatggaccgtgtttgccttaaaaaaggaaatgattctttactcttctcaaatggtcataaagaagcaactcatgtttatgtaatgcagctcagtgctgaggctgaagataagagtgaatttcgatggagctcttccaagcactaaaacaaaatgaaggaaataagatacgattagaccagaattcatggaagtgagtcaaatatacatctccacctacaaagaaatagtctcattatcgctttaaaagatttttatgtgggaacatcatgtgcgtattgtttcataattactctttaacatgcagtaaaaataattttgcatgcaccagtttgagtgtttattggcttccctaaaagcaaaggccttgaggtactaattgggacagaggcgggaggagaacagggtcagagaagagacccaaggaatgtcaaaatcagtcatttgctcctaagtggtaggaaacagagacatttttggttccaagttgcttgtttgggcctagttagaaaagttggttaaactctgggcatttgcaggttgagagctatttgtttatgtgaactagaaaaaagtatctttcaggaccaaaggtattgggatgggttcagtggagagggtggatgtactttgggctcagagcttaatattgatcctatagatcaggggtccccaacaccaggccaaggacccataccagtccgtggcctgctagggacctggccacacagcagaaggtcagcagtaggccagtgagcattactgcctgagctctgcctcctgtcaatcagcagcagcattagattctcctaagagcgggaaccctattgtgaactgcacatgctagggatctaagttgcacgcttcttatgataatctaatgcctgatgatcggaggtggaacagtttcatcccaaaagcattccccgtcatccatggaaaaattatcttccatgaaactgatcccaaagcgttttgggaccactgcagatgcctggggatacctgacatccgattgcataacaaacttcatcctctgaatattcataaccatgagtagtgtttgcattatagtaagtggtgtgtggacaaatactacaaccattataaataaactgtggtagtaattgtagtaataatacctgctttgaattaaggaggtgtgccatttgcctggtattttagatgtgccatctagtggtcagaaggagcattttcagattattaaagtcgctctagtactcagagacacttgcaatattctgagtactgattatttcacggtaagtatccactatgtttcttcctccagggaaataattcatcatttttggtaatgtaagtctgaagcttttttgaaatcctttcgtctgtgtaaagctagtttccatctcatcctcttctataaaataagatactctctatttgctaaagacaatttaaactgggtctcaggggaggagccagaacataccaacaggtgtgggcaaaaggacaggtgtgggcaaagggacagaaaaggtggcttggccagattgtgacacttgtcgttgtcacagctaaaatgtttgaggtttggcatttaggggacactggaatgtcagcagtaaagtgatgggtcagggctgagatgcaaaaaggtagcttggtgtcgagcaatgtgaggccagaggcaggacacctggatgatgggtgtgacggtggcccagccaagacacagacatggcctgaatcagacacagagttggtgatggggagggctgggggatgcagcaacatgacccgtgggaagtgggacatggctacaggcagtctgcaggccagtctggcaccactgcatcctgacacccggcacatggcaggtgtggagcagccaggagggagagcccctgagcccctgcctgatcagctcctccctccctcctttcctccctacctccctcccttccttcctccctcccttcctttcttcctcccttccttccttcctttctttctttcattccttccttctttctttcttttttttttggagtctcaccctgttgcccaggctggagtgcagtggtgcaatctcagctcactgcaacctctacctcccaggtcgtgattctcctgtctcagcctcccgagaagctgggagtacaggtgcccaccaccatgcccagataattttttttgtatttttagtagagacagggtttcaccatgttggccatactggtctcgaactcctgacctcaaatgatccaccagcctcagcctcccaaagtgctgggattacaggtgtgagccaccatgcctggctagctctgttttcttaatgagaaaaggatctgcccaggaggagtggagtggcacaccgtcaggggcttggagacagaaaggaagggaataagaagaaaatcaaaagtatctcaaattgtactgaagcactgcttgggctaaaaaccaccagcgatgtgggcatctattcagcaaggttgtgccattctccctgtgccagagcagagggacaggataaagtttgtgcaaggccagagagggagaagacaatactgtcatgtccatcagccctgtccttggatcatcaactgttaactgcagtctagctccgtgaggcttggtagctttgtggttaagacccatcccacctctgctgcccgtggggccatccttaacctctctcagcctcagtttcctcacctgagaagcagggatcagaacataacctatcccccatgcaatgtagttgcaattcggtggggtagttcatacaaagtgcctggccacgagcctagcgcattgctggtgctaagttgatggtagctattactttctgcagaaatgagtatttctgtgcacacttcatatatggcctacaaagaactcactgcatcattccagaatttagctgttgccctgccacttgaatctttgagactaagaactaatggatgatggttctagttctgccacttctcccaccttttttgggtttttgactcacacacacacacaatgagaaggagaactctcccactctgaatatttaggcatgccacatttcgttttatttattcactattctcggtagccggatatttttgcactgaggccatctataaaatcaaaaaaatgaaatccaatcttggctaactttgtagttaattaacacatttctttaggctctttatgaaggaaaaaagaaacaaataacttttcacttctttctgcatgtgcctgtatggatgagtagaaggaattactgtaattaatgctggattttaaaataccagtatggggagatagctagcatcttccaaataaggagatgagtcagagcctcagagatgctatggtgtttagataaatgtgagttattaggtaaccaggaaaaatacattacagaaggcaacacatagggcaatgaagctgcaagccagcacgtaaattgcgagccacagtcctgagtgctctggtggatagcaggtttgtaactctatacaaaacctatgttttcctacctaagaaagggcagagggttttgtccagtaagatctctacccttcaggacttccaggtactgtttgatttccatttttctgactcaaggtggtcttcccgggggccatgctttgggaaaagcttgtatctctaaattcacttgatctcctcttgctgattcctgtagcatcctggagaagtaagagttgaagaacttcctagacttcacagagctctggtctgggggcctctctccatttgttttgttgttaaggccaattttaagaacaatcaaacagaaggttctggagaggggaaaaaacaaattgaaaaggtacaagctaaagaacttaatacaagagaaagtgaaggatgtgggggaaggactagaaataaatcctaggaaagctacaattcatcaggtttgaagtaagtgcattttctagtggctcatggatcactggctcatgaaagaagaaacaaagagagatgtaaaacctggagactgacccagcaaactcattagccatcaagctgcctatagccttgcctgcaggaggaatgggagcaggacgagggctctgagtcagacagggaatgaagctacaccttagtcgggaggctccgatccagtgatgaccaacccttattccattatcacctccctatggagtctcttaagacattgtttatctaaccacccctccttgtgataccacagatacaccatagagctctctatgtgctgtggccttttagagggccacaaactattgtaatctctaagattttcacccccaagaaacaatttttatcccctgggggagtgatgttgcccctaggtacttactgtatgcctggccctggtgtgtattatttcatgtaatccactattcccatttgacatataaaacttagaagggttgaataacttgttctaggacaaagaggatttcaacccagggagtcaatgtcagctctgccctcttaacaactatgcttctgttcaagatcacaacccgccctgctcgtaaccaccatactgtcctgctccttatttggagaggttggacagtctcaactgggatgcagaaataacatccctgtaggcaggactcatgggatcatgacaggtgccaaaggggtcccctcatataagcaccttccactgaggtaaaagcaatgagtgtgaaaacagatttaaaatctagtgccttgttaaaaagtcctgttttagaccattacaagacagaaatctctgactccattttcctctctctagagttctgtattacaaactgcccagcatggaagcacatttctaatctaaatgatctctacagattttaccaaggtgaggagcccaatgtggatcctttcatcctaatgcagtcttctgtgaaccattcctgatagttacccatactctgcctgaacattttccatgtcattccgtctttcctcatggaaagacacctcccttcacctctttttattttaatcaggcagggtataacctacatgaagtaagttataccattctttttgtttgttttgtttgtttgtttgtttgtttgttttgagacagagtctcgctctgtagcccaggctggagtgcagtggtgcaatcttggctcactgcaacctctgcctgctgggttcaagcaattctcctgccttagcctcccaagtagctgggattacaggcacctcccaccatgcctggctaactttttgtatttttcgtagagacagggtttgttggccaggctggtttcaaattcctgacctcaagtgatccgcccgcctcagcctcccaaagtgctaggattacagatgtgagccatcgtgctttcttaagtgtacaactcaatgacttttagcatgtgcatgattccgtgaactgatgtttgtcatcatatacattcacttctcgtaggcctatacttaggaatgggatagctgagtaataagtaatgtttagctttagtgtcaaacgtcaaacaattttctacagtgatcagaccaaattacactcccgtcagcaatgtgtgcaaatgttccagttggtccacatccttgtcagcatctgatattgtctttgtaagcttaaccattctggtgggtgtgtagttctatctggttgagattttaatttatttttcctattaagtaatgctattgagcatgtttatatgctttttagccatctgatatcttctttcatgagatacttgtgaaagtctttggcccatttttaaatttggtgttttgtcctttttttatgattcctaggaacttttatatacactaaaaaatttcctattagctaggaaatattatttaaggccatacatggtggctcatgcctgtaatcccagaactttgggaggctgagataggaggatagcttgatgctgagaatttgagatcaacctgggaaacatagaaccaactttacaaaaaaattttttagagaaagaagtattatttaaaattgaaagctgctatcatgtcttgctccctctgccccaatttggaaatcagatcatgtttgtaaaggcaaaccatcatgttcaggggtggaatgtgcctcttgctgccagatactaaattatcttgttggactataaatgagaagtttgcccttttgtgggaaagtaagggcacatggtttatattagtatttcaacataatataagacacttactttacgtcatagccactacctcttcctgatgctctggtctagattctggcaggtagaaacgaaagcttaaggggaaaaattaccatttttatagttagcacttatgggccaagaagttattcaagttattcattttaatataactgatttttaagggcctatagtaataatggtcattgatcaccttctctgtgccagactcctggctaggcatattgtgaactttatcccatttaattttcacaaaagtcctacaaggtaaagatgaggaaacagacccacagagaagttagaaatgtgtccaaggtcataagctaataaaggaagagccaggattcaaacccatgttcaaagtccatgtctcccaaagaaaaaattacacttttacatcattgtgaaggttgtaagttttctgtagatgagaaagaagtttaaaaattatccccattctgtttttatcttgttctatgaacttccctttccaacaaagcagcttggagtttgtgtgccacagttggcacttaggactctcatgaatttccaagtcgattctgagggcaatggcgccgtgtgcaaatgtttgtttaaagacatgctgtgcggtggcaggacccagcctgctcaggcagcagggggaatcagcacggaggcagtgatcacaccaggtatcagctcctgagtgagcctgcctgtctgtccctcccttcaggggctgtgcataaaggcatttctctccagcaaacatgcacatcatcctgtcattttgagctagaatcttcctcccaacttgttatcattatcaaaaagcaagttctgtaccttcagactctttccctaagggaaatgagactcaaagaagggttactgatatcaaaatttggggctctcattaaactatggttccctctgtcttccgcagtagagaagaattcgttcagagcagtaatgcacagggtagaaatggaaggtctcaataatggtattcaaatgactgatggggaaatttcaaaatatttccaacgtttctcttaagattgaacctgatttttcactacaggggaatatacatgctgagtccaggttatgctcatgaaaagttacccagagcaatctgtgtcttgtccacagtgcacagatctctttaacctgatgggatgtgaaaatcatgacaattgaaatagcatcacaactttctcatgttgatgaatagatggcccagggtatacctttgacttagtctatttttagctctaataactatttcttgctgcatagcattccttatggtttcttctgggctacacagtaaaaataattctggacatggagtcagaaggcctgggtataagtcctcgtgtgactatcacccccatcttacctctgcaacatcacctcctgcaactctgtctccacacaccctgcaccagcccctgggtctcctccctccacactggcccccctacctagaacaggggtccccaacccccaggccatggaccagtaccagtccgtggcctgttaggaaccaggctgcaccaggaggtgagcaacaagagagcaagggaagcttcgtctacatttccagccactccctatcacttgcattaccacctgaactctgcctcctgtcagattagtggcagcattagattctcataggagtagcaccctaatgtgaactgcacatgcaagagatctaggttgcatgctccttttgagaatctaatgcctggtgatctgtcgctgtctcccatcacccccagatgggaccgtctagttgcaggaaaacaagctcagagctcccactgattctgcattatagtgagttgtataattacttcattatatattacaatgtaataataatagaaataaagtacacaataaatatagtgcacttgaatcatcccaaaaccatgccctctgtcaaccccggtccatggaaaagttgtcttccatgaaaccagtccctggtgccaaaaaggttggggaccactggtctagaatacccttccttcagatacctgatgttttgctccaacgtcaccttctcaatgagagctccctgaccaccctgattaaagtatttctctgcctctaccttccatattcggacctcgtatcacgttctacttattatcttcaaaatctctctgcaatttatttctctgtgttgtctatcgccctctctagaatgggatctataaaatctcttaccaaaagcaatatatatacttagttcttaatctataaattttaatattttgatacgataagttctcctctcatcaataagatgcactatctgttttgttcatatctcaagtacctagaagaatgcctggctcgtagaaggtattcagtacatagttgtttgggttgttgctgttttcattttattttgatcccttatcagcatggagtctttaaataaatccatttctctctcagagcctgagcttttaaaatttataaatgaggagaatagttagaccaacaaagttggatttttaggaaaattagataaaatagtgtgtacaaaaattatacataatattggtgagaagagtatttgttgtagtaaattatgggaatttataggttaagaattaagtgtatataatgcatttggttagagatcttctagaggtagatgtattgagagcattttgtactttatcttccactggtagaaataagatgtgtaaaggagcatatcacatccaccatgacattgggagacacagacatgataaggaggcagaggctggggggtgggcacaagatggtggaagccaaccatgaggatcagaaggttctactaaaactagacttctcagctaccactcctggttacccctgttatggcgatccgcttctaatgtcattatgagaaacacacacacacacacacacacacacacacacacacacacacaaaatgaggtacatagtaatcagggtccgagcatcccacacgtggtgtgagagctccatgttgagaaaaagatgaatgaaaattgggagggatttgaggagaggtccttggctgggatcacatgggaaagggtattttacagttaacagaagggccaccctaagactgtctagggcaaggttctttctcctgctgttgtattatgtgcagtgtagataacattcacaaaaccaccttgccccacctgtcctgttagttgccctcatgcatggaaggagctctcgccagaaaatagcgagctcagtctattggtggctttgtcagcaatgcgtaggctccagagtcaaggtcaggaatgcccggtgggaacaggcagatgagtaaataaaaaggctctgtaaactatgaaggggtgtccagatgtcaatttttatgttttccccagctgcttctattccttttactgtgatgcgttaggtccattaaataatggcatatcaaaacaagaatgacccgtagagattgtctgatcattcatctgttcaacacacaatttctgcgcatccattctgtgtcagacttaggactcagcactggttagacaagaaataagtgtcattgccctcaaggaattcagttttctaggagataacgagcaaaaaaatggaagacagtggggcatctactatgacagagccatacatgagatgctgtagagcagagaaaagggatgtttaagtcagatgggtagggggtttctggatggaaagtcagtgggaatgggactgttttgaagaccgagtaagagttgcccgggcagagaaagaaaagaagacatttcaggcagaaggatggaggagtgaggaaggtataaaaaatcttggtttgttaaaggaactgccagtaatttggactagctggaatgaggtaaacatgacaaagtgtccaaataataaatcaagacaggttggcaaaatacagtcgattaaagatcttgtgtcttaagcaaatgactcggagcttgatcatggaaacaaaggtgagccaaggaagtattttaaggtgaaaaatatgagactgtgttggtttatacaaaggttattcagcctgagacatagattcgggagtcaacttgggtaggaaggagcaatttaggcaattaactggagaaggtctggacaaagacggtagttataacaatgggtttggagatgagcagacaaaatcatgagctatttaccaaataggcctaggcttttgtacactctgggtttccataaggaaggattttttcttaagcacacacctggactcttacaccgtttgcattctcttccttcttgagggaggtggagtgacattgaattggtgaatttggaaagaataactgggcatgctcagttcagctcagcttagccattttcccttgggagcgagcctgtctacaagaatacaagtactccatttcttcatgccctaaatcttacctggacagccaatccacttgggatgccctgtcgtgctgctgcgattgcatggatgaccctaacaaattttgaggctcagtatttgcaagccttcttggtccacagatctaaagccatgtcttctactgagcctctctagggagaaaaggtaacattttgatgtcatctcctgctttttgtttctttctcaattttctccgacctgtgatctggaagagtgccattgggtggcagtccttgaagaacccagaactagcaatgaataaaagaggtggtcaatgagagaccagacctaaatatgactccccatttcttgctgtttgggtttttccctctcctcagttttcctggggaaagatgggaagtcattactctggattggagatacagggggaggaaagggtttggggaagaagatggtgattttaggttcggtcacagtgacttcagtgaataccaaccaagtagctatgccccttcccccttcccctcccttatgttaggtacacccctcctctgtgcacctatgcttgtatctcccattatacacatcagaagatgtacctgcagttacctacatacctgtcatgtattttgtctttgagcttcccaagggtatgatctgtgttttaaaatttcttcactgtaggtcccatcttatctgagccccagaagttagtcagccatgcttgttgaatgaatgaataaattcacttaaccacaccaacatgtcagttcctatgtgtttcctcaccctggagtatttggtaatacaaggatcatacatatgcagaaaaggcttcatcagaggaagtgtgtctcctctggcatcagcagcttcctcccctagtctctcttctctttcaatcaaaccctaatcctccctacccagtgtctaccctccaaaggtttgaaatcagagtccacagttaaatgagaatcttgccacagtttccaactcatgttgacccagaagtgcagctctgagccctgctgtagctgttgtcagcaatcccctggaagctgtcagtgggctgcagtctgtgcttacagagtgatcccccaaagagatgcagattgtgtagatacagctggcaggggctgacgctgggaaagactgtgctctgcagggagggcatcatcagctaattgcttctaccctctggggcatggagaaatgcaggagcagatccggaatgacagcgtgaatgagccccaagcatctagagtagagggaagcctgtctagagtgttcctgacaggcttgagtcaaaagcactagatcgtatttccaagaaagggagactttttttttatttgaaatgtaatagacatgcagaacagtgcctagaaacatatgcacagttcactcgtcacaaataaaatgcctttgcaactacactttgcaactacagagataatattttctgcaatgccccctgcaaaacaatatttgcaactacagagatattttctgcaatgccccctgcaaaacagtattgcctgccgtcccctcaacatttgtgtgctatttcctagtcgtatccaatttgttgattatcatggtaaccattttattggccttctttataattttaacaccttcccatgcatctctaaacaaatttgctaatttggttgttttagaacttgatatggagtcctaccattatcattttttgacatgtcttccacttgacatcatctttgtgaaattcattcatgtagctgtgtataattgtagtgtactcttctgattgctgtactgttacactatgtaaatatgaccgcttatccattctaccctctacgggttgatggacattcaagttgtttgcattttgctctggaatcattatcctggtatatttatgtataagtttctgtggtaaggtatttgtctggagatagaggtcctgagtcaataggtaaggtctgcatatcctcaaattgaatagaaatgccaaattcttttccaaattggacatacctaatcatagtcccaccattaggagtttgcagacatataaaggcaccctacaattctaactgcaggatcccaaggtaactcgcactggctgcaaacagggagctcctgcaagtccttggagcttgcctcaaacagggagctcatgcaagtccttggagcttgcctcatacatgaaacgtggcattttgtctcttgcttttagattttaaccgtttccctctccgaggatggaagaacatcacatattatttgttagtcaaagtatcactcagctaacctggaaaggcagagggcaatttaataacatatagatgcttttccttctaaagttgtacatacagaagtatatttgtaacaagaaggtcaatagaaaattgaatgcctaaaataataccgtagcttctcttttgagctcaattgatttgctccatatacgtctgctgaaaaacaaaggttttaaacaatatatgctattcagggtctgaattaaacatctgttggtgttctctagttgtaatagggtaacataagcaaaaaacaaaaaaaacaaaaaaaaaacaaaagagtatatcctaagaaattcagcattagtctattcagggaatttttccaagagaaggaatagctttgttttgaccctttttacaaaacatcatcagaaccaaaggtcttacacgttagaagagttttcatttcattacttttttcagccttacaaacaaagcagtacttatctactaattgtctcaccttcacctcagtgtccccaatacctagcataagccttgacaataacaggagctcaaaaacatttgaatagatggagttcttgtacacttgagatgaggaaactttaccaaaatcaagaaacatattttgttaaaaatcttgtcctctaagactcaatcccatccaattaccgcctcacatgaaaaaaaaatgttgtaggtctcaagaaatcaggccaggttatttttgtaaagaaacattaattcaagacctaatgatggccctttgaaatatcagttattaaattctgttaagcaaaggcataaacgagattcaaagcctcccactgccttttcccaatatgttctagtaagagcttttctgtgtgattccgaaagttattgtttggaagctcatgatactactgagtccccccagagtacaaaacagcttttgaagtttaagtccagactagagggggtatcacaatggaggcttaaccaactgtaatgagaagctgacaacaatgaaagaaatatctgctgggagggcaataaatcctctccccttaataaatgtctgacaggaaaggaactcatgacgtctcagtgctgtgagcttacaaattaaatcagaggagatgacttgttgattgatactgcaggtaatcatataattaaccagtcatgggctgataatgagatacttttggctaattagaggaagaccaatgaatttaattcagatgaaatgctgcaaataaaagccatttagagaaaagggcaggcaactggatagatggaaggaaatgacagtggagagtggaagttataccattctggttaacaaatcatccacttattcagtgatccaggctcaaacaccagaggcgtggaaacttccctgagatgggtttgtaatccaaaatctaacatccagaagagaaaaataagtagtgggaacattttatttaaatattattccatttcatttaaaatgttaaataataaaatttgtaggcgcctattgatttggactaggctgctgcactgggcccaacagaccaaaccaatatggagtcactcatgctaaatgaaactaattaacttaggagtgcacttgggtaaacagctgggctttagttggttacagcagctgagcttcagtcagtcaattgcaggcagccagctgattcaaataaggcaagatgccgagctgtaaccaattaagctgtctctatatctcacttccattttctgtcagtaaatactgtctaatcactttgctggctggagttttttgaacctgctgtagttctgagggctgcccaattcttgaatcatgaataaaagccaactaagatctttaaagttgtaattttttgtcttttgacagtaatctgaaatctaatgctcaggggggaaaaaaagtagtggaagccatatcccaataatgtctttatattttctcctcagcaaccccttaagtgtgagttgagtatagaatagttagattttctttgggagccattggaaacaagactttaaattgaagatagatttcagtcccagagggggcttatttgatccaaagggatataatctaagtgattacacttcctatacgtatttgagaatacactttttatttcaaagacaagtaaggcaacaccctcctcccagcttattcttataacccctgatatggctaggctttgtgcccccacccgaatctcatcttgaaatgtagtccccataatccccacatgtcatgggagagaccaggtggaggtaattgaatcatgggggcagtttctcccatgctgttctcgtgatagtgagctctcacgagatctgatggttttataaggggctcttccccagctctgctcagcacttcttcttcctgccaccttgtgaagaaagcacgttgcttcccatttgccttctgccatgattgtaaatttcccagagccttccccagccatgctgaactgtgagtcaattaaacctctttcctttataaatcattcactcttaggaagttctatatagctgtatgaaaacagataatacaacccctttcctcttgtcaaaatacacgctatccttctgaacctactctccctatgcgccagtaagaccaaaagagaactacagccatgaggcattaggaagtgggcaatgaaaaccacttaggacatctctgcttctctatttttccgattgaccctttctctgttacactcttcccccttctcccctgcctcctcacttcctctttcttccttcaaccgtaataaatccacacgaaagaattcaacatgcttcttagtttccagcatatgatcatcgtcaagtgatgcggagcctttatttcttgtaacattttctctgagttgactcctttaaaccacacactccctctcctttactgaataggtgctcagtctactcaatctctatgtgtatgtatattattaaaaagcatattggatagatttttatatgctgcaatttacataaatatatggtgctataaattttgtttcttgctttttttcattccacaatgtgttgttgagatttagtcttgtagttatgtaaatttagttcattacttctgattgctgcttcaagttctatcatatggccttttatttgctgaattgcatgaatatctagtatgttctcgattgtaacctcttaagcattttaggcattgaaaacgtgttatctctcaccacctcttagctttgctatgatgtcccttaagcagaagactttcattttgatgtgcagtccatcattctcattacagccttgttttatgatcttgcttcagaacaaggttacaaaaatacttcttaccttttctcttgtcagctttaaacacttaccttttatacttatattttcatccatttgtaattttttatattttatatttatatatttatatattatatataatatagttttatattttatatagttgtatatatacatataaatgtatatattgtgtgtatatatgtatataaaaatatatattttatatatatacatacacacacacacacacacacacacacaaatctccataaaatgaaccagatttctcaacatcattagctacataatccattctttccccatacatgcgtggaatcgttttcattacatagcaagtctgcatggattcatggatttctctcaaggctattctgttgtctattactgtgctttagtattcattctttattactgtagcattgcaatatgtgtgatagttggtaaggtaatttcttccactttgtttttctgtttcaaaatgatcttgtccatttgtgaggttttattcctcaatttaaatgttggcgtcagtttgtcaagttctatcaaatgaccaccaggattttgcttggaattgtactgaattcacagattaactcggaaagaactgatacttttgataggttatgcaattcgtgatcatagtatatattcccacttatttagctctcctttaatataccttaatagagttctgatatttttctcatgaaggaccttgtatattatttattaattactggatactttagcattggagctattataggtgatgtcttattttctattatattttctaattgatgactatttaaacaaatgttattgatttatgtatgttgatattttttaattggaaacttcactaaactcttactaattaccagtttattctattgatttggataggactcaaatgtgaataagctttatggatgagcaagtcatctataaataatgacttttgttttttattttcttctaacttttattttaagttcaggggtacaaatgcaggtttgttacataggtaaagttgtgtcatgggggtttgttgtgcagattatttcatcactcgggtattaagccgagtacacagttatttttcctgatcttctccctcctcccagcctccacccattgaaaggcaccagcgtgtgttgtttccttctatgtgtccatgtgttctcatcatttagctcccacttataagtaaaaacatgtggtatttggttttctggtcctgtgttgttttgctaaggataatggcctccagctccatccacactcctgcaaaggacatgacctcattattttttgtgactgcatagaattccatggtatatatgtacgccctatctttttctttatccagtctatcattggtgggcttttaggttgattccatgtctttgctattgtgaatagcgctgcaatgaacatacacatgcatgtgtctttataacagaatgatttatattcctttgggtatggtatgtcccccgtagtaggattactgggtcaaatggtatttctgactttaggtctttgaagaatctccatgttgtcttccacaatggtcgaactaatttacactctcaccattagtgtgtaagtgttcctttttctccacaacctcgccagcatctattatttttttaaaagtcaaaaattagtgacctttaaagttttcctcttttcctcacttctggtctaattctatatccttatttactcttcattttgtaaaaatgatttaactgatgagtttagaagaaactaggcatatgtagctcagtcctttctgtgtatcccatttgggagctcacctgcccaagaactccttcacaccatcagctatgcagtgaggtcagcctaattgtctgtctgtgccaacagcagggtaaatctctaaaattcagaggtaaaatgactgcaaatccaccagactggctgatccaagcccattcttcaatatcagcttcatcagttataaggtaatgttttatttccatctaccttactcacatgtctttgtctgtttttttctgacttgatgtggtataaagatggtgttatttattatccccttaacacctgcacaccttctgatcgttatacctctgctatgatgggaacatttatgccccttcaaaattcatgttgaaacataatctctaatgcaaagtattaagaggagaggcctttaggaggtgactaggtcatgagggctcttcccttgtgaatgagatttagtatcttataaaagaggccagacacagcatttggcccctttctgcctttgacctccaagcatgtgaggacaaagcctccacagtgccatcttggaagtagagaccaaaccctcaccacgcaccaaactctgatctttgttggattttttttcccctgttttcagaaacgtgtccatgccttctagattttcttttttttttttttttttttttttttgagatggagtctcgctctgtcgcccaggctggagtgcagtggcacaatctcggctcactgcaggctctgcctcctgggttcacgccattctcctgcctcagccttccgagtagctgggactacaggcgcctgccactgcgcccggctaattttttgtacttttaatagagatggggtttcaccatggtctcgatctcctgacctcgtgatctgcccgcctcggcctcccaaagtgctgggattacaggcgtgagccactgcacccggcctatgccttctagattttcaaatttatcactgcttttgttcatagtatttttttgaaatcaaatatttcttttaggacagtttcgaaattacaaaaatttacaaagatagtacagagagctcccataaagcccattcccagtttcccctagtagtaaatcttccattagtgtggtacatttgctacattaatgaaccaatgttaatacattattttagagtctacagtttattctgactttcttggttttcatctaatacacttttttctgttctaggatcccatgatcccatagtacatttagttatgtcttcttaggctcttcttagcagggacaggttctcatatttgccttgttttggatgacttagacagttttttggggttttttttgttgttgttgttgtttgttttttttctgagacagaatctcaccctgtcgcccaggctggagtgcaatggtgcgatctcggctcactgcaacctctgcctcacggattcaagtgattctccctgcttgttaagtttttatagaatgtcattcagttggatctgtctgatgtttttctcatcattagacaggaattatgtatttggggaaagctgcatctcacaaatgcacagataaagtgccattttcatcatatcatataaagtgtacacaataccaacatcactcatcactgttgaggttgaccttgatcactgactgagggtgggttgcccagctgtctctactgtgaagtgatgctttttatccccctttccatagtgtgcactttttggaagtgaggagtattccacctcaaggacagagtatctacatacattatttggaattcttctgcatgggagatttgtctattctcctccacttatttatatcaatatggactggtgtttatttattttatattttgagtgctgtgtttttgttcaaatcttacagttatattggtagatattttcaccttcaaattctgttggatgcttactttgcatcttctcccctttttccttgattaatatagccagaaatttgtcttattagtcttcaaagaaccaactttattaattacctaaattgcttctttctgttctcattaatttctgtccttatccttattgttacattccttcttgtttctttttattgactttgctgctttttatctaccctttagagttgaatgctaaacttttttgtagtaacctttttgttgttgctctctgttatatgtaatgaaaggtttaaatttccctctaaatatcgctttagctgcatctcacaaatttaaaatgtggcaccttcattatcactcacctttaagtgaatgcaatttgtctgatgatttcttccttaaccaatgaatgcttatctcaccccttccctcaacataggacaaattttttagttatacaagttattcatttctaattttgttgcattataagaaaatataatattggtttttgattctttggaacttattaaggcttcttttgtgttttacatgatactatttgttatttttccaagaatgctaagaatatagctttttatacacagtccagattatttatcatattaattcagatttatctctttgtttatattttctgcatgatctgtcacttattaaaaatgttgtcttataatctccagctctagttgctgatctatacatgctctctgttgctttattcagttgcatattttaaggtgcattttgattcacaattataatctctcctagctcctttcacaatgtataactttcctctttaactcacgtgatgttttccccttttaatttaattttgtctaatgtgaacattgttatacaagagtttgttgttaatatctgtacaagctatactttcaatttttctgtatttttgttatatatatctcctgggagcaacatatttttaaatctcactttttaaaatccaacagcacttaagcagttccttttccctctttcttgtctcccactgaataaatcatgtgttcttcttgaacagttaacttcttatttctattcatttaatggtttctccttataaaattcccattaagttgtaacattaatttgtaatttttataataactaaatttatactcattgagagtgtttactttgtattgtcatggctatgctttggtttttgtaagaaggaagtacaggaggtcattgcacatctaagcaacaataaaacttatctactcacccatacttcctatacctcatttttctctcctgaattaatctcttctctttgctagagtatttctttcaaatatgttcttgaagtaggaaacaatttttaggccctgtcaacctgaaaatatctttatctcacaatcatatttaaataaaaacttaactggttacaaagttctaggttcaaaaatgtctatgttcagcattgaaaaaatattatttcactgtcttcttgcataaagcattactgttctatttcttcctggaacatgcattgaatcaatgctgatacttttctgtcttccatgtctctcaatgttaattttattctcttcatctcattaacccttcctggtactctctgggacaattcctcaacttgaaattccaggttactagtttagtctttggaagtatccattcagtttttcaacacatctactgagtttttcatttctatacttatatttttcatgcccaggatctcccattgtttcttatctgtaactacttgttcttacttcgtgttcaaatatcactccttcccttttaaaagatatttactaggcttattttaagtgtctctagtagatatttcttgatatactgcctttcagggtgtgtgtgctccaaagaagtcttattaaacaactcctaaatccgcacccccaaaccttgcatgtcccttgggaatttcagttgacacggagagtaatgtatacctgaaggagaatcaaaatcttagactgtgagtttaggggtggggagtatgctttaagctgcacagcttcagatgtttctatcaggaatcaaccacttccagtttgctttctcctacctctccctaccctgtacctcctgagacctcaccctcagagagccccggtaacttctctcttccaactgctcctctctgctttggggttggagaggtaaggaggaaattttcaggggctggccagcttccccacacttattctcactccagagggtctccagctctgtgccgatgttggctaactgctctgatacattctgatttggggaggtgctttgccactcaaacaataggagatcaatagcccactgaggtcagggtaagagagataaaaggtacactcagccagcattccaagcacgtatcccatctatggccctgggcttctcctgatataggctatcatcttcctatcacacaggaatttaactatctttcatcttcccatgggtttttcatggttttggtgttaagtgcggggatccatccacatgtcttctgtttctttccctaaaatctcctaagttggatttgaggaagggaggcaatggcttatgttaattttccatgttgtccagaattgaaattttttctaaagattgtgagtgttgatgattatgggaaccatgaggcctatagccccattaaatgcacaatgcctagcacatagtaggttctcactaaacactgcttcaataaactggtaaatttattcaaagatattttagatgatatgtaatgtcatgttctgtattttaactttttatagttatactttgcttgaaaaaaattacattgttttggctggcctaaaaagggagagtgattgcattttaatagcttaatcacaaagaaagccccaaaacagagtaaatagtgcaggcagatacaaggctaggatagatttccaattacattgacatttttctttctgatacctaagcttctctggctttgaaatccattttcaggctgcatataatcatgttaatactgtgagactttcagcatttattagtgctgttattttcatctatacagctccttcttcagacgaactgaatatgttttacaagagcctacagaacagacatcaattctttgagtctcatgagaaggtggaaaacactgaagaacgaatgattaaccactctttctactatttattacttcttaaagaagaaatcagaaaggaaaagagagaaggagaaaaggaaaggaaatcagagagaaggaaagaaagggaaggaaaaacacacaaaaggaagacagcctgccctcacctcttctcagttgtcttctttcccttgagtttctgctctgtcctaacctgctgttctgcccctgggtgcctggccctggacttctctttttatttcaaatgggctcttgtggctactctataatctccatgttcacctctgtgaagtcttaatgtgtatttcacaatggcaatcctgggctcttttccctgtcttctaaccacccccttcctgctattgtctcaacaaaactgtcgcctttgttgagaaatttggaaatgtccaccagaagctttatcttatcctcctctttacgatggaaaattcttctctgcacattcaaccatcctttctccctacagctgcaggggttcctttctagctccttcattgccatctcctcctcttcttctctcttctgttgctgccttggatgcctctttcttacttttcctcctcctatttctctttgtaaatcagtattttatctattgatcacttaatgggtacttagcactgtgtgaagctaagtatttcataaattacctcacttaaaggtcacaatatcccaatgaaatatatagtattactacccctgttttacaagagatgcttttaaggtttagagaaatcaagtaacttgtcaaaggttgcacagcttataaccagtagatttcattagctccttccccttggccttcaaacatgaacatgttttggctattcaactaagaaaataaatgaattgcctctcttgaggcatagttctatccctccttttagttgttagtttacttgtcaagcaaataactacctatgttcctattttctcagcatcaaaacctgccttatatctttgcattctgacttcttcattctgccattctgccattgttagagtgacctctccaaagtcaccagtggccaccttctctctgaacaaatgacctttataattcttttccttgacccctctgtagctgttgatgctattgataatcctgcctttgaatttcacctgctggccaacgtggcttactatgcaaatttgtgcggtcagtcagatgtgctgttagataatgcagttgtgaacacatgggtgagccactaatggatgcaccccaagcccgtggccagaaattctcattttctttgagggtcaggaggcataaattatcttcaggatgggaaggatattttatagatacagggctatttttgcaggagaacaaatgatttacctcttctgaataatgcagaatcatgtgtggtgaccctatgtgcataaaactcttacatcttgagggtctaggtaacaaggtaataattgtatttgcaacaaaatataagtaaccctgatgaaactacaaggatatggggtcttgagggaattaggtgggagtagagttgggaggagtgtttttcatttttattgaatggtttggtagaaaatgaatctcccggggatattttatatgtaactttgccaaagagtctcctaattactctcgtagaagtatgtgtgaatatcacagagtatttattttctctgatgatttcacagtttctaaaatgaaagaagtagctcaaacaaaatagttacagatgttattcctctgccacatagtttggaaaaagtggggtctctggttgactggaaacatgaatgcatgtgatttaacacacccaagagaatgaggttggtgaattttttaatggagaatatacttaacatttacatagaaatttacagcatccaaactacattcacacttattatccccactgccttctttcagctctttggataaaatggggattctgggccgggcacggtggctcatgcctgtaatcccagtactttggaaggccgagacaggaagatcacaaggtcaggagatcgagaccatcctggctaacacagtgaaaccccatctctactgaaaatgcaaaaagaaattagctggcgtggtggctggtacctgtagtcccagctacttgggaggctgaggcaggagaatggcgtgaacctgggaggcagagcttgcagtgagccgagatcgtgccactgcactccagcctgggcgacagagcgagattccatcatgaaaaaaaaaaaaaaaaagggggagattctgatcccagtttacagatcaggaaataaaagtcctgacagttgatactgcttgaccaagtctccattaggccaagggttcacaaccaggtccctgcccccagccagggctaagttccatcttcctccagcccgttgtgtgcagatgattagtgaattaaggggagtgggagtgggctgccgcaagagggcctggcacaggcatgcaggcaagcatggtggctcagttcacaaatattaatgaaactgtatggaggaagaaaatttacttccccaaaagataaaagcctattcagttgctgtcagagggcagcattattctgctaaaaggacaaatttgagcatgattcattcttggcagctccattactaagggcagtgggtgtttccacgtgaaaccagctgaattttctactgagatggactctccaagttgctggatgaagtattaatgtgcactgcggaagctcaaagagcatttaggtattgcctatgaacttctggttagaacaccaaaatccagagtgaggaagtcatctaacaatgttataaaaatgtaagaggaatggaaatttctatccctctgaagcaaaaacatgtgtggagaagaacttcagggatgccagtccagccacagatccctgagtgtcaccccctccacctttgcactccctgccacacacacagaaatgcatatacacaacacatgcacacgcatgggcttgggccccagcagccatacttctgttatgtgaccctgacctctcagccataggtgcttacaacaggtgtggacatgtggacacctgacccaagctgcaccactcaattcctctctctccagaattaaagtcaagagaaaaagcaaatgggaaaatattgctgagtaatgtggatgtcaagtctctagaagaaaaatccacaaccttgggccctagaggttcctacttcattcttcctttttcctgatcactgggttatttggctttttctttgacttttggagctactgcctcaggatccttccagcaaattttgcctgagcttaagctaatttgaagtgggtttgtgacatttgcaaccaaaagaatttcaactaagctatgagacagcccccaggcaactgataaataccctctcctaatgctgcttcatcctgtctattatagatttaataattagctggttaaattatcaatttatgcaagtaactatcacaagttgaaacacttatttttaaaagctatctctttttttggaaagtttgatggctcttaaatagctattagaaaatatactttaaagttaaataagttacatatgtctctgtacacatatatacgcagagacactaatattggaaagttaattgaattgtcaattgtgtaatatgaaattttaagtttaaagttcgtttttagttttgtcaattataaaatactgtttacttgttgcagaaaatttgaaattgtgttagttttgtcccacacattataccacagggctttacttatagtttatctgatcctaatcacaatctataaggtaatcactatccctgtttaaagacaagaaactgtatgttgtatagtgtgtgtgtgtgtgtgagagagagagagagagagagagagagaagaggagagaagagagagagagagagaacccaaatcattaaatcaaacaagtttatagcacagactaaccgtaaaacatatggaaaaggataatgattactataaagcaattcataatacctatcatcattgggagcaaatgcatgcagaaaaagcttactttggagaacctattcagatttatgctctgcagccaacataaatatgaaaaaaagtctatacatttccactgcatttggcaaaaataagtaagagtgagggatgccctggatacacttgctgagtcacacttgccactgaggcaggcaggagggagcatagcatcatggaaaataatcattcgtaggcagctttgatgtgaacgtggtttgcatggtttaaggaggtatgctcttgtcaacaataccacagcttccatgtcaaaaggcaggtctctcctaagaacattaagcatgtacttatctcctctaagacgtgagcagattctattttacacacccgtgtggaagtcagcggggtattttaagggctccctcagttattaaattgacatttaggaggggtgcagtggctcacacctgtaattctagcactttgggaggccgaggtgggcagatcacgaggtcaggagttcgagaccagcctgaccaacatggtgaaatcccgtctctactaaaaatacaaaaattagctgggcatggtggcatgcacctataatcccagctactcaggaggctgaggcaggagaattgcttgaacccaggaggtggatgttgcagtgagctgagatcatgccactgcactcgagcctgggcgacagagcaagactccatctcaaaaaaaaaaaaagattaaaaataatttcacaagtaatctatttttactagaaaagtttgaacttacaactagcaaaaataataaactcttctattgatatctggatgaatgtcctttcatacttttctaaatatctatataaacacactatatttcatgaaaatgaggtgaaaaatgcctgctttattttacataacaatatatcgtcagcattttgtcattgtagggaaacagttctccatgagcctctcacgtttctgcacatcttgtgagcagaggcattctccacctatttttctgtctatcttttcacagatatttatatagtgaacaggtgtggaagattggggtagcgtctcccttcagaacaatggcagatgtgttcattgttaactataaaagatttgggtttcctaagcttggagttcctgttctgtaatacagccactgatggcagtgctagtgttacctggccctttcctgtaactcggtggtaattaggacttgagaaactggcaggaaaaaggatcctgaaattctggctcctgatattgctgtgagtattagagacctttgttcctgacccaggagtcttgtgtcttctttcatgaagctatagcagagttgttaactcacaagttgggtaaaatctcagactccctgtggttctagacaattatattgctaaactatttttcaacatcatcattcttgatagctgtattttgacaagtgcactccgatgtctttatctaattccctgtcggattcttaaactgttttcatggtcttgcccttgaatataatatttgcatacaacatattcatacaacatattcatcccttataaataacttttctagatgaagatttaaggaacttttgctcttgatgaactgcatattaaataccatttcagattttctgggtatttaacaattaatttctattgactgctcctctgtcagtggtcctgaaggtcaggctcattgaggggatggatgggtcaacccatgacagatgatgggatggctcaagtgtcagaggccagtcatcctagggttagctgtgaaaatagaaggcaaaaggtcagaaatccaaaaggatgatatagctcaaaaacctcacaaatacgttctcaccctaatattccacctctacaatttcacgtttagttgttgccaagtgcatgcacatgagacaaaacaaagccaaggccaaagcctggctaattcagctggtaatagacagtgaaccacttataggtttagacagttattatttttatatagacagtgaagaggggggccagttccccatgatctttcccaaacaccaaactgagcaaccctgaaatggaagggatcagatgactacaccatgagctggggcacttgcagattttggctgaacagtttcgtgttctgcagctctacttttggagtgggggaaacagggcagaaagcgccaaaccttgtcagcaccctggagaccttgagaaactgattcatgacaacctctcaaggagagagggagatgagtgggagatggcttcacagcagctcctacaagcctcatgtccttggaggagcacaggcattgtgccaagccattcaagaggtagcttctctggttaggtgcaagtcaccagggcaccatggtggagccattgccccacacttacctttttatcctattctctcacatttcctccaacctctgcccacacactattgcctgctgctgcacattctccagacatacaccccacacacctgcagctgtgccttggttgcaggtgagcttttaactggggccgtttgcctccatctcataccacctagcaaagtcccagctacctccaagctgagcttggtgccttaatatatttaatgatgatgacatcccaagagccagcagggtgggtatagtatactcattttacagaaaaggaggggagttgttagggaacttgctcagggctctccagtagcagagccaagattcaactcctttgatcctttgcaggatgcagcacaaagcctagctcatagcaagttagaataaaatgtctggagagtcacatcaaatgaattgcagcaagggggcatcaagaggaactgaatccacagtcttggataatcagatctaatggtgggtgccagagcaagtgacagtcaaggtacatgagggatggggcactatcagagtcagagctaattcggcctgaatcctgggccttgtacagtctggtcttgaaggggcagggcccagcgctggtagagctggggactagctgtgctattggaaggttgtgtttgaggagagaggatttgagcatagaaggggcattagcaggtttggggttcatcctgatgttccctagcttctcccttctctctggagtccctcctccccctggcctgtctttagcccttttagttccaatcactttatcctttcagcctggccgagctctcccgctggtctcattctcctctaaccagacctggggttgtcggctgcttttggaattcaccattaggagatgaagaggcagccacaggttgactgagcaagcgtcattgtctatttgaagtttcaaaggtatctctgaaaataaacacagttttctgcaagagtgaaatggcatctgtggtagaattggaaagacagttgtcattttgcttggagttcctcttctatagatggcagctgggcctttcaaagtcaagggtgacagtctgcacatggcttctccccagcactgtactggctggtgggggtggggtgcaatacaagagaaataaacttccccggtttgctgctctgactgaggcctccttcccccaccccctcatcagccaggatgcaggactccctatctgggtatcttccacattgaaaattgtgctgtgttgagataacatggcacagagattcaacccacaggggttttggggttaggcaggcatagctataagcctcagcactgcccctctacagcagcttttgtaatgttgagcaagtgactttgcctctcagagcctccatttcctcatgtgtaaatggggataagaggatctgcctcctaggatgatagggatggatttagtgaaatagtgcatgtcaagagcttatgagtgtgtggccacagcaggaattcattactgttgctctatgactgttatcaaagctgtggcccacatgtacacccggctaatggctaatgtgaggtaggctgtgatgcctgctacaatgaagctgtgattgtaactatagcccacacccatatccctgggtcccacacatgtggattcaaccaactacagatcaaaaatattagaaaaaaataaaagtagcaatacaacaaaaatacatataagaaaacccagtataacaactatttacgtagtatttaggtattgtaagtaatctagagatgatttaaagtatacagaaggaagtgtgtagattctatctaaatactatgccactttgtatcagagacttgagcatccatggattttggtgtctgatggtggggagtcctgaaaccaatcccccatgagtattggggatgactgtatcattattgggccatcttctcccttggggaaaccagatctccaccagcattaataaggcaattgctgtgccagagaccattaatattgagaatctcatgttttcatgttacaacatcatatttaaggatgtataagagttctttatcactggcaataaactctaaagataaatgagccagagccaccaaggaataaaaactctccatctttgactgtacacgcccaaggatgacgctgttacccttagatctaagccataggcctgaacacaggcaaacagctgttggttaatggccctggagatctggagggctgaacagaaactccccaaatgataacgttctggggagtcatagcactgatgcattcactaggcatctacctctgatctggaggaagtccatgctgcttcaaattcagagactgtgccctaggcatcgttttgattttcctcctctccaccccactctatgctgtgaaactgagattaattgaactgctaaaatgatgaagttatatataccagctaattttccaatggtcagcatgaccttttatagaagtgtgttcagcatttgaaaatgtatattttttcaacatcttaccataaaatacatatcagaaagtaaagttttaaatgattttcttttatactggcaaactaggaagtatgagatgttcatttgccgcagagttagcaaatacataaccaattatgaagtctgagaatatcacagttgacttaagcagcaaatagtcgtgcctatgtaattccatttaactggttactcagctcttttttgaaaggcattatttagcttgttagggaacctcaaagggaatcagttttattaagcaactagacaattagaccttggagtatttaaaaagattacaggcagacaaatagtactgcaaactggcctgtgaaatacattcaagaactccatagacagaaataaagatttacagaagtcctttttcctattgtgttctttctaattacctttttaattgtggtttttctaattgagattgttttttccaatgtaagatatctactgcataaatatatgcatattatcttcataatacttgtattacagataagctaaaagaagaaaatgacccatttcaagaaataaccaatatcaattctttgctctaaactttccagaggcctgtatagtacagccagatagccaaaagcctaggggccagagtccgagtgactggatttatagcctagttttatcacttattgactctgatcttgaaaattcacttgaacttcgtttgattccattttcttatctgtacaattgggattttaaattgtaccttctgtacagcattttgggatgatcaaatgagatagtatgtgtaaagtcttaaatcaatggctggtatttggtaagtcttcaataaatattagctattttatatatcttatatagacagtgtataatgaaaatgggattttattgtatgttctgtttttatagttcactttttttttttttttttttttgagacgagtctcactctgtcgcccaggctggagtgcagtggcacaatctttgctcactgcaagctccgcctccggggttcacaccattctcctgcctcagcctcccgagtagctgggactacaggcacccaccaccacacccgacacacccgactaattttttggtatttttagtagagacggggtttcaccgtgttagccaggatggtctcaatctactgaccttgtgatccgcctgtctcggcctcccaaagtgctgggattacagatgtgagccaccgcgcccggcctatggttcactttttatttactggcatattgtgaagatttttctatataaatagatgcacatctctttattatttttaatagctatataatattgcatcatctgctgcttgataaattaccaggtaggaggctaagcagagccatggtttaggccccacccttccttgctagagctcagtgagggcaaagcttcctgccctaccccaggtcacccctgatgtgccacagtgagtatttttaccttggttcaaaccctgtgaccgagttctctgcattcatgggctcctttacagtagcagaatgcccagctagcagaggcactggggattcccaccatcgaaggctgctcagggaagagagcctctttctttgcttctaataaaccagcatctctgccatttgcataacttctggagaagggccaatacattttgggaagatgcttgttttcttgcagaggcagctgaaactcatttgaataaccaagtcaaatcaattcagaagaagccagctcagcatgaaagcaaggattatcattcttgttcctgccatatccctccaagtagcacagtgaaccaactgcagaatcatagactccgtgctttaggatgtgcaaggtgacctggtcctcctttacaggtaagcgagtggaggcatgaccccaggtcacatgaaaagtaaggggcagaacaggggaaaactcaggtatttggacttcatgttcagagttcttcccactccactctactaccttctactctctctcatccaagagagattgaaagtgactgcaggtgcagacttttgtgagaggatataattaaagcgctactgttgatctcttttgttcccacttggtcaggacatcttggggaaaattagggtggacagagctacatgggttagggaggaatagagtgcaaggtaacatcaatgaaaacgagttgctaaaaagagaaaatgatgttactgattcaatcctctaagtggctaactcaacaacagcaaatatgctgtgtgtgtccaccactggggcatcctatcgaagagtttgatgcatggagagacaaagttcagttcttggcaggatgagaggaaacattgtgctgatctaatatggaatccattctcagctctagcatttgcccccaaggaccgcatagatgtatgatgttccctgaattatcttttcaaaatgcaagtctaggcttgtggttccctgccttaaaccctgtcagtggctctccattgtcttctgagtgacctactgacccctcagcaggaatctttgggggtgagagcagcaaggaaggggtaggatgattatgagaggtaggatgagcttcttaattacacatttctcgaggtctagagccctccagtaatggtacctggcagaaaacagccttgccctgcagagttgtctagaagtggatgacaaaacccagcggggccaggcccagagtactggtcctaccttgacggcaggacctcagccttatagatttctgcagggtcaacccagagaacatagatgcatggaatagaccaaagcagttatttgctttcccccgacaaggcccttagtgtctgcggctcaccccatctaatggacttggagttcgagacagctgttgaccctgtcacttttccagtttgatatttagttatcagtgtgctcagcccttatcttttagatatttgacattcaaaccccagttgggactcttgtacatcagctggctaggaaacattttgggtaattggatggtggcactacctgccagctaccagttggattcgggtgctgtctttcaacatcagtgtgtacttatgcagtttattgcattttaaaattgttatataaaaatcagtaaaaatgaaaactgaaggtctgatattaatggtaagaattagtggccttataaatgcattcaattgaggcaaagatgaaaagcaatagcacgttaacagtctttgattttgaagaacatgcaccaaacagaaggcaatatattgacaacataatttttctatgccttaaagatagggctagttagaattttcataatttgtctctcagagatcagaagtcttcttctaaaatatattatctattttcagttttcacactactgactgatgttcagaaggaaggtcttgacgtcaagcatctcctgccacaaggaaaactttagggggaaatgtgagcaaagtgcagagggtgaggctcatgagaggggtggacaggtgaggaggcagtgctgagttctgaaggccgccctgatgctgagattccatagctggggctaccctcatgacccctaaaactctcttatcactaaataccaaaggactgtcccctgaggactgatggaccagatacacagtgttaaaataaaaactttaaataaattaaatataacagagtttaactgagcaagaaaaagaaaaagattcacgaatcaggcagccatcagaatcacagcagattcagagagattctagcacttgccacatggtcagagcaaatttatggacagaggggaaaaaaaggagcctgcagaaaacaacagtgaggtccagaaacagctggattggttatggctctgcgttagcctcctttgcacatggtttgaacagttggctgcctgtgagtggctcaagcatggctgctgggattggctgagactctgctagcttacagaagcatactcctgcgttagttttcggtttgcctgcctactatgttaggttacagttcctccataagaactcaagtatgagagtacagaggctttctcagaccagatcttagtttgactttacagtgatgctgggcttggtgtgagatgtggggaaaaggcacgggctaagagtttaagaagaggtggcttgaagccagtaatatgctcttggatggaaacagctttttactttcactcaggggcgaagacaactggaccacgggctataaagaactgtgctctacagaaatgggacagaaatgcctactgagggcctagagtgcctagtacattagcgttcattacatgttgaggggtccccttttgtcaagtagaggaagcagaagttggtcacattatgttaatatatctgtgtcagtcgtgtagttatcaaatgccccttgctgttctctctaatcttttcactactctcattggggaaaggagatgaagggaaccgacatttgcaggtggggctgctgcatatgattatggagagactatgtgaatgacacccttggcattgcacagtgcacaacctatgcagctgtacaggatgatcctggctgttgtttgcctcctgttgttatagcaggtagctagttttgcatgaaaagggcaggatggggttccctcccactgcatcaggaaggtcaggcgaccatcaggcaatatggtcaggcggttgttacactgtttctctaaaatggtaattggtcgcagccagcactagggaaaggcagtctcccaatagacagaaaaaaacctgaaactggtgatcagcagtttcccgataagatctcaggagttgggtgagtgggctcaagcatgtacactaagaggcaaaatggcggagtttaactggtatatgaccttctcagagcattcatctggtgagggaggaatgcctcaggtgagcatcacacaactccaggaaatggttgtagcggctcctcccaagtgctagcaggccactgtgcatgcaggtatcccacatcaagggaaaaatcaggggagaagagaggcaagctccaagaagtatgccaatattataaaaccctgagtcaaaggtcaaactggacacttgatctctcaagttggctgcttggccctcttgcaagtgtattttccttcctttcattcctgctctaaagctttttaataaactttcactcctgctgtaaaacttgcctcgttctctcactctgcctcatgccccttcagctgaattctttcttctgaagagggaagaacaggttgctgcagacccatacagatttgctgccagtaacactatgtttatagtactgtgctagatcttcctattatcacatcaaattgcactcctaaaagccctgggaggtgggattatccccacttgtcactaaagaaataatgagttggaaaagttgaaggatgtcccaagatcacaaaactaggactagaatgaaaactgtagtctgactcagccagctctttctcttttcttttaaaaaaaagaaaaatctctttcttttaaattatactttaagttctagggtacatgtgcacaatgtgcaggttagttacatatgtgtacatgtgccgtgttggtttgctgcacccattaactcgtcatttacatattcacaggtgaattctatcagaggtacaaagatgagctggtaccatttcttctgaaactattccaatcaatagaaaaagagggaatcctccctaactcattttatgaggccagcatcatcctgataccaaagcctggcagacacacaacaaaaagaattttagaccaatatccctgatgaccatcaatgcgaaaaatcctcaataaaatactggcaaaccgaatccagcagcacatcagctagctctttcagtcatcccagagagtttggagctgaatgcacctatgtgcaaatgaaccatccacctaagagtgcaaaacctgtgcaatacacagaagccctgcgttccctcactgcatgatgctttctgtgtctggcattggctcccagagactggctctctggaagttcgaggaggaattacagctttagcaggagcctgggttcttcaatccagaatctatgcactgaatcgtaaactctcatttgaatttgatctcctgcattagctccagaatctattccttctcttcttccttgatacttcttttcatctttttatgtgaaggatgggagtccctgcattatttaatgctcagtgtccttcacagctggggcagcaattctaacattgagctataaaacatcagaagagaaaaaaggaaagtctgcccctgttacaggaaaggggtcccaatccagaccccaagagagggttcttggatcttgcctaagaatttacggagagtccacagtgcaaagcgaaagcaagtttattaagaaagtaaagtggtgaaaggacagctactcgatggacaaagcagggtgttccctaaagtaagagggggaatgtgtccaccctagttacagtgcttgtttatatacaggataaaaaagattgggccgggtgcagtggctcacgcctgtaatctcagcactttgggaggccggggctggtggatcatgaggtcaggagatcaagaccattctggccatcatggtgaaaccttgtctctactaaaaatacaaaatattagccaggcatggtggtaggcacctatggccccagctacttgggaggctgaggcaggagaattgcttgaacccaggaggcagaggctgcagtgagccgagatggcgccactgcactccagcctgtgtgacagagcgagacttcatctcaaataataataataataataataataataataataatagggagatctgctctgttataagggtttgtgataaaggactaattttcttaattactgtatttcgcaagaatcaatactatctttaaagcaaaactagaaatgcgtttgttctcaagatattgggatatcaggacacttccaagtctgggtgtgtttagcaaacattgtcaatctattcccctaaccgtaaacatctagaggctagaaatacctcagtttctgagaaggcagcccagcaaatcccagcctcattttcctagccctcattcaagatggagtcactctggttcaaatgcctctgacacccctaatcaaaaaggaagagactgctgatgatgcctttaggacaaaggcacagaactggaaggaacctgcagagaggagctgccagcccctaccttctctcccacagaaagatgtgctcaggtcagagaaggatattttggttatcaaggggagatgaggcatgagagagagagagagagacaaatagacagacagagaaacaaatagaaaatgattataaggctgtggttagaaattccatggctcaatggaccaggcagccacacaagtgagtaaagtaggtggtagaatccatggcaaaatggagatgtcatgctctaaaggggctgtacctactcatagacccaaccagttgtggccaagtacttatcccatgtactaggatgtactaggactggttttaagaaaatctaagcttttgaattttaaagaataattataatagctaccacttgtgaagcactcaaggctgagggcagagcatggagaatctatttgggaataagaggaagatcagaagtgagtggagacaaaggagctatgaagagtagcaaacaaacagaaaatcacatccatggagacagcagtggaagggagggaggtgaccatctgcagtggcacctggcagagaggtggagacccaggatggacaaggaaaggctggtgaacatagtgtgcaggatggcttcggtgacctcccagggactaatttcagcagagggacagagatcaaaacagactacaaggagcgggcaagtgggtgggtggaagaaagcagatgcaggtggcactactcgtttcaaaagtttggccaaactccttagaattctgagttttgtattccatccccattagtaccattagtttcagtggctactttcaattagttctccacgcaggcatctgcagccttttccttcccactgttcaagcctattatcagaaagaaaaaaggaagcaactcagttgggatcttctttttaaatgttcatcaaagaaagaaaatcagcaaaactgctgagtttattctaagcacagcagtgtagagtccaaccaccaaatttatttccacctgaatctctaatgagggagggagaggtgaaactgtcattcttcagtgcaaatttcttcagatttacctgtagatggggaaactgccaggcctcccttaggactgcatttttttggtgacagccattcctccaagacacaagaaccctcttatgcaagtcttttgctcaaggtctccctcttggtcttcctaaaacttgcttggaactgcagtgcagcctgagactcctgcccaacccctcttctgtccttctgtcattcacaggtgtcagagtggcacagccatttgagagcgctcgcagttgcctccacatcacaggtgtgtgtgtcacaggtggtgtgaccaccaacactgacttctaaaatgttaatccaactgcccccttttttttttttgagatagaatctcactctgtcacccaggctggagtgcagtggcactgtctcagctcagtacaacctctgcctcctggattcaagcaattctcctgcctcagcctccctagtagctgggactacaggcacacaccaccacgtccagctaatttttgtatttttaggagagacggggtttcaacatgttggccaggctggtcttgaactcctgacctcatggtccaccggcctcaacctcccaaagtgctgcgattacaggcatgagccactgctcccggccccctgacacttttaaggaaaacaattgtacctctagtttaacattttgatgtagtacaggcttctgcaactgagcacttgtaaatgccttatatttagttgtaatgccatttggggcactaggtatggtgcgtcatatgaaaagaggccttacgttatagagtccaaaggatagcgcaaatgtgttccagtttcctgatccttccatagagactccaacctgggcacacacatgggcattccctttctttccagtcaccttccctgacctcacaatcatgattatttgagctcttttttcaccctagggctcctggctgcatcccagaagtgtgtgtggcatcttcaggttctgagcatcactgtaggctcagttctggagaggaagtggcaggcacttagctgaagaaagcctcacttccttcggatttttcagacttgagctttaagaggacaaacagcccctcctctagctaaatttgccagctttaactcatatgcttttatgccaacctaccaaagatttttttttccatctttttattaaccttgccaaacattcccaggagctctgcctggagtgatggaggtagggggaaagggagaaaaaacggaaaacaaacccatctcatcacaagtataaagctctaagcgtcaggagataacgaactaaagttatataatttatttaaatattcttccacctgagagagagcttaaaacccctaagagtcttttctgaactacacagaggggagtggaagaaaagatgttccgatttaattcctacattataatgaaagcaattgtcctgtgtgtatcattatttttccattatcttaatgcatcagttaatgaaaattttcagagcccattcacatggctacagtagctgagaagttagattgcatcctccaccctgtgggtacagatgcagctgcactgcacatgggttgtcttccacacatcaaaatctcaccagtgctaaccctaagttgggctgcatatgccagcctaagggtacaaagcagcttccatttcatccagatggatttctctcccccattaccttccatttgcagcatcactgtagacatagcccattcagaaggtaccctctgtgttgatgatagcagattcatagctcttgggcaccacaggcactcggggatcccagacacttcgggcatgacacacaactttgggacaataacttcctctgtatgagaagaaacaatatttttaatgtgtaaagagttcagactttatccactgcctgcatataacaatttcagaattgccagctttgcttttcctgtacttccccctcttttccttatttttgagggcagaaagggcaaaagcttatgcaaagcctgatgagaaaagagatgggagagaagaatgtatttcccaggcagcttcatggggagcaggaggatgaaactggtcaaatgggtcatgataggaaaacaagacactcaggtggcagggacaggaccatctggatgagagagagtatactcatggcgtaggagtgagaaatctctgactaattgggggtggcagagaacagaacaagagaagttataaagatttggtgtagattttgctcttggatcccccatgaatttttgagaaagacctaagtaaaattaaatccccttcatgggttgcagttcttcaaatgtgatactcttctgaaactggcccactgggtcttagctttacgggcaggatattttgtttcttggccactctgtgcccatctaccatccaagcaccaggactaatgtgaaggggcaacaatgtagaattacaggctttcaaaggatgaagtcacattagagataatcgactctagcctcatatctaattcaggaaacttcctagtgctcccttgcctcgtctctggttaaaggattccaataatatgaatttcaggtccaatgtagaggcagtgtaggtgtggtttccagacatttacaatggttaaactcctgttccctgagtgttaggtctgtcacctggaaaagagtcacaacagtccctttctagaatgtcaatgaggggaataaagaacagaatggatgcagatatgctccagaaagaacaatgcagattctaatcatcgtgagtacggcctcctgactcagtggcctggattgagtctacatgttgaccaaatatctggtcagtttagtgaggtccagtgtggaaacatccataaaataagtgatctactggagttttggttttaaagctctggtgacatgctaatacccagctgtgctcaattaacaatgagaaagcatgttcaaaagactatctacaccaggtggatagagaaccttggaaaaccaacacttttccaatcaaaattatttcattcgtagaactttttagtagctatttcaaatatcctttcatttaatgagcttggtatctgaataagaatatatcataggaaatgggagtcttagaaaatctgacactaaagtagaaaaaaaattgaaagaaaaatattccaaaataagagtggaggaattcaggacagcttatttttcttccgtgttgaaaattctctacaataatgctataataccttaaaaataacaatcgtgttataataatactaagcacaatttaacgggtagctttatgtatgttcttaggttaattatttcacctttcactacttcagtttcttcatcttcacagcaaggggattcaaatagatgctacataaggacctttcttataacaactctattgtgtgaaaatttcacttacatgcaatagatgtcaccccattcaaaaatctttcagcttcacagtagattatttttccgtaggaaaaacacatcttttgttaacgattatatgcatcttgcctcagaaacaataaatacaagaatgacagacgttttacgtctcagaaatttttcactaatacaagagcaaataatacaagaatgatagacattttgcatttcggaaatctttgactaatataatacaagggctatgacactgtgactttggccatgagaggatgggtgttatacatcacatttacacctggtttacccagtgaaaactggcaagtctcagacgagttagtgccctttgagtccatcccttttgtagtgcataagcttcaccgccattcgcagcatacacaacctgagtgctcacctgacccagggcagctaccattgcctgagttgactgcccagcccgataagccattaggtagacaagaatgtggtggatatgcatagcagtgcctttgaaatttgcatcctccttaaaatcaagctacatctcatatgcaaaatataaaattaaaagaaattcatgaatgcaaacactactgggtctaattttaaagtataatttaaataaaatagagtattaactacacattggaaaggaagaattttaagaaaaatctatacgagtatttaaaatgttggatttttgctgggtgacacagtgataaaaatccaatatttggtgccagacagactaactttctaggtttgatgctaagtatttagcacctctgagtttcagtcacttcattggtagcatgggcatgtggtaggttcctttctccttccttggataacctgagttatctttaattctgtggtatagtttataaaatgttggaaatattttatacagatccacatttcctttcaaagtttcttggtacgtgtgatagcaatacatctccatctcactgtgccctccttgcctattgatgaaaggaattgggaagaaaggctacagtttcttatcattgtgattactaatttgctaaagcattaaattaatagcagatcccaggtcctaatcctccagttccataaagggataaaggcatgtctattgtaccaccagctatgtatgctgttgtcttgttgcttcttgaaaatgaagctatttcttatgtgcataaataatctacttttttaatttttattttttgatgagtcttgctttgtcacccaggctggagtgcagtggtacaatcttggctcactgcaacctccgcctcccgggttgaagcgattcttctgcctcagcctccccagtagctgggattacaggtgcacaccatcacgcctgactaatttttgtatttttagtagagatggggtttcaccatgttggccaggctggtcacgaacccctgacctcaagtgatccacctgcctcagcctcccaaagtgccgggattacaggtgtgagacactgtgcccggccaataacccacttttgagactggaattttatagatgcacatgcgagactatgcggcataatttaatacatattgttttattgtggggataggaaaaacaaaagatatatttgtaaaattctacagtaaaaatgcagtgctagcactcagatcttcataaatgatagcatctgtcgccatcactgcttgttgcctctccagcagctgtcccccgcctatactcccctgctgggggaacctggatcaatgacaaacagaagctcaaaaggttagaaactcactttccagttgctcttgagccactggcagccatgacacctagttttatccagagacattggtggaaataccttgggggatcttcttggaaagattttcctcctggagagatatgggctagagctctaccccatcttgcttttggacctttggaaaactcagaaaatagcagaggcaataacctggtatccagacataactgagttactgaaccaaccccaataatcaactgcttctgaacttattatttggaaggaaaaatagtccttattgcttaaactgcttttagcctgcttttgggtactctactccttgcagttgaaaacatccctccgactgcctctcccactgttccactctggctctgagcctgcctacctcttgcttttatcctggtgtgatctctggcacacccaagcatactgccagaaaaaaaatgacacaaagttggccttttctcaatccctttgaatgcactgctcccacatgtcctgatgagagacgtgagaccctgaaatcaaattcccttaggagcctcagggaaagggactgaaaagggcagagcgggaaggaggggcaggcacaggtgggttggtgacactgaagtggcctaggcagctatcacatgccctggaggagccgcagggcacatgagctgcccctgaccccagcaggaaccacgggctgtgagctgcagcccctctagttccagaggtgacctttacaggctaaggctgagttgtccaattgtctgaatcctaagagatggtggctgagagaaatgccattggcaattgccatccacagggctgcagagagatggcggaagtttcagggagtccctgcagcagggagaagcaattctacagcctctgccttgattaatgatgctctgtagggcactgtggaaacactggcaagggttctacgaaggactgggctactaaggaactgctgagttgccagctgaggcaccttgctgctcaaatgtccccagctctctgcatcctcctctcgtgattcacccttgacatctgtgcagtagagaaggaacatatttctctgttatattcacccctcactgtagacggaaaatagcttcccctcaccaggagactgtctctagagagtgaagcccgcaaatctagagttgatccaactgtgaaggacctaaagttctagtcccaccttcagatggcaagcagtagatgccacctgggcaaagatgcttatgcctgcagagatcagcaggcaagtcccatgcaggtaaatcacagactggctactttcactaagacatgaagctcttcaaactttgggcagcagagcaggatgctttgtttataaacattggcaatctcgagttttctgaaaagcttggaatggctcacaagccttcaataaattccagtttctccaattctttgtgctcaagtgtactgacacagcacaaaatgaagtggaaatgtagcaagagatggtcgagttggtgacaaccagctgatatcactaacttgtctattgacgtcactaatatcaaaccatggctaagtttccccagagctgtgcccatgtaagcattgcagtaataatcataacagcaaatatgatgggatgtgccagacaccaggctcatgtgcttgtcgccgtttaatcctcatgaccctatgcaataagaatttccttttttttttttttttgagacagagtctcgctctgttgcccaggctggagtgcggtggcacgatcttagctcacttcaacctccgcctcccaagttcaagcaattatcctgcctcagcctccagagtagctgggattacaggtgcccacgaccgtgcctggctaatttttttgtatttttagtagagacggggtttcatcatgttggccaggctggtttcgaactcctgacctgaagtgatccacccacctcagcctcccagagtgctgggattacaggcatgagccaccgtgcctggccaggaatttactttctgtgtagcattggcaagttacttattcccttgaagctgataagtaacagagccaggactcaaatatgtgtctggtggagtccaggacctgggctttagaccacggtgctgtcccatgtcctctgaactggccctgggaagctccaccttgcgctccactcatcctcacagtgtctttcccctgacatgttgcttttaggaaggtggctaattaataggctccgttatttttcaggtgatttgaaagggcagttgcagacccattaaaggtcagcaagttcatggaagccagggtgactcaacgatgacttgcaatggtgcagcatgagagcatctgtctagcagtgaagtgggtccagggccaagctcacactgctgctggctctgccctcctgtttctatggtatacagcagactggcattacacttgcccaataaaacagggacattcctaattaatatcccaacaacactttacttagagtgtgtgtgtgtgtgtatgtgtgttatagggtgtgtgagtgtagttagagagaatgtgtgcgtattctgtggtattatagcataaatgatttgcatcatataaatgaaagggaacatcactactcttctgaacacagcgattccttatggcatcccatcactggcaagaattatgcttaagggttaatctatagcttctaagtcaataaagccatgtgaattaagcctacatcacaaggctttttttcctgataccaaccttcatggctggccatagactatagaattggattctggctaagaggacagttaaaactcaagtcatagaccttcccagaaagggaaatttgattcaagaattgaaaaatcaattgtgaatacttttaataagtaaaacaagacacctgaaggcctaatatgtactaccttagtgtttgttagggcagcgttctaagcttgcaaaagaacatgtgagaattttagaaataaccctggaatcaaactgaactttataggtttgaactacttttaaggggagggctgtgtgcacgagtgtgtgtgcctgtgtgtatgtgcctgtgtgtgcctacatgtgtgtgcctgtgtgtgtgcgcctgtgtgtgcctgcgtgagtgtgcctgtgtgtgtgtgtgtatgtgtgtgtgtgttggggacagtaaagaggatactccaggctgttagtgcagagacaattttcaaataaatttaattttcttttgtgcgctgccttacagaaaagacccatgtaaatgaaacattttgaggatccaagtgcttacttagaaaaatacaataaaacaactttaaaggagcctatgagaccgaaccttttgtaactcaatagtttgactaggaattcctattccttctgcatttgagcaccacaagccaattatttatcataaaactttctaggtggtcctcagtataaaagttgagaaagcatgtcacaaaacacacatgagcacttaaaacctttaaaaacagccaccttattctgtctttccttctgattaaacaacatcaacatgaccgcattttacttaactaagacaaaagatgtgaaaactccatttactaagcgagagagcgatgtactctaaatcattagcaattataaagagtacacatatttcattatgagagattggctatacatttattttctaacccatccattagtgagaaatattggccgcacatattagtggttgtgttggacgaatgatttatatttaaaatctcattttcacttctcagaagcactttggaagtaagtgttttgttcatgctgagcactgtggatggtttgcacctcctgtgactgcttcaggcagcttcgccaggctgagcgagcacaggaaccacgtgctatgcacacttgaaacactccaggtttcctccctatgcagacaacaacagccatgggaacttccctctcctctgtatcaacagaagtatagtggaaagcagaacccagctgttacgggtcaaactgtgtcccccaagaattcatatgtgggagccctaatgcccaggaccttgaaatgtaactgtatttggtgatagtgtctttaaagaggcgattaagttaaaatgaggactttagggtgagctctgatccactcagacttgtgtccttatgagaagatgaaatttggacacaaaaggaggtatgaaggatttgtgtacacagggcaacaaccatgtgaggacacagcaaaaaggcggctgtctacaagccacggagaggggcctcggaggaaaccaaccctgccaacaccttgatcttggacttctagcctccagagtgatgagaaagttaatttttgttgttcaagtcacccagtctgtggcactttatggctaccctagcaaagtaagacatctgcttgcttattcattgggcaaagatagatctagcattatgctgatgattctcaaaacatggcaagccttggaggtttaatgtcagctttgctcccattccagtaaaggagagccatcttctgtgagtaacgatttcaccaagaacttaaaattttgagagatgtctgacccatgtgattatagtaaatgaccaagtcttcagttaataatgctagcaacaatcatcaccagcatttattggatgcttatgatgtgccaggctctgtactgcacattctatgtgtgttatctggtcatcatccttgcaatcatattaggctgatatcattgttaatccagctttacagaaaaaggattctatcttgcccatggttacataactaggaagcccaacttggacccaggtaactcgtgtctggagcttatggttttaacctctaagctatattcactggtgatgttagtggccttacaatgcaagcatttgaaaatgaagtgatagccttattttttcctccaaacaagtgactatgatgataggggaccacattcttttgtgagcagggtctgctttctctctactcttctatcttgcccaccttccagagtttatccacctcctgcaggaagccttctggccctaccctatctgatgtggtttggctgtgtccccaccaaaatctcatcttgaattgtaactcccacaattcccaagtgttgtgtgaagaacatggtgggatgtaattgaatcatgggagtaggtctttcctgtgctgttctcatgatagtaagtctcacaagatctgatggttttaaaaatgggagtttccctgcacaagctctctctttgcctgccgccatccacctaagatgtgacttgctcttcttgccttccaccatgattatgaggcctccccagccatgtggaactgtaagtccattaaacccctttcttttgtaaattgcccagtctcagggagcatgaaaatatactagcacaccatccaaagggctccttcactcctacattgcttattgatgaaattcttcatttggtacttggtataaactgaccttatgttctcatgcacatttgtcatgtcttaccaacttctattcaataaatggatgtcagtattatgtgacagatattctgggaggtcaccttctgtggctttcatttgttagaaggaggttgctttgtagaggtcagtgtgtggagataagctggttcaattgatcccaataggagatcacctgaggttacctggacaaggatctggatgaccaggggctcccctcttccccaatagagcataggaggttgaacagcctgtaaacagccagcctctaaacccagactgccagggcccgagtgggtgagcatgtccctcaagggcaaagctgctgtcactcttgctgtatatggagggacccaccgttagtgtcagatgaacaaatcagttttctctcacatgccaactatgatcagtcacatagaggtttgcattgagaaacttacagtctgagatgcaggaaaagggttatccagaatcactgagaagcactttttaaaaataagagtgcttaggcccccccagcccagactgattgaactagaaactcctggaggagctgcccaggtggttctaacatacagacagggagagagctggagagaatcccagccctcatggtgattacacctggggagtgaattggttggttctgtgaagtgagagccacacagtaggtcatcaatatcagttcctatcccccttcttttgtagcccccctagttatctactaggcacataatagaaactgagtaaatactgcgggttaatggacatgtcagctcaaataagagcagagctttgccacgatgggcaagccgaacaccctgggggagtagagtgaccaacttaccctgattttaaaactgaaagtcccaggcaaatcagagtggttggtcatcctactggaagaagaagtgaggttcctacagcatctctgcctcccacctaaatcactgagattcaaaactgggagaccctcaaactcacctggggtgagggctgtccacattcctagctgccacttcactgtgacctaggacatccacccaaggggaagataagatatgtctccagcagtaagaggagttaggcatgttagcaccagatgagataggtaaaaaaaacaaaaaaaacaaaaaaaacaaaaaaacaaccaggggaaaacctgccacccagacctcaatattaaatttgacttgtaactcctatctgcgaaagctactgcctgattatagaagtgtcacatatatggttttgttttgttgtgttttggcaatgaatttatattagagtcacccaagactcctctgatgccctgcatggggacataccttcaagtgccgttttacagacattttcagctattttcagccataggtaaaaatttcaaaagacaattttggcagctataaaggacacttctgggcaattggggaaactcgaatatatatatggacaattagatgatattcattcaggtgtgatcacggtggcattgattagatagaaaaatgtccttattttttagaggtacatactgaaattttagggatgatatgttgtctgtaatttacttcataataattcagagaagaaaattggtaaatattaagacaaaaacaaaccatagtaatggaggatttgtatgtagaaggtgtttccccaactccacatggtgaaatatgatgaggtgatgaaggttttttttttttctttttttgaaggagtctctctctgtcaccaggctggagtgccgtggtgcgatctcagctcactgcaatatccacctcccaggttcaagcaattcccctgcctcagcctcccaagtagctgggactacaggcgtgcaccaccatgtctggctaattttttgtattttagtagagacggggtttcaccatgttggccaggatggtctcgatctcctgacttcatgatctgcccacctcagcctcccaaagtgctgggattacaggcgtgagccaccacacctggtcaatgaaagttcttaatgatgaggttggtcagtgaagagattgttagtgttcatcccatttactattaggggataagaaaatgggtaattctttttattttattttatcttattttactttaagttctgggatacatgtgcagaatgtgcaggtttgttacataggtatacgtgtgccatggtggttttctgcacctattaacccatcatctaggctccctccccatcccccccacaccccacaacaggtcccatgtgtgttgttcccctcaaaaatgggtgattcttaattttcctaatctctcaccccaaaaaatggttttaatgctaaagtctttgcaatttttttgaagcctgaagatttctaaggccggcctgctacaagaagtgcatctgagtgagcacaggttggggagctagagggagctgggcccccacactatcgttatggctgtgggaccttaagcaggtggcagaacttcatggaaactcaggctccgtctttgcaaagctgggatgggaccacatgaaatgctatggatgcagagctggcctgggacaggttagataatcaatgaatgaagattctcttgctgggatggaggaaggaaaaaaaaatgtaattttttttttcaatgtaaagcaaagaaagagacctgactaccaagtttagcaccaaccttccacgcctgtgggatagatgtattaatacactgaattaatagttactggaacccaaagctgtcccaggaactatgcatcacaggaagtagccctgtgacatttacattataaaaattatttcttaaagttaaatcaacataggcagatttctattattaattagcccaacctagatttctatacaaaggaaattgaacttaatataagttggattcatgttttcccatttccaaccttaagtataatggaaattactccatttatcgaacagatactatgggccaaacacatcactagatgctattaattttcatcttcagcacaccctaatgaagtggatattactacacaattataccccacttagcagaagtaacgcatatcagataggtgaaatctcatgcccaaaagccataactgaaagacaacactgccagcacgatgacgagaggcactatgaccttgccatcccaccgactgttccccttctggccctgctacctacaagccatagactgctctgggtctcagttgtcttccttggtaacatgagaatgatgatgggaatgagcccatgggatcctgaggattaaatgagctagtgtgttcatccatgcaaagcatttagaacagcttctggcatgtggtcagtgttccgggagatgaggctaatggatttaacaagtaaaatctggccagcagaccctttatgttgccttcatagtgaataaactggtggctcctatcatcactctccaatgggtgcaaaaataccgttagatagaaggattaagtgctggtgtttgacagcacaatagggcgactacggttaacaatagtttattgtatatttcaaaatacctagaagatttggaatgttcccaacacacacaaaaataatacatgtttgaggtgatggatctcacgattaccctgagttcatcattacacattgtatgcatgttttaaaatatcacatgtaccccataaatgtgtacaattattatatagcaatagaaagagagggctagaaaaattcaagtcttattcctcttgttatgctgttcagtagggctgaggctggcccgttcctggccttctggccccaaaggtcattattcagccacagcacaccctctggttggcttcatcactggctttctctgcatattagagtgatccagacctgctatgccttactggctgtactgcagaaatgctttctatgctctgactataaggttgttaaatccttaaagcttgttagggcagggcttcaaaactcttgcttggggttaatggtgtcttgtgatgcagagagcaagctgcctcacatgttaagaggaaatttctgtggctgagaatatcttgaaagacagagtttagccaggaactcttgaggataaacaagctttgatatattacattgtgtgcacataaatgaacattggtcccctttcagatacattccagccatactaagatggatgaacttaggttggtctagggttggtgcgtttcttaaaatgtttctgtgtttgtgcacagcacaagggttccaagctgagttggaatataggatgcgagggaagtggtgcattgcattgtcacaaaacagaggaaatgattcaaagaaacaaaaagagaagtatttcaaaagtaaaaaggggaatttcttccagccacagacataaatagaagaaacagttcattcattcactcactcgcctattcgttcaacaaatgctcatgggcttcttgtgtcaggcactgtgcaaggtgtgaagatagattaatgagcagcacttggttcctgcactcaggactcccactctggagcgagaaggcatccatcattgattatgtttggccttgggtaccacctctgtgtgctggacctgctttcagccctgaggggatggaatagggcctaatcttttcccaccctcagggctggtagttgtatcttccttggagctgatgagatggtttgagaccttcctcagagtagagacaagactgtcagccccttatatccccactcctgctgctttgcagtgcttctgcccatctcctccttgctgaaaaatgttgtggggaattgcaagacaggccaaccctaataattcatattctccttcttcctctccttccctccctctaaagaaatgaattacatatcccataagcatatataattaaagaaaattaaatctaatgtatccctaacccatcatgttcatgtttatatactctctgtgcttattactggctattaatactcctattgatcttagcttagaccaggaattcgagggtggagattttagttgctgttgtaattgacataaacatccttctgcctacctattagatgactaaaatccaatcaagtgattagcatttactgtgaacctgctacgtgtcctgcactcagtactatgaacaacatggaagaaagataggcacgttgttctgacccactagccacgtgcccagccagtagccccaggctgaggatgagctagcactcaattagaacaagcccagagcatcacctccctttctatcccaactcaatcctcttgggccctctcaccctccactttctgaagaatccctgatccaaagcaggacattttgacacagctgtgttgatatggctattttgctttgaggtatgttttatgacatagttgcaatgtgtattaccaagaattatgcacagcaaacacttctaatctttttctctcccgttcccacccccacttcatctgggagacatttatttttctgcattgtctaaactgcttttgaagtattgtcttctatttagtggtgttttcttcaaaatctgttagaaaggaattagtctttatggatatgttcctgacttccaaaaagtctttataaattaggttaatgctattaaatataacttacatatactgctgggtactgaggatgattagaagtgtatttgaagcttccctctgcgatttggggaagagagtaagtgcttctttttaggagactgaaaggcaaatggcactgcggagacaggaggatggggaaggccagcttcttttggcgggtcacaggggtaggtcgagatggtttggatttggggaacttctgattttgtaggagtagcagaaacttctggcactcactgacatgtggccttgaccaagtccctcaacttctcagagcctcagttttcttatctgtaaaatgggcatgacagtgtccactgaaacaaggtgacatcggagagaataaagaataaagtatttaaagctttatgggaacagcctgaaaagaagctggactgaacttggcttagtctcacctcacctgggttaacactgtcccatcccggtgtcatttgaggctggataattcagaaatccaacatgcttcatgtagaaatattgcctgggtctctcactgagaccatgggatcagtccacatccctgtaggtgaggttgaggtccccactgtcagtcaccttaagggaggttggtctggaaattgaagactcagaagagcagcctttgatggggatgaaaagaaggaaatgaaaaccaccaccttcaccctctccatcaacccaaggtctcttgcacatatccaggaacttccaggtggccggggcaccagggaattccctggagaggcaggctgggttgctctaattccctttcttttctcaaatccttcagtgatgtctcttgcctggtttaactgaggagtgtaactgtgagggacaacaggaaacaattttccccgatgactattcctgctatgcctcatagagccctccttcctggctttgtagagacctcctaaatgtcagacactttccttgaagtcacttcatctgggtaataagatgtggtcctgcccatttttgaaggtcaggctcagacttaagtgaaaactgccccaagtccagccaggtctgggaggaggggaggagccacagattacttctttatgcatgggcccctcctcctggccctagggttggttgggtaggagagctgggtgaggggctggagaacagacttgtctctggtgactgccctgctgtggctgctctctcctgggaggcatctctggtggtttagcttattttctaggccccactagagggtctcagtttctagttgctctcccagacctgggtccttcctatgtgacttggcctcatcttcgcccagctgctggtggccgcacacccactctcctctgatgttggagtggggtctcctgcaagtcagcagtgaccagtcatgcccatctctcagaaactcgcacttcaatggggcagcccctgccccctatactgggccgaacatcagtttacccccctccccccaacactgggctggacatcagctcatatccctccccaacacacagggctggacatcggctcatcccccaccccacacacacacactggactgtgcatcagctcatccccccgacacacacatactggtctggacatcagttcatcccccccccccccacacacacactgggctggacatcagctcacccccctcccacaacacacacactgggctggacatcagctcaccccctccccccacacacactgggctgggcatcagctcaccccctccccccacacacactggactggacatcagatcacccccctccctaacacactgggctggacatcggctcatcccctccctccacacacactggactggacatcagctcacccccctccctcacacaacacacactggactggacatcagctcacccccctcccacaacacacacactggaatggacatcagctcattgccctgcccccacacacactgggctggacatcagctcatccccctcccccccacacacacactgggctggacatcagctcacccccctcccccacacatactgagctgggcatcagctcatctcttcccagcgtagctcctcctcaagtggtggggaagagttcagcagcccagggactgagtgggaaatggagcattagttttctcttctcatagccagtcacagccttgatccccttagaagggcttctaatcaggggagcagcaggaagccaagcgaggccctccttatcctctccacaaagcagaggaagctgcacccccttgctccaggcatccttggagacagagggcatgctactgaaaagccacctccccataagctccaaagggagctgaactgcccacagctcactaattttgctgttggttatttttctattgaggtataattcacgttccataagatccatgatttttaagtgtacagttcagtgggttttaggacattcacaaggtcgtgcaaccatcacaaccatctgatttcagaacattttcatcaccccagaaagaaaccccaaagccattaacactcgcttcccatctcctgatctctccaggccttggcaatcactaacctactttctgtctctaagggtttgcctattctggacatttcatactaatggaatcctaggataagtggcctttggtgtccggcgtgtttcacttaggttaatatacttgaggttcatccacattggagcatgtatgagtacttcattcctttttatggctaaataatattcccttgtgtggagagaccacaatttatttactcattcattaattgatggatatttgagttgtttgtttcaaacttagatcttgggccactttgaaacctttattaggaaaaactctggatcttcacaccactattttattggctaacgttacaaccgaggttgttttgtggtaggcagatgaaagagtggaggaggtgtggggagagcaggtccctctcctctgctgggtctgtgcaatgccagtgaggctgcccttcatggaagcagctgagacagcagagccaaggccccagagcagttatgggcagcagaaagtgttttgtgtgggagcaaaatagaggctggaacaagtggtgtgtgaataagccagtcctctggggaggggaaaagccctgctttgcagcatttgctaatttccatggtataaatactctcattgtggccaatttcaagctacaaactaggtgacgctgaacacagacttgggagaaatatacaccatggggttggtacaaccagttccaggacaccactgggctggaactcagcttcctgcacatggatgagaaagcagctccctagggacctctgggaagcagctggagactctcagagggggtcagtttccagcaataaggcacctagcatctgcccaatgtgtgtttccctccccgatcttgttccaaaataccagtcacttttttttttttttgagacggaatttcgctcttgttgcccaggctggagtgcaatggcatgatctcggctcactgcaacctccacctcccaggttcaagtgattctcctgcctcagcctcccaggtagctaggattacaggcacccacaaccatgcccagctaattttttgtatttttattagagacggggtttcaccacgttggccaggctggtcttgaactcctgacctcaggtgatcccccacctcggcctcccaaagtgctgggattacaagcaccagtcacctctttgaattaggcagcaaaaccagagcattcctgggcaactagcctttggttactctaatgcttcctcatcatgtagggtcacgtaaaaagcccttctactcactgcaagtccctgactaccctaccagtggaggaatgtggattgatgaagtgtttggtcatagctgaaatacaaccctcttggagcttctttggaaatataataagggaaatgatagatcggcattaaataaagaatattgtataatagttcacaatcctatgataatagttcataggaatagaaaatgacaagtgttgaaattggaaaaagtctgattcttaatgtctacacctgtacagtccagtatggcagccactcacatgtggctgttaaacaaccgaaatgtgactagaacacattgagaggtgctataatatacacaccgcatctcgagtgtttgtttagtaaattaaaaaaatgtaaaatatctcagtaagttttataatgattacattttgaaatatatttttgctattttggataaaataaaactaaatcatttaatttcacttgctttttactttttaaattttaaaatttacattttaaattgcatgtgtgacttacattctgtttctattggatagcacaatactagatactattggacacctcttaatcaatttaaacaacaggagctacatttattaggttttactatgtgtccaacaccaaatgaaactatttatgtatataattttatttaatcctttcaactttttgataggactcgttatccctgtgttataaaggagaaaactgaaggtcagagaagttaagtaacttatccatgttcacacaaggagtcttaattcaaatcagtctttggctcaaaagtctgtgctgtgatgctttttgctaaagcaaatgaaggatttcctaatctctaatagacatataggttaatgggaaagacaatttgttagcagtctgtttgttttggtaactgtatattttgataggatttcaaatttagagaaaaattgtaagaatagtacaaggaactcacatgtacatggtccagactcaccatctgtctataggctagggatagagagagagaaaaagaggatttttcccctcaaaccatttgggagtaagttgcagacatcaggtccatatactccaagtactgatgtgtgtgtgcttccttagaacaaagacattctcttatttagtcacaatccaatgttcaaaattaggaattttaacagtgatataataccatttcccaatgatagtccatattcagatttcatcagttgtcccagtaatgtccttttcagctactttcccccattggttcagagtccagtccaggataatgcattagatttagttgtcacgtctccttaatctcctttaatctagaacagttcctcagcttggtgtgctgcttgactctgatatttttaaagaatgcaacccattattttgtagaatgttctttagtatagtttatctggattcctttaggatcagaatcaggttttgcactttcagcaagaatattacaaagtgttcctggtctcactcagcacatatttgctagctgcttttaaatattgtttatgagactttagcataaaagtaagaaataagtctttcaaaaacatttctagatttggtccaaatatttctagaaattggtccaaatattcctgtgcaaaacaagtgtaaatgttaggtgtaaaatatagataatgataaatatggattataataattataacatggctatattttcatattttcctgaccctgtatagaaaacaattatttttaattcagtctagcaatttgaaagaaagattagaatatatgagttggcgatggatagataggaaaagagagtgagtataaggtcatttaaccactaaagatggtttaatttcaaggcacctgttgtttagagtaaaataatttctttgttctcttttctcgttcttttcacttcaattcatatgataagtgctttgattagagtcatcaaactgccattgccagatccactgctatgctgcaagaagatggtgtttgttcagagttagcagcaaactcttataatctcatttcattcaaatgatgtttttattgcaagatgtaacaccagcaacctaaactgtctctgacagtctcatatttttcttgtttaagaaacagctgtcaaaaggatctgtgtgagctaagcaactgacaaattacaggaaaattatatttttaatcaatcacttgcctaaagtcatggaatgtggtttatagttatccagatataacgccatttagaaaccttttctttcatcatagggcatctagtaatttttatggttttcttcttatcctgtggccaaaaaaaaggatgtctaagacaaatgcactttaaatataaagatatagactgaaaggaaaagtatagaaaaacatataccatgcaaaatgtgagcttaataaacacgatgtggtgtggctatattaataccagtcaaaataaatttcaaggcaaggactatgaatagagataaagcacatttaataatgacaaaagggtcaattcatcagaatacatgacgacaaaagatgtatgtgaccttcaaaatatacaaaatatatagagaaattcaaaatccacaaagaaaaaaatggcagtgttagagaaatagaagtaattggagattttaacacctcttgttcaataactgacagaaaaaatgggacaaaaagatgggtaaggatatagatttgactatcaacaaacttgacccaattggcatttactgaacagtggtagaatacacattcactttttaagaacacacagaacattcaccaagaggctatatactaggttctaaaatgtctcaataaatttcaaaatattggctccctctccccctccccctctttgcatggtttccctctgatgcccagccgaggctggactgtactgccgccatctggactcactgcaaccccccctgcctgattctcctgcctcagcctgccgagtgcctgggattgcaagcgcgcaccgccacgcctgactggttttcgtatttttttggtggagacggggtttcgcagtgctggcccggctggtctccagctcctgaccgcgagtgatctgccagccttggcctcctgaggtgctgggattgcagacggagtctcactcactcagtgctcagtggtgcccaggctggagtgcagtggcgtgatctcggctcgctacaacctccacctcccagccgcctgccttggcctcccaaagcgccgagatggcagcctctgcccggccaccaccccatctaggaagtgaggagcgtctctgcctggctgcccattgtctgggatgtgaggagcccctctgcccggccgcccagtctgggaagtgaggagcgcctcttcctggccgtcatcccgtctaggaagtgaggagcgtctctgcccggcagcccatcgtctgggatgtggggagcgcctctgccccgccgccccgtctgagatgtgaagagcgcctctgtccagccgcgaccccgtctgagaactgaggagtgtctctgccccgccgccacgccgtctgggaggtgaggagcgtctgtgaccagccgccccgtctgagaagtgaggagcccctccgcccggcagccgccccgtccgggaggtggggggggcagcccccgcccggccagccgccccgtctgggaggttggggggcgcctctgcccggccaccccgtctgggaggtgtacccaatagctcattgagaacgggccatgatgacatgacgatggtggttttgtcgaatagaaaagggggaaatgtggggaaaagaaagagagatcaggattgttactatgtctgtgtagaaagaagtagacataggagactccattttgttctgtactaagaaaaattcttctgccttgggatgctgttaatctataaccttacccccaaccccgtgctctctgaaacatgtgctgtgtccactaagggttaaatggattaagggcggtgcaagatgtgctttgttaaacagatgcttgaaggcagcttgctcgttaagagtcatcaccactccctaatctcaaggacccagggacacaaacactgcggaaggcagcagggccctctgcctaggaaaaccagagacctttgttcacatgtttatctgctgaccttccctccactattgtcctatgaccctgccaaatccccctctctgagaaacacccaagaatgatcaataaatactaaaaaaataaaaaaataaaaataaaaataatttcaaaatattgaaatctttaaaagcttatttagaaccataaaattaaattagaaatcaataacaataaagtatctaggaagtctccaaaggcttaaaaattaaactacccccttgtaaaaaatgcacaggtcaaagaggaaattataagcattaagaaaatattttatacagaaaagtgattttaaaacacatatcaaaaattcagagattctgctaaagcactgacttaagagagatgtatagcttcgaaaccacctttgcaaaattatgatagaaagaaaaatctgacatggctgattccatctcacttctaacctcacaggctagctgtttttgctaattcctgggcatgggccaagctaactttgggagaaatttggtttatattttaaataacaatagcccttccctaaaactaaactgaccttgtaaaactaatgaaaggtcatcaggttaggagaatgagaggggctggaattctgctacaatgtaaagtaggtaaacaattacagccattttcccggaggtcacaagatttgcaacttccccaattactcctgcagataacattactattgtagaacccaagtttggctttttgaagtgtcttttcagggttttgcacttctaacaaccagatggccccatttggacctgtgacttaaccagttctgtggccccacctagaagccaactcagctcatgaggaccatatttcataccaccatcattgcatccccaaccaattagcagcacctatagcctagccccctgcccaccaaactatctttgaagaacccctaacctccaagccttcagtgagattgatttgagtaataacttcgtctctcacctggtgtggctagtctcatgttaattaaactctttttttatggcaatgccttgagtctccgtgaactgattttgtttgtgcaagaagaacccatcgggcagttacagatttaaatctgaaatcactgacttgaaatatttcttcttttaaaatatgttttcacattatgaaactaagaaaacatgggtgaattaaactcaaaataagtttaagggaagaaagaaagatcagcagaaatcaaagaagtagaaaacagataaataagagaaaattagcaaggacaatagttacttttgtgaataaaatggtaacattgataaccccacaacaagacttcacctgagggttgatcagagaatctgagccaatatgagtgatacagaatatggtaggaatctgacctcatgcaattgtgctgtaaaccagaaataaaactctaagcctctcagccaactgatggatgttcctcttggccaagggcattccaaagcaaacccgaaaaactatttaatgcaaggatggaaaggagtgggggtcagacatgcctcattgtaacctcttccctgtggaattcaggcacaactgatcagcattaacattaaaacagagattctaagactgagagaacaaactgtttgtagcaataagataccaaattccaacctgactctagtatagtattgcatgacaagtagcaggccctgaaagaaatcagtcttttgtcccaaaatatacttatttgatatattttgaaatggtcttgcaaagctgtctcttgtgggggaaatttacattctatagagaatcccctgttctttccaggtctttttctgatcctgaagaggttggctgagagtctagcaccttttgagggtctgaatagaaaacacttgccatctattgcctctaagggcggccacctaggagacttcatctacataagaaccctgttttccacagtcctttatcttaacccaaacactcctttctattgattccaggtcttcagataaccaattgccaatcagaaaatctttgaatccacctatgacccgaaagccctcccactttgagttgcctgcctttccaaactaatgaacaccttatatgtattgattgatgtctgtctgtaacttctgtccctctaaaatgtttaaaatcaaactgtaaaacaaccactttggggacatgttttcaggacctcctggggctgtgtcacaagccttggtcactcatatttggctcagaataaacctccttaaatagtttatagcatttgactcctacgttgacaggggtaactggttaaacagtctatgtgaaacaagtgctttggtgtccaaagcctatagagccaccagtcaggaacaaaacctggactagaagtgggagaaatccaggataaactggagcctcggaggacccactaggattcaggggcacaagctggaacgtgcataggcctttcactgcctctgagcgtccaacttcaatgtctcaagtgagctgctggtgctcttgttgtacagctgcataggtggctcaaccagggttgagaaaagctggaggcagaagcccagaaatgaggggagctgtagacctggctcttgcccccacatatatgatgaaccaccaaagaaccagcaatgtgcaggagctcagccacgccttcccatacatccactggctgccactttattctactgtgaaccccaaatatctgaaagaggtctcagttaattttgaaagtttattttgccaaggttgaggacacatgcccatgacacagcctcaggaggtcctgacaacatgtgcccaaggtggtcagagcacagtttggttttatacattttagggagacatgagacatcaatcaacatatgtaagatgaacattggttctgtctggaaaggtgggacaagtccaagtggagagggggtttctaggccataggtcaataagaaagaaatggttgcaatcttttgagtttctgattagcctctccaaaggaggcaatcagatacatatttatctcagtgagcagaggggtgactttgaatagaatgggaggcaggattgccctaagcagttctcagcttgatttttcccttcaacttagtgatttgggggccccaagatattttcctttcacactgtcttgcacatctcacataaatttctcttggggacaaccctgactcagaaccaaacagagaagggaattctgagaaaggtagtttttgctttagcatgttgacacaatacctatccacactgattgagaaaacaaagaaaatacaaattaccaaaatcaggattgaaagaggtgatatcactatagattttataaacatttatgaaaaacaagccctggctcattcattgctcaccttcagaatttcctggttgtgtgtgctcctgggagaaagaaagtttacattaaaaaagaaaaagacatccaattacctatccttcttgtttccttgctgagttaaatatgcctatgtattaaagcaaaaatttaaacaatcgatcaattagagtattaggatgtactttgctaaaggattcttcaggcagcagaacatggacaagtttcatggtaggttatttcactgacaagctcaagggcaagaacggtgaaatttaaaatcattagcctctgcgcattaaagattggtgagaaatgaggacaacatttcagaaatgaaaattatatgcccacaatactttcaagcagaattaaacacaatcttaagacccacttattgccggaagtgaacattctttgcacatgctccagctcccttgtttccttacaatacagattctttgccttttgtagtcaggattaaaggacataacatccctcactatgcagagcgttgtgcaaatagtgatcatgagaaaggagcctgtgagttaggtttctgctttatttgcccatacaaagagaacagagccttctagagtagctttcccattgtctcattatttgtcatacaactcagcacacactggaagacaatcacaaggtgggcacacagaggtttgatcgaggtcctgttactcaaagctcccctttgcctctatctctattgccaatgaggaaatgtatctgatcaattaactcacactagcatacagaggtgccttttcagatcagagtatttctaaaaagatatctggagccgagcatggtggttcatgcctgtaatcccagcactttgtgaggccaaggtgggtggatcatgaggtcaggagttcaagaccagcctggccaacatggtgaaacgcggtctctactaaaaatacaaaaattagccaggcacagtggcaggcatctgtaatcccagctacttgggaggctgaggcaggagaatcgtttgaacctgggaggtagaggttgcagtgagccaagatcgtgccactgcactctagcctgggcgacagagcaagactctgtctcaaaaaataaaaatacaaaaagatacctggagaaatcaactacaatatggatttataatggtgggatatcaagcactggtgaggctgagttagaagagatttggctactatgggaggaatttttagactctgcttgaatcctttctccctctctctgcttccttcattgtttcgtggaaatctagaaagtgccaactacctcataagcaggtgggttaatgcctgccttgactggatgtttgatctcattagccgacagtttcctttttcatcatttccaacagcgccattgtttatgaccccagatagacctgggatgctagttaccagcctgatcatgtccactgtcacatttcatgtcttctgtcagaatttatgatgtagcatcctttggaggtcactaaaaacatcttcagaggaaagagcttctgtgaatccactgagtcataaaaccgtctcctagagaggagtatttctcatggatcagaagctgtctggaagagcagcttgcaggaaggaagagttaaatgagacagtcggttgcgcaaacacttgagtgagaaagcagtgagagcgattcgatgagctttttcttcccctaaaattaattacaattttaaaggctggcagcttgattttatattgcaactttcttcaattaaatctacattttttctatcttacttcatgtcatctcactaattggttgcagcatctacttgtgctaccaccaaactgtctttgcttaaaagaagctgttttactaaaagaaaattaaaaatgtaaatgtatcctatcttatattgcctcttccttttctgccagaagagagggggaaataactgatcagtgaaatcctaagaggcacaaactggagttacatttttgcaatgtgcgggacagcgccatgaagctacaatgtgtctggtaccctgggttcattctcatccagtcaatgcatattgagcacccactgtatgccaggccctggtctagatgctttggggtctaagcaggatcattcaagtgtccataagagcttcctccagcttcccaggcatggcagaatcattagcacactcaaaactctgtttctggtggcctttccccaaaccgttaaaatcatggcaatgtcaagtgaacaattatttccttattttccttcaataaatgctggtagctattgtattaccacctcctccactaacatccattttgaaaataatggcaattcagtaaaaagcttagaaagcaaaacaaagtaaaattattctgtttcattaaacaacattaaaagactgggttcaaaatagggtctgtgttatactcagctgactctgacgaccaagtcagcagggaagtccctccaatttcttaccatctgtgggtgctagaagggcttgcaaacctgctgtgtgtaaaaggtggcagtcaaagaagcctcttaaaacaagaaagggatttgaaatggctgtgtccaactggttgtcaatctggattccaggggccctagaggttcaaggtgatgcctccagaccactaggaggagctgttgagggtggtcaaggggccaacagactgcaacctccagttccccaccccaacttcaacccaaagggtatccctttcacctgtcttacctaccagtgtcccttgggacaatccatgaaagaaaagagctctacagaagaaaagggctctacagccttaaaaataaggaaacccactggcctatgacctgctgtagcatgctagagggcaatgctgatgacgtattctctttgggactcaaatagtttgaaacagcgaacgttttgatgaatgacgaagtaaaagctgggttggccaacactgtactgttacagatgatgcttgctcctctcctgcagttctgcacactcctccacccaacatcaagtgcctggggaagccaagccagcgtagcacagcccccagatacttcaacattcaaacttcagacattcaagtccacatttccatgcaatcctgcataatgtaagcaaatttagcttgcttaaaaatagatactcccaaggttgggtaatgcacggccttttttgctgtaaaccaagatgcagcagatggagaccttaaccattattctttttgctccttctttttctcagttcatgacacagtaaaggatgatttcagagaaaagttaataagaatatgcatctaatgaggattgcaaaatgttcactttgcagtgatggataaagccattttggagtcaatcctaaaaagccaagactcctgggtgtcagtcaggatggagcgatgcacagaacctagaggggaagcagtccaaccccccagcagatgcatgagtttatgcagaaatttgaaacaaggctgccatttattaggtatttatcatgagccaggacctctgtaaatagcatctctaattctcaaaacaaccttttaagttaagtattttcattttacagataggaaactgaggttcagagaagtagtattatgtccaagccgccaagctagtaagtgacagaatcaggttgcaaatcagatctgcctgattgttctcttcctgcttcccacactaccccactgtttgcacatctccagtgacagggaactcactgcctcccaagccacatgtgtgctgaatagcgctaaggaataaaaagcactttgtgttgaaatgaaacccactgcctgttactgctacacctagaacctgcatctgccctttggagccacacaaagtccatcaaagagggcttccacaagacagccttccaaggaatttgaagaaagattgtggagctcaatttctcttctctaggttaagcctcctggggctggggtgtagggctcaggatgtgggtcctggaaccagactgctggggttcaagtctctgctcagtgacctactgggtgaacgagatgaatttcaaattttcttttactcagtttcatcttatactctgtctcatccataaaatggtgtgaaagcaataacatctacttttttgtgtttatgagaattcaataatttatagaaagcacttgccatacagcttgcaaacagcaggagcttaataagtgacaatgataatcagtactcatggcttccagctgtgtaacaatcctgctgtttctcctcttgaccttttcttattgatgtaggggcctcttgaatgtgatgaggaaacagaacggaaaactccaggacaggcctgagcagcttgtaagagaagagcatcatcgcctttattctaaatgtgatgcttgttttaacgtaggctaaggggagttattagtttgggctatagccacattatactggtaactcgtattaaacttggagttaacagaaaccccctgatatttttattccaccctccatgccatcctaactcaagggccctctgaagtctaaagctgaaaggtggcttactcgaattgagtggtgggtaaatgggggttggttatgcataatctgtttttcagacatttgaaattctccatattttttaaatgagggatttaaagatttccaggacttagtctgggccaacttagtgatgattgaatgaaatttattgaatggacagatggaaagatcgatctggtaagtccatggatgtgaaaactgaggatctgagattttaagtaatcttcctgggtctcataaccagccagaattaggcatcagtcttcaagcctggggaaagaaactggcatttattgctttttgtaccagacccctcgccaggggctttacctgccttttctcatttaatctttacaaccaacttatgccgacaaaaccaaggtccagacgtcacccagcaatgaatggcagggctcagctccaaacccaagccaccagaccacacactgcctctctccagctctgtgtcgacgggtagttctatatgcaaagctatctatattgttttaaggataacaagtaacattaagcaactatctgctggctcctcttctatgtgccttatttctttcaactcactaatcctgatagcaacaccataagatgtgaggcagggaaaatgtaaatgtcttgctcaagttcatcgttaataagtagaaggactgagatgtgaactggatggtctagtctacggactgtatatttaacaaccacagcctattgattcttgtctatcaacctggaatccagaaatacatgcctcatgtaggcaccctccagaattctttgtcctccctttctcgtgtatgtctctttccctagacccttacctcctttcctcctaccccatcataaatggttgcttcatttgaaatgatctaacacaaaaattggtgaaatgattatcaaatttgcagagtactcaggttgatgtgtgtcaaacacatttattatgcaaccaaagatgccgattctggcttgttttctcaattctcagctctaaaagcttgacaaggaacattactagaaaaacacatgctctgtagttaagatggatgaaactgcagtttgtgttgattttggtaagacagctagttaagaacatgtttaattacctgatcccaggggttgtgtttgaattaaccagatgttggttcctctctgtactggaagatgttctcaacggattcttattgatgataggaggatcaatgggtaagtgtgcttcaaagtaattaataatgcatgtttaggttagagaattcaatagcttaagagaataaaatattttaattcctatatcatcaacagcagttatttgcaacaaaggacgactttgtcccccaggggatatttggcaacacctagagactttttggttgtcacaactggggtgagaggtgctactggcatctactgagtagaggccacagcttctcctaaacatttacagtgctcaggacagctccccacagaaagaattatctggctcaaaatgttaatagagtggaggctgaggaacacttatctataacaataccaaaataatacaaatagtaatgagagaaaaggtattgatttcacgatacagaaaatgattcataataatagattgacattggtccccaccatcacatcaactctattaaaatgaatgataatggttataatttagttaaaggtcacactgaagcagagttatcagtatccaatgaaaacatttctagccctctttttctgtagaaattgttccacaacagccagtttttctgggattcacaaattcagggataacatgtaacacatgggcttagcattaacataactacagaaggagaattggcttataaacctgaagacaggctcagcacggtggctcacacctgtgatcctagcactttgggaggacaaggcaagcagatcacctgagatcaggagttcaagaccagcctggctaatatggtgaaaccttgtctcttctaaaaatacaaaaattacccagcgtggtggcgcatacctgtaatcccagctacccaggaggctgaggcaggagaattgctggaacccaggagacggaggctggctgcagtgagctgagatcgcactactgcactccagcctgggtgacagaatgagactccgtctcaaaaaaaaaaaaacaaaaacaaaaaaaaacctgaatgcaaacgaaggttcaagtgaaggtgtcacctgcttgggtaagtcatataagtcccatgcctgggtttccctaatcttataatgaaagtaatagaaaacttcctgaggcattaagatgattatattaaataaagcatatcagccccttaataagaagaaaacactatcctacagaaggttttattagaagaatcgttattacaagtaaaaacagacacctcaaacagccatagaaattgcctgataattctaaattctaataacaaaccctaaaatagttatgccctagtcaattcaatcaaagacttagtcattcttttctaataaaacatgattgtttgaattaaatgctcttaataatatcccagaattagataatggcagtgcacctggagatttctctattatcaacagaatagcatctctttgagaagcagaaatggttgagtgagttctgaaatgagactagaaaaaacaaaaatagatatggggaaaaagaacaatgtataaaacaatctttcaattaagactaaacagaaaaaagaggcatataggccaaaatctggggcagagaacactcttcccttatggttttatgacattagacaagtttttcagtttcaagaggacaggcacatgattttagtaaaaggaaggctgtattgaataactaaaggcgtgaaaatagaaggacaaacaatttttaaaataaaaaaggcaaacataatgccctaaagcatatccttggttaaataatttatttttccgagttgcatggaacaagagcaggttaaactgtacccttctgtaaaattaagtagaactctctatataagggtatcaggagcagagggcccccttttaatctgtgaagtgatgcactttaaaaattccatgcagtgctggcccaaggctaaattttcatatcaaacacaatgaaattcaggaggaacttataccaaattaattttctcaaagcatacattgatttgctcacttcctacactccgtgcaaactcaaaagccagctgaggctctgtaaagagtgtaagttcagaccctcctcctgccagtttccctcccattccctctgttggctgtcacacctgctattatgcacaactccctccctgaattagggccctggatcccctgctttcctctttccaaggctgcttttgctgctgcttttccccaggaggaatactcacatttggatcctagccagctcagccgccacccctccaggaagcctccctgacttccccagctggaaggctgccagcagcccatcctgcagcccttcccaacagctcacctatcacactttttgtattctagattattttgttcctggacccaacaccatgctaagcaggagaggaagaaggaaagaagggagggaagccctggcttcagcatcctttgagcacttgctgcttgcttgcccagcatttccccaacatccttgctcttccaactcttgcataatcctggggagtcagcacactccacttacagaggagaaaactgaggctcagggaggtcccctgctctttcccccactctatgtggccacagcttctccaatctgcctggggcaccccaccagtgatgtgttgcttactgtaggctgcctggacacttttggtgcgaatgctagaaaaatgaattccactgacagacctcagcattacttagtgggagccaaggaggccagttgctttaagcactcctggagcattgcctcaggccactggataattctgggcaagctgatagccactgccccagccccaaacgccctgggtcccctatcggaaatagattccctcacaccaagccgatgcctgggctgcccacacactgctatgcagagtaacagggtgacaggccgtagcattcatggctgccactgtataaatattcctagcatggaaaagcagtcttagactcatggtggctttttaggattatatttacatcaaacgcagccactaacttcgggaacatcttgacaacccacctctctccttcctctctggggtagctcttgtaaccctcccctttgctctctctgtgccagccccattggcctctttgtgtcccacaaatgcactgagcatacttgagcctagggctttgcagtgactgttccctctgctagaacactcttcctttgcacatccatatgaccagattccctttatctcttccaagagttggctcatgtgtcgccttcctgactggggcaccgttctgaaaattgtaatcacttctcacccaagcacaccctccatactcccaagccccatacctgttatgtttcttgtctctgtagcattcaccactgtactaatattctatttatattctaactttatttttttcttatttcttgtctccacccactctttccccaaagagcaggcacttttgtcaaatttatctcacttttctatcttaagtccacagcagagtgtctggggcatagcagcactcatgttcaataagtacttgttgagtgaataaaccttagaacatttccctggtattatggttcgaatgtatgtcaccctaaaattcatatgttggaatctaagacccaatgtgtgagtattaagaagtggggcctttagaaggcaatgaagccatccctcatgaatgagaccagtaccttataaaagggccccagggaaccatctaggtcctttttgcctttctgcctccagacatgtaaggatgcggcaaaggccctcgccagatgctgaatgcggatgccgtcatcttggacttcctagcttccagaacggtgagaaatacatttctattgtttataaattactcagtccatggaatgctgttgtagcagcacaaatgaactaagagacctggcagattacagacctcattttaattttaaaaacagaaattaggatgagctaatatattaatttcctctgactgctctaacaaattaccataactttgatagcttaaaacaacccgaatttattatcttacagttctggagatcagagtttgatatgggtcaaacgaggctaaaatcagggtctcatctggcttcattttgtcctggaggctctggaggagactctgtttccttgccttttccagctccgagaggctgcctgtattcctgtaattcctcgtaattatgttgagcctactcagataatctaggaaaatctcctcatctcaagatccttaattcaatgacatctgcaaagtctcttttgccatgaaaagaaatatatattgataggttttggggattagggcacggataactttgggggaggcagattattctacaggtaaaaactttttgccatttacataatctttaaaaaaagatttgattaattatgcaaatgtttacaacatacagaggaagtacaaaaaatgatgtctttcaccaaaagcaaacagctaacatttgtcatatatgtttggctcacaacttttggaaataaaacgttgcaaatacagctaaatccccaactcatttctcatttccttccttcttacctttcctcaacagtatccactattaaggctaatgggaattattgtgatgaatgtatttttaccatttctactgctaggactcagaaaacaataccctgaaatgcagacctcagaagcagcttcagaggcaaaagtttttctccgaccttctcctgctctcctgtctctcagttccattctcccctgaggctaggcagagaaattagaatctctcttccccaaggcaggtcatagaaaccagaacccctcttcccaaagccagccataaaacttaaaaatgttactttaacttttcctccacctgtctgtgtaaaaacggaccatgaagaaattatctgacctacgttatttgactgtaggtcttaagagccccattcgagagagggttctgccccacgcccagaaggaaggagtgcatgctctgagaggctgagaagaatctagacagacgggccttgctggatttcctcactcagtcagctattagcattagatcataccttttctgtccaatcatatttctacatggttgttgaacttaagcataaaaatggacaatttcccctgtagctttgagtctctgttctgaaggctcccgtgtatacactaaataatacactaaataaatatgtatgtccattctcttattaatctccctcttgtcagtgattttcagtaaacctttagaaggtaaaggagaattttcccttggccctgatactacaacaatagtatatacactattgtgtgttttttaaatttagataaatggtgaaatactgttcatttcttttgctgtttgcttttatgttttggaaatgtacctacgttggtaccatactgatctacttccagcctccactttattcagagacctcagattatttatctatttttctactgatgggtagtttccacttacatgctatgaaataacagagctgcactgacacccgtggatatgtcccttttgtgcaaatgtggatttctctaaaggagaatgtactgagagatgctacatcactctctgaagtggccacttggaccaattagcatctccagtgatggtacagcgtgcccattcctctacgtcctcaccaacactaggtatgagcatgcttattaatggtcctaagctgacgtaagtgatgtgtgtgtatgtcactgctgtttcattttgaaatgtgcttatttgtgtgagaggttgagaatattttcatgttgacggatcatgaaatattccccctcaaggaatttcctatttatattattttccccatctttctattgagtttgtcttttaaatagggattctttttacattctggttactgatattttgttaattacatggattgtaaaatctgttcttatcttttcatgttttttcctgcttcttggcaagtgagtttatactgttaattagaaaactttatcacactttttatttgtgacttgtacttttcctatcatgaaaaaaggttttcttcaaatcggttcctattctgttctcataaagatatttgcccatgttttcttctaacagttctatagttttgtttttgacattcatatttttacattatagaattatttttaatatgatggcagataatgatcaaatgttatcttcttctgaaaatgtgctagaattacttgtttggtctattaccttctgctaattttaaagctgcctctgtcatataccaagcttgcatctatatgtggctcagtgtccaggctgcctgacatcccaggacaatgctgcactgatttactctctacagctccatggtaagtgatatggttaggctatgtgtcaccacccaaatctcatcttgaattataatccccataatccccatgtgtcaagggagagacaagatggaggtaattggctcatgggggcagtttctcccaagctgttgtcatgatattcaatgagttctcatgaaatctgatggtttttgtaagtgtttggtagttcctcctgcattcattctccttcctgctgtcttgtgaagaaggtgccttgcttccccttcaccctctgccatgattgtaagtttcctgaggcttcctcagacatgctgaactgtgagttaattaaaccattttcctttataaattacccagtctctggcagtctttataccagtgtgaaaatgaactaacacagtaagctttgctatctaataagaaaaattttgttccccatcccagctttctcccttaccacacatatggccacttcctttaaatttgtctgggaattttttcactctttactcttacatatggctttaggatcagcttgtccaattctgaaaaaagtcttgttaggacttttattagactaacaatgaaagtgcagaagtgatatgtcttctttataatattaaatcttcctgccaatgaactggtttttatatatctttctaaatatttcagtaaagtttttttttttaaattttgttgtatctgcaaatgtctgttacaaatatcaagtttagtgttttttaaaattacattttataattaatagttcctaggaaataagaacagtattcatttttatattgatctatgcagtcaccattagaactgtcctatttctcagtagcttttctgtagctccactggaaatttttgtgtcaacaaaattttgtctataataacagcaaaataaaataacagcaattttgtttctgtctttttaagtcttatacattttatttatttttcttattttactgcactgatttaaaatctttttttttcaatgttgaatagaagcagtgatgaaagcaaggaaaattttattcctaacttcagagggaatatatgcaatgttgcactcttcaggtatgatatttctgtacattttagcagagactcttcatcaggtaatgctgttcttttctatttttagattgctgttcttttaatgaatggatgttgaattttggggaaaaaaacaactttttttttttccttttacatttgagatgcagagcagtagcgtccttagagaataaactctggagtcaatgcctggaccttaatgaacagtggatgacatgttattttcttttttcttcttttaacttttattttaagctcaggggtacaagtgcaggttttttacataggtaaagttgtgtcatgggggtttgttgtacagattattttgtcacccaggtattaagcctggtactcattgtttttcctcatcctctccctcctcccatcctctaccctccaacaagccccagtgtgtgttgttcccctctatgtgtacatgagttctcatcatttggttcccacttgtaagtgagaacatgcagtgtttggttttctgttcctatattagtttgctaaggataatggcctccagctccacctatgttcctgcaaaggacatgatctcattttttatggcttcatagtattccatgatgtatatgtaccacatttcctttatccattctgtcattgatgggcatttaggttgatttcatgactttgttgttatgaatagtgctgcaatgaacatacacatgcatgtgtctttatgatagaacaatttacattctttggggtatatacccagcaatgggattgctgggtcaaatgttattgctgacattaggtctttgaggaagtgccacacggttttccactatggttaaactaatttacactcacaccaacagtgtatatgtgttcctgacagattcttttcaagggcatgcagttctcacacttgttggtgtcagcacttcttacagtcttaagattgaagattacaaagagcttttgttcttgtggattatgtatctatcaatgtttatcatgttacaaattaaagctgatattgtaaaatattgattcattttaatacaacaataataaactcaatccatgttaagtaacatatttttgtatgaaaagtatcatattctccagaacaaaatgaaatggagtctgtctgttgagtgacatattaaactcatcccacctatcttcaagcctaatactacttcttaccttccagccttcaagcgattgtaatcgtatgttatacttccacctatgttataaaccacacaatatattattatttttgctttaagcagtaatttttaaaaataatttgtaaaaataacaaaaagctatttaaatatagctacatatatgcaagcccaaatctgacttcaagctttgatgtggggggaactttttagcttatttattcacttatgcattagtcatgattgctgcatctgcagaaactcacgtgaaaataatgtgctaaattgtcaaatgtttggggtggcttctactgttggaccatacacaaccttcacatttcagatattcttactttagggactattgagcaagcagagaagaaagccttactatgcactgtttttattaattctcttccaattgctttcttttcctgcccttccagttgtagttaaacagcggggagaacagagttgtcctgctggggcagtggttcacagctccatggggcccctaggtgtgtgcgacttactatcattgtccagcattctctctctgcctcaggtcctgcaccctaagcctggccaaagctggaagcaggtgaaaggagagttgaggtggtcaaaagaagcatagagatgccctacttccacctccctggcatcttcagtccgtaggactgagggcacttccaaacagcctgcctttcccagagtcctctctccttgtccatcagaacaatcagcagaacagagatcttggaagcataatgatatactttttcttcctctttccctcttccctccctcctcaccttcctccctcccatcccttccctttctttccgtcccctcctctcccctttcttttcccttccctttcttttctccctttcttcttcttctttttttttttttttttttaagacagagtctcgccctgtcacccaggctggagtgcagtggcacgatcttggctattgcagcctctgcctcctggtttcaagcgattctcctgcctcagcctcccgcatagctggaattacgagtgtgcaccaccatgcccagctaatttttgtatttttagtagagacagtagatgttggccaggctggtcttgaactactgaccacaagtgatctgcctgtctccaccttgcaaagtgctgggattacaggcatgagccacagcacctggccccttctttctttccttccttccttccttccttccttccttccttccttccttcttcttctcttctctctctctctttcattctttcttttttctttctttctccctccctccctctctcccttcctttcttcctctcaatgaacatagtattttgaatactatagtagactaaatagtgccccccccaccaaaggtccatgttgtaatacctggaacctgtgaatatgttaccttacatggcaaagggcacttactttgcagatatgataaagagggactcagaaggtgtcagagtcaaggaagacaatatgacaacaagccaagaggggtttgaagatgctactttgctggctttgaaaggggccagagccagagaatccaaggaatgcagctctagcagctggaaaggccacagttctcccctagagcctctggagggagcgcagccctgccagcaccgtaggttcagcccggatgcaccatttcagacttcggacctccagaactataagagaatatattgtgctattttaaaccttaaagtttgtggtcatttgttccagcagcaacaggaaactaatttgagcaccaagcactgtatctgatataaccaaagcttcaaaggagggtgcaggcccaggagtcgtgtggccactgccaggagagctaaagccataagagtgagtggggaaggggaagagttccaggagccatgaacggattactcaagcagggatgcacattgtatataaaagaaagacatgaagtacagttacagaagagagattggggcattgtcacttcacagaaggcaatggggagtgtcaagagattgattttccctccttttccctgggctgtaatttctccctctttcttggctattcataaacagatggcaatggaccccatgagtggagctttaagccaaaatgcccaaatccatagagacagaaagtaggttggtgattgccagggacgggctggaagggagccgggggaaaatgaggagtgactgctaagaggtagagggtttcttttgggggctgtgaacatgttccagaattaaacagtgatggttgcacaactctgtgaaaatactaaaaacccactaaattgtacattttgaaggggtgacttttaaggtatgtgaattatatttcaatacaaataaaataagtagatagatagataaaagcccactccttgagtggctttcattcaatgcagcagaaccaaagagcagccagcgccctccaagcctaatgtgctccttctcaccacgcagctcttggccacctcgcttcctgcctctctcagttgattccctgtgactctatccctgcatggaggagagacaagtgaaaatgaaagacagatgaatgtgtcaagttgagagctctttacatgatgaaggtgtttctgcttcattgcatgaaacagaacatagagcggtgataaaacccagccagatcctttgggttgacttccaaccgcaggtggtggttactcattaggaaagagcgaacactgtaatgacttcaaaactaaggagtgcaaagccaaatattcactaataatcactcatcaaggagaacagatggcacacgttgaacactcctgaaaatgaaagcccttggctgcaggggtgaatgtccaggacccacagaaaatatcaagtcagatacctcttgaagcactgatgggaaggtgcagctggactccctggaactctgaagctgaggtcagagatgactctgcttctgtccaactccttaatcacatttctacaaggcactaagcatctccatttttctgtctgtagaataggtatcttggttgccatacaccaacttttctgatgttttaattaaaactaggaaaactgtcttttaggattgggctgctagcaatacggaaaggagcacaaatttctgggtaatggagagaaaatctattctagttcaagtatttggagttcctataaatcttactctatatacaattgttgcttgagaaatagtattaccaatagaccgcaaacaatatgctttttaatcaactgtgtctcatctgagctgtgatacatctttggccttatgaaaagagaatgtttatttaataagagcagctgctgtaatttttcaaaatcatacctttttctgaaattattcccctgctcacaaatggtagtgacttttgtgaaagagtttattttgattattctattagctggatcagtaatcagaaaacttgctttgagggaattgtttccagatcatgtcatatcacacagggaccccttgggagtcatctacataagctttctaaaacctaacttttaaacagcagcaacagtcaaacacagtggatgtggcgggaccattctcttatgataaggttttgtacttctaaaataggtttcctactcaaagttcggaccataattaatcagtcctggttggagacttataccaaaactgcaatatatgtgtgttttaagcatgatttaaacataacttttcttttctttttttagagacagagtctcgctctgtttcccaggctggagcgcagtggcatgatcacagctcacggcagccttgacctcctgggctcaagcaatcttcccaccttagccttctgagtagctgggaccacaggcacatgccaccaagcctggctaatttttttatttttttgtagatgaagggtcttgctatgttgaccaggctggtcttgaactcctgggctcaagcgatcctcccacttcagcctcccaaagtgctgggactacagacgtgagccactgcacccggcctaaacatagttttccaagcacactatggtcattatctttaatttatgggagaattaaagagttgaaatgactcttcactcttttgaagtggtagcaactaaaaaacatagtagttttttagttttggcagtagttatggcagagagattggaaccactggatgctggacttccagggcatgatggctcactcgataggtgaggatttgccacccatggagaagggggcctcaggtacaagtgccccacaggccatcccctctgcactctgatatctcaggtagacacctcaccttacctccctcaggtcttcctttccaagagtcaccactctgtccacactccacctttcatttccttcttcctccttccacatttgtcccatagcccaaatctgagctctcttctctttgaaacttctctccatttccatcaatgcttagtgaacatctgcagggtgtcagaagtttaaaaagtgacattcatctaagaacccaggaacagccaaatttatgtgtccctggccagcctttcctttgaagttcctgagaaacccatacagcagaaagtcaccaagaattagacatttttgggttactattttggcattgtctccaactaagttgtcctggtcagcttgggactgaggaagtttccagggacatgggactttcagcttgaaaaccaagacagtctcaggcaaattggggaaaattgatcactgttgcggattcaattctgtgtccacccccacctcaaaattcatatgctgaagccccaactcccaatacctaagactttatttggaaatagggtcactgcagatgtaatttgttaagatggggtcatactagagtagggtgggcccctcatccaagatgactggtgtccttataaaaaggtgagatttggatgcagacaagcacatggggagaaggctacatgaagatgaaggcggaggtcagggttatgcagcaccagttaaggagcaccagcgattgctggcagaccaccagaggcccggggacaagcatgggcagattctccctcacagccctcagaaggaactaactttgctgacagcttggtctttagcaaaaatctggactcatataacaattatgttggaaggtcacagatatgggaagggttcgggtaaaatttgaggagtaaggtgatgctgaaaccacggagagggaacgaggtcacttaaagctttcccaggcttcaagaggccttgcatggatagtaggaacccatgtctcattcccaggaagcacactgggattgggactgtggatgggaccttggtaggacttcctatgaaatgagttaggagtaagcctcctaggcccagaaaagaccccacatgaagcctgccaaggagtccctgccactatccgccctcagggcactgagctgtacttcttaaataaagaatatgagccacagactagaggagccttctgtaaatgtcctggactctgccatattttcttttctttcttttctttttgttttttttttttttgagacagagtctcgctctgtcacccaggctggagtgcagtggcccaatctcggctcactgcaagctccgcctcctgggttcatgccattctcctgcctcagcctccctagtagctgggactacaggcacccgccaccacgcccggctaattttttgtattttttagtaaagacggggtttcaccgtgttagccaggatggtctcgatctcctgaccttgtgatccacccgccccggcctcccaaagtgctggaattacaggcgtgagccaccgcacccggccgactctgccatattttctaggcttgcatacaactcagaagcagagaaggaaaacccctagcttatgaccaagacgaagtttccagtgagtctggttggtgggagctcagaacagattaaagttgatttagaaaaataaaaacactctgacatttttcatgtgcacagatgtagggtaagactcatacccactacccattcattgattcagacaagatatgcttttaactctgcaagctgaggtccaacaggctgatgtctctaggctcatttcttgtccaagcttccctgccttagctgagcagcagttgctacagagagagacacgtcttccccaaccccaatcagaaagtcaattgaggagattcctgaagtgctatagccgtgctgtgaagggtggcgggagattaggcagagatgggagtgggataaaaaggaaacagagaaaccttctgtgctgtgaatggttggggagaggtgaagcagggatgggaatgggatgaaaagaaaacagagaagcccaaatggatgggagacaagaggaagacagacaatgtacagtccagccctgcagaggcctctgggcccctctagaactccaggaggccccctcagctccatggtttgcattcctgccccagcgattcctggctttcatttagaaccctgggtgtgtattagtttgaatcatagcccacagcttgctgcactgtcaaatttgtgtctgccaacagaaaggaatgtatttcagccagcaagagagggaactcaggatttgtggcaaggaaaaatggaatgcagtagaggagaaaactccattagaaattctctgaggagccaggatcattcgtcttcctcttctggttgtcagtgggccactctctgcctacagctgccaccatctctctaaaggaaagaaacacagcatgcttatttgcctctgctagttgtagaatcagacagatcgttgataaagccctgcgtcaacctctcaacctaaccttttactttatcagtatcctgtcctctagatgggagatgggagtgggagcccaatccttttcttttcttttttcttttcttctcttcttttttttcttttttctttttttttgagacagagtttcggtcttgttgcccaggctagagtgcaatggtgcgagctcggctcactgcaacctccgcctcccgagttcaagtgattctcctgcctcagcctcccgagtagctgggattacatgcatgcaccaccacacccagctaattttgtatttttattagaaatggggtttctccatgttgatcaggctggtctcgaactcctgacctcaggtgatccacctgccttggcctcccaaagtgctggggttacatacgtgagccaccgcacctggcccaacccgctccttatcaaaaaacttcaccccgttgtggcctctttatccttcacgtgtgtgtcctgtccactagtccgtctttccatgattggtttgcacacggccacttcagacctccctactgcccaatgtatctactgttatcttcctaaaactcatgagctttaaccaggaaattggactttgaattcaaaataagtaaaacaattagaagaccagaagtacagggagtgctctattttacttcttgctgtttgtgtttatttccccagagacagagcactacggaagggagccccattcccaagcatggtgtccaatacactggtgagtcttggcagattatgaggcaggtcacagacaattgctatcgtgaattaaaatctgtgaataaatctctttataataaagtagggagtatccaagagtatccttataataaaattacatctactcatttccatttggatatgccctcttgagtggaagaaggggatggagtacagttggcacacacctcagtcacctaactaccaaattatggttgttaaatatggctgtaataaaaaaatttcaagcttttcttgaaatctagttatacccatggggatgtatttaacacgtgataccacttgcctcttcttttgacagaaagaataactgggctcagtaatgcacctagagactcagattccagacctgcccacttgctttactatccaaaacaaccatgacacatgacttctctggcggggtgttggccaagacaaactgaactatagaagatccttgacttgccaacgttcaaatgatgaactttcaaaaatagcgaaactggctgcagagcaaaagcttttcagctctgcacaacaccaacagatggcgctaagtgtcacccttgtggagagcagagggacctcggaagggcctttggaaatctaatctggttttgagttcttggtgggaaaatgcacctttaagttgggggagtttgaagacgttgccaagacacgtgctgcagcatttgatcttttctgccgcactggcttctgcaattaacatgctttcaccagtgaaactcaggttgcggggagagcattcttccaggttcatgcctgttgtcatggagtaattataattcatgtctccgttcacagtgtcctggtttgtagaataaaatatctggtccacccacccagtgggatctttgagaatccattcattttagagtcagcatctgtggctggttccaagactgtaatttgcttccttggcaaatgccacactacatcaaaagggggcaaaagagtatgattgctctatttttacttagaatccaagtggtaatttatggaatacaggggttctcaacctcagcactattgacgttggagctggataattctttggtggttgtgggggaggggcgagggcgggagtcctgtgctttgcaagatgtttagcagcacctctggcctccacttgctagatgccagcaacacctccccactctctcccaatttgtgacaaccaaatacgtttccagacattgtcaaatgtctttaggaggcaaaaccatccctgtatgagaaccaccattttagtgctttgtacaagtaggattcagtgtacaaacctgagtcgattctacctcggacagtgatggtacctggaatagcacccaaaatcagggagtgagaaacgcttacctttagcatttgaaagaatgagctggtggtgatgagctcaagatttagagtcagacaggtttaggtttgaatgtggccctgtcactttgtaactgtataagcttgtgcaagttacttgatttttttgaacctcagtttcctcatctataaaataacagtaatacctgcctcttcaggtggttaacacttaaatcagttcaatgatgtaaaccacttagtacacagcatacactatgtagtgtgagctactaccgtcattattatatgcaacatcatctcttctcagatttctataattagccttggttattatttcggttatttacttcctcatcagagtctttctttagttgtcagcaatttttgaaccctctttaacaatagtcagcacttgtttttttgcaagaaatgattctaaaacagtttgcaaatttctacataagaaattgatgcaataataacagcagcagcagtaatttctataggattactgagatagagctatcatcgtggccaggcttgcttctatgtctaaattccagacattcttgatcttaaagggcttctattaccagaattcagaagcactgaatcaaaattcagaagagaatgttctagattaggaatcaaagtgccttgacaatgagattgtacagtctggctcatttctatggttccttggagattcaccctctccatgagaaaagaggccatttgcaattctgcctgattccagagcccttttatttgtttactgggtactcatgccagagaaaaaaggcagcttccagatccatgcaaatcacattgcattagtgcttatatttacagataaacagctccattaagcactggaaaagccttcttatacttggacaaccaggtgaaaatatataaattgaatttcacactcatggcacaaattcatccttacaatacagtcccccaaagcacttcaagtgattttgtgtgaagagtttctgagatgaaatggtaagatatgactgctctgagggagggggcaatagggagaggagttacttcattagcattgtcagctttgtcacaaggtgacattatgaaagaatttagcctctttgtagaccattaagggaataaatacatattgtaatctaattggcaaaactgcaaaaaggccccatctggataacccaccactttcattatgatgtgcttatgaaagatatttgaaagtcaaatatctgaattttgaagaagaagaaaaaaaaaggtttggcctactccttgtttagagagaagatatagataacattccaaacaatggtttgtatcggtgctgctgagctcaaggcccaggcaatgaggtgggtgtggtaagggtctcctcaggccgatttagagcctagactgaaggtggcttctagttacctggactcaggtatctgtctcttcccagggctgctgtctttcctgctgggacagggagaatagaggacaggcaactcttaatagtaaacatccctcagagattcattaggagtctatagcagggatggcagagtccatcagaactgagcagattctcagccaactacctgcacccccaccccacacacatggggggtccatggagaggatctctaacctgctgcctgccagcaagccctagcattactcactaggagatgttaggcaagttaccttattttaccaagtctcagtttcctcatctgtaaaatgcggattcctgcgcatagtgggctgtgagaattaaatgggatgacaaatgtgaagccctgagcacagcacctggcttatgggagtgtcccttacccctcctcctttctaacataggagaaggtagagattctcaattcctctttcaacagcaataacaataacaggccaccacagtctacaaatttctgtatgtcacgggattcataagaaattgagaagtacatttctttcgaggacaaacacactcaattttttttactgtatttctagtatatatagagaaaagcaaaaaatacaactccaagagacctcggtagtagtctctcctctccctgtaatgtgttgtgtgaccattgatattcccttgatcagtctgattcctggttacctggacaaggtgatcttcacagtgaattctagctgtgatgtttgctgactgattctcctacatagtcaaggctctgtagagtgagcctttcagggattgtctgtgaaccctttccttcctccagaaacatttccccatccacatggctatatgagatctctggctttccctggccaaacagggttcttccaagtatctgatccaaatgagtgagttcaagttcttcttcatgagttgttctggaattgagaaagagctataggaagcaatgagatatagctgaaaacctgctgacagtcaccttgccagccatctggtgaaaaatagtctgcagcaagagagaaaaaagccaacactgagagagaagcagaaaggagagatgcagggagagtctagtctgtacttgactccctagttctgattgtctcacctgtgcccctctcctttctgaagttttcctttcttggattctgtgagccaaagaattctctttttgttaaagctactttgagttcgttctctgtcccctgcaaccaaaaattctgatttggagcatctttttatgtgatctaagcatccctatactcatctaagatggcatggtttttaatattttattaaacctactgttatgctacccttgaaattcagcttctgttgcaacaagcttttatcgcaagggaaaacagggagttcctccatggtatataatcctgtcctctccaggtcccacagatatcctctctgtgagggcccaaaaaagaggaacatgccacagagtaagccaacaccagccagggaggatggagaggcagagctggctggggtccccctgaatctgctgctgttagaattttctgtcagtgtggagtttattaagagtggatctaactttcagaggagagtgcaaattttctctcaagccagttttaaaacatttaggcagagtaaaaagtcaaaaaagactttaggctctgaagtcctgcattctagcctgacacaggagggtttccctggtggctcagctcttacatgaagctctgtttttttgtgtgaaacatcaaaaactcaatgtttctcagaaagttctgaaaagaatcttatttcccaggcaacagcttttcacttgctgtcttccccctgggcctccacaaattaatcatgagtataaataaaagcactactcaagtcggtgactgcggccctgccctgcctgttgggatagcaatggagaaatcaagaacagagtgaggtcctaagaaaagcagtggagcaactcaaggctgagtgtccagactatagctgggcggctgcaatgctggtcaaaaacagggcctgccaagctctgatgctgcaggaacacatgggagcttgccttcacaggcaatgcctcctgacttcgcaggagctggatgcttcctgctttcagaggagcccgatgcatcctgataggaggcagatgtgccttttgcatctgatgccatccactgacaaggagtgtggactgttcactggctcttattaaagaatgcctcagacactgcttataccaatattttacaccacagttcaacttttgaagggtgtattgttttcagtgtcaaagtaggtcaatctggatgctttaagctgcagtaacagaaaaccaactcaaattgattaaacaatttggggatccattgcttaacaaagaggacatcaaaagatagggttagctttggtttaattggcagaatcaggctcatgatataatcaagaccgaggttctttccaggactctcctctgctatccagcctcaactgcatcctaaagcatcctcttggtcatagagtggcttctagcagcaaccaggcctattcccttgttcacatccaataggagaaagggtgagtttcttatggaaaactttcagggaggcaaataagtatgtttccagaaatttccagcaaaatgcttctcatgtctcatcaacgagctgcatatcacatgccaattcctgaaccaacccctgataaagaaggaggaataccccttggacccatcaggaataatcagtcaggctctagggagccaagggaggtatgtggattatttgggaaagggtagatagcagaatcaagtctggtttctattagacacgagatgggaaatacatggctagacaggcatccaatcatactaactagcttaaagtctgaatagcccacttacctatttaggttgcagcttctacacaaatacactttgcaatacagttcttcaactcccacctccatattcctcacctcataagaagcagcaggagccttcatcaggagagacaggataggaaagttgctcgggttgttctgagaatccttggctgggttttctcttgcagacccttaatgtagtacggtaaagtcttcatctagacaagggcatttgcaacatcttgacatcaagtgtactgactagaaccacagttcccacactccagggtgcagaagaatcttgggatgggggatcagctttgttcaaaatgcagatctctgtgccccaatcctagacattctgactcattgggtttggatgagactcaggaatccgtattgaacaaatccagcgtgagattgggatgcgggttttctttggatcacacagagaaacaatggccatgagccatgtgtcgtagtaggttggactccccacaagcatgcccagagacaagggtctttcatgacagtgattaactagaaagtgttccggaaaaacagttaggaaatggaaaatgggaccggaaagggaaggaagacaagtcaggctgcaatattagtgaagtcccatggaggtgaacctatggcttggttccacagagaagctctggaaacagtggaggacagtgttgttccagtcagcagagaagggagctggaatagttatactccacctcaccctgtaaacttcagtcattggttaatcactgcagggttctagcagctgggagtagaaagcctttatcaggagccattgtccacaaaaatggtaaaggtgtcggataggaggtatgggcaggacacctacattgtctgctcctcatattgtaagtatattcaatcacttcaaaaattttatatgtgaattatatctcaacaaagtgttattcaaacgatagattttaagagatatactgaagaactctatactctgagctccacagtggaccatgaaaccacacaacatacaaaggatgcagattgtcacactacatgcaggccagactcaggagcaggataccatgttcaacactgactcatagtacttcaaatcagctatgtggtctcctcatagtttaataaaattacacgaatatggtcaggcacggtggctcatgcctgtaatcccagcactttgggaggctgaggagggcagatcacttgaggtcaggagtttgaggctagcctggccaacatggtgaaacctgtctctaataaaaataccaaaattagctgggcatggtggtgtttgcctgtaatcccagctactcgggaggctgaggtaggagaatcacttgaacccgggaggcagagcctgcagtgagcctagattatgccactgcctccagcctaggagacagagtgagactccatctcagaaacaaaaaaaattaaatgaatatttgaaaaaaatgtatatatggacagtagcacttaggaactccctgtttttccctgaggtaagagcttgttgcaacagaagctgaatttcaagggtaacataatagtagagacaaatgctcatataatgaattcaacaaaatcatggttgcctactggagattagagatacaaagatgcctgagacaggtttctgtttgcaaggagcttagaatttcatttattcatccatttaacaaacatttgttgaacacctataatgtgcctatcactgacctagtccctggagaatatccatgaatacaagagacaggttctcttataattgaagtggagagacactcagcaaagaggtgcatgatgaagagataaacaaacttacactaaagtgccagtagtgatgagttacggagagaaaatggcaggtgagggggcttgacttccaaacgatgggagacctctttgagcaagtgtgtccttaatgttgtcaaagcctatagataaaagtcaactgggggggggtcaaaatggcagataggaggcaggactaacttgcagctctcactgagacggacagagcagcatgtggagactcacatcgtgaacttttgctccaagaactaccgcaggaacataccaggaaagctgagagaatccacaaatgctttgagggaggtggaatgctgctgcaggctccacgggacagctgaggaactgtgagtgggcttgccgtctcagctgggaggcttatagcccgcggcaagttttcagccctgttcactggctgcccggaaataaactcggtgctgttgcaggggcacagtgggagtgagaccagccttttggtacttggcataccaaaccccatcttagcacctgcctcagagaaacacaacctacaacaggcatcaaagaaaacttcctggaggaaatgtttcttcaggcaagttctgaaagactgataggagaattaggcagaagaatgagagaaggagacatagcatgtgctagttaataaaagttcaattccactttcatctggggctcccttgttctgtgttgaaggctgtttcttgctagcgtacaggagaaaatgtagtttactcattctgttaatggatattgagatggtatcacaaggaggctcaggggagagatacatggatagatctctgtgcctggactcagactttgagaatatttgtgactcatgagatttcccctcaaaaggtagccactgtgcagatgtcagtcagccctcttccttggccagcgcagagcttgctcatgaagcagaggctgtgcgtgggctccacaacatggacttctctctaaagatcgccttggcagtgccatgggactgtacaatttgatggcagcgacaaccaaacctaaaaccccaatatggtgtaataatctggcagtagcttggtcataccaggtgcttttcaccatggaagggcagagcttttccctcactggaataggccctcttacctggacttagatgtgttgcttctgcccatgacgcttttgccagcaccatcctccatgacttactggatacatcatggtagcccacacagcatcccttctgttctagaaacttccttcattgtgaaaaaagtgtccctaggaggcactgggctaaggagccccattatcccatccacaaccttgcgttttgctagattaaataaattggagcaaggtgtactgttaggttgaaccatatgaaaatgatgatattcaaccattttctgacctataaaaatgacaatttcatatgactcaatccaataactagtggggtttcggtgaggctctcctaggagagcagactactgcatcttgagtcatgagaggtaataaaactgctaggcaggagtgatatttagaagcataaatataggaagaagcatacatgagcccccaaatgaacagaccatggtagatatttctcatttttcacacagagaatccagacatattttctatgttgtgagaatgtcaagctcatgacctagcacagccaagcagatgcttctgtctgggactttgaactcaaaggagtgaggcagtcagaggcgtgtgcgtgcgtgtgtgtgtgtgtgtgtgtgtgtgtgtgtgttggctgctgtggattaaagagttcagtgatgcaggggtgagtcttacaggagggaggagcaggatgttcaggggcagcaaggccagcagcagtgagtgtccagctgggagcagtgggatcttgagcatattcccagtgcagtttcaatcggtcatgcctcacctccttttcactcctgctcaaacctagttttccagtcttcccattgagtgtactagcttctaaaccctcttacaatgaatctttttttctggttatattaaccagagtagtttctgttgtttgtaactcaaaacatttataaatacactatcttttggccagaggttttacactgctttctagataatggtatttaatcagattttttttcttttcttttttcttttttttagacagaatcttgccttctcacccaggctggagtgcagtggtgcaatgttggctcactgcaacatctgcctcctgggttcaagcgattctcctgcctcagcctcccgattagctgggattataggtgtgtaccactgtgcccggctaatttttgtattattagtagagacggtgttttgccatgttggccaggctggtctcgaacttctgacctcaagtgatccacccgctttggcctcccaaagtgctgagattataggcgcgagccaccgcacctggccctaatcagtttcttgacagtaaaagaatgcacctgtaaagtaaaccaagtaaacagtgggcaacgaggaggagggcaggtgtattccttttattcactcctctttagttattggttttttcatatgtttttaaaaaaattattgtgatagcaatttgtatttgttggaaaaatcactcattttatttagactttcaaatttataatatacaagtatgcatggtactttaaaaattttgtgttttcattgctgtaacatcttcatatttctaataatgttcatttatttaactgttttttaaaaagatttgccaaagggtaatcaatttattgtagcagttttcaacagagtgatttgatttattaactatactttctttttatactcaacttcttttgccttcattacatccctctacttggcaggagaaatttgtttcttttctaacatcccactaaaattattaatatggtgatttttttctctttcttcttttgtagcaataaaagcatttaagttaattaatctggttcagttcaacaaacatgtatagtgtgcctactatgtaagacagtcacagagccagagggcacaagataaataagacatgaatatgtgtccccaggaggtctaaagaagggaacaggcagatgaaaagatacatttaaaatgatagaaatataatagttacctttagataagattaatagttatttttttcttctatacatttttgttgttactaatatttcaatggtactttttctttttttttgagatagagttccctttgtcacacaggctggagtgcagtggcacaatcatagctcactgcagtcctcgaactcctgagctcaggtgatcctcccgcctcagcctcctgagtagctaggactacaggtgcttaccaccatgcctggcaatgttttttttttttttctttttagtagagattaagtcttgctatgttgcctaggctcgtctcaaactactgagctcaagcaatcctcccaacctcatcctcccaaattgttgggattacaggcgtgagccactgcatcctgctccatgatacatttttgaaaatttaccaacatttcattcatgaatacatactaaagtcagaaaaataaggaaaatgtacttttttaaaagaaagaatatgacagcattaaaactagtggtattaagcctcaaaatctggagattctagaaagacctctgggttttcatggaggaaaagtgtcaaagaaagacaaaaggatgttccaggcaaaagaagcagtatcaacagggacccagcaatgggagaaaagcagcattgtgctggttgaatgtgagccccctgaagcctgtctccacatgtgctgactgcactgccatatccccgccaactgttgattagtacatgtactacagttgggcctgcagtgctagacttaacagatgccccatgaatatgtgcaaacttgaatgaagatggatggggtaggggtagagcaccatttcccacgaggccattgggagcccttgtgacttttagaaatgaaagaaaattttactgcacccagctctgtgttttagaagaataggatgtccctttctacaattatgcaagaattctagtggtttttcccttttaaaaatgtaagtgaaatttaagcctgattcctacagagaattaatttttataaccactatattctgccatgaggagggttaattactgttttccttctctactttctattgaaactatccatgcaaatgaaaaaaaaatgtgaggaacttggcacaaagcaaagccagctatgacttatctaattaatttgactggaaacccctgggtattacaggtcctcctcaaaagaccatccttcaaaggtaggagccaaattctcagtaattggcttgttctgcaaccacccagctatgtttatcttgagaaagatatgtgggtctggtcgctgtctccagccacctgcacccagcctcccacctgctgagctacgtcatggtacccagggaccagtgaaggcaaggtaaggctgggaagcccaggctccctgcaggccagagagtggagcagggtgagggggaaagagggataatgccttcagcaccttccaaacctggctccagatttggaaacacctgaaacttcagataaagtttatttatttatttattttggcctatagtcagacgtgttattgcaaatatagaacactatattgttaaaggacagtctggcattcaggcaatgaaggacacgctaaatgaaaggtcagtatacttaattccattaaaaatgttaaatttctgtatgtcaaaaaattcagaaaataaaagacatgataaattaggaaaatattgcaaatgcttgtatccaattattgaatggaaagagaagagtaaaaatagtactttatataatgacctcaatttcataaaaataatacatacatacattttaaaggaagacggtcaaaagaagacattcttgctagtgataatataattaatttttgtgtttatgcatttctgagacctgtattttcaacaagtatttattcttaaatatagacatttttaaaagtaaaaaaatagttctacttacttctgcgaattatcttgaggaaataattaaaccaaccagaagtatacagatgcctactctaactttattattataaaattggaagtaacttaaatgttaggtcatagtggaagacctaaatgagtattgtatatgcactctaacaaatatgataaaatcattcaaatggtaattatgatgattacataaagattataaatatgattatgatagactgttcgaagaaaaaaattaacaagatatgtgcatattatgtaaatatgtaaaatttatcatttggacaagaactagggggaaatgtgtaaatataaaaataatcacattagcaaatgaagattatggatgcatttttctctttttttaaaaaaagttattatattattgtttatgtttcaaaagagtaggatgagattgtcctgaggcacttccattataggttagaatgccatgagcccttgctctgtccagtgctggcatccaggcttctcagttcagtctgtccacacttgtatcagtccatttgtgttgccacaaaggaatacctgagactgggtaatttacaaagaggtgtcttttggctcgtagttctgcagtgccatatacaagcatggcaccaatgtctgcttggcttttggtgagagcctcaggaacttacaatcatggcagaaggtgaaggagagcagtgtgtcacatggcgagagggggagtaagagaaggggagtaagagacaaaagggaggaggtggcaggatttttaaacaaccagctctcccctgaactaatagaaggagaactcatgaccaccgggagagcaccaagccattcacaaaggatccacccccacgatccaaacacttcccacctggcctctcccccaacactgaggatcacatttcaacaagagatttggaggggacaaacacccaaaccacatcaacactcaaggctgttttagagaagactctgatttacaagttaatattatcctgagtagaaacacaagtatgatactcagagatccaaagaaacagtggtaaactggcatttatttttaattgcaacaattggaggattctgagaaagaccagctaaaattatgaaatccttaaacttgttaaagcatctcacaaactatttccaccaaggttcagcttgttaagaatgataaatcaatagaattattttttcctccagaaatcatgatcacacaccagacacaaccttgttagtttaatgtaatgtatgaaatgctcttccatgagcacaatgttcagacattgtttatttggactaacaaaactctgatgaagaaatcaaataagaaagtcctgtagctcattttttctttaaaaacagccaatcactggaaaaacacacattgacagaatctatgtagtcccaggaatgagacatgctgggatccactcatggctgagggagcagggctcaggcctcatacagagagcaggccagaggtttagcaaaatgacctggagttcagggctgggctctgtcctcatgaccacagtaaaagcactgactgagcgcctgccccctgcctctgttacatatgtgacctcatttaatcatcacaacaactttcccaggtgggttactattagctccattgttcaggtgaggaaattgaagctcagcaaggcaaggttgcttttctaagagcacacagcaagtgatggaccccctgggtctggcacccaaatcacctagcgcctcacctggtgtttctccctctacattatattaactacaatgtaacaattagtgacttaatcttggtaccttacctatatgacttcatttaatgattatgaagtaccattatgtattatttttatcctctaaactttcctaaagttacagagctaggaggtggcagagatagggtaggactcctgtctgtctatctgcctaaaactgcaaagccctcactgtttccagcaatacccagctgcctctccttgtaccaagggtgttagaagagcatatccccaacacagcctgctcaggataaatgcattttatcatgactgctcttctcagaaacatgctacagtctaaaaaaccttaatcaccatgtcataaagtgcagtgactaatccattgtactgtgattatcacccataatatgtagagacataaaaagagattaataatgaaggtagtcaaataatacataggactgatgattatccacaacaaagtaaggagtgagtggaacgtgtttaaggagaaaagtcgatgccggatctgagctgtcagtttagtgctctccctactcagccagtcacccactctgctggtgactttgtcttccatgttactgggtgatgtttctttaaaatgtcttgctgtgcaaagtatgcactcctggtccctattcaacccccatgagaacgtcacaaacactcctaaatctcacatgaagcagctttatatcctggacagagccctggcttggaagtgagaaaacctggccaaggttcgtttctgtcctcagctagctatgtgatcgtgagcaagtcacttaatctttctaaggctgagttccttcatttacaaaatggggttggtgatacccaaaataaggctgacaaaataaggttcgctggaaattcaaatgctttgggttaaataatacaggattagctgatttaaagtaccaatgttataaggaaaataatctaacaaatgcagtaaaggtcttggcacattttgatgctagagttggtgggagttggaacagccaagcactaggaaagagttctgagtcgagaccaggactggaaagggaggctcggtgcaggtcaaaccaggaggaaactggaggcaacatcatactgaaaggtacacaagttgtagcccccctcctttaaaacttaactcctgcagtcaccagaggcaagccctgagcagcatctgcctaagtaagcgtctgtgacttgcagagtggtcgtcctggcccacagctcttggagagcactgggtggggcacgcctggcagctcaaacagctgagtctttcactgagtgtgaagacagcctgatcctttaaaaagagtggagttaacccctcctctaggtcaatctcagcagtaattttccaaatgctgcatgatgcattcatgttatgaccccctaaagctcttgttttagttctagagctagtctaagactatttaccactggttttttgaatctctgtgtgtcatacttgcattttcacttagagtaagaccaacctgtaaatcaaagtctgccctcgggcgcggtggctcacatctgtaatcccagcactttgggaggccaaggcgggcggatcacgaggtcaggagatggagaccatcctaactaacacggtgaaacccagtctctactaaaaatacaaaaaattagccgggcgtggtggtgggcacctgtagtcccagctactcgggaggctgaggcaggagaatggcgcgaacccgggaggtggagcttgcagtgagcagagttcacgccaccacactccagcctgggcgacagagcgagactccatctcagaaaaacaacaacaacaacaaaaaaaaacaaagtctgccctaaaacagccttgagtgtggaccgactgaattgagaggcctgggtaccagcaacagccaaagcaggggttcatagagccctcacctatcctgaaagtgcctcaggacaatctcatcctactctttggaaacataaagaataatacagcaactttttttaaaaagagaaaactggctgcagttgtggtgtcctggtgactcatgcagcaaattcaactccatctttacccaaatccttattatttcttctcctgcaagccactccttaaagagaaaatataaatatcgctcttcagattcaagatggtatagcttagatgggttagtgttgttattgaaaataggaggcctcagccgggcagagtggctcacacctgtaattctagcactttgagaggccgaggcgggctgatcacttgaggccaggagattgagactggcctggccaacatggtgaaacctgtctctaccaaaaatacgaaaaaataggcttcgtggctcatgcctgtaatcccagctactcaggaggctgagacacgagaatcacttgaacccaggaggcagaggttgtagtgagccaagaccatgccaatgcactccagcctgggtgacagagtgagaccctgtctcaaaaaagaaagaaagaaaataggaggctagattcatgctccagcactgtcagcaaataataaggtactataggaagctaggtgctgttttgagctcttttaatatgttatctaatttagtgtttttcatcatccaggaatagttactctcctccccacaaataacagaaggagaaaaggaggcttaatgaggtcaagtaatctgcccaaagtcccaacaaacaccctcctgttactaatgctaaccttccatgactctccagcgctagaataaaatccagtgtgaggggttaagaagtgaaacaggcttagctcacatagaaagtccttagctcatctcctagcacatggttaaatgctcaacaaatgatatctggcattagcaatagaagggcatttgaaagcctttaaagaaacacacagaatgcatggattttatggacttgtgcacagagaagcccgtggtgctagaagataccatgtaggactgtcaccagtgtgcctcaagttgctcattatcttgccatttcacataaaataaaacagaaatgcaaataaaagctacacaaataatgaaacatatataaaagaaaattttccctttgactcatccaatttttcctgggagtaatgcaccttgtgcttagatacacaattctcattgtcagagttgttttccctttgctttccacaatcagaccacaatcagaccacatccaggccagtgcttggttttggaaataagaccttgaccacagccctttgcctcactgggaatgtgttgctcagctaagtggctcaaagtccatgctgccacctacagaatgtgagaacattttggcaaattatatatctgacaagagactcaaacaggcactatggctcctgcctgtaatcccagctactcaggatgctgaggcagaaggatcctttgagcccaggagtgtgaggctacagtgagctatgatcacaccactgcactccagcctgggtgacagtgagaccttgtcttaaaaaaaaaaaaaaagaaagaaaaagaaaaaaagagactgtttctagaatatatgaagaactcttataactcaatagtgaaaagacagatacctcaatataaaaataagcaaaggatctgaatatttattcaaagaagatataaatggccaataagcacttgaaaagatgctcagcatcattagccatcagaagaatgcatatcaaaactacaacgagaactacttcacacccaccaggatggctattataaagaagacagataataatgagtgttggccaggatttggagagattggaatacttacacactgctaacagaaatgcaatacggtgcagtctctggaaaacagtctggcagtttcctcaaaaagttaaatatagagtttttatatgagccagcaattgtactactaggtatatacccaagagaattgaaaacatatattcacacaaaaaatatgtacaggaatgtccatagcaacacatttgaaatagctagaaagcagaaacaaaccaaatgcctatcagctgatgactgaataaataaaagatggtatatccatataatgaaatattactcagcagtgaaaaggaataaagtactgatagatgatacaacatggacaaattttgaaaatgttatggtaagcggaagaagccaggcataaaatactacatgctttatggttcccttcatatgaactgtccagaacaggcaaatgtatatggacagaaagtagatgagcagttgctagagttgagggatggcaagtaggggaaatggtgagcaactgctaatgggtacagggtttcttttagaagtgataaaatgtcctgaaattgattatggtgatggttgctaaactctgtgaatataccaaaacacagcaaattatacatattagatggatgaattgtatggtatgtgaattatgtcttagtgaagctgttgtttttttttaaatctcacgcttcccaggcagctggagtttcttctaactgggctgtggagtacatgacatggaaggcaatgtggttaaaggcatgcgtttcagaatcagactcccctgggttccaacgctggctctgccttttattgtctgtataaacttgggcaactctgtgaacttgtgaaaatatttgtcataatatagtctttgtgactttgtgcagatgaaatgagatgatgcaggtaaaaggtttatcacagtattcaacttgcaagtgcttaaaaggaagctactgacttcatcacctacgtgaacttggaaagtttacttatgaagtaagtcatttattctgttacatattatttctgtcttcttccatttcttgtgtttccaccaccaaatcaaaataggaatcagaagttcgcatgcatttatctctactgacttcaaaagaagagggtaaaaaagttgtcctagtttagggatgcaaatgatttagcagtggcaggatgccctgagtgcgcattaccaggctttggagtttatgtcatcaggcatggggcgaaatggtagcttttgaggcataaaagaggagcataagttctgtcctattaaagagatcaattgtccagtgtgtccaatattctgtcttccactctggccaagacagatgcttcagagaaggacataaaatccattaacatacttaattacacactcttgtattatgggagatacattactgtcccaaacccagcctgtccttgcctaaatatccaacatccattatcttcaaggtagcttacagatttaaactaattaatctctttttctccaagaggctttttcttaccagggggatgagagggctggttacctgctgcctgcccccatctgtgagctactgcgctgatgcctgattgtcaccttgtgcctgtttgaccttatgctcagtgggcatttggaactcctgcaccatcaatcatttgttgaagaccaactgtatgccaggaaaggtgccagacattggggcaaaaggaagactaggattttgttcctttatgagaggaactctaagtctactatggtatatataatttttcctatattatgattacttaaaaatgtgttggcctcccctttgagacagatatatctgaagataataataatgtaaggtgtaactattgaaattgctcagaacagcaaagtgacttctcagaggtcactatgcaacacttccattttcatttattggccagaaatttagtctcatggctgggtctagttgtaaagggagttgggggaatgtactcatttaatggagggacaaggtgcctagatataaactcaagttctatccctaagaaaaaaaggagagaatgaatttggggagtcaattagcaatcttctcatgggaggcatcaaagatttttaataagagagtgataaatttagatgtgtggttttgggcacatctggtggcccccaaagcatcagtaggttagggtgtggggtaaggaaaggtaagacaacaagggaaggggagggaagctgcagcaaaacatgatcaactaaaagccaaaacatgatcattggtttgaacaactaagaggatatgaggtgacctttgagaaagctgttttacaagaatggtaagctagacacaaaaacctgtgatgaaaaatcaccaatatgttgtcccttttgttgatcaaggagctaactgtcaggcctctgagcccaggccaggccatcgcatcccctgtgacttgcacgtatacatccagatggcctaaagtaactgaagatccacaaaagaagtaaaaacagccttaactgatgacattccaccattgtgatttgttcctgccccactctaactgatcaatgtactttgtaatctcccccacccttaagaaggtactttgtagtctcccccacccttaagaaggttctttgtaattctccccacccttgagaatgtactttgtgagatccacccctacccaccagagaacaaccccctttgactgtaattttccattaccttcccaaatcctataaaacggccccacccctatctcccttcgctgactctcttttcggacttagcccacctgcacccatgtgaaataaacagctttattgctcacacaaagcctgtttggtggtctcttcacaccgacgcacatggaatttggtgccatgactcggatcgggggacctcccttgggagatcaatcccgtcctcctgctctttgctccgtgagaaagatccacctacaacctcaggtcctcagaccgaccagcccaagaaacatctcaccaatttcaaatccagtaagcagcatctttttactctcttctccaacctccctcactatccctcaaccgctttctcctttcaatcttggcgctacacttcaatctctcccttctcttaatttcaattcattttctgatagagacaaaagagacacgttttatccgtggacccaaaactccggcgccagtcacagactgggaaggcagccttcccttggtgtttaatcattgcagggacgcctctctgattacatacccacgtttcaagggtgtcagacaatgcagggacgcctgccttggtccttcacccttagcggcaagtcccgctttcctggggcaggggcaagtacccctcaaccccttctccttcacccttagcggcaagtcccgctttcctagggggcaagaaccccccaattgcttatttctgcaccccaacctcttatctctgcgccccaatcccttatttccgcaccctgacctcttatttctgtgccccaaccccttctctgcttttctggagggcaagaactccccaccccttctccgtgtctctactcttttttctgggcttgcctccttcactatgggtaagcttccaccttccattcctccttcttgtcccttagcctgtgttctcaaaaacttaaaacctcttcaactcacacctgacctaaaacctaaatgctttattttcttctacaatgccgcttgaccccaatacaaactcgacagtagttccaaatagccggaaaatggcactttcaatttttccatcctacaagatctaaataattcttgtcgtaaaatgggcaaatggtctgaggtgcctgacgtccaggcattcttttacacatcagtcccttcctagtctctgtgcccagtgcaactcgtcccaaatcttccttctttccctccagcctgtcccctcagtcccaaccccaagcgtcgctgagtctttctaatcctccttttctacagacccatctgacctctcccctcctcgccagcccaagctaggtcccaattcttcctcagcctccactcctccaccctgtaatctttttatcgcctcccctcctcacacctggtccggcttacagtttcattctgtgactagccctcccccacctgcccagcaatttattcttaaaaacgtggctggagctaaaggcatagtcaaggttaatgctcctttttctttatcccaaatcagacagcgtttaggctttttcatcaaatataaaaacccagcccagttcatggctcgttcagcagcaaccctgagacgctttacagccctagaccctaaaaggtcaaaaggccatcttattctcaatatacattttattacccaatctgctcccgacattaaataaaactccaaaaattaaattccggccctcaaaccccacaacaggatttaattaacctcggcttcaaggtgtacaataatagaaaaaagttgcaattccttgcctccactgtgagacaaaccccagccgcatctccagcacacagaacttccaaacgcctgaactgcagtggccaggcattcctccagaacctcctcccccaggagcttgctacaagtgccagaaatctgaccaccaggccaaggaatgcctgcagcccaggattcctcctaagccgtgtcccatctgtgcgggaccccactggaaattggactgttcaactcacctggcagccactcccagagcccctggaactctggcccaaggctctctgactgactccttctcggcttagcggctgaagactgatgctgcccgatcgcctcggaagccccgtagaccatcacggacgccgaggtttgggtaactctcacagtggaaggtaagtccgtccccttcttaatcaatatggaggctacccactccacattaccttctattcaagggcctgtttcccttgcctccataactgttgggggtattgacagccaggcttctaaacctcttaaaactccccaactctggtgccaacttagacaatactcctttaagcactcctttttagttatccccacctgcccagttcccttattaggctgagacactttaactaaattatctgcttccctgactattcctggactacagctacatctcattgccgcccttcttcccaatccaaagcctcctttgcgtcctcctcttatatccccccaccttaacccacaagtataagatacctctactccctccttggcgaccgatcatgcacccctttccatctcattaaaacctaatcacccttaccccgctcaatgtcaagatcccatcgcacagcacgctttaaaaggattaaagcctgttatcactcgcctgctacagcatggtctttcaaagcctataaactctccttaccattcccccattttacctgtcctaaaaccagacaagacttacaggttagttcaggatctgcgccttatcaaccaaattgttttgcctatccaccccatggtgccaaacccatatactctcctatcctcaatacctccctctactacccgttattctgttctagatctcaaacatgctttctttactattcctttgcacccgtcatcccagcctctctttgctttcacttagactgaccctgacacccattaggctcagcaaattacctgggctgtactgccacaaggcttcacagacagcccccattacttcagtcaagcccaaatttcatcctcatctgttacctatctcggcataattctcataaaaacacacgtgctttccctgctgatcgtgtccgattaatctcccaaacctcaatcccttacaaaacaacaactcctttccttcctaggcatggttagtgcggtcagaattcttacacaacagccaggaccgcaccctgtagcctttctgtccaaacaacttgaccttactgttttagcctagccctcatgtctgcgtgcagcggctgccgctgctttaatacttttagaggccctaaaaatcacaaactatgctcaactcactctctacatttctcataacttccaaaatctattttcttcctcatacctgacacatatactttctgctccccggctccttcagctgtactcactctttaagtcccacaattaccattgttcctggcccggacttcaatctggcctcccacattattcctgataccgcacctgacccccatgactgtatctctctgatctacctgatattcaccccatttccccatatttccttctttactgttcctcaccctgatcacgcttgatttattgatggcagttccaccaggcctaatcgccacataccagcaaaggcaggctatgctatagtacaagccactagcccgcctctcagaacctctcatttcctttccatcgtggaaatctgtcctcaaggaaataacttctcagtgttccatctgctattctactactcctcaaggattattcaggccccctcccttccctacacatcaagctcgaggatttgcccccacccaggactggcaaattagctttactcaacatgcccgagtcaggaaactaaaatacctcttagtccaaatagacacttccactgaataagtaaaggcctttcctacagcgtctgagaaggccaccacagtcatttctttccttctgtcagacataattcctcagtttagccttccacctctatacagtctgataacagaccagcctttattagtcaaatcagccaagcagtttttcaggctcttagtaggtgtcagtgaaacctttatatcccttacaggcctccgtcttcaagaaaagtagaacggactaaaggtcttttaaaaagacagctcaccaagctcagccaccaacttaaaaaggactggacaatacttttaccactttcgcttctcagaattcaggcctgtcctcagaatgctacaaggtacatcccatttaagctcctgtatagacgctcctttttattaggccccagtctcatttgacaccagaccaacttagactgtgccccaaaaaacttgtcatccctatcttttgtagtcatactcctattcaccattctcaactactcatacatgccctgctcttgtttacactgccggtttacactgtttctccaagccatcacagctgatatctcctggtgctatccccaaactgccactctaaactcttgaagtaaataaataatctttgctggcaggactatgctgaatctccttaggcactctctaatcagatgtcctatgtcctcccaattcttagaccttttatacctgtttttctccttctcttattccatttagtttctcaattcatccaaaaccgtatccaggccgtcaccaatcattctatacgacaaatgtttcttcttacatccccacaatatcaccccttaccacaagacctcccttcagcttaatctctcccactgtaggttcccacgccacccctaatcccacttgaagcagccctgagaaacatcacccattctctctccataccaccccccaaaaattttcgccgcctcaacacttcaacactattttgttttgtcttattaatataagaaggcaggaatgtcacgcctctgagcccaggccaggccatcgcatcccgtgacttgcatgtatacatccagatggcctaaagtaactgaagatccacaaaagaagtacaaacagccttaactgatgacattcaaccactgtgatttgttcctgccccaccctaactgatcaatgtactttgtaatctcccccacccttaagaaggttctttgtaattctccccacccttgagaatgtactttgtgagatccacccctgcccaccagagaacaaccccctttgactaattttccattaccttcccaaatcctataaaacagccccacccctatctcccttcgctgactcttttcggacttagcccacctgcacccatgtgaaataaacagctttattgctcacataaagcctgtttggtggtctcttcacacggacgcgcatgaaactaacaatgtattggggagagaaacacacatctgcaaatatcattgctgaaaagaaatcattgcattaagtgctatagttaaagcgtataaacccaacactgaacacaaaggagggaaggactgggtctgacctggagagcagcagaggagaaagtgcgaaatgaaaggtacccagcaacagacaaagggtcacacttggccccagacatagtgcttcttcctcaagtgcgaagggagtattgcaaacaccagatatgcagtgttatctgtatttggaaattgtttatattcaggccattcacttcattcagtctggcaatttcattcaattaatctcattcatttcttaattaatctcattcattattctctgtaaactccacgagagcggagactttgtgtcttcttcatcggtagatcccccatgcctactggcactagtagttgccctaaattcacttatcaaaggcagcaagaataactgggactcttctctcttgcttttcacgatttccagcagggcacaaaggcctacagtccccacctgaaaaaaacagacttgactggaggcagcgcctcttcttccaaatacagccccagctgacgcagattagcacaaccgcctaagcggcggaactctggagagtgcggaacctaggatcctaggaaactgaaggcaacggaacctgggggcgatggaatccgggagcggtggaacccggagcctgtagaacttgaatctagaggaacctgacagcggcgccgagggggccacccggactctgtttggaacggaagcacagtgtccgccgcttcctggttgcgggtcagcgcccaggtcctgggctggccgccgggatgttgccctacacagtgaacttcaaggtgtcggcgcgcaccctcacgggggccctcaacgcccacaacaaggcggcggtggactggtgaggacgccgagcttccaggtcgccaggatcggccaggaatgtgtgagggggaagggggaaggacaagaggtttcaccccctggttagtttggcctcgctaaggcagggagccgccctcacgcaatgagcttgctttcagttggtggatttttgttgttacaaaagtgataatagccccgtgtgggaaattcccccatgcaaatacatttcccctctttctcgcgtatttctctgctgttttctctgcacctcgcccttttgccgttccattcctctctcttttcctctcctccagcttccaggcttctctctctccaccattaattccctgtgcactttctctttcccatcctgtcttttctttttcgttgtcttgtattcctgttgtctttcaacaatgtgccagaccctgtgctaggcgcctgttctttcacctgtccttttcacctcttttcgggctcctcctgtgtagaacattcctgccttcaacaggtcgtctttattactctctcctttcactataaattactactgcagctctgaaaactactcattagacaaatgtaaagcaaaattctgtggctgtgggatgttgttaggaggactgaaacgtcttgtgcagtgtttgtcgttttatttagttggaaggactaggattagtcgcagtatccccaggcacattgtggatactaaggattagaaatcggataagcgaaagacgtatgcctacaagaacagtcagagggcacaagttcctttttatgtcctcgggtctctattttcatatcttttagaactttttttatccgaatgaaaagtgaatttcaacaagcattttaagcttagccagatcttttatttaagtgggataatgataaatactggcctttgggtttaaatgattttattaatggtggtacatatgaattagacttatcatttatttaggcttggcaagaaagaagtcgtcctgctttgttctgtacttaaactttaacattactgttttgctaggggctggcaaggtttaattgcttatggatgtcattcacttgtggtagtgattgattccattactgcccaaactcttcaagttttagaaaagcataaagctgatgttgtaaaggtaagtaaaatcccactttgacgctaacatgttgtctagtctaaagtttaatactgtgtatcactaagctctcattaagtcttacgtgtaagtgttgaatagcttttaaatataacaacctatttggggtagcctagaattttcatatatatgacttaatgtcaatacagggtgagttattaaatgctagttgttagatcattttaaggcagatgaaagttctaccatttacaagaccactcagtcattccttagttttgagcacttaccatatgctatggatatggagatgaaagccctcagataattctccatcttataaggaagactcacagcgtgatagtgtgataagtgagacttgcgtaacacgctgtgagaaaacagaggagctgcatattgcctggttgtgaggagagtcacagaagtctacagtttcaagactagtagacagtagttagccaagtaaaaaattgacaaggagcattgcagggaaaagcaagaatatacacagaagtaagtagcgtgccataaagatggctaaagatgggacacttgtaggagtgatgaaataagaggcagccagagagattcagctgtctgtcctgaagttttgtaagattacgaaggagtttggattttttttttttttagacagaatctcactctgtcgcccaggctggagtgcagtggcatgatctcggctcactgtaagctccacatcctgggttcacgccattctcctgcctcagcctcctgagtagctgggactacaggcacccaccaccatgcccagctaattttttgtatttttagtagagaccgggtttcaccatgttagccaggatggtctcgagctcctgacctcgtgatccacccgccttggcctcccaaagtgctgggattacaggtgtgagtcaccgcgcccagcaggaatttggatttttgagtaggagattgatgtgaccatattcgcgtcttagaaaaactctggcagcagtggaggatctgctgaagaaatgcaagactggaggcagtaagatcatttaggagatttctgcagtaattttggtgggaaattctaagggcctaaaataaagctggggcatggagaagtcatgtttaagagcagcaaagaggtaaacctgatagcctttatagtgatcagtataaaggagagtaagagaatagagtgactccaaggtttcttttggtgtaattgaatgacagtgtttccagttatcagaggtaagcatctgtgaagtcagtgaatttttaagttttcaacatgcaaaatctgagatgcctgtaatatattgcattatagtgatccgggctttaggagataggtcaggattagagatagagatttggagtctttttcttttttaaataatagctttattgagatactcataccataaaatgtactgacttaaaatgcacaattctgtggcttttagtatatccacagttaatgcagccacaattacaatgaacttttttacctcaaaaagaaaccctatatccactagcagtcatattccatttcccccatttccctcatcctttggcaaccactgacctactttctgtgtctgtagactggcccattctggggattttatataaattgaatcatataatttgtggtcttttgtgcatgacttctttcacttaggataatgttttcatggttcatctgcgttgtagcatatatcaatactctgttactgatgaataatattccactgtaaggatgtatcacatttattttattgatggacatttggatattttgtactttttgcctgttacgaataatgctgctttgcacattcatgtgcaagttttgtgtgaacctgtgttttcatttcccttgagtatgtttctaggggtggaattactgactcatatggtaactctgtttaactttttgaggaactgctggactgttttccaaattaacattctcattagtagtgtatgaggagtctaatttgtccaaatcctcaccaacgcttgctgttctctgttcttttgattataaccatcctaatgggtatgaattgattctcattgtggctttggtttgcatttccctgatggctaaaggtgtggagtatcttttcatgtgcttattggccatttgtatatcttctttggagaaatgtctatgcaggtcctttgcccattttaaaattgtattatttatctttttataattgagtcgtaagatttctttgtatacagtagtcctcccttatccagaagggaaatgttccaagaccccagtggaagcctgaaaccctggatagtactgaaccctatatatattgtgctttttctcatacatacttacttatgataaagtttataaaccaaaccctgtatatactgttttgtctcatacatacttacctatgatcaagtttataaattaggcataataagagattaacaacaataactaataataataaaggagaacaattataacaatacatcagcattactactcttgcactttgggggcattataaagtaaaataagggttacttgaacatagcactgagatatcacaacagttgatctgataatcagtatggctactgagggcaggtggtgtatacagcatggatgttctggacaaagggatgatttatgattaaggcaggatggaacaggacagtgggagatttcatcatgctattcagaaaagcgcataatttatgaattgtttatttttagacttttttgtgtcatatgtttggattgatacatgatttgcaaatattttctctcaatttgtgggttgtctttttactttcttggtggtgtcttttgaagaacaaaactttttcattttgatgtagtccaatttattattttgtattgttgttgcttgtactttttgtgccatatccaagaaaccattgctttctccaatatcaagaagatatatacctttgtttttttcttagaattttagagctttagcttttaatccattttgagttaatttttatatatgatgtgaaatagggaaaaatactattaatttttgtttattgatcatatcctgtaatctagctaacttcacttagtagatctatttaatagtaattttgggtaaattttttttaagtagacagtcatgtcactgcaagtgactgcagtttaatgttttcattgataatctgtgtgtcttctatttttcttgccatgttgcattggctaggacctctactacaatgaatgggagagtagtgagaggatactcttgtcctgttcctgagcttagggggaaagtattcagtctttcatcaagtctgatgtaaggtatagggtgttttgggaaaaatatatttaccttctctttccctctctgtttcctttcccctacactgccccttggcatttctggagcttttatttctttatgtaggtccaagtttcagtctggtattatattcccatcgactgaagaatttactgtaagttcttaaagtgcctgtctaatattggttgattctcttagcttttatttctctgagaaagtatttcacctttgttttcgaaagataattttcaaaggatatagaattctgggtttataatttttttttctagtagtactttacaaatatcattccattggccaggcatggtggctcacacctgtaatcccaacactctgggaggccgaggtggatggatcacctggggtcaggagtttgagactagcctggccaacaaggcaaaacctcatctctactaaaaatacaaaaattagccaggcgtggtggtacacacctgtaatcccagctacttgggaggctgaggcaggagaacagcttaaacctgggaggtggaggttgcagtgagctgagatagtgccactgcactccagcctcggcaacagaataagactctgtctccaaaaaaaaaaaaaaaaaaaaatccctccactatcttcaagcttacatagtttctgatgaaaaatttttgtttttgtttctctgcattatatcttttttcctccgattatcttcaagatttccttaaccttggttttcaatagtttgattattaaaatatatatatatatggcttggagtttacctaaatggaattcaacatatacatatacaaatatatacacatatacaaacatatatatacacatagagacagtcaattcttgttatttgtggtagctatattctgtaaagttgttgtatacactgaattagtgaatactgaaactttgtttgctcctaggggttaggttcttgtgaggctctggtcacaacattttcatcaactgatcaatagataaccttgctttatatgtgtttccgtttaaagacatattaatatgtcagttgatctattaacattgaactcatagccaacaacacatgcctgagcaaagattatcacatatatatatatgtatgtattttttgcaagacacatcacaacttctcatacttagaaacggtaggcagtatgcttggggacctatttaaacagtgaagtcaccagcaaaaggaacaaaaatgtgaaaaatgtggtactaaataaatcatgagatgaacacttgttttgccattggaaaagctaaagcaagaattcttgtttgacttcagctgggaacacacatgtatgttcggtgacatttttttcaccattctgcacttgtccacaaaagcactgcaagtattgattttgaggttgcaaattatagtgagtaggtaaattgacaaatacagaatctataaataactagaatggactgtgtacacatatatacactatacatattctattcatacacattctatacctatgaacttaaacatatacacatacaaatatgcatacacacatacatatgcatatatacacatacctcatttaaaaatttttgcctgagcaaaagatctattacaggaaaaccttaaggcctgttcacgctcattttcagaaaacgttgtttccatctttttcatgaatactactgcaattggttggcttactttcctaccttagcattatatatgagtgtatttatatctgtacacatatataggtatatacatttatatgtatttatagatttgtggtatttaaatctacttattaaacagaccttggacactgtactaagtctgagaatagaaatgcaaacaaagaccacatggtgtgccctatggaacttacagttgatggactcatgaataggcaaaaagaatgtaaataaaataagtacaaattgtgtagtagtaaatgctttgaagaaaataagcaggatactgagaagagaggggtggtagtgaccagggaaggcctgactcctagtgaggactatgaaatttttcccttattctgtcagtattcattgttcaagaatttaatcagatttgccctggagttcatgtgttttttattttaaaaattctattgttaatcatgttgctataggcatgaagcatttttttttttttagagaaaaacttaatgttttgtgaaagagagagacagctagagttttttgtttgactttgccttctcctgactttccctctgcaaggtttttgtgtttctaagttgtcttcttttagttaggagactagaatacagaaaaacattctgctaaatatgattttaggtattttgtcataaattagatcttaggaaaactgattttcaaggcatcctggggttttaacctaaatttcccaaaatattaaggctgtgaatcatttttcatcacaggatctttgtgatgtgtcaaagaaaacaattttgtaactgcagttaaagatatctaccaaagtaacacaaatgctgccttcaaaatgaaaaccagttttctgtttattcttgctaaatgtttatgtaatataaatgtagtatgggttctggttgatgttttgtgaaaattatgttctgtttcatccagcgcaagtatttacttgatctgatttcttcttgatacaggttaaatgggccagggaaaactatcaccataacattggctcaccatattgcttacggttagcttctgctgatgtcaatgggaagatcatcgtctgggatgtagcagcaggagtagctcagtgtgagatccaagagcatgccaagcctatccagggtgaggaaagtctgctcagctaagtgtgtatattgatacacttactcttggagtggttttttggttttgggggttttcccccattcatttaattttatcaattccaagttagctcttgattgtgttttgcctattctgctgatctaaatctggctttctgtccttactaatacacttctaggcatatttcttcaaatctcaactgatttgtgctttggtaaaactcattaattgcaatatcagcctcattcaagcatgataagaaaaagtaagtggtacaatcttgtaatctaagctacaatataaggaaaattggccactgctgttaggaactagccatcagtgcttactctacattaagtaatttgttcattatcagagatgaacaaaattttattctcattttcatatagattgcttgtttgttcgtttcatgttactgacctaaaaccagtacggtattctttttttttttctttttttttttttgagatggagtgtcgctctgttgcccaggctggagtacagtggcgctatctcggctcactgcaaactctgcctcctgggttcacgccattctcctgcctcagcctcccgagtagctgggaccacaggcacacaccaccacacccagctaattttttgtatttttagtagagacggggttttaccatgttagccaggatggtctcgatctcctgacttcgtgatccacctgcctcgtcctcccaaagtgctgggattacaggcgtgaaccactgcgccctgcccagtacagtattctttagacttaagtcctccagtggctctcttgactgaatgaattttttaaatgactatttaaaaaatatttattaaatacttactgtgtactaggtactgaactagatctttgcatattctgtttattttttgaaaaaccatgaagaactgtaaagttccattaagtaattccacagaaacattaggaaagtctgacatcttggttgtggctaagagagtttcatattgattttatagttttaagtaatgattagggcaaattgccttttattttctttgaagtaatatttcagattacttcaaaatttttaccttgagagtttaaccagacaacttatttttatatagaattagttttttctctggaatattgatacacacacacacacacacacacacgtcacatttggggctggtggttaagtttttaaagattatattttaaaaactaaatatcaaggacaagttagccaaggactttggagagtgtggtttctgaattttgcctttctttatcgggtctttccagatgttcagtggttgtggaatcaagatgcttcccgcgatttactgcttgctatccacccgccaaattacattgtgctctggaatgccgacactggcaccaaactatggaagaagagctatgcagataacattctttctttttcttttgacccttttgatccctcacatttaacttgtgagtaacagttgcttgtggaaaatgagttaagtgagatatttataatatagtaatgctatgtgcatgagatatacacacacattatacatctataatgttaaaatgactgagcgaagtggagaagcatgtctagtccatatatctgcagctcctaatacacatactcaatcataagttcatatcattgcaaatatgataaaaaattaaatcagcaagctacaccttcactgtgttgaatttgtgaatagtattagactagccagggacagagagttactttgacactccagacttaattagttcttctaagaacatttaaataacttgaatcaagggtttcattcagtctgtggccaagttaagttcttgctttttaataaattgtcctaattcacgccattcattttgagtgccataaacagatgcatgtaaagaagaaataagcctaagcaagttttttcttgcagagatagtttttgctaatatgcttttaatgttttcctgagctaatgatctaaaaatgagatgtgctttaggtatttttgtggctaaattgtttagaaactatttaatcatccaacagatatttcttgagctattgctactcttctgggaaccaagatgtctcagaacccaaaaggcaggagccttcacagagtttgcattctagtgagaagaagtcatatcataaactgtgaccacaatgaattaataaattctagtgtagtaagaggtgacaggtgatataaaggcaggataaaggggatgcagaagaatgggggatgagggcatgcaagttgtatgagataaagtggtcaaagtaggcttcactttgataatgatcagaaatgtgaaggaggtaagggaattagctatggtaaggaatgtttttcctggatttgaatgactcaaaattgttttacccatcaacttttattgaggggtgtgtgtgtgtctgcacgtgttaaaggaggaagagaaaggcagacaaaattgaaattataataacatgggaaatgtggctgtgtaaatacactacagggtgcttaggcttttatgtatgtaaatgtttgtatatggacgtgtgcatacatacactcacttggtcaccagtttacttactcacataggtgcagtgctggggaaacacctaggagggctggcccagttggcagagtcagggaaggagggcatcacaaaagaaggaagcaaaggggaccttgaaggatgagttctggaacctgaaaaggcaacaaggctttcagctaacttgattgcatcagctctttacatctctgtaatttggttgatgaaagcattgtgtgttccagagtgtcagttgacctaacatctttgatttactcatattgaatgtgctagggttgtcataactcttgaatgcatcctttttccctgtgtttagagcagccttgctaagggctgggacccagggtagtaaggtttttctgctcatgtcttccagtattaggcccattgttgagggagattattttttcagtcataaaaaggcataatttgtattgctaaatatggtgctccctccttgactatttttgtttcatgtacacttagtaagtcactgtgggcccactactgttttctaaatattaagggaaaagaatattccttaatcatcttaaggttcgatctgatgcttgagaagaaaaagggaatatatttagactgagtagctcaggataaaaatttggtatcatcaaataaaatatatgaacttagctaattgtgatatgcagagcctcttaagtatggttttttgtttttttaagttatgggatatgttaaagtttttttgtttgtttgttttttgtttttgtttttgttttttttttttgagatggaatcttgctctgtcacccgggttggagtgcagtggcactatctcggctcactgcaacctccacctcccagttcaagcgattctcctgcctcactctcctgagttgctgggattacaggtgtgtgccaccacgcctggctaatttttgtatttttggtagagacggggtttcaccatgttgatcaggctggtctcgaactcctgacttcatgatctgcctgcctctgcctcccaaagtgctgggataataaggaaagatttttaatgaaagtccgtgccctgaatttatttagaagaacaaacacttgttctttctgccaataaccttatgttatctttttaatataagacataatatagaatgccaagcttggaggcctctgatgaattgtaatggaccacctgtttctcttcaacttagagaacattcccattatgttatgaatgcataacattgccagttatatattattaaaattatcactatattgctctcaaaattgtattggaataaaactgtatgctaaacttcattaaactttaatcagagttttgcttttctcaatatagtgcttaccagcgagggtattgttttcatctcagacttctccccatccaagcctccctcaggccctgggaaaaaagtttacatatccagcccacactctagcccagctcataacaagctggccacagccacaggtgccaagaaagctctaaataaagtaaaaattttaatcactcaagagaaacctaggtaagttacaagtgtaaaattaacattcatctacttatctggtatgaaagcatcatttttggagatgtacaaagactgatgtttttcttcatctcactttttctcatttctaattttgaatttattagaggaaaaaaatatttatttttgtcccctgccctaagaggagattcagcatttaacattgcctttgtttccactagctgtgctaaacttccccactgacttttatagattaaaatttttgaattctgatttttacttgtgaaaatcgcaatgatcctaaagttcaggcaattgaatgcattaaaaatttgggcacaaaagctggatactcattttaaatacattttcctgacttaggtgctgtgcattctcattcagcagtaaaatcggagtgtttttcttatgcaggtgaagatgtctcccatcctggttaagagccaaggctccgggggaagctttagctatgagactgagaaacttctttaatcttactcaaatttctctctcccagtctctaaaataaggctttaaagtatttcatagggttgttttaaagatcaatagatccaataatgtaagtaaagcatgtaatgtcattgatacatagtaatttatttagaagatgtcggctgttattaagaaattacaactgaataaaagtttattttaagtaatttgatgtattcaaaataggtttctttctttttcctatagcaataatctgtatattattgctttggcaggcttttttgtttgttttggcattcattttcagatagcctttatttttaatatgccaagattactctctctaggcttggtgagtaactacttgaaaaatatgtggtaaaaatataaattgctctacaaatacattttgcacttgtgtgtaagtatcacttctatatattaagccataggctggttaagttcactagttaatttatctctcaccctgtgccaaaatgacttaagattacttcttaagtatcttaagagaactttctattttttatgtattccctctcataaacaagaaattatttggcagtctgaatagttttataagttatgttttatatttcttaagttttctctcatatgaattatatgtatatcttgagtattggggaaatacattatttcttcaagtagaaccgctctgggtgctttcacatctattaattcctggactcttactacaattctggcagtagtaatattcccattttacaaataaggaaaactgagtcccacaccaatttaaataaagttactcaagctcacccaactaggacatggcagtcgggattttaatgcaataaaaattcctctttctagtcttgtgaactaactttattttaaatttcaaagccttttaataaaattatgtttgtaaaatgaaatgtaaaatgaaaatagtacataattgtatgtctattcctattgaaatatatttaatatagaaaaggtcattgaatgtatgcaacaatcacaaattattaaaatgatttttcagaccctaacaatctcttaaaatccttatagtttcacctgttttatttacacacaagaaaatgctgcaatataagtgaaactttgtttcaaaaaagatttaagacagcttaaaagtgaatgaaggcagccaaggggaagttacttgcccaaagccatacagatagtccagtaactcctggtccaggggccctaattaccctaaatgttgatgtttttcatcctgagtcttgattttaacagtttgcctagtacttttaatgacaaagtaaaagtaaaataaaactgtcttatgcatgccagctattattatattatcatttaccatgtcttgtgtaatattaataacttaatattctactacttaatatttcaaaaacttagaaacactgacatttctacccatcctatacaatattattagcatttggattttggtacatagtagagatctaagttttggatgccaacccatgttggtcacttcagggaatagttgtacatttttattgtcaatttttatgtgtaaagtacaaaattaaatcttttattaggtctgatataaatgaagtctttgacccaagtgaatgtttacttttttcagtgctgaattcataactctcaatgattgccttcagttggcatacctgccttcaaaaaggaatcacatgttgttgctctatcctcgagagattttaatccttgaccttgaggtgaatcagacggtgggtgtgattgcaatagaacgcacaggagttccatttttacaggtatctacaattcataaattatattccccaaaattattaagaatgttatattaaaagaaggccataatcttgcataagtcttgtcttcagttctccactttctcttttcaatttatcaaaagactagcaacactattttagattgttttttttgtctgcacttttgattggtttgatttaccctagaaattgtgactgatcctgagatatttattgaactatttaagtcacatgggtaaagacaaattattttaggattataaatggatattttaaatgtacatttagttttaaagtttgggatttgtctatttttttttcttttgcccatattatctaaatatgagtttgagtttcacagtatatactttattaatctattgtgttttaaaaaataaatatatcatctatttaaaggtaataccctgctttcagcgtgatggtttattttgtctacatgaaaatggttgtataactttacgtgttcgaagatcttataataacatttttaccacttcaaatgaggaaccaggtgagtttctgtctcacaataatgttatatttttcttcaaaattattttataaagcttgatgtggcaaataccagccaaggtatatagttaatgatactccttgctttgaggaagtttaaaatatggttataataagaggcataaaaagtataagcccaagattaatctcttgatgttaaaacagtgcacctcctgtatacatcaaagagagtaaaattttgtgtttcttgatcatatccatgagccaagtagatattattttttggaattttttttttttttcagtacaagtccaaccttgtgtgcctttattattatacccccttgacttgttggctgtaagaacttccattgtaaagtgacagaggttattaagtctcagttgtcaagtcagtcttatcttggagaatggaaataatgtttttgtgaaattatatactgtgtaaagatcaaagtgattttcacatcttttggaaagtacagttattttcaggcttatagactactacaaattatgatggaaatttattcattaattatatatcactgttgatcctttttcaaagtatcgtctttattttaaaatattgaaaaaagatatcttgattatagttgttattttggaaattaaacttagtacagtcattaagtaaattatatttggaaaaaatttagtagtaattgtaaaaagtgaagccatgcttgacattgcattcatgaaggagtgatgcccaaatttagttgaggttttatttaaattgaaacaaacagtagtggtatcgatatggctgctttctgatatttaaaacaattttatgtgaagatccagatccagttcaggagcttacctatgatttacgaagccagtgtgatgcaatcagggtgacaaaaaccgtccgtcccttcagtatggtgtgctgtcctgtcaatgagaatgcagccgccctcgtagtgagtgatggcagggtcatgatatgggaactcaagtctgcagtttgtaatcgaaattcacggaacaggtaaatgaatcaacaggatcatggttttgttttttgtttcctgtttccttttataaaaaatttccataatcataaaaataggagggctggttttctataaaaatatttttaaggtaataattaaggctttagattattagggaattatgtaaatctgctagagctatttcacctatgggtaagatgaatgaataatataaaaatagatagaatgccataatctggacttaatactttgaattcctaatacgtaatgcagattttaagtatgtaaaaccttctaattattatgtctttgcagtagttctggtgtgtcacctttatattcaccagtgtctttctgtggaattcctgtaggagtgctacagaataaactcccagacctttccttagataacatgattggtaagcttttttcccctctaactccatgttaagtattctttctgaagggcaaaattaatagaatcactcacttgtaattattttaaagtcaaaaaagttaatacttgagaaaactagaacatggaatcattctttcctaaataaatcagaggggtttaaaatacttaggtagaaaagtgcctgaagtagcacgggtttgcattatagttgttagaaatagaaaacgttcattcgtgagagactgatgtaaatgaaagcaatgacattaggcatctggattttggacctagagccgatgctgagctatgccatgccaactcagggccttgctgtttgctggttcctcagcttggaatgaagtacatgcttcctttctgtctgctactcctaattcaaaattcaactcagatgttgttttctttaatctcccaagtctaatttaaatgctcttcttttgtttttcctaacagttatcagcatattttaattgtgggtttttttcttctgtttcatctcatcaattgtaagcatcacaagggtggtacagtgtttgattctattttgtctttcccagcactcagcacagtaccttgtgcatgcctgttttgtagtaaatatttactgaaggaataaagtaactgagcagtattagaaaagattattttaactttttgacatgaattatttttatgttggggattctttcaaaaaatcatttttggagataaagtgttcaaagttatttaattatgaggccagtatgtattaaaggaagaatgagagtttgtgatttcaaattttatgctacttgaaattataaggctttgtaaatatgccaagcaatttggacatctaatttttttacagttgtggctatggtttataaaggattttctgttttattatttattctaccataatataattgaaaacgatattatttaggagggtttttttgttgttgttgaaacgctaaataagtgatgcactagaaagagcattggccaggcgcagtgactcacgcctgtaatcccaacacttttggaggccgaggcgggaggatcacttgaggtcaggagttcgagaccagcctggccaacatagtgaaaccctgtctctactaaaaatataagaattagccaggtgcagtggcatgtgcttgtggtcccagctacttagggggctgaggcaggagaatcgcttgaacctgggaggcggtggaggttgcagtgagccgagattgcaccactgcactccaacctgggcaacagagcgagactcgatctcaaaaacaaaaaaaaagcattacattattaattacattaattagatcacatttattgggtacttcatactgtgttaagtgctgtgctaaatattctacatattaccttggtacagctttgcaatgtaagtaatattatctccatttgatacatatgagaactgaggcccagagagattaaaactttaaaccacacagtcacacagtcacacaatggaagagcccaagtgtgacccgggtaatcctggctccagagcctgctccttagcaatggcctccagtcctgacagctccactgtcatcttgggtaagaccatcattcatctctaggcctcagttttttcacgatttctgccagttatgaaatccttttgttcagtgatacttactattatatctaaaattatttctctccactatctattctaccagacataaatccatatgaggaagcctggacacatgttttgcaaaatttattttatcagtaacacaattttttgagttaattcaccttgtctactcttaatatgaaaacttaaagtgaaaagaattataaacacacacaagaacagcactaatcagttatatggagcccataggagtttgaaattttatgctgtttaggtatctaagtgatataaattacaggttttttttttttttttttttttgagacggagtcttgctctgtcgcccaggctggaatgcagtggcgcgatctcggctcactgcaagctccgcctcccgggttcacgccattctcctgcctcagcctcccgcgtagctgggactacaggcgcccgccaccacgcccggctaatttttttgtgtttttttagtagagacggggtttcactgtgttagccaggatggtctcgatctcctgacctcgtgatccgcccgcctcggcctcccaaagtgctgggattacaggcgtgagccaccgcgcccggccaaattacagtttttaagagacaaatggatacggattgtatagcagttcttgacaatgtagttgattttaaagtgttaaataaagcttcgtacttgaaaacattttaatttaaacttttaattaaacttttaatttgaaattcactgtgttcttagtgaaaattcaaagcaattcaggtaaataaagaggctgatttatattcactggataaatgctgatacttattaaggcctaatttgccctacattgtgaattgcctcttatgaaaaatacttgaagaaaaatgtggcattccctggatgtcaactcaaagccaacatatgtatgtgtggcacttacatgttaagcttcccattccttcatatttcatcttttttattttattttattttttttgagatggagtctcgctctgtcaccaggctggagtgcggtggcgcaatctcggctcattgcaacctccacctcccgagttcaagcgattctcctgcctcagccccatgagtagctgggattacaggtgtgcgccaccacacccagctaatttttgtatttttagtagagacagggtttcaccatgttgaccaggatggtctcaatcttctgacctcgtgatccggttgcctcggcctcccaaagttctgggattacaggcgtgagccaccacactcggcctccatctttttttaaccaaagttatgtagagagattgatattgagtatgtggctaatcctaagggatcattttaataggattaaaatgctattttttctatatattttgtggattttaaaataacattattaaaacaactttacagcttcaaaaggttgtatttatcacccactcttagtaattatttatacttttcctttcacactatatacatgtttgtgtttatgtgtgtgtagacatgtatgtatatactcatgcatattctttctatttttggcaagttaatcccaatattctgtagtggtttataggaaggaaatttgtatacctttttaatgaacagtcttgatttcattgtactgtttagatttagcttttgttagaatgatttttattggagtcatctttttagtttgagacttgctaacctaagtacgaatggtatatgtgaaaataatgccattgaagtcttaactattgacagtgatggtgtatatattatacacgtgatttatgaatatatatatttgtatttgttttatatttacttataaaacattttgtaattacactgacacattaaggtttcttattagaaattatgaataagttatttaaatctgtttttcatgaataccaattttgtatgtactttacagagtacatcagattgaaaagtaaccctttcaaaaggcagtaaaatgagaaaaatgtggtacagtagttcactctgcagaaactgttctctaatgcaagttctcttgctttgttctgaagcctgtgtagtgctttaataccaggaacattgactgaaacagtgtttcttagaagacataggtccctgcattctggatagcaggactcgggagtaatctatcctttgaggtgttagttgatgcaatttaagtcctatagccaggtacagagtcattgtgtccttaataactacagccactaaagtactacattaactacattatacttttagacctgaagagcatttctactgaaaattttctttagctttttaagatcagcatacactgtagttaatatatttgttatttttattacaaatcagggcaaagtgcaattgctggggaagaacatcccagaggttcaattctgcgggaagtgcacctcaagttcctgctgacgggactgctttcaggactgcccgcaccacagtttgctattcgtatgtgtccaccgttgaccacaaaaaacatcaagatgtatcagccactgctggctgttggtgagtatttgacctggtctttttttttttaactcactttataagatgtttaggttttctagtttctagaagatcctttattctttttgaggatgctttaaaaggagatagagactaagtgaaactgtaaatactcatcctggaacttaaaaaaaaaaaaatttctgtccttttattccaactgtcttatattgaattggaatgctgagtcttcatccacctgagactggacagtcgagtctctgacgctgtccattcatctcggaaataccaggaggctcatccctgcagtgctgaatcccaggctccttgtctgtaattggaccaccccagtctttatgtcatgtcagttttcgttgggtctttattgactaaaaatatagtcagggttaatagcttaataatagcagggttcttcttttgccaagagttatatattaaatattatttaaagtggctatggtccctataaattaagatttgccttttggtgtgaaattgtgtatttgtatgttataggtagaaaaatttatctgggttccaacttgctgtcacattgatttcatagtaatgtgatgaacctaattttctttacagcatagagaaaaaaacaaaatttagtttgctattaagtacacattattaaaatacatttctccaaaacttctgaaaaacagtgtatttgtttgaaactcaacatttcttcttaagatgctatcggctggcttctggctttctcccccagtctattaacatgtgatttgtggtgaaaacctcaccatatttattctgtggccaacatggctgacttctcagtgttaaagactcatttgggtattactgtttggtagtacccttctgtttttttctgtgcctatcttttgaaagcgatttgatttttatgattcaattgtctatatatgtgtcccgatttatataatgcagataaatgtttaatttttgctttagaaactgttgattaatatttcaccactaatagattttaattaggattcatcagtgtgcttcatatgtgcatgtatgtattatgtcagtgttcctgatttgtcagttaggattttgtcaatttcttggggaaaactacttcttgggatagctatgtaataagagctatggcaaggtctgagctttccattgtagaataagctgtattggtatgtagtgaatatcatttactgaatttagtataacaaagtaaaaatataagtacctaaaagtttgtctagaggtgtcactaagaaagataaataagagttcagctatggaattaattctccttgtggtgcccctagtgcattagatcataggttcagcattgttaaaactttcagattgcagaaatcattggattattatgaagttctgttaattgaaaaattttagtaatttagttattttctcagtgccaaaaggtattattatgaaatagatgataaatgtaaacaactgtacaatgtgtttttctagaatagttttgcaaaagatttctggagttttattcagcaaataagataatattggaatttgcccagcatttttacttccactctgttgctttgcatgaattcattaatctttaaatcatgtgcagtgcaaaagtgattgtccatatagactgttcacttttcttgcttaacttataaaaacactatagagactgaagctttactttctcatgtatgtccgtgtcctttacatttaaactttagacatactacctgagaccatgaaaagctttagaataatacctgtaaactattaattatagtgatgacagaatactaatagttaaccaagtgcttactttgtgccaattactgtgcttagtgctttatgtttccccatttaatctccaacaactagattttctactcttcccattttaaagagatgaaaacacagatttagtgtgggcaagtaattcatccaagagtataaggaagagccagggcttaagcccaggtttctttaattgcagaaaccacagttaaccattatactttactctcttgtcaggatttatttaataaaagagacaaaacaaaaagaaaactttggaaagaaaaatggataaccctggttagtgagctctgctagattgcttatttgaggaccagctataataaaccttctgagtctcaaaaagtataaattcccatgtgtataaaagcttaggaaagtgtttcttcaaattgtatgtgtattaatgtaagttttaaggtctttctgtgaaaaatctattcctggaattaggcaaggcttttgagcacgtgaggttaggcccattttttttataaggaagtggaccagagaaattcattcttctttgtgtgtttgtttaaacacatagtttgggtttcttttataaaagataaatgtgttaagtgattaaagtcttgagaaaagacttttcttgcaaagtgctggaactcccactgaattaatgctcttccatgatgtcattttgaaaggtacaagtaatggttctgtcctggtgtaccatctcaccagtggtctgctacacaaagagttaagcatccactcatgtgaagtcaagtaagtatgtcattgtgatgatgacatcacaaacatcatatcagaaaaaaaattctcatagacttttctacattgagtactctgtaatatctgcagtggtgattatttgaaaagtttgaataatattcatgtccaactaatggctatgttaatcaaggatgataactaattctttgctgtgtaaagaacataagcagtagagaatgttttctcttttattaggttggtgcaaaagtaattgcggtttttgcagttttttttttttttttgttgttgttgttgttgtttgttttgttttgttttgttttttttaaatggcaaaaaacacagctatttttgtaccaactaatattgttgcacctcatttatttctcctaagggccaggctgttttctcactggatatccttacgttgccttgttcaggtttattttatttatttattttgctcaaaattattattttttattattttaaaattttttttactttaagttcctggatacatgtgcagaatgcgtgcatttgttacatagttatacatgtgccttggtggtttgctgcacctgtcaacccatcacctaggttttaagctccacatgcattagctatttgtcctgatgctctccctcccctcacatgcccccgccaacaggccctagtgtgtgttgttcccctccctgtgtccatgtgttctcattgttcaactcccacttatgagtgagaacatacagtgtttggtttttctgttcctgtgttagtttgctgaggatgatggcttccagctccatccatatccctgcaaaggacatgatctccctttttatgactgcatagtattccatggtgtgtatgtaccacatttcctctttctttttttttctttaattttactttaagttctgggatacatgtgcagaatgtgcaggtttgttacatagatatacatgtgccttggtggtttgctgcacctgtcaacccgtcatctaggttttaagccccacatgcattaggtatttctcctaatgctctccctccccttgcccctcaatccccgataggccccagtgtgtgatgttcctctcgctgtgtctatgtgttctcatcgttcaactcccacttatgagtgagaacatgcagtgtttggttttctgttcctctgttagtctgctgagaatgatggcttccagtttcatccatgtccctgcaaaggacatgaactcattcttttttatggctgcgtatttttcatttctataacgatccatcagtaggactgcttatgacaaattcaaataaagtcattttaattgttaatttgtcttatttattctttgtttaaacatcatcagaacgctgcatagcatttatttgatttttaggacatgatctgcttatgagttctgtgtatgcagagctgtccgagggaaagctaaattgacggaaaagtgcttcttgctttctgttccaaaatgcctacctgtgctgtccatagcattatttcgctgaatgcaaggctattttccttttgtgtcctatcagtgatagatcgtagagttacatatataaaatatgaatttccacttttttgtttgttttttgatacagtcttactctgtcacccaggctagagtgcaatggcgcgatctcagctcactacaatctccgcctcctggtttcaggtgattcttatgcctcagcctcttgagtagctaggactacaggcacgtgccaccatgcccagctaaattttgtatttttagtagagacggggtttcaccatgttggccaggctgatgttgaactcctcacctcaagtgatccatccacctcagcctcccaaagtgctgggattacaggcatgagccaccacccccagccagtttccagtttttttttatgatctttcagtgaaagcataagaagtcattttctgttttctgtacattaaataattgtaggtcttgtgtataaaaattctcagtgaacccttagcaaacacattatcctgagtacatgcattttcttaatggagaagggttaaccttttttttctttttttttttttttttgagttggagtttcgctcttgttgcccaggctagagtggaatggcgctatcttagctcactgcaacctctgtctcccgggttcaagcaattctcctgcctcatcctcccaagtagctgggattacaggtgtatgccaccacgcccagctaatttttgtattttttagtagagacaagatttcaccatgttggtcaggccggtcttgaattcctgacctcagatgatctacctgcctctgcctcccaaagtgctgggattacaggcgtgagccaccgcgccaggccaggttaaccttttaagtatcacagcttctgattgtgatggaaatctctgaaaagtttgcattgtcttactgtttcaagtgcattgttgtgtggtgcagcccaggtgactgtttattgccaccttacgctgttcctatacagcatctccccagatacatttacgtggaataataatgtctttaaaagctttgggcttttgaggtgcagtgacacaggtatctgtttggactctttcaggctgttattcatctcttctcttctgttgcagtgtctgtagcttgccattctggcacttctagtagtctctgcttacactgctgaatcttctctctctctctttcccatctcctcttctctcgacatttcctttcaccctgccttgtgtgtctggtgtttccttttatggtcagcactaaccaatcgaaactctccatttaatcactacttattctagggattatgttaactattaatacttcacacgtatcatttcattgaatccccactacaatcgtatggggcaggtattgtatttccagtctacagagtaagaaactgaaaattacagagtaatctgtgaaggagctagatggaattcactctgggcctttgaagcctcagaacctgaactcttcacttatacttacagtgcatgtgctgcatctcctgctaaaatacgcacataggttagtaggaatcatgttggcagtaaaattaaaatgttggctgagccaagatttgtgctaagaatttcacacatgcttctgaaaaatcaaacatgttgtcttttcaaacacagaaagttttaatagctaattaatcagagaggtattaattttaagtaaggtttattatcctggattagtcaggttatagatgtcactaaatacttgacttatacatgttaagataatatttatggttgagtaacattgaaattgattataagtgttacttgggatactaactctgagggatatactacttatcagataaatgtgaatgatcatacaaagatactccatttttatatgaatttttcctcttcattgccattttgaaaataatttgtattttatattcagagatactgcccaagagaacactaaaatcctgctttgtgtttcagttaatgcaattttagtattataatcaaaagccattaagaaaatttcacagaaatacaaaaattagctgggcgtggtagcatacacctgtaggctcagccatttgggagcctgaggtgggaggatctcttgaacctgggaggcagaggttgcagtaagttgagattgtgtcactgcactccagcttgggtgacagtgagaccctgtctcaaaaaacacaaaacaaaacaaaacaaaactttcacgatgtattataaaaatgtctgaatttattagcagtaaactcaaaacattttagattttcatgtccaaataaggttaacttttagaaagttgtttttctaccttttattaagtgtgtttttaaaaaatcataatctaaagcacttgaaggttgtatatactgtgccggggactcatgacagcagatagcacaaagtgtgtgtgtttttaaaaccatgatgttttaacttgtgatgctttatgaatatctgttgaatatcttctctatgcttataaacagagaaagcctttgaagcttataatgcaatggaagatacttagaagtaaacaaaatagagaggtatatgtagattttcttaggtcattagtttgtgtctttgtctggtaggctgaaactactgtcatatgactctctccctggccagattttaatagtcatactaatactgatgtgaatcctgataattaaactatcttgtcattacatttgtagataaagttttggttagaaatgattttgtatgtgttaggtatggtaatacagtctcaaataaaaggtcatgttaagataaaaggtcatgcttactttttaattaatttgtgtaataaaatttaggtctttggaaaacttatttttcaaataaatgaacctttcaaataaaaaagagaattagtttaacctttatctcatttcctattataggggtattgaatggacaagtttgactagttttctttcttttgctacctcaacaccaaacaatatgggattagtgagaaatgaacttcaactggttgatcttccaacaggtttgtttttaaagatccaaataggtttgtcatattgaataaacatgttgccatttataaaacatgtttgaaagtacttctttcaccttggaatttttttttatatttcatgcttatatatttattcttttattctctaataattgccctagaaaggcctcatcattgtttacatggaaatgttgttggcacaaatacatggtaaaatggaggaccattagcctgaacagacagattcattaaaaaataggataccggttctacttttaagtgcattgttatatgtaaccaactttaaaagatcgatttaaaaataactctgtcaatggactttattagagtctgtgctggaaattttggcttttataggaaacacttagaaaatttataggttaaggattgtttttaaatgctcaaatttaaaacttgtaatagtctctggctgaatgaatagagaaacttaatttgggattttgaagattctacagtaggaaacgtcccaataaggtaactttttcagaattgaaagcctaaacccagtgaatttcaaaataaagaatttgaaaatataataaggaaagagtttcaaattattttctggtgtatgcagtagtttcaaagaggtttttttaaaaataaaattgtgatgagtttctttaaaatggtatagcaacacgaatcatatgtagatgatcttaaccaatgagagcatgtgtatgtatgtgtaaaatgaattaaatcaaataaatggttgtaaatcaagtaagttgtaaataaatgaagtacatggttgcttttttatgttctccatatgtattttcaagctctcaaagatccagttgttcttacttctcagggtatgttgctgaacttccaggaatcattcccgtctttagtccagtgttgctgctctagtctcattggaagtgacctgtccactgactctcatccccaagttcctaatttgccagcagaatggtactggccctgtgtctagtgatcccagggataaaatgctgttgtctagtatcattgacttaaaaaaaagaaaaaaaatccctgttttatttgttttggtcagctcaagttcaggactgttagataacttaaaatctgctttgcacagatgtatttttaaggaacaaacatctacagtaacagttacagatttccttaagtgggatatttgagttcatagatggtagacttttatagcctgggcttctaaggagggcagcagactagtgcagtcaggacaggacatgggctgtttggggtataataatagtgagtatagtgagattccacatgatggaatctcaacaaagagtaggaaggcgtttaggccttcagttgtccttgaattgagtatgttctctcttttgtttaatgtagataaaaatctaacacaagatactaaaacatacaaggtagaatttatactttttttattcacagaaaatcatgtaacttcctttgcgggtaactcattctttcacagcatacatgaacaccgtagttattccctagtttccagtttataaagatgttttgagaggaacatgttcaaaatatttaactagtattttgcacatgggacaagaagatcttaaatacatgtttcaagagtttttcccccactagttagtatttggaaacatgggaatgtttgtattaaatattactttaaataagtagttttcgcaccagacaattgctgtaccataaatatcttaaaacttaacattgtttttttaaatttctaaaattgaattatagaattcaagaaactgtgtgacaaatgaaaatgcctttttacaaaataaatatctgaatatgtgatatattattgatcattagtttgtaacacttttaagaatattctttgaacttacattattagaaacagcttagaaggaactgggcgccgtggctcacacctgtaatcccagtgctttgggaggctgaggcagatggatcactagaggttaggagatcgagaccagcctggccaacatggtgaaaccccatctctactaggagtacaaaaatgagctggcgtggtggcgagcgcctgtaatcccagctactcgggatgctaaggcaagaaaatcacttgaacctgggaggcggaggttgcagtgagccaagattgcgccattgcactccagcctgggtaacaaagtgagaccatctcaaaaaaaaaaacccgaaaaaacagaaacagattagaagcaaatggaagaatgaataggagaacagagggtaggatgggtaggactgatcaaattacattggcgtggcttcttgtttttcatacatgttttatgcactgttctcacttttttaaatatttgcaattaaaggtaggagcattgcttttcgtggtgaaagaggcaatgatgaatctgccatcgaaatgattaaagtatctcatttgaagtaagtgtcaacctaaaaaaaaatctatggtgttatcacaatgaaatctcgtggatttttttaatctttaagaaaatgggaatgtgctggaatgcatatggaatctttttagtgatagcaaatggtgatatgcagcccaaagaaaatattttgattacaaaattaagttgctatcacttttaattctctacttctaaaaagatgaagtaacttttgcatgaatcgttatttactttcggataaagttcttatgtacttctatctaagcatggagttactgagtgaaagaactcattttctttatgtataatttaaactcattttgcttccagaaattgagtttttttgtttcaggggaaaataacatgtaaagcagtattattaaaaatagaaactgaatgaaaatcaatcaaaattacaaagaaagagtaagctttctaaagtagttttcaaacttgttttggcttttctaagatctttgcatttccatataaattttagaatcagactatcagttttatcaaaaaatcttcctgagattttgattgggattgcattgaacccatcaatcagtgaggggaagaattggtatcttaacaagttttgtaactcatgaacatggtatgtctctccacttatttaggtcttttaaaatttcagcaatattttgtagttttcagtgtgtaagtcttacatattatttgtttattttgtgttttctttgatgcttttataaatgacatttttaaatttcaattatttattatttgtatattaaaatacagttaattttctgatattgaccttgtgccttgtgaccatgctaagcttagttattacttctagtataggtgcttttgttaattctttaggattttctatagagacagtctcgtttgctagtaaagacatctttacatcttttcgatctataggccttctttttgcttgcactaattaggacctcctgtatagtgttgattagaactgagatgtcagctacgagctgacatctttgctctgatcctggaccttatggagaaagcattcagtctttcaacattaagtatgatactagctgtagattttttgtatatttcctttatcaagttgaaaaagttttattcctagtttgctgagcctttgtattatgagtaggtgttgaatttatcaaatgctttttctgtattcattgatatcatcatatggtgtgtgtgtgttattttgtttttctttttgaagttcactaatatggtgaattacattgattgattttcagatgttaagccaacatgacattcccggaataaactctagttggtcgtgatgtattactgttttgacatattgctggatttgatttattgatatattattaagagttttatgatatattattaagagtttttatatctatgttcatgaaggatattggtgtcgtttttatgtaatatcctttgttttggtatcagggtaatactgaccttgcagaacgtgttgtaaagtattctctctcctttttttttgaatgagtttgtgtagaattgatattattcttactaaatgggaaaaatttattaggaaacccatctgaacctaaaattttctttgtggcaaagtttttaaatacaaattcagttttgtttttttttttcataaatataggactatttagattctctttttttgagctttggtaattggtgtcttccaagtaatctgtccattttgttgaagttgctgagtttattaatttattgaaataagcttgttcatcatggatctatgatcagtgattatctttcccactcctaatatcagtaaattatatcaaccaattttatttattgatcttttccaagaaactacttttgattcatttgattcttctctatgatttttccattttcaatttcattgtctgtcatgcttatcttttgttcttctgcttactttttaaatatgctctcctttttttacatagttttctaaaatagaaacttagataattgaattaagttgattctctaaaatgtaatgtaaacagttaatgctatatgagcaccagttttcctgtatcctacaatttttgttatggttatatgttttcattttaattcacattataatctttaaaaatttccatggggtgttattcagaggtatattttttaacttcaaactatttgggtgttttgccaggtatctttctgtaaatttctactttctgttggggtcacacatggtcctgagtggaagaatctcagtcctttgatacagggagtacagggatcttcctactctgtcacatttcctctatgtcagccatcatttgctgataatattttagttcctcataatgcttattgagtaatcagtgctcaaattatatttgttgaattgcactcgttgatgtcattcagtacttctttcaggcttaacagaaagtgaataaagtggcatttgttgaataccaactgtagtagaatgatagaaactttacatactttttcattgaatgtttaccataatctgtatatcaattaattgaggtacatgatgagattctcctgtcatgtgtgagaagttgagcctcaggagggttaacataagttgtggcatcagggtttgaatctatgccactctttcttccaagttggactccttgcctaattgtgtgagactgtatgttctcttacaggtcacttagagctttaccttcttatgactgttaatcatggtgctaaatggtagtttaaattgtctatatttagaatgcgtcagctgagtttttcaatttactgaactttttatttgctctaattcatggtgaaatttttgcaaaaaggggcttatttagtaattttgtttattttaggcagtatttggcagtcgtattcagagataaacccctggagctatgggatgttaggacttgtacccttcttagagagatgtccaaaaacttccctacaataactgctttggtaagttacaatttaagaatttaatagcttatttaggtatatatgtatgtggtgaatgttttgcttaagcttgaatcaaaatcattactgccaatgtcatttttttggttaaaaatgtgtgttcagagaagatgatctaaataaatggagataattcttattttcttggataaatcaacctaatatcatattagtgcaattccaattcaagtttcatttggatattttgaggaatatggtaaacatattcaaaaatgtttatgaaagaataaaggtcctaaatagctaagtcatccttgaataaagaggagtaaatgtgggaggtgtgggtggggttggcccttcctacctgatattagtacatcttacaaaaccatggaaataaaatcagtattgtattggcacaagaatagaaagtgagtcaacctaataaagagctcaggaacagacccatgaatatttggggacttaatatacagtaaagtagcacaaatcaaagaggatggacagactgtgtagtagacggtgttgggaaaactgtctcactttatggagaaaaatacttgatctctacttaataccgtatagagaagtgagtgtcacaggactaaagacctaaatgtaaaaatgtaaagctataaaattgaatataacaaaatacaaaatattgctgtgacctagaggcaggaggagacatcagaagctcaaaccaaaaggcaaaaaaaaaaaagaaacaatgcatttaattaatcaagattaatgctttttgtttgatgaagatgtcaaagttaaatacagaagacattttgggaaaacaaattttccagtgtctaaatttaactagaaactcctgcaagtcaacagtgaaaaaaagcgggaaccctagtgagaaaatgaacaaagtctgtgaagagctaatgagaggcagagaaacctaaaaggccaacaagccatataaaggaatgttcaaactcatcagttttcagagatgttcaaaccatgatatggatctaccgtttagactaacaaaaactggacagccatatagtgttaagtacgggtggaacatagggtatgggaatccttgtgcattgctggtaggaatgtagaccaatgcagccattctgtaaagcacgctggcagcacttgggcaaacacagacatcttctgtgtccgctgagctcttggtcgtaaatgaacttttgcaaggatattgactggtgtgttttgtcatgatgtgagtttggagaccatctgtgtgtttttactgagagaggagacagattaacaattggctgatgcacccatggagtattacgtagcatgcagaaacaggaggaagaggacttaaatacagtggaaagagtaagaaacaggatgaagtatatatatatatatacacacacacacacacacacacacatataaacacaatactatttaggtaaattagataataactacatgttaagaacttatacatatgcgaggatattggactaaaaggctttacaataggtggaatataaaagaatatataaataaaacaagtgattttggaggaatctatggatgataaaggaccctggttcgagaactgtgattgtcttatcgtgtgcacataagagatgggggaggagacgaggaataggcaatactatcattgaattcattattttcattttgtaagtattttataaaaacatcaaaaggtcagaccttttggaagtttgccataaaagctccaattaaaatgcattcatttagcctttctctaagtaggtaaaatctaaagaacaaatgtggattcatgtgtagtaataataaatgatactgggcagtggtgtgtgtgcccagctcttctggacgattctttgacagaaggaaacctagcacttctaggtttgtctgcatttgctttacaggagtggtcaccatctcacaacttgaagagcctgagaaagaagcaacttgcaactcgagaggccatggcccgccagaccgtagtctcagacacagagctgagtattgttgaatcatctgtgatcaggtacagtacagtgtttcttgacactgtcatttgtgccattagcatcatgtctgggaagttgacaagtatcatcggaaggtgtctatggtagcaagttggactctgcttttgaacatacttagtttcatctttcagtacatacccagattactaaaaagataattttatcatttttagtattgtactatactgtttgttataactaataacatatgcagtaatattcacccatcagcatctagtagtaaatgtgctcattccgagtgcccttctactccatacacttcagcttctgaaattcaaatgaacatagcatagacatacagatagatcatattatcatttatacacaccaaagaaaatgtgttgggaatcctaaatttgtgtatcatccccatccataccaatcttacagataaaaggcttcagagataatgttgggtcactgtacagcctcccttctgttgagcacagttctatagccaaaatctctatgaattttatttttcttgtgttaagtttagatcaccatttctctctgtgcagggtaaacttcctctgatgttgtggctgttaaggagtgattcatgtttacccataattagctgggcaaatattagtttcagacttttaaaaaaatagttttggacctcctcttaatgcgtctgtactttgggcaagttaattaattatgagtatcactctaggggaaaaaaaaacatctttatcatatgtttcactatcccaaagcttgctgcaggaggcagaaagtaaatctgaacttagtcagaacatctctgcccgggaacattttgtatttaccgatattgatggccaagtgtatcatctcactgttgaaggaaactcagtaaaagacagtgctcggattccaccagatgtgagtacaaccttgattaaatcttcatcaagaagattttgttttgttggttccatatccagtgaaggcatagttaagttggaaacttcagaaaagcctaatgtaaataaactttatttaaggagatattatcgattaaacttgttccatactgctagagaataacgctgtaactattttgattaaatgtttactgtgtgctactcatttttatccctgtaataatccatgaggagttatctccattttacccataacaaaactgtgggagaataagtaactttcccaaagttatccagcttactcatatggcagagcagtgttttaaactcaggcctgtctgacttcagtatctgtcttctttccatttcaggcattaccctgaaggatttgacttacaatctagtattatttttggataatagtaatcaggttgtaagtgtaatagtattattaacatttactaacttacatatattcttatggccttgtggaatctgtaactaaagttttgccattaatcatttgtgtcagcatgcatctcatagatagtttttaatagatggatcatgaaaatgtttatgttaattaatgcaggctattataatggttaaatgaaggcatgaggggattttttaaaataggtatatttattttaaattgctatctaaaaatggaatgctctagtagaatgccaacccccataattttataggtggctttggggtctcataaagttacaatctagatgttggctgtggctacagtcttttgaagtgtaatgggacagaaggatctatttccaagttggctgcctcacaggctattgcacattaatgctggctgttgacgagggaccttagttcttcatgtcgatctttccataaggctgcttgagtgtcctcacgacatgacaactggcctcccctagagtaagtgatctgataaagcaagaaggaagttgcagagtctattatgacctggtttcagaagtctcttcaaaggcaacttcttaattaaacattctattttatggctaggaaagtagatatcttaaaatgttgcttcatattatatacagaatttcatttctttaatatttttttttattaatggactttattataatattgatttttaaatccagtttttgttttgtttcttgactattaccagagtttttacggtattcagtgtgtgtgctagtccactaatggtcaattattcaaaccactagagttttcttactttttaccatggataccatttgaatttttatgttgtacaataaatgcaaaaataaaatttcttttaataaatagagaagtaattgagcagtaatattatttaatagctaacatgtattgactatttactgcatggcaggcattgctttaaggcctttgcctttataaatttattaatactagcaacaactcaagtttcatgaacttaccctactttatggacaataaatccaagacagaaaggttaagtaaacatgcctcaaatcacataccagtttcaagctgggattcaagcccaggcagtgtgactgcagagcccaggctgctgagccctccatgataccacctctgagcatctattagaactgcaagttcctttcttcctccaagttagattgactacagcagcatttcattcttatgttgtgcttctatatgtaacttctgagcaaagctttctgtgaatttaaactgcatatgcctttagtaaacagcatctcttcaccttcatgattccacaatgttccaaaacgtgtcagtgaagctctggatccttttttcaatagaaaaatcacggcacaattagttataaaagagctttaagtttcccttggaatggatttagttatccttttgcagtgagagataagtttgagttggctctctggaaaaccttccctttacttctctgtttttcttactttaatttcccccttttttttttgaggtatttgttcctcaaaagacatcccctctctttaaatctagttccagtaactacttaatgtctatgaagttgaaatctcctatttcttcatagttgaaattgataggcaatgtagctctttgttagtgtctaaagtctgttttaggatttgatgactaaaagcatactaaagcacagccctttaaattaagttttattaaaatatttattataatgtcttatacagcatagtgaaatttatatttgtttgttgctgttgttttctagggaagtatgggtagtattacctgcatcgcttggaaaggtgatacattagtgcttggagatatggatggaaatttaaatttctgggacttgaaaggcagagtatccaggtataagccaagaatgaaatcttgttatttcattaaaaaaaagaaatgaaatctttttgttttgttttgttgagatggtgtcttgctctgtcgcccaggctggagtgcagtggtgcaatctcggctcactgcaagctctgactcccgggttcatgccattctcctgcctcagccacccgagtagctgggactacaggcacccaccaccacgcccggctaatttttttgtatttttttagtagagacgggatttcaccatgttagccaggatggtctcgatctcctgacctcgtgatccgcccacctcggcctcccaaagtgctgggattacaggcaggagccagcacacccggccaaaaaatgacatcttgatatggttccattagaggcttgtgacttggcaagaaggatcagtaaactcgtggaggtgtagcttggacccttgggtcccttcacctaaacttgggaggatgggccttgagccaagcattcttaggagatagttatctgcaagtggcccctgcagaagtcttagctgaccttaaagggcaggccctttctgtcagatgtggcccccagtcccagcaagtaaagggttctcccatcatcagacctgttagaaatggaaatagtgagagatgttagacatagcttctggtgaccagatctcactctacattgtattgatgtttttgtttctttgtcttcagaggaatacccacacaccgaagttgggtgaggaagattcgttttgctcctggtaaaggaaatcaaaaattaatagcaatgtacaatgatggagctgaagtgtgggatactaaagaggtaggccctctccatgaggataaaacgtaaataaattgttagccataggaactgtgctttgttaaaaaacttctttctgatttagaaatgaaaagtacttaatgagttcgtcaagtttcccataacaaattattttctttactttacagtatttgtgttctaaaggtaacaactcaagatttatttatttatttatttatttatttttattttttattttgatatggagtttcactcttgtcgcccaggctggagtgcaatggcgcgatctcgacttattgcagcctccacctcctgggttcaagtgactctcctgcctcagcctccctagtagctgggattataggcatgtgccaccacgcccggctaatgttttgtatttttagtagagacagggtttcgccatgttgggcaggctggtctcaaactcctgacctgaggtgatctgcccgcctcagcctcctaaagtcctgggattataggcgtcagccaccgcgcccagccgatttatttattttttaatattatcactgtctctgagacctttaaaatgctgcctatttgtggaagatagattgccagaggctgttcagttctaaacttgaactgggcctttgccacagactgtcttccttgaccatttaatctagaataataaagatcttccttttctgtctggaagtgatgcccaaattcactcttgaaggttcagatggtgagcagtttaagaagtggcagaaatgtgacctttcgtatattggatgtggactggtgtacgtcagataaagtgatcttggcctcagatgatgggtgcatcagagtcctagagatgtctatgaagtctgcgtgctttagaatggatgaacaagagttaaccggtatggaatcctaatgatagggggctttgaaacctgtctttactttgccacaagctcttgtattttggggagagagctgctgcttctgtttcatttcagtcttattttcttagaatctgagtttaagaaaatatattaacttgaagcttgagtgtttttactgctgagatgctgcaatctttgtaactatagatgtcaatcattctcaattcaggttttttaagtgccccttttgactcttttctttggtttgttaacaagataaaagatgtttatgtttataaaaatggcttactcagaatttaggcaaactcatcagaggacataaatctagtgataaggctgctggctttttaataatggccttatgtcttttgcaaccatatatcattgaaaagtcactttagaaagtgttctgagtattatgaattttgatgccaatctgtgactagtaaaatgaccagtcaagcaaattagcagattgcagtatcttgctctgttttgtatggttgttttgacattgctttttaccagaataaaaagcattttagtagaatatactccatatatgacttctaaaaaaaaaaagaatgggacaattgtgaatgcatccatttatcagtttaaaaggcagcttttggctgatgcaatacagtgttcatccttggaagatacttgatcctacttggagtggaggagggaacttcttgcctgagtattctcccagcaaaactttggtgcacactctaggctgatatgtagaaaatttcatgagacttttctgaacctttgtagagtcaatatttggcacttcagacacagtaaggttttaaaaacctggtttttcactttgtgttcatgcttgaggcactactgagttgctgctaatgttagcagggctgcctttaacttagttaggtatgctttggtttttgtcactgcccacccctgcccactgcatttgggcaccaccacttcttactatgtaactgactgccatcaggtgaagccagaattcaagacctacattcccatgtctgtccttgtgtcgtttgccagctctggggaagcaccaggatggcctcctaggaaagggcaagcattggtattcattttaaacctaaaggtattgaggacattgaaggaacttcaagggtggtttttgaaaaaattggttactaattctagataaagaagtgtggaactgctatctaaatgtttgaagagcttttccttcacttttaatataaaatttgaatctaaaaagctccaaagtcaaggtgtagcttgttcttaaattaaactgactacagaaatggagtccattgtattaacccatgttcaataccatacttgaacatctggcctgtggccagattttagatcacatgtttcttttaaaatttttctgatttttttttatattcttttcaatctctaatgttacagcctcagccagaaagagaaaactaaatagcaattgggaaaggtcatgcaattgtgtattcattccacaaattgaacttcaaattcagaacaacccttaataaatgttaaagaatgaaaactatggtagtgtaaatgtggagtgaggaaaaagacatctgtgtgttcacctccagattcatggccgatttggtcttgaggaaaaaaagtttgaggtagtatatttctattctgaggaattagaagtatatttggggcttactgacatgggataaaaataaaataggtcctaacattggtgtttcctatgttttcttcaattctccttgaaaacaagtagagaacgtaaaatattgattcacatctgtacattttcttagagcagcttagataggccacttcttcctccaataaagagggggcagtcagacaaattagaagattagaattcctgtttttgagttggagaacctttcttatcggctgcctaatatgtcagggacacaaagagccatcaaaataaatcttaatagtctttttagcagcatctaaaaggaatgcaagaatatgagactgtttaatagcattctggtatcatgcagtttccacaccctttaaatagtattgacttgatatcagggactgttcaacctaatttcctccccagtgttttttttttttaattttattattattatactttaagttttagggtacatgtgcacaacgtgcaggtttgttacatatgtatacatgtgccatgttggtgtgctgcacccattaactcatcatttagcattaggtatatctcctaatgctatccctcccccctccctccaccccacaacagtcccaggtgtgtgatgttccccttcctgtgtccatgtgttctcattgttcaattcccatctgtgagtgagaacatgcggtgtttggttttttgtccttttgatagtttgctgagaatgatgatttccagcttcatccatgtccctacaaatgacatgaactcatcattctttatggctgcatagtattccatggtgtatatgtgccacattttcttaatccagtctatgattgttggacatttaggttggttccaagtctttgctattgtgaatagtgccgtaataaacatacatgtgcatgtgtctttatagtagcatgatttataatcctttgggtatatacccagtaatgggatggctgggtcaaatggtatttctagttctagatccctgaggaatcgccacactgacttccacaatggttgaactagtttacagtcccaccaacagtgtaaaagtgttcctatttctccacatcctctccagcacctgttgtttcctgactttttaatgattgccattctaactggtgtgagatggtatctcactgtggttttgagttgcatttctctgatggccagtgatgatgagcattttttcatgtgttttttggctgcataaatgtcttcttttgagaagtgtctgttcatatccttcgcccactttttgatggggttgtttgtttttttcttgtaaatttgtttgagttcattgtagattctggatattagcccttcgtcagatgagtaggttgcaaaatttttctcccattctgtaggttgcctgttcactctgatggtagtttcttttgctgtgcagaagctctttagtttaattagatcccatttgtcaattttggcttttgttgccattgcttttggtgttttagacatgaagtccttgcccatgcctatgtcctgaatggtattgcctaggttttcttctagggtttttatggttttaggtctaacatgtaagtctttaatccatcttgaatgaatttttgtataaggtgtaaggaagggatccagtttcagctttctacatatggctagccagttttcccctccccagtgttaaaggccactgctaagcacatttttcctaagtaagcatatatagaaagaagctttctgaaatcagatttctgcacaaacctttcctcttcatctgccacagctttccacagtcattttcggtaatcttggggcattcagaaatgtctcacaatgacttgccgatgtggggaggtctggggatgctaaacaacctggaacgatctggcgcaatgaagaattgtcctgccccaaacgccagtagtgttccttagctctctttttcaccgttcattgaatcacactgaacaaaatcacaaaatatggtcctttccttcccagacttccagctcaccttaatgttgccatttccaagtggtggaggaataacttttttctactgattttcttcttggctctttgcttactgattttctgcattcctgtcatgtaggtagctaaaaacctgggtgttatgattcatacctcacataactttagcccagatggagcagaatccgtgacaaacagcaatgatgctaactgcttttgcattctaattgtgtaattttcagaggtgaatgagctcttgcatgtgagtttctccagatgtgagatgatctcctattactttttcatggctgatctttacctttcagaagaaagatttcaattcatttgagggagggaagtagttaagggtcactttcagtttgttcatgctcattgggatgctgtcaacaatattttgcttttggagaaataacatatttgttttaaaaaataaggtatttccctccttttattcagacttggtaaatgttgtcttgcttgcatgatgtaaacactcgatgctgccttctacgtggattctcttgtatcttttcgtttgttcattgattaagaaattaccacacagcatgagaactttccctgaaccattccaagattattatgtatagttaatttttttccctgacatttaccatttccaaacatactgtgatataataccaacaactatctacatgaatctacctaaaacatatacatatgctatctaaaatatgaatggggctgacttgagaattatatagattgtcgtctatgaaggatgaatagaaagaaagttaagtaagctagccacctgcatccctttcagtgttaagtgttcagtgcttctgtaggtagttagataagcctcatttttccaagatgcaatccttcctttatagcccagatgtaaaagaaaagatgactaagtggaaattaaaaaaaaaaattcaaagcaaaagaaaatctttaataagaataaacgaaagtgttcaataagcaaagccaaatacaaatgattacctggaggaaagtaattcacaagtcacagactgtctacagaggggcaaaacagataaacaaatgatgcttcaacatatgaaatgatactcaactttatttataataagaaaaatatttgacctcctactggtaaggataaaagaagaaaataattttaaaaagtaaatttttaaaaagagaaaaatacaaattaaaattgtttcttacctatcagattcaaaagcttgaaaatatactctgttggcaaggctatgaggaaacaagcactctcatccattgctaacagtaagatccctataggaaggaatttggcaatatctaacagagctacatgcacatttacctttttacccagcaatcccagcgctaagaatttatcttaagatgtacattcataccctgtgaccaaaatgcacacaaagttattcatagcaaaattttgaaaaaagccgaactgcttagccgtaggagattggttgaataaatctggggacatctgcagaatggagtaatctatgcagctgtaaaatagtgaggaatagctctgtgacctgatgtagagtgatatccaggatatgtgtaagtgaaaaatgcaagtgtaaaagagcacgtatagcctgcttgtgtacaaaggcggattttatacataggttcatgcacacgtttgcttactaaaacacacaccacacatacacagaataatccagaaaccaatgagaatagttagaagatgtagatggaaaaatggagagtatggggatagcagtgaaacttctctatctttgttatacagtttcaagttttgaaccatttatatattttatatattaaaaatacacagtgaaaacaagagtgaagaaaaagcaaaccctaaaattgaatgcaagacacagttgaaccaaactgtgtaacaacaatattggtaacataaccacacacacacacaaaaacagttcaaataactaaaacacagaacttcccattcactgcacacctttagtggtttatattctaaggacagaattgctaaggaatgttgaactttaccggggtagttgatggtgacactagtaattctgaagctgttttgtgcatgttgtagtctggaacacattagtaaccaaattgcagttttggggagccaagatctgtgctgatagaaagggagatatggatgggaaatggcggtggtgggaagaaacattccaggggtggatttgggttggtaaaaaatcatgacttcttgaacatgtatgttccctggctctgctcacagagagttttcttgcaatgacactcaatggcagtgagcgcacatagcacccagattttactttgcaagttccatttccaggctaaaaggagccagagctctttggacaaaaagtttatttcaggacagaggcacaaaaggtgcaagatgggtctggggcatcttgtggtgccagaattcaagtaaggaattgaaaaaccaaggaggacctgacataagaggcttctcctgtcaaactgggggtagtctgagcatcacgaaaactaatggtggtattgatgtaagtgcagaataccaaagaaaccctcactccatagtaatagtcacagtaaggaaacgggaagtgggcaagaagcaaaagctcaggtggacagaagaatgccagctgacaaatgcggaaagaataagattagaaaatcaccactttgcagccccgatacaataattaattgtatacacaagcaaggatcacttgtggatgtcaaatcactgagtaaaaggatgtttgagaataggaaattcaatctgacaatatttcctccacatattacttactaattaattatacagtggagaaggtgccctgataagagctctggtgaataccccttatctagatgatcagatttagtgtttcctgtaaccagacagctaacatgttccttctgatgcaatgcagtgaaaagtacacagcatcctttgttcagactctgtcaaaaatgtttaacccgaatctgataatcagaaaacagacaagttagaacgtagggcattctccacagcagctgaccaggactcttcaaaaatgaaaaggtcacataaggccaaaaccaaaaaggaagaggaccattctagattggaatagactaaagagacatgacaatgcagtgtaccagccttgactggacccgatttttaaaaataatacagctgccaggacatttggggaataacaagggacttttgaatttggactgcattttaagtgattttactgaatcaatattaaaattcttgggtgtaaaaaaaaagtattattaaaaatatttccaatcactttctggcttttaaattgaaaaatccacataaaatattttgtgtataatttaatttttatttaactacatagaataaagttttctaaagcagagttttccaatagaaacataatgtgagccacataggtaagcttaaattctagtatccacattttaaaaagtaaaaagagatgaaattgattttaattaaaattttatttaagccaatatatccaaagttttatttcaacatataatcagtattaaaagttactagtgagacattttacttttttaaaattattcattcttcaaaattctgtcagtattttacatttattgtaaaatgaattgccctcaaaatttataggacaaattttcagcacaaacagttaagctctatttagattttataaaattttcagttgaaaaagtaggcatgtattcaagttgtttcaaacatatttaaaagttatccaatgactgaatcaataatcactttttaagtttaaattagacaaacattcatttccttcattatactagccatatgttaagtgactatcatattggatatcatactggataattgcacagtccagagttgatgtggatcactgatacgatttggctctgtgtctccacccaaatctcatgtcaaattgtaatctccacaggtcaggggaggcagctggtagggggtgattggatcatgggggcagatttcccccttactgttctcacgatagtaagtgagttcttaggagatctgatggcttaaaagtgtggcacttgccccctcgctggctctctcctgctgccatgtaagatgtgccttgcttccccttcaccttctgccatgattgtaagtttgcctccccagccatacggaactgttgagtcaattaaacctcttctctttataaattaccctgtctcaggtagttctttacagcagcatgaaaacagacaaatacagtcacttaaataagccaacaccatgtataagtttgtgtcattttacataattgtgtctattcaagggatccatggataaagcctcttcaggattctggaggggagttggtagtaaggccaagttgtaaaagccagggcacccctagaaatttggagctaaggtcgagtccgatagagtgtagggtggtcagagcagagctgctgggcattgcagcctttaggtcttctgcttctttgcactgaaacatgttgacaactaggcaaatcttgcttgttagtgttctaagtaagccagctgctggatgtgggggatgctagggcctagagtctaagaagatagcccctgtgttcaacagctacctttataagtgagacctgggaatgctagtgatcacaggtggcatgatcccttcagtgacatactcaaggttgataggccatgttagttgaatagtctcggaaaaacaaaagtacatacaggtaaatatatttatttttaatatttaaaaataatgaactttgttgctatttgttgaatcattgcattgaatcctttattcaagtagtaccagagttgtataccacacaggatacttaaattttaaaggggaaaagaaggccgggtgtggtagctcatgcctataatcccaggactttgggaggccaaggtgggcagatcacctgaggtcaggagtttgagaccagtctggccaacatggtgaaaccccatctctactaaaaatgcaaaaattagccaggcatggtggcaggtgcttgtaatcccagttacttcggaggctgaggcaggagaatcgcttgaacccgggaggcggaggttgctgtgagccgagatcgcaccaccgcactccagcctaggtgacagagcgaggctttgtctcaaaaaaaaaataaaataaaaaatcaaaaaagggggaaaagaaaaatatgttaatcagatttgaatgcagagactctctctgctcttggcttgtgtttcctaagcggtgactacattgaatatactctcagttgttccagatttacctgttgctctctgctgactgctctgtaaatggtttatagctgaagcttcactgtagtataaaacttcattttatttttaaaaacctttctttgttgtctagagcctgtgtggtgcccctatctccttgttccaagggcctctcttgccttgaaagccttcttattacaccagccttggaatggacagtattctttggacatttctcatgtgtaagtttttcacttttctttttctttcataatttacttggggttgaaagacacccatgaaagtcagccatggcctgtactccagcatttaaagggaatggagcctttaaagccgagagaaggcagagacactacagaattgccaggctgcctctgggttctcgggcctttgtggaagtgtgggtcagtgaggagctgtgagggcgtgtattgctctcaggtggctgtgtgcttgtcttatggtctgaacatggatgtgtcgtgatgatgaaaaggatgcgtgtgaagagggcaatggaaggcaggagaatttggagccgggcacgttctttttaaaagcagcatcattagcttcagggatatactgtgtcttaaaaatctcaatatttgcctcattgcaaaaaaatattcacagaaactattagtgtttattaattaaattcacaaatattactgaactcctgccatgtgcagcacggatggaggatttaaaaataatgccaggaagtgtctgttctccaagcactgtctcctcagaatattcattctgcagagctctaaatgagcagattcctttagtaacattgttaagttcttcattaaaaggaatctaaacctgatagattttaaagcctgcttataaatttcctggtttcttgaaagccaaggagactttctttactcattttcttgtttttgactcaataagataaaagcagatattaaagttgattggtggggtcctgagtagattgttgttattttggtctataaccaggtttctaaccaagaactacgaagaaggttatctctatattaacacaacttttttcaggtgaagaaatacgtggttttaagtgaagagataatgaactcattcaaaattttttctttacagtgactatccagaaaatgaagaaataaagaatctcctccaagaacagttgaattcattgtctaagtaagcactccatgtttcattagaagataggaatatgagaaagaaaaatgcaattcaactttaaatgcaattcaaaattaaaataagttacgttttagaaaatattagtggcccaagaagagaccattctgtttagaggtttgcttcccgttagagtctgtgttttgcagaaaaagtacttattcagtagttacagtgacagagcatctgtcttcaccaagttcatgagcaccagctgctctgatctcacatcaaggcaggactagatgcatagtgggagcatccttgtagctcagcttgcctctactacaaacctccatgaagcctcacagcgggagacgaatcgcagggtgattctgggtctgcttcccgcttctaaaatgagttctctgtgtcaggtgctggtgtgcacaggtctggctaagaaattaatgtgctccctagagccaagggcatttaacagaatgtactgggaataagaaaggaaaaaatatgggtctacaaggagttcttggggaaagcgtaacacatttttgcaatctagaatctgttacatataattatagtatttaacaaattaagcatgatattttattgacggaaaattcaaaataattagttttttctatgcaaagattaacatttatgtttaaatgggaaactatagatttaaagaatgtcttcctttctgatttgtgaatattcagtattttactattttagaaatacgaacttataaaagcacaagccattcttccttagatactttatttttggaatagtttcagaataaattacgaatgtcatcttctttaaagtatttactgttcttgatgattttttcaacaatggcattcttgttccagtagttaggcagctaatactttcaaaaactgttgtaagcctataaaccagaaatgagagcgctgcagctccctgtggtggctgaaagctgctgcttctccaagccttgagaacactctcagcccccttcaacttttataatttcagggtcatggtaaagtaccttgtcttgtgtaaattctaaacatgttatttgactggaatttttcatttcaagagtatattgatcaacccccatgctttattgtttgattgaaaacttttgtctcacttttgtccggatttcttccacagtgacataaagaaactgttgcttgatccagaattcactctcttgcagaggtgcctgcttgtttcaaggtaatattgtttgatgtattctgtataagagacaggatttcaagttaactcatttcttttaagggtttttagttagaaacacttagattttagaaaaatgtatcagttcatcctttagatttaacttaaaataattttgacagtagtaataacaaatagggaaaaatcaaattgcattttaaatgtgagatctaggccttctctctggaaagcacttcctcctacagctttttaaaatatgtgttttaaaatatcagatacaggtatatttaaatataccaataaattatatttagaagcgataacctctatatcctgacttacagtagagtttgtcacttataaaaaagactcctctccccacagaataaatagcacattactttcataccttatctagccagttatcccagaggaacttcttcctaatgtgaatcaatggcccacattgaaaggtgtgctaatggcaaaccaggtaaataattgttcttaacacagaacagaaagatgctggagtctgaaggggtcctgtgcagtcaggcccccgtattgttgaaggcccagtagcagggcaggagaacttgctgcctccccctttcaccctgtcaggccccatgccagtatcccagtggatatgtgacaacactcccttccagtccctcagtctactctaggaagccatccaggccaggtgtgctgagtgcagtcaaaactttgcttcatccttgccaggctctatggtgatgaatcggagctgcacttctggactgtcgctgcccactacctgcacagcttatcccaggaaaagtcagccagcacaacagctcctaaagaagctgctcctcgagacaaactgagcaacccactggatatatgctatgacgtgctctgtgaaaatgcctactttcaggtagtctgcttcacacagcaaaacctttagagctgtcatcttgattacttatatctttgtcaatatcttaaacttgggaaactttcaaactaagttactgttcagtaatagaaataagcccttgaaaattagctgggtgtggtggcacgtgcctgtagtcccagctactcaggaggctgagggaggagaatcacttgaacccaggaggcggaggttgcagtgagctgagatcacgccactgcattccagcctgggcaacagagcaagactctgtctccaaaaaaaaaaaaagaaagaaaagaaagaagccctcggtacatttgcattaaaaaaaaagcctgatcaagatttgaaaagctcatagacagttactgcgttgtttactaaacattaaaattttattattaaacaggcttgtttaatttgtcttacatttttaacttggcttcattttaattctgtcattaatttcctataaataacaaatactttatacacttggtttgaatttgctgttcacatgataatttctttaacctcctgcagaatccttcagtgcacataggtttttcatccggctctacttaagtgtcagtttctgtaggcaggcaggtatgcatccaagtgataatatctatcaacatttttgctgttcaaattcttattaaatgtttggggtgctgtaaagttgattatctagtaacctgaaaagtcaaagtagtttattaaaatgatcttattaagtacagtaaaatttaaataattccaaactcttataatccaggcttaatttttcttttttttccaattctagaaatttcagctagaaagggttaatctgcaggaagtgaaacggtcaacttatgatcatacaaggaaatgtacagaccagctactgctcttgggtcaagtatgtcagtttttataactctacatgcttcattaaattgctagttaattcgtatttcagagcaatatatctgtatgtatatatttcataatattttccccttgtatgtacctccttccctgtagacagtttaggctttctttcaaaataataccaataaacctcatgagaaaaaacatatggttaaccagcttgtaatttagacttccataatgcccagtggagcccagctatttgttttgttttgtttttgtgtctgaattgactggtacaaagctaaaataggcaattactcgagcacctagatacaccagcctctggctttatgtttgtctcaaaaaagtagtgtagcacctctgtttaatgtttgtatttgtaaacaaaatattcaattgcattttttgaaaatgagtgttttcctttagttttctaccttatgaattttaaaaagttatgttggaggaaaatgttctcataattagaaaaaccgtttctcttactagacagacagagctgtgcagttgctgttggaaacaagtgcagataaccagcattattactgtgattcactgaaagcctgtttagtcactactgtcacctcgtcaggcccctctcagagcaccattaagttggtggcaacgaatatgattgccaatggcaaattggcaggtaaggcacacttgatatgtttgtcatctctctgaaaaatgagaccttgttcccagcaaagtatctgattagtagggacatttctttctcttttacatatgctgaagaaaaatagaaaaattattgctacctataaatcagatgaatataattgtctaaaccagaattaattgtttacacttttcagagtgaaagggggcactgttaataattgctgagataataggcataaatccaacaatcctaggcaaatcagaacaataaaacctgtgagagaactatgctctccctacttattctccagactgtattgtgcttcctaccctggttacttgagtaataacagtaaaactcttaatattatgtttcagaatttaaatcaagaatgtcttcagtaggtataaaatgggcacgactagataaggtcaaatggggatttaactttttaatgacttctcaaagaaggagctgcagtgtcacttaaggggatgcgcttttgtctttcagagggcgttcagttgctctgcctgatagataaggctgcagacgcctgccgctacctgcagacatacggcgagtggaatcgggctgcatggctggcaaaagtaggtggttccaagtttcaataggtgccctcaacattcgggatagaaagctcagtcctgaactttggacttatgacttagaaacattttttggcctgcaaagctgctttgcaaatactgtcttggaacctttatccttttcctattctttatgagtgtaaattgcattacttatttaaaaatggatcttgcattggtagcaattaagtaaaagcagctgcctcctctttctcccagagtctgagccgaaactacagtccagaggtatagccaggccctgggtcccgtaggcacagaccgttatcattattcagagtatgcagcagcttcagggcagtgtgctagtcaagcagagcatagcctgtatttcatagaaacagatctcactttaactgaattattattttttctttatagagtgcaggatgtttttgttgttaacacaggcgtctttctcaggtccgtttgaatcctgaggagtgtgccgatgttttaaggcggtgggttgaccacctttgttctccacaagtcaatcagaaatcaaaggctctcctggttctcctctctctgggctgcttttttagcgtggcagagacgcttcacaggtaaaccgagagttcacatgggctgctcaggcctgcccgtgagcagtcacttcatgttctctcgcggttctagcaggtcatggtactcgatgtgtaaagtgaaaggagaagtatacatttcaggtttgtcaaaaaacccaaaggagaatggaactgtccgtattcattacatcttcattcggtctaggagctatgctagtttcctactaatatgctgatcagacttaacaggcacctagtaaaagggaatttaaaagtcttcagagaattggggtccattcagctttgactagagcaactgagaggaggcccagagagcagggggagaggcgacagaaggcatggtgaggtggagacatcccgtctgaaaatctggaagaggaacaaccatcactaattgtggagcatttcatttattcaaaactaagggaggtagattacggaaatatgacaaaagattacttgtcaactctggacaggggtacatgggcacttgtcatatctctgtagatttttgtgtatttaaactatttcacaattttttaaagtattaattttaaaaagcttgtgtttggagatgtgagtattcttccctccttttttcaacaaactagggcttagaaaagtgcttgtatcttaatgcagtatgcaggtttccagggaaaatgtgtaaatgtctttatacccttcgatgctgctgcccaccagtgatgtaaatcacaaagcataactcttgttttgttctgttgagcagcatgagatactttgatagagcagccttatttgtggaagcttgcctcaagtatggagcatttgaagtcactgaggacacagatatcctttgcaaggttgtttgtagtgacgaggaagaaagtgacatgcatgggttttggaatttcccttagttgtgctgcctggacaggaactatattatattgtgaaagatccatgttctgattttctgattcaccaaagccaggaaagagggagaaattagaggacaaagaatcagataagaaggtggctgcaccatgggtgtcagctttgactaggatggagggaggcaggaaggactatagaggacagggcccccaagtcttgtctgaacttaaaaagaagatgaaggaatgatttgggaaacaggtagaaggacctggtactttgaaatagtactttttcaagaccagacattccatggaataaattttatatatttatctagaaaaaatatactggaataactaaaaaagtctcacgatcacctctagtgacaatatgatatgggacaaaatacagcacttaaagagaggtgttgctcaggccagccactataatccacccatcagccagaacattttatttcttctaaatggcacttgagcaacattggtttctttgaaaagaatgaacttgagaatgcaactcccaggaccagaaaagaatgaaactgggccagtgcttgcatggtcctgctgctgctcactgcactttgcttcaaattcttacatttgctctcatttctacatggcaggtacttggttctctctctctttctccctctttctctgtgtgtgtttataatttttttttttttttaacagagaattaaaactaaactaaaaattttttttttcctttttttgaggtaaggtctcactcttctgcccagactggagtgagtggcacgatcatggctcactacagccttgacttcctgggctcaagcagtcctcccacctcatcctccccagtagctgggaccataggtccacaccattgtgcctggcttttttttttttttggtagtaacccgggtctcactatgttgcccaggctggtcttgaactcctagttcaagcagtcctctcaccttggcctcccaaagtgctgagattacaggcatgagccacccagccctgcactgaaagttttttaaaattaaactgaaggctgagcctactcaagatcatgtacctagtcactgggaaggtgactggttcagtgtatgcattttgaggatcaaagcatcagcacagagtacccaataggctgtttaaaaaaataaaaataaataaaaaaaaaccaataggacagggctttctaaaaacccaacaaccagatatagggaacattcagaaataaatatctgcccccaaactgccagcctctcagactttcaaatggaatgaggatatgcaggttaagtttctcctctcttatcattcatcttccaatcttcagttgagtgtaggttatgggaggatgttggttgggtcttctggaaggagaagctttggactcagctggtacgaaaggtaatgatggtacagactgagacatggcctactatggccgggaatcaccctctgcccgcgaaaagtctcctgtgttcatcctgtgctgcccgctgtggacaccaggtcccttccgagcagccagcagagcagacgcgactcacccttcctgcttctgggagcctgtgaagagtctcatcacagccctttttactcttcttttccttaactatggtttacagaaactcatcactgctatatatgcagattatgcccggagtttgaagaacctcggttttaagcagggagcagttctctttgcttcaaaagccggagcagctggcaaagacttattgaatgagcttgagtcccccaaggaagaacccattgaagagtgacagcttaataaatgccagggaatctgacctggaaggcagatgggagggggctggtctggctgtggccaccgtcacagtccaggatgaagaggagtacagggtcctgtgagctgtttgaccactgttctaagactatgtgtgcccaaaagcacataagcatctatgttgagagtaagtttgtatcctgcgttggtctcagaaagaacgtgaatgcttaagattttgaaagtacataatattttatactttgggagagagctttaagagtccctggaaatactttttaatttttttaacttaaaattcaagagactgaatcacttttctcattgattaaatgtaaagattattgagaaacctatagtaaatgaaatttgtgagatgttttctcaaatatatgctgtgcctgtacttatatacagtctttcaagagagatacaaacaaggcagaaacatttaaactagtattaaaggtagtttaccaaagcattttttgttttcttaccttgaaaacacagaaccgttaattccttggtttaagcagttgctaagttttgtaattttaggctcagaggaccataggaggttttaagatttatgtttagtccgataggtgaggtctttgatattttgaattttaactccttttatgatacatcacagtaacctcatttttgaagtctttctttgtactttaatgttctctctgttctaatagttgaagtatgagatgtaactattataaactgttgctgaaaacataaatgtctgtaacttacaaacatgataaataaattaaaaattccatccaggcctttgtgttctctgcattgctgtgcatgaggccaggtcatgaggtggctccttaggagtcatctggtcgcccagcctctaaagcctggctgctcctgctgtatccagagaaacctgtatgtgggaatcccatgggtgcggtacagggcaggaatgacacccacaccccgggcaagtctacctctgagttcccgagtgggaatgtggcttagtgcacagcttttggagatgagggggtgagcacttccatcttttccctcctgagcctgctgggtgacacatcatacccactaagaggtacaatttttaaagagaagcatagcctctttctaccgttagaccaaccagtctgacaccctctgccaaggaactgagctccatggaaaggaaggcctgtcccaggaatatttgtccgtagctcggtgctttggcgagcagttctgtgtctggagttggttccttccggtgggttcttggtctcgctgacttcaagaatgaagccacagaccttcacggtgagtgttacagctcttaaaggtggcacggacccaaagagtgagcagcagcaagatttattgtgaagagcgaaagaacaaagcttccacagcatggaaggggacccaagcaggttgccactgctggctgggatggccagcttttattcccttatttgcccctgaccacatcctgctgattggtccattttacagagtgctgattggtgcgttcacaatcctttagctagacacagagcactgattggtgtgtttttttacggagtgctgattggtgcatttacaatcctttggctagacacagagcactgactggtgcatttttacggagtgctgattggtgcatttacaatcctttagctggacacagaatgctgattggtgcatttacaatcctttagctagacagaaacgttctccaagtccccactcaacccaggaagtccagctggcttcacctctcagttctagaagaaattcaggatccattattggtcccatacctggctcgtgtttcctgtcctttctttgcctagacacacagcagtagactttctaaaggccacatgcaaacgccactttctttacattgtttattatttgtccagatttctttattcaaccattctcttagctttggctgctataaccaaatacagagattgagtagcttaaacaacagacatttatctctcataattctagaggctggcggtccgagaccaagatgccagcagatttgttcctggtgaggaacttcctggcttgtagagcgccgccttctcgctacgtactcatgtggcctttcctctgtgtatgcacgtgaagcaagcaggctgtctgtcttccccttatataggccctaatcccatcatggggtcaacctcagcctaattacctccaaaaggctgaaccctcgagggaggagccaagatggcggaataggaacagctccggtctacagctcccagcctgagtgacgcagaagacgggtgatttctgcatttccatctgaggtaccaggttcatctcactagggagtgccagacagtcggcgcaggtcagtgggtgcgtgcaccgtgcgcgagccgaagcagggcgaggcattgcctcacctgggaagcgcaaggggtcagggagttccctttctgagtcaaagaaaggggtgacggacagcacctggaaaatcgggtcactcccacccgaatactgcgcttttccgacgggcttaaaaaatggcgcaccacgagattatatcccgcacctggctcggagggtcctaccccacggagtctccctgattgctagcacagcagtctgagatcaaactgcaaggcggcagcgaggctgggggaggggcgcccgccattgcccaggcttgcttaggtaaacaaagcagccgggaagctcgaactgggtggagcccaccacagctcaaggaggcctgcctgcctctgtaggctccacctctgggggcagggcacagacaaactaaaagacagcagtaacctctgcagacttaaatgtccctgtctgacagctttgaagagagcagtggttctcccagtacgcagctggagatctgagaacaggcagactgcctcctcaagtgggtccctgacccctgacccccgagcagcctaactgggaggcaccctccagcaggggcacactgacacctcacactgcagggtactccaacagacctgcagctgagggtcctgtctgttagaaggaaaactaacaaacagaaaggacatccacaccaaaaacccatctgtacatcaccatcatcaaagaccaaaagtagataaaaccacaaagatggggaaaaaacagaacagaaaaactggaaactctaaaaatcagagcacctctcctcctccaaaggaacgcagctcctcaccagcaacggaacaaaggtggacggagaatgactttgacgagctgagagaagaaggcttcagacgatcaaattactctgagctacgggaggacactcaaaccaaaggcaaagaagttgaaaactttgaaaaaaaatttagaagaatgtataactagaataaccaatacagagaagtgcttaaaggagctgatggagctgaaaaccaaggctcgagaactacgtgaagaatgcagaagcctcaggagccgatgcgatcaactggaagaaagggtatcagcaatggaagatgaaatgaatgaaatgaagtgagaaggaaagtttagagaaaaaagaataaaaagaaatgagcaaagcctccaagaaatatgggactatgtgaaaagaccaaatctacgtctgattggtgtacctgaaagtgatggggagagtggaaccaagttggaaaacactctgcaggatattatccaggagaatttccccaatctagcaagggaggccaacgttcagattcaggaaatacagagaacgccacaaagatactcctcgagaagagcaactccaagacacataattgtcagattcaccgaagttgaaatgaaggaaaaaatgttaagggcaggcagagagaaaggtcgggttaccctcaaagggaagcccatcagactaacagcggatctctcggcagaaaccctacaagccagaagagagtgggggccaatattcaacattcttaaagaaaagaattttcaacccagaatttcatatccagccaaactaagcttcataagtgaaggagaaataaaatactttacagacaagcaaatgctgagagattttgtcacaccaggcctgccctaaaagagctcctgaaggaagcgctaaacatggaaaggaacaactggtaccaaccgctgcaaaatcatgccaaaatgtaaagaccatcgggactaggaagaaactgcatcaactaacgagcaaaataaccagctaacatcataatgacagggtcaaattcacacataacactattaactttaaatgtaaatggactaaatgctccaattaaaagacacagactggcaaattggataaagagtcaagacccatcagtgtgctgtattcaggaatcccatctcacgtgcagagacacacataggctcaaaataaaaggatggaggaagatctaccaagcaaatggaaaacaaaaaaaggcaggggttgcaatcctagtctctgataaaacagactttaaaccaacaaagatcaaaagagacaaagcattacataatggtaaagggatcaattcaacaagaagagctaactatcctaaatatatatgcacccaatacaggagcacccagattcataaagcaagtcctgagtgacctacaaagagacttagactcccacacattaataatgggagactttaacatcccactgtcaacattagacagatcaacgagacagaaagtcaacaaggatacccaggaattgaactcagctctgcaccaagtggacctaatagacatctacagaactctccaccccaaatcaacagaatatacatttttttcagcactacaccacacctattccaaaattgaccacatacttggaagtaaagctctcctcagcaaatgtaaaagaacagaaattataacaaactatctctcagaccacagtgcaatcaaactagaactcaggattaagaatctcactcaaaactgctcaactacatggaaactgaacaacctgctcctgaatgactactgggtacataacgaaatgaaggcagaaatgaagatgttctttgaaaccaacgagaataaagacacaacataccagaatctctgggacgcattcaaagcagtgtgtagagggaaatttatagcactaaatgcccacaagagaaagcaggaaagatccaaaattgacaccctaacatcacaattaaaagaactagaaaagcaagagcaaacacattcaaaagctagcagaaggcaagaaataactaaaatcagagcagaactgaaggaaatagagacacaaaaaacccttcaaaaaattaatgaatccaggagctggttttttgaaaggatcaacaaaattgatagaccgctagcaagactaataaagaaaaaaagagagaagaatcaaatagacgcaataaaaaatgataaaggggatatcaccaccgatcccacagaaatacaaactaccatcagagaatactacaaacacctctacgcaaataaactagaaaatctagaagaaatggataaattccttgacacataaactctcccaagactaaaccaggaagaagttgaatctctgaatacaccaataacaggagctgaaattgtggcaataatcaatagcttaccaaccaaaaagagtccaggaccagatggattcacagccaaattctaccagaggtacaagaaggaactggtaccattccttctgaaactattccaatcaacagaaaaagagggaatcctccctaactcattttatgaggccagcatcattctgataccaaagtcgggcagagacacaaccaaaaaagagaattttagaccaatatccttgatgaacattgatgcaaaaatcctcaataaaatactggcaaaccaaatccagcagcacatcaaaaagcttatccaccatgatcaagtgggcttcatccctgggatgcaaggctggttcaatatacgcaaatcaataaatgtaatccagcatataaacagagccaaagacaaaaaccacatgattatctcaatagatgcagaaaaggcctttgacaaaattcaacaacctttcatgctaaaaactctcaataaattaggtattgatgggacatatttcaaaataataagagctatctatgacagacccacagctaatatcatactgaatgggcaaaaactggaagcattccctttgaaaactggcacaagacagggatgccctctctcaccactcctattcaacatagtgttggaagttctggccagggcaattaggcaggagaaggaaataaagggtattcaattaggaaaagaggaagtcaaattgtccctgtttgcagacgacatgattgtatatctagaaaaccccattgtctcagcccaaaatctccttaagctgataagcaacttcagcaaagtctcaggatacaaaatcaatgtgcaaaaatcacaagcattcctatacaccaacaacagacaaacagagagccaaatcatgagtgaactcccattcacaattgcttcaaagagaataaaatacctaggaatccaacttacaagggatgtgaaggacctcttcaagaactacaaaccgctgctcaaggaaataaaagaggatacaaacaaatggaagaacattccatgctcatgggtaggaagaatcaatattgtgaaaatggccatactgcccaaggtaatttacagattcaatgccatccccatcaagctaccaatgcctttcttcacagaattggaaaaaactactttaaagttcatatggaaccaaaaaagagcctgcatcgccaaggcaatcctaagccaaaagaacaaagctggaggcatcacactacctgacttcaaactatattacaaggctacagtaaccaaaacagcatggtactggtaccaaaacagagatatagatcaatggaacagaacagagccctcagaaataacgccgcatatctacaactatctgatctttgacaaacctgagaaaaacaagcaatggggaaaggattccctatttaataaatggtgctgggaaaactggctagccatatgtagaaagctgaaactggatcccttccttacaccttatacaaaaatcaattcaagatggattaaatacttaaatgttagacctaaaaccataaaaaccctagaagaaaacctaggcattaccattcaggacataggcatgggcaaggacttcatgtctaaaacaccaaaagcaatagcaacaaaagacaaaattgacaaatgggatctaattaaactaaagagcttctgcacagcaaaagaaactactatcagagtgaacaggcaacctacaaaatgggagaaaatttttgcaacctactcatctgacaaagggctaatatccagaatctacaatgaactcaaacaaatttacaagaaaaaaacaaacaaccccatcaaaaagtgggtgaaggacatgaacagacacttctcaaaagaagacatttatgcagccaaaaaacacatgaaaaaatgctcaccatcactggccatcagagaaatgcaaatcaaaaccacaatgagataccatctcacaccggttagaatggtgatcattaaaaagtcaggaaacaacaggtgctggagaggatgtggagaaataggaacacttttacactgttggtgggactgtaaactagttcaaccattgtggaagtcagtgtggcgattcctcagggatctagaactagaaataccatttgacccagccatcccattactgggtatatacccaaaggactataaatcatgctgctataaagacacatgcacacgtatgtttattgcggcattattcacaatagcaaagacttggaaccaacccaaatgtccaacagtgatagactggattaagaaaatgtggcacatatacaccatgcaatactatgcagccataaaaaatgatgagttcatgccctttgtagggacatggatgaaattggaaaccatcattctcagtaaactatcgcaagaacaaaaaaccaaacaccgcatattctcactcataggtgggaattgaacaatgagatcacatggacacaggaaggggaacatcacactctggggactgttgtggggtggggggaggggggagggatagcattgggagatatacctaatgctagatgacgagttagtgggtgcagcacaccagcatggcacatgtatacatatgtaactaacctgcacaatgtgcacatgtaccctaaaacttaaagtataataataaataaataaggaaaaaaaaaggctgaaccctcaaatactatcacactggacggtaaggcttcaacatgtgaattacgagacttgcgaagcagagagaaagaagaaactttataccagagtcgtgctttctgaaaaatgaaaatgctttggattaaggccaacaaataggtactaaggcattgcctgatggtgagagtgaagcagggccaggcacggcagctcggtataaacacagtgagcagacaaggcccagagcctgggtttgtgtcagtccagctggctagtgtagcagttaggactcccacggggacacagagaccaagcctggtcgagacaccactgaaaatccccttccaaacagaacaggtgatctctggtgatattcacagccacactgctgaaaactgccatactcacctccatcaagcattggaaatcaagagctgaacaagtatgaattgtttttcacatttagcctttctgaatatcttttcacgaaagatcattaagaatacgtgttgtcaacacactaatgaggtggcttcacgagctgaaacaagcagctgaaattgggaataagactgagaattacttcaggacagcagaccctggccccagtgccagcccccacagaagctgctgggcaaggcctgggcccttccctttgccacaaagcctgggtgggggtggaggagccactctggaggtggggcttcttcaggaagaaggccaggtggtgggtggtaggtgcttccccttgactggtctctgagccatttcctactgctcaccgttacctttttcctcctctgttgctaacgaaatgctctgccaaatgtggctggctgccccaccacggtcttgctctaggtttaatcattgctttggacgtagtagcaggacattttgttctttcaaaagagataacagagcagattcatacaagcctcatgtccctctcacacaggtacccgatcagaaagtctcaacatgtagacacaatgaaataagaaaacaatttctctctcatctatttgtttcctgaggcttcctcttgcctcaggatggtgttaggtttcagtgaatcctgagctctgtgactacccaggatattccattctcagcaacaggatgtgattgaagtaaagcattcaggcacaaacttgtaactgtgctgctgaaataaaagagggccacgcagggaaggcacccaagggagaatgttccaggcaacggggccgtttctctgggagcctgcatgagattattttgactgactcaaaatgacttgtgaatgaaagaacccttttaattaaaacgtaatggcagttttaatcaaggacatgttgctgccactttaaaagaaggaaggaggagctgcgcttttggaaggcacttctgaaaactgctggaatccaatgagatgtcaggtctaagaggaaatcagaagggcagacagccgccacctcgccttgcctttcctgcaagggtcctgcatgttttctttccttccatgcctgtttggtcagcacgcagcacacattcaaaataacccgggaaagccccgcttttctcccgctgagagatgatgagcgactgaggctctcacaggagtccctgtggacaatttcaggcctttctctttggtgtttggcatcatgcctaaaaatgccaaataaaaaccaccctcaccttatttttttcaagaacattgagaaatatgacttaagataaaatatgtcctaagtataagagaaagaaggacattttgggttccacaggtgacctggcatgatttttagctttcccgtcttccatatttaaagtgagcaaagccaaggacaattaaagatgctcaaattgccgggtgcagtggctcacgcctgtaatcctagcactttgggaggccgaggcaggcagcttaccagagctcaggagttcgagaccagcctcagcaacatggtgaaaccccatctctactaaaatacaaaaaaaaaaaaaaaaaaaaatagctgagtgtggtggtgtgcacctgtagtcccagctactcaggaggctgaggcaggagaattgcttgaacctggaaggcagaggttgaggtgagctgagatgggaccactgcactccagcctgggcgacagcgagactccatctctttaaaaaaaagaaaaaagaaagatgctcaaattagccgggtgtggtggcgggcacttgtattcccagctgcttgggaggctgaggcaagagaaccgcttgaacctgggaaaaggaggttgcagtgagctgaggcagaatctcttgaacctgggaaaaggaggttgcagtgagctgagattgcaccactgcactccagcctgggcaacaagagcaaaactccatctcaagaaaaaaaaaaaaagaggcaatagagacacaaaatcacttcaaaaaattaatgaatccaggagctggttttttgaaaggatcaacaaaattgatagactgctagcaagactaataaagaaaaaaagagagaagaatcaaatagacgcaataaaaaatgataaaggggatatcaccaccgatcccacagaaatacaaactaccatcagagaatactacaaacacctctacgcaaataaactagaaaatctagaagaaatggataaattccttgacacatacactttcccaagactaaaccaggaagaagttgaatctctgaatagaccaataacaggagctgaaattgtggcaataatcaatagtttaccaaccaaaaagagtccaggaccagatggattcacagccgaattctatcagaggtacaaggaggaactggtaccattccttctgaaactattccaatcaacagaaaaagagggaatcctccctaactcattttatgaggccagcatcattctgataccaaagccaggcagagacacaacaaaaaaagagaattttagaccaatatccttgatgaacattgatgcaaaaatcctcaataaaatactggcaaaacgaatccagcagcacatcaaaaagcttatccaccatgatcaagtgggcttcatccctgggatgcaaggctggttcaatatacgcaaatcaataaatgtaatccagcatataaacaagagccaaaacaaaaaccacatgattatctcaatagatgcagaaaaagcctttcacaaaattcaacaacccttcatgctaaaaactctcaataaattaggtattgatgggatgtatttcaaaataataagagctatctatgacaaacccacagccaatatcatactgaatgggcaaaaactggaagcattccctttgaaaactggcacaagacagggatgccctctctcaccactcctattcaacatagtgttggaagttctggccagggcaattaggcaggagaaggaaataaagggtattcaattaggaaaagaggaagtcaaattgtccctgtttgcagacgacatgattgtatatctagaaaaccccattgtctcagcccaaaatctccttaagctgataagcaacttcagcaaagtctcaggatacaaaatcaatgtgcaaaaatcacaagcattcctatacaccaacaacagacaaacagagagccaaatcatgagtgaactcccattcacaattgcgtcaaagagaataaaatacctaggaatccaacttacaagggatgtgaaggacctcttcaaggagaactacaaaccgctgctcaaggaaataaaagaggatacaaacaaatggaagaacattccatgctcatgggtaggaagaatcaatatcttgaaaatggccatactgcccaaggtaatttacagattcaatgccatccccatcaagctaccaatgcctttcttcacagaattggaaaaaactactttaaagttcatatggaaccaaaaaagagcctgcatcgccaaggcaatcctaagccaaaagaacaaagctggaggcatcacactacctgacttcaaactatactacaaggctacagtaaccaaaacagcatggtactggtaccaaaacagagatatagatcaatggaacagaacagagccctcagaaataacgccgcatatctacaactatctgatctttgacaaacctgagaaaaacaagcaatggggaaaggattccctatttaataaatggtgctgggaaaactggctagccatatgtagaaagctgaaactggatcccttccttacaccttatacaaaaatcaattcaagatggattaaagacttaaacgttagacctaaaaccataaaaaccctagaagaaaacctaggcattaccattcaggacataggcatgggcaaggacttcatgtctaaaacaccaaaagcaatggcaacaaaagacaaaattgacaaatgggatctaattaaactaaagagcttctgcacagcaaaagaaactaccatcagagtgaacaggcaacctacaaaatgggagaaaatttttgcaacctactcatctgacaaagggctaatatccagaatctacaatgaactcaaacaaatttacaagaaaaaaacaaacaaccccatcaaaaagtgggtgaaggacatgaacagacacttctcaaaagaagatatttatgcagccaaaaaacacatgaaaaaatgctcatcatcactggccatcagagaaatgcaaatcaaaaccacaatgagataccatctcacaccagttagaatggcaatcattaaaaagtcaggaaacaacaggtgctggagaggatgtggagaaataggaacacttttacactgttggtgggactgtaaactagttcaaccattgtggaagtcagtgtggcaattcctcagggatctagaactagaaataccatttgacccagccatcccattactgggtatatacccaaaggactataaatcatgctgctataaagacacatgcacacgtacgtttattgtggcattattcacaatagcaaagacttggaaccaacccaaatgtccaacaatgatagactggattaagaaaatgtggcacatatacaccatgcaatactatgcagccataaaaaatgatgagttcatgtcctttgtagggacatggatgaaattggaaatcatcattctcagtaaactatcgcaagaacaaaaaaccaaacaccgcatattctcactcataggtgggaattgaacaatgagatcacatggacacaagaaggggaatatcacactctggggactgtggtggggtggggggaggggggagggatagcattgggagatatacctaatgctagatgacgagttagtgggtgcagcgcaccagcatggcacatgtatacatatgtaactaacctgcacaatctgcacatgtaccctaaaacttaaagtataattaaaaaaaaaaaagaggctctgatgggctgcttcagaaagacaggatttgaacaaatcgttgagaatttaagaacagataaaaagacaatcctcagtaatcactgccttaaaaatgtaaccagattttgggaggctgaggcgggcagatcacaaggtcaagagatcgagaccatcctggccaacatggtgaaaccctgtctctactgaaaatagaaaaacttcgctgggtgtggtggcatgtgcctacagtcccagctactcgggaggctgaggcaggaaaatcgcttgaacccaggaggcagaggttgcagtgagcctagatcgtaccactgcagtccagcctggctcatagcgagactctgtctcaaaaaccaaaaccaaaacaaaatgtaaccagaggggtcaattttcgctttgcagttagggtattttttgttttgttttgtttttgtttttgttttcagacggagctctcgctctgtagccaggctggagtgcggtggcgctatttggctcactgcaacctctgcctcccaggttcaagagattctcctgcctcagcctcccgagtagctgggactacaggggcatgccaccatgcccagctaatttttttgtattttcagtagagacagggtttcaccatgttggccaggatggtctcgatctcttgacctcgtgatctgcccgccttggcctcccaaagcgctgggattacaggcgtgagccaccacttgaagcaaggcagccgacgtgaaagcagagcgagaaaagctacacacgatgcggcctctgctgttcctgttcctgttcctggtcagtgatgttgcaggtttagggtcagcaaaccacagccggcagcccgaatccctgcctctttctagaaatatggtgttactgcaacaaaactgtgcccacctgttcattgtctgactgttttcaatgatagggttgaaaagctagaagggaatcaagtggcctgaaaagcctaaaatacttactctctgggcctttacagaaaaatagttcaataactccttctctagggtcgaaatgcttcctggtgatgaaatctcagctgtctaactgccgtattgtttacagactggtatgaggtcctttgtaatttttctgcagctaggtgcattagaacctacctccttagaaggttgttgttataagctccgtcccatctggcttcttcataggcccatgttgccatgggaatgggcccaggagactccaaggtttatccgccaggctgaccttagtcttattgagaggtgacatcgtgctggcagtcctcagagccctcgctcgctctcggcgcctcctctgcctgggctcccactttggcggcacttgaggagcccttcagcccaccgctgcactgtgggagcccctttcttggctggccaaggccggagccggctccctcagcttgcagggaggtgtggagggagaggcgcgagcgggaaccgaggctgcgcgcggcgcttgcgggccagctgaagttccgggtgggcgtgggcttggcgggccccgcacttggagcagccggccggccctgccggccccgggcaatgaggggcttagcacccgggccagcggctgcggagggtgtactgggtcccccagcagtgccagcccatcggcgctgagctcgatttctcgccaggccttagctgccttcccacggggcagggctcgggacctgcagccggccatgcctgagtctcccaccccctccatgggctcctatgcggccggagcctcccagatgagcgccgccccctgctccaaggcgcccagtcccatcgaccacccaagggctgaggagtgcgggcgcacggcacgggactggcaggcagctccacctgcagcccctttgcgggatccactgggtgaagccagctgcgctcctgagtctggtggggacgtggagaacctttatgtctagcccagggattgtaaatacaccagcaggcactctatctagctcaaggtttgtaaacacaccaatcagcaccctgtgtctagctcaggtttgtgaatgcaccaatcgacactctgtatctagctactctggtggggacttggacaacctttgtgtccacactctgtatctagttaatctagtggggtcgtgaagaacctttgtgtctagctcagggattgtaaacgcaccagtcggcgccaagtcaaaatagaccactcggctctaccaatcagcaaaatgtgggtggggccagataagagaataaaaagcaggctgcccgagccagcagtggcaacccgctggggtccccttccacactgtggaagctttgttcttttgctctttgcaataaatcttgttactgctcactctttgggtccactctgcttttatgagctgtaacacacaccgcgaaggtctgcagcttcactcctgagccagggagaccacgaacccaccagaaggaagaaactctgaacacatccaaacatcagaaggaacaaactgcagacgcgccaacttaagagctgtaacactcacggcgagggtccgcagcttcattcttcaagtcagtgagaccaagaacccaccaattccggacacattattgttgataaatctgaggtcaaaggcatcaacagatgattgaaaagtttaactccaagtgccgtttcattatcaaatatttttaagcaaatctccattttactccagatacttctgaacacgttctgctatgagatcttcactttattccaatcttttgcattctaccatcatttttaagccaaaatacttcaggcaggctagaagatgaaaaaatatttatgtcccaaataagtggcatgcactactgtcgtagaagagaatccatggggtgcagggacccacgtacctccctcttgggaagtgcatctcaggtcagggactcctacagggcccaatgactggggcttcaaataatcccacagagctgagccaggaagtagaacaataattagaagtgaaaaatggacaagtctgcaatataatccaatggagacaattcaaggaggaaattggcaaaccactatgtttgcacaggtacgttatggaaggaaaggagggaatcctaagaaacaagagatttcttaaggctgatttgtgcagacatgatgcagatcattttcttaagaactatctgcccaacaacacaattcagtcctccaggtttttacttcccagtgttcttcaaaaatgtgtatcaatgaggaatttatttgaagaacagctccttgtttgaagttgctgatctttgcctagaataggccaaggaaaatatacctcatcccgttaaggagttagaaagctgttccagcagatcatattgtagcaaacctgacataagttcatttaaatgctaaggatctgatctgagcttgtgtttctggaattgccaatgcacatttcagagggcctcagtaactgtcagccaagccttggttttgctttttgcctttggcaaacccactcaagaatggttctaaacacaaggaccagagatgtggaacagggtgaaagcagcggcgctgggaacacctgcttcccggcaatctggctgcctggccttggacaagttatcacctgagcctcacttgtaaaatggtgataatagggtctcccgataatagggtctccctccaggggtggctgagagtcagagaagggagctgcgagggcttctcaagatcaaggatctgtcagcttagctgctcctgggaaggaggctgagactcacattgtcagctttcactcactaaagagagtcttgcttgaggggcttggacaaacaggagctgggattagagtgggtgggactgggaaggagagagagaaaaaaggaaagaagcaaagattgactctccaaatctctaaaatcacccaccctacaagtgcagaaagcttgttctgagcagaaaggacttgatccggagccaggtagatcaccttctctcctggaggcagctctggaaaaaggctcttaggcttctggcagttcctcccctgagaatctcaccctctgcaggtctcctcctgcctgggaaacaaagtctctccagtccttttgctgccttatgcccctgatccctgcacccccggaccggacccccagccccatcccatccatgggaaccaccaagctccaagtacttattgagccaccaccttcttccagggactcaccacccctgtcgggggatgcagggttgcagtggagagcagccagctggggtcattgggaataccagagttggggcttggatggaaactgagtggggagggcagcagttctggggaggtgggaggagatgtaggtaagtgaagggggccagggagcagccctgcaggtagggggccggccagaggctggcagcaggagaggagacccctgcaggcagtatggacagtggggcagaagtgagcaggcgggagggcacatgccacttgagggcccggtgtgagctcagcgaggggatccagccagggtccctcctgcagaggaaccagcctcagtgtggtccgaagagccccaggagctcaagaaggtggcaaagccatggcaggcagagggaaactcagggaggggaaagaaaagatcggaactgaggggagtcctgcagcagctacagcagggaagtggttctgcagcaccgtttccagattgcagggctcgtttagaaccgtctcagcctgctggggtgggagactggagaggagctgcccacagcctccagggtgttgtcagagcttggtgcttgccctgctctgtcggcaatcagcacggttgctgtgatgacactgagctgccttggaaggagatgcacaggtaatggggacctttctcaggaatgccataaactgtgacataggcctctcctcgggactttacaaagccttagtgaaattctgaaatccaccaaatgcttaatgtgattcggtttgggggaaaagccagagaggggaactgaatgttgaatcaagattgaaacagcctcagcccacatgatgatgtgagcagccacacatttaggtccccaaaagggtcactgatagggtcacactggtctggcccaggaagggtctgtctgcatctgtgctgagagctggggcctctggagggctcagcggaaccaggtgagaccagccagcaccagcctgagtcctcagcccccgggcaccagaggccttcccacctgactctgccatgacaagtgccctgactgtctgcggtgttctagaaaggtgaccaacaggtgtaggctaattacatttcaaaaaagtttttttttttcccggcacatataacaggactagtcctctcccctcttctcatcagattccatttcctttagcaaacgcacacggtgttcgatttaagtgcaattctcagaaaacttaataactgcagtgtttaattagtctgacaacatttattgaagcgatgaatacagaaaaaagtactttcaaggaagaaaaatgatgtgtcattgttttgtgttttcttttctcaaatctgtaggcaggtatgaaaccgagcagcaatctctgtcttgaaaagctggtatttctgtttctagaacgtatgtgtgtttggggtggggtatagaatagagggatgaactgagtccttcacccactacctggtctgctcactctgcccacgcgtgtcccctcggcagccctgtgagtgcctgagctgtggctccccaggcagtgaagagctaggccctggagccagacccccagaggtgattcccagctctgccattgccatgcctcagtttccccatctgcaaaattggcttaatgacagtgcttccctcttgcagtcataaagctcttagaatacagcttggcagaaaaatgttgcctgtcactatttgtgctgtaaaagccctacctcttggccgaatggagctcagtaaaccaatgggagaaacaggtcccttctgagatctccctagatccctattcagcccctggtaggctcacaataagggctcagtgtttgtgggagtgagtatctgtgcagaaggaagatcagaatccagaggtgacagtttaaggttaacatattattttcccagcatttcaaaagaaaatgccgtgaaacactagtcccacaagatattcctgagaaaaaacaaatgggataggaaccaaatgagctgggaaaacagggcattcaatgtctcccctcagagattcccagtgcacgcttgcacttcaaaggctctgagaagtcctaccataaagacacctgcttaaatgtgtttcagccaatactagctaaactcatttgctgaggaatttccttctcccctctttgctttccctccctcccttcccttctccctccctctctccctcccttccgttcatgctgtgaatgccccatggaatccatgctggattaggagtgggcacagttgctcgagaagcacaggaacttgctgggtgtgctacagaaagcctttgttttctctctttttttttttttttttttttttttttttttttttttttgagacggagtctcactctgtcacccaggctggagtgcagtggcgcgatctccgctcactgcaagctccgcctcctgggttcactccattctcctgcctcagcctcccgagtagttgggactacaggtgcccgccaccacacccagctaattttttgtatttttagtagagacgggttttcatcgtgttaaccaggatggtctcgatctcctgacttcgtcatccgcccacctcggcctcccaaagtgctgggattacagtcgtgagccaccgcacccggcctagaaagcctttctaagcaggcaacagagcaacgatgccactctctcaataggatttctggaaggcccagcactgcagtaccagggaggatccaggggtctaagccttgtaggaggctagtacctcaaccatggagacagatggtttctttccagagcacagcctcagggctccctttcaactgatctgaccttggctgacgctaaaggatttaatgtcttttcccagagtgaaactaaatcttttctatatacgaagctgagagaccatcagacaatttttttccaagcctagaagtttcatggggaagaaaacaacaaaaacacgtaagccaaatcaaaccaaaccaaaacaaaagcaaccctgagaacagaaacacactaatgagatttctgagcctttaaaagcttctgaataattcgtgcaaccacaactttccttcttttttgtttcttaggattcccagggtaagaggactcagctttgccatggtcccttccaagtggcatcctgtctctgcttacacacctccaatgatgggctgctcactacctcccaggctgtcccttgtattactcttaacttccatcaccagaatgtgctttaggtaacagtaagatgactccagagatcccccacatcagactggttgtctagtgtaggcattgaaactctggattctgaattaggcctcctggattagaaccccagctccaccatttatgagctatgtacaagtaggcaacatgccacattcctctgtgcctcagtttactcacctgcaaaatgggggatcatacactgtacttatcccatagggttgctgagtgataacactcatatcagtgtgtggcgcatagtgctatgcaagggtttgatgctattcttttctaaattgtgatgacttgggacattcagcagcgcagtcttttctagattctccatcaagcacatacaggtctgcgcacccagcctggacatcagccctttggacttataccaggcagccatgtcccaaaggcacagccatggcaccaggaggaaaaggccagggaacgaccaggacactgggagctactctgcccatccactgtggtaagttcttgtgctgaaagctcaggtcctcaatccaaactatcctccctttagattatggcctcctggcctcattttctgattcactgaggttcattcactgagactttggacgtgaatggttgtgtagctcatcaccctcttctccttctgctggaacctatgtggctgccaataatgaaggggtgtctcttaacttcactcaccatctgctttcaagccttgggacctggtaaagaagcagtgtcccaggtggaactccccaggaccctgggaccaggaacctgttgcctcttgctggagatggccctgaggacatctggaggcactcctagtccccagagatgcttcatcccccagtccacagacccagtttcctggcagtgccctgcctgtctctctcctggggatgtacacaggtgccccactggaagcagctagagagtaggtgagggacagggggatggaaaggatattgggccaggtcaaaatacatcacagatggaaaacatccaagtgacccggatgggagagcacccatgagtgggtgtcctgctgggcatccccctaacctcagactctcagggagtgaagcttccattgagtcacccttgccaaaccatgcgccatatgatcctcagagcttcagggtagccacgatcaccccacttcacagaggagtgaactaggctcagagaggttgagaaaaccaggatgaccaaccattctggattgccccaaaaggaggagtttcctaggacaccagactttcaactaggacagtccttggcaaactgggacagttggttgtgctgcaattaagtgacaaatttgggatgcaagtcaaagccctgcctgacatcctggtctgagccacttccactctaaccagctttccagaggagggagaatttagaaggatctgatccccagtgatgctggaatcacaagtgctctcttcctgcaggagggggaagctgagttcggtcagcaaatgagacaggaaggcccagaaaccagcaggggccagaattaaaggattgtcttcttagccatgctctgttggaaagaatgcagttttcaaaacatttttaaacttttttgcgccgtggactttggacattccaagtaaatctatttgcaacactggaccaagttataccattttggtttggggtgctttcctttcatacaaaaactaccaaagaaagccattgctgcttcttctgtccttatttttctcttgaacgaatagcagatgctttaggggaaatgaaactgaacatgttggctgaaaaccaaaacatcagtctacagcatctgggctttagaaccaggattcttttcctgctaccttgggggtggctctgtttttaattacaaggccagcaaatgacagtgctcgctcctgacaatggcaccagggtcattcttcatgaggacagggtcacagtggccactactcattccaacgctggtctcagagattgtcatgctcagggccaccttccactgtttgatctactcaggaatcctggtgagatcagattcaataaataaactaaataaaccaccaatgaggtttaaataaagctgtaacactgcttgcaggcggaagcattgtgactgttaagataccataaacagtcaggatgttgcctgcacttgcagggggatgagaatttaagaaagctccagagaggttgctccgtttccttgcatttgcttcctggcccacccctactctcatctcctccttcccattttcctttcctaccctgaccaacttggatgttggccactcctagtgaggctggctgagagtcttgctgggtgtgaattagaccacgtgaaaccacttgaggtcattagaatgttaagtggagaagcaagtcccgactaacacagagtggcctgacctcactgtccagctgccagaatgagggcaaaggctcatctgaaagttcgtgaagacccagctcccatctgaacacacagggaggcacttgtgccttggagaaccaatgacatggaatatactcctgggaaaacctccctttgtggcctgggcctgtcaagcaaatggcacttttggccttcggtcatcagattgacccttatgttcattagagtcagtaggctttaagccatcagtggttgaggcagcttaactcgtatacatgagtgggattatgaatggaaatgctgtgtttgagaactgagcggctagtggcttttcataaagtcatcgcgatgcttggtgagcctcaggcccggcctctgatggaccttcccagggccatcctcccacaccctgagccacagacatgagcgtccacctgagctgacaatcaggactctggaacacctgactctcctgtagtggagtgaatagtatcccttccaaattcacctccatctggaacctcagaatgcgaccttacatgaaaatagggtcactgcagatgtaattagttaaagatcttgagatgaaatgcaatgactcctatcttcacaagaagagaagaggacacagagactcacacagagggaagaaggacatttgataatgtgggacagagattggagttgtgctgccataagccaagaaatcccaagttttgccagtcacctccagaggctaagaagaggcaaggagggtccccccactagaacctgcagagagagcctggtcctaccaaccctgatttcagacacctggtctccagaactgctagagaacagttttctattgttttaagctagcacatttgtggtcatttgttacggcagctctaggaagctaaccacctccaatgaacaaaaatgaggacccagaattcttctgggtcctcttcaagttgtagagataatccccctgcattttgcccaaaagactaagaattctaactctaccctcctgtccttctttctggctgagggtggctaggaggaggccttttgcttgtgtttgttttacttggagtccttgtcaggtaaggacccactttctaaaaagaaaaggatgtccttcagttgcacctttggacttagaaattccatttgcagccagatttacaccacaggctcagtaccttcggcctccatcaccatgttcagcagccctcccaggcttggtggcatttctttctgttgtctgctgctgatcagagggaactatgaacacccagcaagtcccaaactcatagcctggggaacgtccagcttgtcaaagacattggacccatgatggtggcttggggaaggttccagagtcagggaatctctttggctttagcgttctaactttctggagcccagaatcccttttgccaatacattccaatctgtgctccttggaactgtaatgccctgcaaaatattaataaacatttttaaagcatcatgatcaaatatgtctgggaactgccaacataaatataattaaatggctttcttactgcagaacttctcagagcctttaatatgccaaatacaagttgtacccctccaagtaaaggatgtggtatttggggattctcaagcctgttaatcataggttttcctctgtgttctgcctgcctctgcctgactgtgcttttatgaacttcagcaatgaagaaatccctcccttgcttctcttccatgctttaaggaagccactctacccttccagtttctcccataaatccatgtaactatgcagcttcctggtccagaacttttcactaggtctcgagcccccatggccagaattcacttttgaatggcataaaagatccgcccaaaatccagagccaggcaacctgtcctgctcagtgtctaccatctgtacccctcgaaatgggcctgaaacccacgtggttctgaacccacagcacaatcacagtgttgctcttgctgtctgaaacaccagctgcctggctcatctgtctgacaaacaaggacacatccttgaggctttgtgcccaccccccaatgcctccccttatctggatcaggagcccacctctgagccccacacccctgagcttaccacaagatctgcttctctacataataattgtattagccagatttctccagggggacagaaccaatagtatgtatatatgaatgaaaggggatttattctggggaactggctcacatgatcacaaggtgaagtctcactatagtctgcaagctggaaaaccagagaagctgttagcacagctcagtctaagcccaaaagcctcagagcaagggaagctgatagtgcagccccagtctgaggctgaaggcctgagagccccggaagactgctagtgcaagcccagcaaaggccgaacgatctagagtgatgtccaagagcaagaggagaaaatggcatcccactctagaagagaaagagagagaagaacgagagccagctgggtacccccctccctctgcctgctttgtcccagccaggccccagctgattgcatggtggccccacatcgaaggcaggtcttcctccctcagtccactgaatcatatcacaatcttatgtaaacccccacatagacacccaggaacaatgcttcacagccatcgaggcctccctcagtccaatccatttgacacctaacatttaccatcacgataatgtaccactcattggcctgtctgtgatgacctggatggtaagttatggacaagtcttgcccaccacaccatctccagcattttctacagtgttgaacactccaggtctccatgcacctgcttcgtgatttgacaaattggggtcctggacattcactggccatgtttttgttgttgttgttgtttgttttttgttgttgtttgtttgtttgttttgagacagtcttgctgtgtcgcccaggctggagtgcagtggcacgatctcagctcactgcagcctctgcctcctgggttccagtgattctcctgcctcagcctcctgagattacaggcgcatgccaccacgccaggttaatttttatatttttagtagagatggggtttcaccattttggccaggctggtctcaaaactcctggcctagggtgatctgcctgcctcggcctcccaaagtcctgggattacaggcgtgagccactgtgcccagcccaccagccatgtttttactggagggtaaggacaagaccatcaggtctgtaagtcacccatatttacagtctttgctccttgccttcatgtctactttgtttgacattagcacaaccacacttatttttcttttcccatgtgcttatattgttttatgttcagcctcctctatccttaacaatgtgtcccttctaagtaccaagtaactgggttcttggttttttatttgctctgtcttccaactggagatcagacaatttacatacaatggtattactaatgtggttccgtttaaatccatcatcttattatttactttcaatttttctcacctgtttgatgttccttttcccttctgtcttcttttggattagtatttttttttattattccattttccactctattatcttgttgcttatagattcttttctatatacttagtgattatgtgttggattacatcatttgtccttgacttattattaaagcctaatgtaaatctgtatttccactttccagacaagtgaaaaggaccttagaacattctagttttgtttatccctcttctggtttaggtgcaattgttattgtgtattttaattctttatgcatccaaaactccctcaagacataataattatgattctatttggtgaatacccctttaggctcgcccacattatctctcctcagaccttcctgcatctctcagctgccatttggaagcttagtgcccttctgcctgaagaacacttttctgtatttcctttggtactgttaataaattcttgcagcttttgcttgccttagctgtcttcattttgcttcattttgctttcatttcctttatggaaaatctcaagcatacagaaatggagaagataatgtaatatacctctatggacacatcacgcagtttaaacaacaatctgtcacccccctgctttacggctgttttcactggctagtctgggttgggaattattttctctcaacactttggagctattccattgtcttctagcttctgctatttctatagaaatgtcagttgtcagttttagtgacattccctttgggtatgcctgatcatttttgattgtcagacactatctatcatctatctatctatctatctatctatctatctatctatctatctatctaatctatctatagagagagagaggcagagtctcgctctgttgcccaggctggagtgcaatggtgcaatcttgggtcactgcaacctccacctcccaggttcaagcaattatcctgcctcaacctcccaagtagctgggactacaggtgtgtgccaccatgcctggctgatttttatatatatattttaatagagacgggggtttcaccatgctggccaggctggcctcaaactcctgatctcatgatctgcccacctgggcctcccaaagtgctagaattacaggtatgagccactgcaccaggtattttaaaatactaacattttaaaaattatatttaatttgagaatttggatgatgttgtcttcctccagagaggatttacttttgctttttgcaggcagctaaacattagaaaccccaggttacttaaatccaataggacctgagatgattcagaactaggcattgacctttgtgaggtttggcctatttctggtgcactttttagagtgtagccttacagagccctccaaactccttgtgtctactaaaagctccacttagattctcagcttctcagtcacctcttgtaaacccaggaaaaaacattttggccacttcttgaagatggaggtaagattccagaggccccgttgccctatctatgtggcctacaggctgcaccatgccctgctataatggccaagtaaggtatgctctccccagctcaccaaaggaaagcaagtctctgtcaaatcttccacaggttttcatgatgtttatcttccgctaatgagcaaaaggatgaaacacagtgcataacagcaagtgtggaggtgaccagtaatgttgaggtcaagggctattttttttctggatgtgtttgtggttctaatatttaagaaaataaaaacacgcagtgctgctgtctttttggctacttggctggcgtcatttggctggtttgtggggttgaatgaaatgtttacacatttctggtgtcacacaaacagagccaatgggctccttgatttgtgcagctggattggagtacgggctaggttgagatgaacccaaacttctttcttttatggatgactgtgatccacgggatctagagcaagtcagaaaatcaagtgctggtaggggtggagcaaccagagtgtgaggggatggtcaaagtgtagcacttatgcccaccctgtgtgagggggttccagggctgcaggttctcaaagaccaggatcagccatgaagctccagctgactcttggcacagaaaaattgggatccagagtgtcagatcccttgatctttcaaaagaagccagaaattcaaataactaggtgaaatagccagtttttggcttgactaaaaaaaaaaatccagtgtaagccaaacaaaatatatctctggaccaacatcagcccttgtattgacagtttgtgactttgatataataaaaataagcatagcattgtggtgcacctttcttttttttttttttttgagacagagtcttgctctgtcgcccaggctggagtgcagtggcgccatctcgactcaccgcaacctccgcctcccgggttcactccattctcctgcctcagcctcccgagtagctgggactacaggtgcccgccaccacacccagctaatttttttgtatttttagtagagacggggtttcaccgtgttagccaggatggtctcgatctcctgaccttgtgatccacccccaccttggcctcccaaagtgctgggattgcaggcgtgaaccaccgcacccggcctgtggtgcatcttttattcactatcttaagacaccaagaaaattgacatatgagcaacactttagggcatcttggtcttgctgtactacttagggcccatcctggacacacttggggcttcttgagtagtggcccagatgtttctgcctcattcccgatcacctgagttgtatgtgcgaattttgtttaaagcagtatgaccacaccaccttattcaggtggagttctgaaagctggggcctgagcatctgaggtttgaacagcagcccaagtgatttaatgtacagccagagctgagttcatttcgctctgcactcccctgtcctcctggtggagggatggtgaccaagatgggactaagcccctgatggccaccccgtttgccaaagtccccaatagcttagaaaggacgatttccgagcaacatgtctacacacatctgggcccgttttccggacctgtcacaggacaggagaaagggcatgaaatctagcaacaaaatacctggagtggtgtcctctgtcacttcctggctggattgggcacttgcctatttgacctccattttttctacttttaacaagatggtaatgctggtgctggtgagatggaagattctgcgagcagctagcaagctgtggagtgcggtgcacacatgggtgctagttttctcaggtcccctacccccagaccttggtgtgtgtccagcctcggcccctcctctgctttcccaggaaacactcccacactgcttcacacaggtcctgccatgggacccactgtcctcagggaggccctcctgcctcagtgtcaccagaacctttgcaaagggccctatcacccccagaggttgagctctggggccatgcctggtccaggacacagggctggaacgtggcttcccatgcttatcggctccaactgtggaaaggagaccttggcccttgttactgacgtcagccccttcagagaggcgagtcggccatgagcacctcagttctgcccctctgctctcctcccaggctccagcccactctggcttgccccacgtgcccccaccctgtctctgcgcctcccctctaaggctccgtctgagcagagactcactgcccccctcccttcctccttccctgagctctcagattccaatagcatgctctcctggctgttgggccatcagtatctctgcattctgtcatgattttttttttttttcacacaggaagccctagaacgctgccactgtcttcttaagtagccatattttcaggaagagaaggccctcccagtgatcggacatggtgcagggtacacttgggggccgaggaccatccccgaggggatgagaataacgtgggctctggatgcacatccctttatagctcccctttccctacttgtccctttccctgactaattaatgactccacccaccacccagccaatccaggtgcctggaagtcatcctccacacttccagcgtgggcagggggtatctcttgatcacagataagagcttgccccatctgctgccccagcccttcgaagcctccctgccatcttcagtatgatgcccccatctttgcctggcactccctcccaccagacgcttcccggggctcagcctcccagccccaccccaccccactccaggccccattcatcccaggtagcagcttctgctgctcagatgcccctctgcaccttgggtggtccaggaactcctcattcttccagaggaggcctgagcagtgagggaagcccttgaccctcgcctactgggggtacaatttgacacagattttttatagcatcatttggtgagacaaataaagtctttaaagtggctatgaaattccacttgtagacattttgcccggcaaacatgaatgggcacaaaaattcagctgcaaagatgtacttgtagcaatttgaaacaccccagtgttgcttaaagcaatcctagtgcatctatacagtggaatcctaggcgttaaaaacattaaggcacatgtaaattttgtttttcgaaccgtcacgtctgccctggacttcctcaaagcctcctaacaggcctctaggtgtccctctttgctcctttccaaatcatttgcacctggtattgggtgagaactaaaagcctgaatcatgccatcgggcagcttaaagccccataaggcatttccattgtaatgagatgagcatgtgaattccctccccaagctgtgcaccatcaaggccctgcgtgctctgtaaccaggcgcttgtctacctggggggtcccacaggaggacaccggcctcagcctgggccctgagcttgtcacacccttgtcaaacagtgcctccctcccgccacacccaccttctatcagcgcctcgggataagcctagctctgccccatctctggactttggatatgctgtccctgcatcagtcggcttccccttcctggcactcggggtaacttctctacatccttcatttctcagagaggcttcccttaacccttctgttcaaatggggttgctgctattattcctcactgtaccttgttctttctgttttcccttttccatttattacacccagtaaatctgtaaggacagcatcctgatgggctttgttgacagagtacatccagcactgaacactctgtacgcctcacacagaggaggtgctcgataaacatgtaagaatgcccctgctacattgtaatttaaaaagcaaactacaaaatagtatgatggcatatataacatagcatagtataatccaatataatacaagagtacaaggattaatattaaaaaatccagaagactcttccacaaactcttgtcagtggttaagtatacatggtgggattatagatggtttcaaatgttcaccttctctgtattatctatattttccagattttaaatacatttttatttttattgtatttatttatttgtagagacagaggtcttgcaatattgcccgggccagtctcaaactcctggcctcaagcaattctcccgcctcagctctcaaagtgttgggattacaggtatgagtcacagtgcccagactgaatcaatttttcaaaaatggtaacaatagcaattattccgcaataaaaaataaaaattttgcttaattctcattgtaaaaagactctgcccacaaatccccagcctctgtgaagtgtttcctctaagctccatctgcaccacacacctgagaaggtgaagcttgaggcatccttctctgtcccatagcacctgggactgcctccttcataagatgagtcatcaccatttcataatcctccgtctccctgcgccctcctgcctatgggagcacccagaatgtcttcttcatagccttcactcattaatgattgtgactaattaatttgagctaatccattttatgtgcaatttctggcctgctgtcttccccgggctgtaatttcaacaagggatcatctaccctaattgctagcgtagtctttataattcatagttaatgctcgatcaacagttgctaaatgaacaaatgaatgaatgaatgcaaaacaggattgtctccgaagttgaaatccctgcccttgattgtgtctgccatcagatgtgcgtccccgaaatgcagaaatcctactcgagagcagaggcatgttaccactcactggagttccatagacatcacctgaccacggagactttctaagtatttgttcctgagaagtctccgctgcaaagttccgattaagatacctgtgagcggcagggcgcggtggctcacgcctgtaatcccagcactttggcaagccgaggagggcggatcacgaggtcaggagatcgagaccatcctggctaacatggtgaaaccctgtctctaccaaaaatacaaaaaaattagccgggcatggtggcggcgcctgtagccccagctactcgggaggctgaggcaggagaatggcgtgaacccgggaggcagagcttgcggtgagtcgagattgcgccactgcactccagcctgggcgacagagcgagactccatctcaaataaataaataaataaataaataaaagaaaaaagaaaaaaaaaagatacctgtgagctgtggacatctgaatgttcacacagcactgacctttttaaacatgaaaatgaaaacgaatagtcagactcctgcatttttccatgtcttatttcagttttaaagatggacaatatgataagaaagtctgtttctcttctggatttctatttccaaagagatagcaaaggttctcaggttacttggagagtttactaggatgctgagcgctcctcacccacatagtttattattcgggaggtctgaggtgggaccccaaaagacaaattctcaggtgaggttgatgctgctggtctggcgaccacgcttggagactccgtgagccagaggactctgccccgacttgctagggaggcaggagctctggtgacctgctgtgtggcctggaggaagtcactgcccattctgagcctcggattccttgttggtaaacagcgtcttaggacgcggctctgtgatgctgtggcctgtgcgtcgcatcggcatgtctcagccggcaccgggcagcagagggcagcagagatcaggaaatggcgtcccggcaggcggcttctcccactgctgaaatgagttctctcaactgtcgctcagcactccgaaaccattagccaaagaagaaagacatttcctcatccctttgctctccaatgactaagaaaagtgaagtgatgccttacactgaaatgtatttcttaaaagttggatacttgtatcatcttgaaagcccctctacatccaggaaaactgcagcccagagaggggaggaaaagcccgcggcctcctgctggtggtaagttcaggaacacgcatgggcctttccgctccgtcccaagctgagttttacattccctcctagacgagaattggcgagtggacatgagggtagctttcttccatggtgctggggggcaggaggaaccccagggactcatggatgtgggaaggacatgagaggtttcccaagtagggccccttgcatttagagccccctctacatggagctggaaaagggagttccgtttaaatgtgtgaccctggagtccccaaacatctattcagagacagcagataaatcccagactgcacctctccagctggtcttcaagctcagaaccccctcctcgtttccaagtgtggatccatcagaatgaagggcccacacctctcccccaccgtggatttcacatttcctggtgcctctaagtcaccaggagggggcagaaaattctgcctcccaagccccacctccagggaccccattcatcaggtttgggtgcggtcctggaatccacgtgctaaacagacgctgagggtggtttgcccaaccagacctggacaatctctggcctggaggttaagcctgggtggtgaagatgaagagataggtggcaggcaacactgggaattcacagtctccgttcttggaatcatacttctcatccacggggaaaattccttggttctggtaccttccctgcaactctctccaatcatcctaacattctgggggcccaagatgagaataaaagcgaagttcccataccatgtgtcaattattaaaaagttatcaatccggggccgggcatagtggctcatgcctgtaatcctagcactttgggaggccgaggcgggtggactgcctgagttcaggagttcgagaccagcctgggcaacacagtgaaaccccgtctctagtaaaatacaaaaaaaattagccgggcatggcgccgtgcacggcgccgtgcacctgtaatccctgctacttgggaggccgaggcaggagaatcgcttgaacccaggaggtggaggttgcagtgagccaaggtcacgccattgcactccagcttgggtgacagagtaaggctccgtctcaaaaaaaaaaaaggttaccaatccaatcagttgttagaagataaaacccataatttttctaccttggtaaatacatcttcatcatcatgaaggcaaggtttgaatttagaattctgaggagttgactttcgaaaaaaggcagcacagagagccaggctgcagcctacccccttcacgcctcaccccacttggctttttagtgcacacacgtgtgtgtgtgtgtacaggtgtgtatacccactagccccacatatccacgcccccacccagttccagctgagccatcacccacagaagaatgatggacccagggagagaggcccacacaaacctggaggttggctcagggttccaggtatccgtgactctaaaaggcagggtacaggatccaggggaagcccatccccagccccagggaccccttgccctagatagggcatagcctgatgagacagagcaggccccacccctgcccaccagggctccttgctggccagtgggaggtggaggccttagagttataaggagctgtcaggttggtcccactgaagccacactggctttgggcccctgggagcctgactgtgaggcctttctgaaacctcaggtaggcctgacagacagacagggctgcaatccagggctgagcgcctgcctggagatggggctccaggagggactgggagggctgcctggaggcgggggctgttaaaatgcagctctctgggccctgcaccagcccttctgaatcagtggagctggacatctatgttttaacaagaccctccttcccaaggattctaacacaacactaaagtgtgagaagcacagcttggaaacattttgttttattcatgcagtcaacagatatccacagaacatcccctcccttggcactctcagtttcctgtcccctgcagccaacaggaagtcagctcttccccacagattctctccctcctcaagtttcaattcaatttcacctcctcaggggcaccttttccaaaatggctgccatctcccggccctcaacaccacatcccctctcctagctccttcttggcctttaccactggtgcagatgagcttcttggagtatttattttactcattgccatgcctccccctctagaatataaccccttccccagggccagggcctgatacatgggaatcattcctttactgcagtgttgctgggatataatatgcccataaacctactgagtatttgatgaatgatgaataaggccgctaccactcagcaattcattcattgcctcttcccacaatgggacaatggggcaggtgccttttggataaagagggaaggtgtaggtggcggaagcctccgagctctgaagaccctgcatggctgtctgcccgcccctccatgaaaggggcagctctcccaggaaagagaggaagagaggccaagagagctcacaaatgggtgtcttctcttgtgaggaaggattcggggctcaacacgcttcctggggctgggtctgtacaggtagaaggaagaggcccagttggctccaagcctgggccagccccagccctgcagcctggcggtgtgcaggcaccctcacttcagaacatgcttgtatgcacttgctcttctggcacgccatgaactgtttcttggctgccttgttaggagattaagctttctctaaaaagatgaaaaaaaaaatctctagcaaaggcctgactagagctgacccccgaggaggcggtggcaataactgatgggcactacatttgtctaattaatcttcttgtcaacaaagttgttctttgccggtgccagctctgacatcatcctgcaagcttgccacactggttcatatgcagttacaaaggctgcctgtgacccagcactacactccctaaccacccccaacacgctgctgcctggaaatgggtggatgagaacagagatgtcacacagctgctggcttagaaggggcaccggggaatcacagcttgaatgaaagttggataaagatctggaaggttcaggggatccccaggctggaaggagcctggtttctaaataggacaccgatgccgaccatctttttcaagttaaactttggaaagttccatttgccatgcaaactacccttgccctggatgggttgccccaagagtgacccaggaaagtttaggtggtaaagttgcaaaatcaagtggcttcagggcccaggcagagatttcactttcagtgccctgggatgaaatctctggatgtccacgaggctgacctggacttcccggattgggaggccttgtggtcaaaagccgagtccagtcctgaacaccagatctaaatgttcaagaagactgtgcagatttacaggctaaatcagagtccctggtagctgtttccgacctctgtatggggcttttagagtgaactgtggtctcatccaggcgtttcccgaccattgcatcccacacagggcctcccttctgattttatcgttagtctctctccctgttgatttcctccaagtgctcatcactgtccacactcaccctgtttatttctgctcaccgatctggctttttaatcgaggagtctgtgaataaaatctggaggaggggggtctatgaacttggacaggaaaatatttatatcattattttcactgtctgagatttaacaatttactcaattatgaaaatcggcaacaagccacagtgtattagcagtgtctgtgactttgtctccaacagaaatcacagctgtttttctatcacgtcgtagttgatgcagttatctcaaaatatcagctgggctaatcactattttgaaatgactgtagttaatagattggtctgtagatcctgttacatcctctatcaacgaagaacatatacgagtatagcaccacttaaaaatattttgataactgcatgacagtataatcggtttgtttcataatcctgtgtatcttaatttatgcttttttcaaatattctggcctcatgagactggcaagaaagactgtaagccatcttttctgttactttttctttctttctttctttcttttttttttctatttttgagacggagactctcactctgtcacccaggctggagtgcagtggtgatctcggctcactgcaacctccgcctcccgggttcaagcgattctcctgcttcagcctcccgagttctcttttctatccttagccccgaccttgggttctggcacacagtaagtgctcaagacaatattattgactgaattaatgaaggaaccactgaacaaatgaattaaataagtgaactgaacaaatgaacatgagccttaacgtggccgtgggtccacgtccatggacccacgtattctggaaggtgcagaagtttccacgaccctttgccacctgagcttctgtctgtgcgacatccacactacccaccaggagagacgggggtcttgctacctccactaagaacagtaggaacagctcagagctgaccacggcgtccccactaaacaagactccaccggcccattgccttttttgctccagccacacgggcctccggagaccagagctggagataaggggatgatcctttttttttttttatattatacttgaagttttagggtacatgtgcacaacgtgcaggtttgttacatatgtatacatgtgccatgttggtgtgctgcacccattaactcatcatttagcattaggtatatctcctaatgctatccctcccccctccccccaccccacaacagtccccagtgtgtaatgttccccttcctgtgtccgtgtgttctcattgttcaattcccacctatgagtgagaacatgcggtgtttggttttttcgtccttgtgatattttgctgagaatgatggtttccagtttcatccatgtccctacaaaggacatgaactcatcattttttatgactgcatagtattccatggtgtatatgtgccacattttcttaatccagcctatcgttgttggacatttaggttggttccaagtctttgctattgtgaatagtgccgctataaatatacgtgtgcatgtgtctttatagctgcatgatttataatcctttgggtatatacccagtaatgggatggctgggtcaaatggtatttctagttctagatccctgaggaatcgccacactgacttccacaatggttgaactagtttacagtcccaccaacagtgtaaaagtgttcctatttttccacatcctctccagcacctgttgtttcctgactttttaatgatcgccattctaaccggtgtgagatggtatctcactgtggttttgatttgcatttctctgatgaccagtgatgatgagcattttttcatgtgttttctggctgcaaaaatgtcttcttttgagaagtgtctgttcatatccttcgcccactttttgatggggttgtttttttcttgtaaatttgttgttcattgtagattctggatattagccctttgtcagatgagtaggttgcaaaaattttctcccattctgtaggttgactgttcactctgatggtagtttcttttgctgtgcagctctttagtttaattagataaggggatgatcctaaagggacgcagtggtcccgcccatcgccgcctctacagggagggagccgcggccccgagctggccacgcgatggcgctgtgcacccggccgcggagcccctgcacgtccggctcccgctcgcgctctcggctcgagctccggactccaggctcggagcaggggttcgggctacggttcccggctccgagggaccgcggggctctctgcctgggaaggaagcttgcgggcctcctcgggcctcgctgcagcccagctaggttaatcaatcagcagccgctcagtcacccatcccttccgcatcagttgcgtggggctggggatcatgcctagggcgggaggcgtgggagcgcagggcgccccgggtccggatccggctacaggggcgaacagagcgggttctccatcccctggggtgaaatctctgggcccaggctttgagaccctctaactcgccttgcacaccctgtgtctgcagaggaggctgtagttcagaggccaagcccgctgtcagaaggcagccaggcggacttgagtcccaattcctccttcctttctaccatcattctctcttttgcaaaatggggatgataaaggtcccgaccagttggtaggattgacggagatggggcagcacagggctcctaagcacagtgccccgcgcccagtcggcaccgcgggacgcatcgtctgcagccgcgtgagctcgggcaaggcgacctggactcatctccgcagcagggacgaggtccgccctgtacttgcggcatctgcgtgtggtggaactgaccgaaacgcttgcggagctgcgcacggtgcctggcacaccgttagcaacccttcccttcccttgttctgcgcctgtcctgtgagtggacaggaggacacccagggcctccgctgcctgtccgatactagtcaccccagggcctagaggcttattccctggagatgggacccacgccaagccaaggtctcccattttctagagagaacttgggcagccgggaatgccatccttggaaggaaaggcaagagggaggtgaacattcattccaaggccgttaaacatggggagaggcactgctggaaaactgttctagtcagaaagaagctgcttagtaaacccaagaggctcagcggaaacccagccgcggtgcttgaggacgtggggaggctccagctcgctccgttccgtgtctgacgtctgccctgcgtgcgtcccaaggctgtgtccctgctcggtgtccctggcccaccggccctccggcttgtccctctgcgcggtcactggggcgtgcagacccgagccggccctccctgagtcagccagggaccccggagtgtcgataattaagagacacacgtcaagaatgtaaattcctgtggttcccagactaggaagggttcactcggtgcctcaggacaattacaagccgagggagtctgaaagagccagtgttagtgtttaaagtgttatcagtttaatgaactacttatgaagtgttaaatgcatgcaagtgtaaactgcaacatctgggtttgtgttttatttgtagacttcaaactgggcgcttggtgttttgaaaatgccaattaacggtgtaaaatcagaatttctaatgggaggaagatgtttttgtgacatctccctaaactatctcaaaatgtctttaaaacacacacacaaacattcacacacaaacaatgcagccacaaggacttaaaggattttctttttaaataaaaaaaaagcaggaatttgctgccctcttctttgttcttcactatatatatgtatatagctagtggaaagaagaatttagcatcagaggtgtcatcagcacaaatttctcagaggttgttgtaggaaatttgtcatttctacccatttcttccaggccagaaaatagatcgccttcaggaatatttactgtgctttcttgagaaaaatttccaagctaccccttgaagcaatgaagttggatttggaacaagtggaaacattataaaattgcttattttcttccaaaatttgtatttttcttccttatttcctgttaaatcagtgccactcattagcaaccatatttttgcattatatactcagcagaatttttgctccgtgactgcattccaaattaaacttttacatttccagggaaagtgtaacaaatgtctaaatcagtcagaatttaaactaatgagaggaagggaagaaaactcaactttcttcttctcgtataaaagcgattgctttttatctgtttcatgcttcggggacacttttatccctgggatcttgaaaggatcattcacaaagcaagaaggctcaggaaaacaaaaagatgtctaaattcagcgctgttgaagagttctgacaaatgctggtttcaggaaacaaaggcagacactttgaggatttcattgcaagatttggatagggctgcctgtaaccagtggccctaccgtagagctggaaggatgtcacaggtggtatggtggaattccgccatgtgatagcagcatacccaagataattcgttgataaggttgcagatagagactttaccctttgctgagtgttccttaattggcagctaccagtctcatttatgggtgcccctctgccagggtgcggtgaagagagctaagtgcaagttattgctttctggccaatagcacatgatcctcttaataaaaagagggtgaccacacatgttaatttcctgtcaacgtgacccagcaaggcccaagctgttccttcactctgtccttcttgcttctccattccaaagcaaaaggccactgtgagccgggaaaaatcaaaagatcagttttttggaagaaagttgtaaacttgacctcatagagggagacaatgttggctgttcaggtcaacaagagttatatacacaccaggtctgcagtagcctggactgtgccttttaagacatttttggtagcacaattcagcccagaatattttgagaaagaagtatattaaaagtattctatcacaatggggagaaaagggtggggggatggtattttaaagcttcaatagccaaattaaactgtgaacagaagaatcgatgtaacagaatgtctcaaccacaggccttaatagaggtaatatagacaaaaaaattagtatgtggtaaagatctgtgaggaaagagagattagtcaataaatgatgtcaagaccaatcatatggaaaaaattaaaggtaatccctataccaaaataaattccacatgcatttaacagttatatgcaaaaataacataaaaataaaagacaggtaaacttcagatcttgagagcaggactttgttgatataaaagcttaggaataggttaaaaagtaaaagattattgagtttgatgacagaaacattaaaacttctagatatcggtaacactggaaagatgtttggataaatatcagaaagaatcttatttttatgtgaaagtttattgcaaaacaatgagaaaagtgctatcctaatacagttaagttggacaaagaacacaagtaaataataaaaatacaaatattcaataaacaagatattcaaatatcaaaaacaaaataaaaattcattttgcccgtcaaattcctatacgacatgcaccgttacacattgcaggtgtgactttccactgacagaaactttctgtaattgattgagggccttaaaagtggccatatccttttgtaattttttcctatttctacaaatgctctacaatcagataaaagtacaaagacttattttcagggatgtccactttgggcattagttaaacattttgagaaataagctatataaccagtaacaagaatggctatcatccaaatgctagaataatacgcagccattaactttttaaatatttaaggatgtgggggcatgatcacgatgtcatgctaagtgcaagactttggatgtcaaaaggtacatattgaatatagcaaaacactaaaagaaaaaatccaaaagttttcagtggggttagtgagaattgtgtataattttaattatctctttttatgtgctcattttttccacaataaaatatataaatttatgatagaaaacaagttattgaaaatagcctgaccatctctgtctgatctccccacacagactctgttggcagctggtgggggcagatgtttttcccaggcggtggtgaaaatatgcttagcaggagacatggctgcgttctcacgaagtgggcctggtaccccatgagcttcttgaatgtttgttctgcactcatccaatccctcagagcagcccagtcagggaagaagagttttcaaaaccctcaaggagctgtggcctctcttgcccacagccatctgtgtatctacctctccgcaggtgcgggtcttgctcccctacctttttgtgtattgtggaagatactgtcaaattaggggtggcttagggttgggtagatgtttctgtgctctgtctaccatgattctgtgtcttggccaaagataggcgcagatagactccaccaatcccaatgcttcctagctctggactctgtcgcataaactggaaaaagaactttaaaacacgctcaggagcacaattggccttcagagccgtcccttttaaagatttactctagtgctgtatacaggggtgtgcaggagtccgcgcatgctacttgtgagaaccaattgtgtgcatctcttcccaactgttgtttatcacattagtagcttaagattggccattgtaggagttttacaccacagaaatagccgaacgctacaaatcagggtggcttttttttttttttatggagaaaaatctacagcataccaatggctatgcttaaaacaacattttattgtctctcccagtttctgtgggacaggaaattgagaggggcttgattaaatggtcctgggtctcttatgcagttacagtcagacagtgtggctggggctgggagagggggagggtgagcagctgggggttgactgggaatctctcaccctttgttgtcacgtggtttctgcatgtaggatagcttgggcttcctcacaacatggcagtcagaacagtcagagtgattctcagggctccagttagttttctgttgccatggcagagctgaattgctttatgatctggctactgaagtctgacaacattacttccactgcattctattgagtacatgtgagtcagaagcccatcctgttttaaggggagaggaattacactccacctctcaatgggtgaatggtaagtttctcaaaaagcatgtaggatgagaagtattgttttggaaaatataatctgccagagagtttaaaagtatactttgggatttgcctttcaaggctactggacatttttctagctatttggtgggtgtggctacctttccactgttgggcatatatttgatttgtgagaacagacaaaagatattgaaagccgactccagcaaacaatgcagataactctgcaggatgacaatggatccggaataggaaatgttacaatggtaacagccagctgagacctgaccaggggcccggagacatttccaagaggatggaggagcccttctcagctacatctcagaaataaatgcacagccttctaagggactactgtgaaagacaaggtgttctggactacatattacaaaagtgccatgttttactatgaaacctgtctcattgccttgtagccacattgcacttttctttggtaaccatcaaaatattttgcattgtatcaggcacatgatggaaacaaagtaaatatctgagtgactgattgatatagctaagccagtccctggttcaactaggtccttaggcattagttggacttggccaactatcaaaagagaaggtgaccctttctcatcaaaaccacttatagaaattctaatgtgtttaaactgggggactcgggatatgaatacaaatgtacatttctcttgatacacacttcttagtttatctctttctaaacttcgtaaatctatttcctgccatccttgttgacagggctcatagaggggaggggtgggaacaatggatgctactccaggtttcttcatggccttgaggtagacccagataaaccttaactggcttatttctgctcaagccactaagcgtcttcttttagttcttagaccccacttgaccaattatgaatcaaccatcaaatatttaccaaggtcctaacctattctgccactaggatagagatacacataaaagtccttatgtatctgtactttctcattaattaaagctcagaatttcccctccgtgtccccaaaactaaaacaatcttttagtaagactcatgattgtagacttattgatggttagatgggatggtggagacgtttcctgctcaccaaataccatatcccctttcccgagcatattcgccagcctccttgcagataggtggggctgtgtgactagttctggccaatgagctgagaaagaaaatgatacatggaacctctagggttctccaagaaacttccaggttgatgcatgattccaggttgggttgggatatccaagggttctcttcttccatgataatcatagaggtcatatgttcccaagaatgtagccacaagatgcaggaatcaccattagtctggctctttaagtggctatgtagagcactagctcccttgaatatcccgcagcccctggccaacccatactgggttacattaagacactaaagttttaggggtaagtagttcttgcagtatagcctcagctagcctgactaatacacatggtccacaactaaagagcaggagcaggagttggcaagggtctcatgagaggctagctgagtggtcctatatacaaagcacaccactcagctggtccaggtgtgagaagctacttggctagtgggaaaaattccacctaacttttgttttaggaaaacttaaaatgagactctcaatggccaataaaggacatttcctttggacacaataaatatttgacatttgacattattgttattatgggatatatttgtgggttcaggattatgaccatgtgtagagagtctaaaagccaatgtctgatgagctaggtgaacatttggcattctgagaatatgtaaacatcacttgtgtgtgtgtgtgtgtgtgtgtgtgtgtgtgtgtccacgtatctataaagttcagatgagttgagaatataataaatgggagtttttaatctgcatattttgtagctggcaacccaatggctctacactagaagctgatatcaaataataggagattatcataaactaagtcagaggccagaaaatcagcccccaaaggaaggccagttatatactaaaatattaggccgtgaaatatagttgttaaaagtgcattttggccaggtgcggtggctcatgcctataatcccagcactttagggggccaaggtgagcagatcacttgaggtcaggagttcgagaccagcctggccaacatggtgaaactccatctctactaaaaaatacaaaaattagccaggcttggtggtttatgcttgtcatcccagctacttgggaggctgagacatgagaattccttgaacccaggaggcagaggttgcagtgagccaggatcatgccactgcacttcagcctgggtgatggaatgagactctgttcaaaaaaaaaaaaaaaaaagtatattctttgaactctgcctgagttagaatcttggttgcacccctcttcagatgtatgaccttgggttagttatataatctctatgtgcctcagtttcctcatttgaaaaatattgatgtcatattattgttatggcgattaaaagcagtaactgcattaggattacgtttggctgttgtaatagcatacctcaaataacaatgtatctgagtcaccatgggcttctataacaaaatatcatagactgggtggtttaaacaaccgatatttatttctcacagttctggaggctgggaagtacaagatcaagtttctagcagatttagttcctggtgaggaccctcttcctggcttgcaaacttctcacatggtggaaagagagtactctaatttttcttcctcttcttatgaggacagtaatcccatgatggggtctccactctatgaccttatccaaacccaatgaccttccaaaagctcacctccaaataccatcatgttggggtttagggttttaacatatgaattttgggagacataatcattcagtctataatacagtggcttaaaaaaagaaagatttatttctcttacgcccaaagaaagaccaaagctaggcaatagtatgtggtccacggtgtcagagacccaggctccttctaagttgttgctgctccaccatcttcaacacgtctcttccacttaatgatctaagatggcaactggagttccagccatcagatcttcactccagccagcacaaaggaataagagagaaatacaaggcaaagggctcattctgtatgtctccttgactggaacttggtcccatggctgcccctaaatgagagaggcttgtaggcttgtaaatgtggtctctatacagggaagccacatgcctagcttaaaaccttgggttctttagttaaagaaaagcaggaaagcaggtatcaaagtatataatttgtagtctgcttgaaacagtgcctggtactcagtgagcagacaatgaacataaactattaactcttatcagaagtctgccatattggatggagctagtcatgcttcaagcacgtcataggcctcatcaccgtgctcagagcacttttttggctgagtttcatgctcaggatgagtaaacagactgcccttctgctttaacggagtagctacaacaattaaaacataaaaagagctaaagctggcataggaatagttagactgaatcttaggttccctgggagagaacatacctgcacctgaatgatgctaagggcattggtacactgtgctgcaaggggagccctgggggagcagttggtacaggggacatgctcctccagctagtgggagggtttcagacagatgtggccacatgcaatgccaatgagaactgctctgattcttctcaaggacatataaggtgacatgtcaatggtagcttctcttcccaagctcatgggcaagggcggagggaagaagaggaaatagaagacaaatgagacttggagaaagccttggatctgggaaaaactgccactccctaaccttgtccccaaagcctttggttgccaagactgcaggggagccactggccctaccctaggtttgcgcaacaaataagggaatggcttgtggtgttctaacctcttccatctctgactctctggttatcttcctggaagcagaggcaggagaggccatctttgccccaggttagtcagctatctcttagaggcttcaccctatgaatgttttatttttatttatttattatttttatttattttttgagacagagtttcactcttgtcacccaggctggaatgcagtggcatgatcttggctcactgcaacctccacctcccgggttcaagtgattctcctgcctcagcttcccaagtagctgggattacaggtgcctgccaccacgcccagctaatttttgcatttttagtagagacagggtctcaccatgttggccaggctggtcttgaactcctgactcaggtgattcgcctgcctcggcctcccaaagtgctgggattacaggcatgagccaccatgcccagccctatgaatgttttggatcctgtgtttctaaaccagtggttctcaaagtgtggctctggacactctagggttctccaagaaacttccagagggtttactagatcaaaactattttcatattattactaagatgttatttgtctttttcaccctcatttcctcattaagtgtacggtagtggctgtgtgtacgtaatgtcacaacagagtgaacatccacctgtcttctgttcacccagactttaaggaaatttgcaaatatataaatcaatcccactcttctcagctgatatttttgttttgaaaaatatcgttgtttttcacaaaaatgtattatttatattaacatataacaggtttattatgttattgtaaataaattaatattttactttttagaccctcatccaatgatccatcaattttttttttttgagacagagttttgctcttgttgcccaggctggagtgcattggcaccatctcggctcaccgcaacctccacctcctgggttcaagcaattctcctgcctcagcctcccaagtagctgggattacaggcacgcaccaccatgcctggctaattttgtatttttagtagacacggggtttctccatgttggtcaggctggtctcgaactcctgacctcaggtgatccgcccgcctcggcctcccaaagtactgggattacaggcgtgagccaccatgctcaacctcaagtaaatacttaaaatgttcatagttttaatttctaaatatggcaaatggcaataaacaaaatccccattttaaaaaagctcttttgggttctctgcgatcttcaggattcaaaaggggctctgagaccaaatagttttagaaccactattctaagcaaaagaattttcatacacattagtgtgcaggtacacattactgcgcatgcacacgtatgtacacttaaaagtatattgtgaccaaatatcttctcataccgctagaccaaggagtagcaaactttttctgtaaaggaccagagagcaaatgtttcaggctttttggggctgtctagtctctgtagggaccactcagccctactgtagtatcgacaaatcagacacagatgatcgctaataagtgggtgtggccatgttccaataaaattatttatgaacactgaaatttgaactttgtataactttcactttgcataatttcataaaatgttattcttctgcaaatcttcttcttcttccacataaatacatttataaatcagataacatccttgttttctactttttgacatgggaaatgtgattatccatgccacgtcactgcttttctcaatgctatcaatggcctttagattaagtgggtggtgaaggtcaagggagtcatcagaagtttgcttctctgggaaggcacatgtgagctgggtgcttatgcctcagagatgtctacgaggaacccagccaaaggcagggctaatgaaagaagaaaccgagaaattcattatgctgaactgggatccaaagtgtataacaacctctaacatttattttcccactcattcaacacacactgtatttatgcgcttactatgtaccaggcattaagagttaaaagataaaatttgaattctatttgccaaagagactttctggaaagcttttgggaaaggatgtccacgaatagaggaggtctgtaatccacaggcaagacctctgcagtctgaaagattcatacacctaagatacatacagtcattctcatcatctgtggtggttatgttcaatacaggcactctgaacaccgaattagcacgtcctgacccactgctcccaggggaaatacaaggtttggtccctgtgagcctctgatcatactgtttttgtcaacagatcaatgcataaccgtgttttatgtgtgtttctgtttaaagaccccttatttaatgtatactgttgactcactgatattgaactcagtgcccatggcactatcacttatgcatgaacaagcttatctaacgcataaactctctctataaggcaggaaagacccttcttgcgcttaggaacaccagacggcacttcagcactgtgcctaggggccattttaaacagcgaaatcatcaagaaaaaagcacaaaaatgagaaaaatgttgcactaaacagagcatgaaaggacatttgctcatagtgtgagagctgaacatgcacatacgtgttcatcactctgcgcttgtctgtgaatgaccgtgaacatgctgcaagtcttgatttgggggttacaagttaattttatcaagtagaagaatttgccaacatggaatttatgaacaatgaggatcaattatatatatttttggtgtcagagaagagctcacgatggaaccccgtacacttgtttgggaggggagttcggttgtgtgcacctaaaatctttgatgctgggagtccaactttggaaacttatctggagaaaattatcaggcaaatgagtgaatgattgtgtacaaggatgttcatttataatttaatgaaacactatgcaatcatgaaaatgcattgatgaatatttattaacatgaaaaatttatgaaatgcaaaatgaaaatacagtcaaacaatatacacatcataggcccatttttgtgattaatatattttatttacgatgtctaaaacagatatatttagtttataatccagatattttcaatttctgagtagaaaaaattctgaaattatatatattactaaggtaccatgtctgggagttgggattatagaacaatttagttttgttctttgtacttttccgtgttttctaaatttgtttacagtgaaagaactgcttctataattagaaatgtattgtttcacaatgaagatttttaaggttcttactctctgccaggcatagggctaagttccttaactcttgaatttttattaaaattgtatgaaacaatcatttatatttcactatttataataaaaatagaaaaaacctcaagattccctagcctcattcctcagatttggaaggccctcgaaggccagctccccccgacacatcttgctgccattctgggaaccggaatcagaggtggagactctggcccaagtccccactgctcagaaaagtgctgaggtctgagtctttccagccagggcagaattcctggggcttggccacagggacaggactaacagattcaggcaggaattttgtctgtctcctctatttttaaaagaaatagcccctgcctaaactgggttgagccttgtattatctggttttcttcaaagcctgagcaaagacgagctgccgctatccagttatgtgggactgtctggggaacggggtttctgggagagaaggtactctgcccagaaacaactcaattgtcagcagggcccattactgcacgaagatgagcttaacagatgtcagcccatcagcgtgagagtttctgcttgtaatttatcctttggagcattgctctatccccaacttatatttttctaacagtcaacaaatcaaaaaatgaccaaaggtgataatggggaccgagtttgggctcccaccctttccacatggcaccttccctagtaccagtctctctagtgtgatatttgacgaatccccgactttccagctttttcgttttactccattacttaaaaactgcagagtctactagatttgaggccagaggacttcgatgcaggtgccagtctgcctcatctgcctgtgtgaccttgactaagccactcatcctttctggccgttgggttacccatttggaaaatcagttcgaaaaattaggtcatgttttgatttgtcgacttaaaaaaatgcaggttgggcatacagcaatgaggtcccatcctggagattggatcatactcctgcctgcggaggcatgtgtctgtcatggcaaaacccagtgtttggattttgtgatgttgaagtacaatcagagaacaaaatgggctactcaatttcagcatcaatgagcttagctgggcggcattgctgtgggcaggagcagggggaccttccaaaaatcacaccacacaaggggtctcctgacctacacagaacaaggcattaccccctggggctggccgattggagctcctgggatcacgtggcagaattagccatggtttgtggttcttttcaagcagccaaattctctaagagtggtgtaaatgtcagtttcatgaaaatccattctaaaagccccgatcaacttttcaatcacctgctcccccttttctgcccagttctcccgagagcccgaggcgattctgagatcagagagcataattacaaatgaaccggggctctggggatggcttacagcttaattagctcccatccctgcactgtctccatggctcgcctcacgctccgctcagcgctcagctcagtcctgactgccaaagaattcagagcaggagcctcttggcttgttaacatgctctcctcggttcctcctgacactcacatctaggctgcaattaggcccaggtgaggcgacagagagtcctgagcagctctcgctgcctctgtatgtgcctccggagctggttgggggttggtgcttgtctggaccggcccgggggtgaggtacaccatggaatgtggagtggcggcggctgcagccacttgcacctgctcggcccagcccaggtcagaaggctgcgggctgcaggtgtgtttccaggggcacctgacagggcagggaccggtcattgaaggcacctggagttaaagggtgctgtctgataccagctggtgggggagaggggattgggagaggtaagggctgggatggcccctgggcagaagtcaccctgtgcagcaggagcttccctctaagcacagccatggccctagaaagggctttgggcttgtgcaacattaaaaggaagaaactacaattgtaccttgagggttcctctcaaggaaaagcgcaaacctgtaagctgatttctcggtcctcatgactccctggtggcttaaggcttgggctgtcaatgagtttccagcttgcagtgtgtgactctaccctagaggaaactctctctctcctggacaggaggaagcttagaggaagaatcttgagggcaaaaagaaaggtcattagctgggaaataacacctgtccaagaagacaaagggaggaaatagcagggccgcctgctcccaagcaggatccaccctcacgtcacctggctgccgggggggtctgcctaggcttattgaacccaagaccctacagaagggtttaagccttcctcagagacaggaagtgaaaaaacaaaactgcaataatgttaaagtgaatgtctccaaaacatagtattacctctgaaagttgaggtcactctacttcaatcattacataaaactgtgttctaatgttagccagggatgtactttaatctgtttcatataacagggagtcattcccccaaaagcaagtgcctgaggcctgtaaacctcttcacatagacctacccctcccaaaagaaacctgcaaagagacggaaggaacatgaatctgttcagtcacaaaagcaccgaggcatctcagggaccacagctccggtctggggccagccacatggctccaggaaaaaacttctctgtcaaagagatcctcagcactcccaccctcaaaactgcactcacctgctaggttcatggtcagaacctggcgaggaagccatgtggtccatgcacagagaggccggtgccacagattttggctttccttctttgggaaggatgattaagtgggagcattcgagggagagaaggagaactccatctatcttctcctatcctggatcaagaattctctgttctgcttgcactcctttactgagaagtgccctgtctgcttccctgagctctgaaccgtgctgcattgtggttatattgttagaaaaccatggcttccgtgcacacggtgaagcgagagagacaagacgctttccacatttgtatcttaaacaggcattgactgaatgcctaccatgtgcctagcaggtgctatttttgaggtgctcagaggctggcagggagataattctggcagtacaaaattccccagagcaggggaaggcaccgagtgtggagaggcctggagaatgaaggattaattctagctgaaggtagggaggcctcacagagcaggccaccaccaagccacgtctccgatgatggcaagggtgtccctggggccaggcctgaaagacggtgtggacttagtggggagggactgaggtgctaggcaggacccaggctggagaagtggattgtaattcaagggagagacccctcatactgccctgagcaattgggagagcacctcctagtctatgggagctactgaaaaagcccaactaggagacatctgtgtgtttctaggctgcagagtagaaaatggaagggacaggaaggaaaacagaggcctcatctactgactgctttttagcaacatcatcgctatgcaccagtcacagccatgacggggtcacaccgctgtttcacccttccaacgtacgcctggctttctttatagcttttgtatctaaaaaccagcagtgttttcatgaaggccagagatgggtttggatctagatccagggccagttggaaaccccaggccttgctcctcacagtgtggcctggggacagcaacatcatcagcatcacctgggagcttgtgagaaatgcagagtctcaggccccacccagacccactgcatcagatttccctagctctccagagccatgtgtgacttcctaagcattcctggaccaaaagtggccactccctggagcaatgtgacctgaaggatggacccttccgctcccaggctcaggccacagaggacagggcaggagcaaaaccagaaattccctccaggttctaagcaaggcttcagcttcagttttttgatattctaggtgggaggccagccagaaagggctcagtcagtctcaggcacacgggcatcagacacaccgtcaagaagcaaaacaacccaggaatgcaggtgagctcatgccgccaagcagcagtaattcatgctgcaacaagttacatgtgttttatagaggaggaggcctgtacaggtggagtcacgcacccgtgcctgtcagcacttacattatccatgattatccggattttcttttcatttggccccagagaaggagctgccacacaaagagttcagcagaacgaagtcactggccttactcctggatagagcagtatccacagatgtaaagaataaccagtctaactgtgtgtgtgtgtgtgtgtgtgtgtgtgtgtgtgtgtgtgtgtgtgtgtgtgtaggagacatgcgggtcagacctcagggctgctgagatatgatgtaccctaaagggaacttgcagagaagctctctaccttgccgatctgtgggtcacagcgtgagaacaactttctcatcatgtttagggccttgagcatttgaaaataataaaaaggaatagtttgaattaaaatttatggttgagtctgcctgtctgggaggagctggcttagtgggcaaggctgacgccagccaggctgcaggggctggaagaaattggacaccagcaaggctgtgaggagggatgactctcccatagacctgcgtggtgggccctctcggccagccgctcccagctctggttgcacattggatgctcctaggagagcgtttaaaaaatgctgatgactgggccacaccatagacacagtaaatctgaaccactggggttggagcccagtaactgaatgatttttaaagctctcctggtgattttaatgtgatgtcaggatgaagaatcataggctgaggccaaaggctccaggctcgaggacagcaggtgggcccttaatgtttctgctcctgggtgggtcttcccctctactaggcaggcatacaggcctcagtgggtgcaggaggggtgatttctagcattcaactccttgggaattttaccaaactgtgtatagggacggcgagtgtgaccaatctgtctgcagggctgtggagtcaattctgcagcagctgcccctgtctctgctagcctctgaatacttgctatggacacttaaaatctccaccaagatgcgtgcgcttttcatttttcagagaacgtgtacaccaatgatcttattttatcttgtgtattagttttctattgctgatgtaacaagttactgcaaaagtcatggcttgagacaacagacttaattgccttatagttccagggcactaaaatcaaggtgtcggcaggttgcattcctcctggagctttttggggagaattgggttccttcacttctctgtcttctagaggctgttgtgttcctctgctggtgattgccttcctcaaatcactctgacctctactctgtctcacatctccttctctgaccctcctgtctctgtcttccaaggacccttgtgtttacatcatgcccaccaggataatcttcccatctgaggatccttcccttagtcatatctacaaagtcccttttgccatggaaggtcacattcacatgttctggggattaggatatagacctctttgggggagccatgactccatctccatgccctgacaacagccacgtgagtcagctgtgcgttattatacccatttggcaaatgacaaaactgacatgtagccagagacctaggttttagagagcaaaggtgaaactatatgcttgttatcctccacctagttgttgccctgccctcctgtggaggtggttatttccacacacttttgttggacaggttcgtgggcacccagttactgatacaaaattactgccatcaggttgggtgtgcatcgccatgggcccaggaagccagtttctctctctgggttggtgcccatggttctggacaactctgatctcctcgactaggtctatgcacctttacacacaaatgattaccacacgcctctcctccatggcatttgtcaggattctaccactgtttatgtacctctgtcattaatctcagcctttccctttcaacggtaaactccatgaggacagaatacatacttgcttttgcactccagcaccttgtagagcacatgtgaatgtttaataaaaatgtgttaaacgaatgaatgtttgtcagcagtcgaagccttacagatgacaagcaactactcctttgccttgtagaagctgtggctgattgctttagtgttcccatctactcacttccctgtaggaagattacgcgtcccattcattggcctgtgactgtgggggctgcttcctgccccactgccaggcttggtcatgtgacttgctttggctaatggaatgtgaatgtgaatataacagaagccatgtctgcgcagctcttagagcagttccatggctttgctctgcctcttgttcttttccctttcccaagagaatacaatatccaaactataagatacttttctggcatgtgtcccagaatgagaagacattaaggaatggagccaccatgttcaccttgcagctctcaatatgcctgagattgaagctgttgttgctgtaagccaataagatttgcaggttttcgttattgcagcataacttagcaaattctgacaaatacagaagtcatcactggacagctcagggcatatccagctttccttcctccccagtggtgacccaggttacagccctggctctaccacttgcaacctgtgtgattttgagaaagtcacttcacatctttggcttcagatttttataccaatagataaaagcttcttctggcttcagaatcagcgattctggagatctagcctattattcgacacttgacttctgtccttaatgaattatctgcagatggtatatggtgccagggaagttgccccaaatttttagtatgacagttatgtattcttgggcaaacttttttatctctctttttgtttctaaaagtcttatttgtaaaagggacagttatcacacaatgtggaggtatgtcacctagctcacaatatgtactcaataaatttaggtgtcctcccctttcccttagctacttgatcagattcatcttttcaagtgtacttttttagcatcttgcatgccctaaacttgggtgctttgagggagggggtgaaaattcctggaaaaaaaatgcacagaaatgtacacagatgttcacagcagcattacttctaatagccccaaagtaaaaacaacagaaaggaatattatttagccataaaaaggaataaagtactgatttatgccacaacatagatgaaccttgaaaagattatgctagaggaaagaagtcagtcacaagtggccaaacactgtatgatcctatttacattaaatgcccagaataggtaagcccagggggatagaaagtagatctgtggttatctaatttactgggaggcagcagagtatggaggagttgagtgggagcgggagggttggtggctaatgggtatgaggtttctttctgaggtaatgaaactgttttgtggtcaaatagtggtgatgattgcacaactttgtaaatatactaaaaaccactcaattgtacactttcgtttttttaatcatgtactttaaaagtatggaacatgtggcgtgtgaatcatatcttaatattgaaaaaaacccaacaacctcagaaggacgcagagggatgagtcccaggggctgctggctcaggtggaggagcattgccacgccagcccttcttctcagccttgtcagtgttatcttgctttgttctcctcctaaatctctcttcttttcttttgatgccgcgtgctccagcaaggggaaaggtctcttgttgctttgctcagaggaaatggttaggagttttcaaagaccattttattaaaaattttaaaagaggctgggtgcgatggctcatgtctgtaatcctagctctttgggaagccgaggcgggtggaccacctgaggtcagggtttcaagaccagcctggccaacatggcaaaaccccatctctactaaaaatacaaaaattagccgggcctggtggtgcatgcctataatcccagctacttgggaggctgaggcaggagaatcacttgaacccaggaggtggaggttgtagtgagccaagatcatgccactgcattccagcctggacaacagagcaagaccctatctcaaaaaaaaaaaattaaacacatagggaataaaaatataaacacataaaagatggaagtgttttggagatcatattctgtacactgaagtagccacaagctcaggccaactctgggtcttgtgtccttcccaccccctcagccctgtctaggggaaccggccctggagtcccatgtggaagctctggacaatttcctccgttctcccttcccgttcatgctgggcctgagccctcactggtcatggtgtagtggaaatggatggcaatgggttggtggtcctctccatatagaacaccattttcttcccccacagacccagggaccaaggcactggtgagtgggggaggggggcatttatgaagactctcagttattccttccattccccattcttccccctacaagagaaggaagggtcatttccttacagcgctccaccaacacttgtcgatggacccactgcaaagcacccagaaaatcataacttcttcttgcttcacagaagactctcagcccctcactcccatcttcaatctatagtttcaaagatcaccaactcaattgttagagtatcctagcaaaatagaaataatttctctgtttttcgcttggatgattttagttttgcatgtgttttggattggttggagtcctattggccactattacatgaccaacttgagctgataggacaactctcccacatacaagagagtggacgggtagcaccttggggcccctccagagaccgtcatcaccagtggggtgggggagtgtctgcttttcctcaccagtccccacttacctccgagggtttggctggtgttatcccgagagaccttgggatatgggaacatgatttgtctacttcttcagagccttagaagcttatttacaaagccctcctggtcctgggttgaaagggcttgcagaaagacgtaagatgttctcaaaacaatccaagatccagtcaatatttataacccagggctttagctcaggtggcttcatgagactatttgagctccacttaactactgtacattgatcatctgtgggagcccttttgcctgctggctcctttatctttattatactgtgcagttgggaatacacttgactctcaaaggctcaacttgtacctttcaaaggaaaaatttccaccttatttttaagccctatcttgttcccctgcagtctgaataaacattactcaatagctggagttacttaagcatcaatcatttccatttcaaggagaaggtaaagggaacaaagatgtaacagcacaaaaagattgaaatttaacctccaccgctgggtgctttccaagcttgttcagattagttcgtcaaaaaaaaaagccccagagaactgatgttacctcaagttcactgaaattctctttctctcaaggattacacttgactatgaagcaagtcatcctggaaaccctaggcaggcaatgaactcggctagtgaacaatttgctttctctgagtggtttccacaaactttttacattcctcttatcttcaatgcaccttccatcaaactggtctctcgcctggcctcccccatacctctgtccaatacaactcacagttcatggccttccattctctctctctctctctcaattctttctttctctccatcctcctctgaaaaataaaatcatcctgtatagaaaaattggcctccaaaatctctactttctccagtctcattgacttcccagatgccatttttggctctgagatgtagaagtcctctccagagtggtgacagtgtgtgcctgggtgtggtctcagaccacctgttctcaactcccccggggaccttggtaagcagctaacttccccgaaccctatccatccctactgaattagactctggaagtaagccaggaaatctgcatattaagcaagctccccaggtgatttttggcccaaggaagttggggatctgctgtactgagggaggatattggctttggagtcagagaaacccttgctgggttctgtgcttcgctctttgctagtggcatgattttaaaaacagctttattaagatagaatacacataccatgaaattcactcatgcacgaatcagtggtttctagtacattcacagaggtgtgcaaccatctctacaatctattgtagaacaattttatcacccccaaaagaaaccctgtgtctattagcagtcactccccatttacccttaggctcccagccctaagcaaccattaatcttatttctgtctctatggatttgcctatcctagacacttcatatcaatggaatcctacaaaatgtggttatttgtatctggcttcttccatttagcataatgttttcaaagttcatccgtgttgtaccatgaatcagtacttattccttttcgtggctgagtaatattctactgcatggatatgccagcttttatttatccattcatctactgatgggcatttgagctgtttccagtttgaggctattggaaataaggttgctatgaacatttgtgtacaagcttttggcatggaggcatgctttcatttctcttgtgtgagctaggcatggaattgctaggtcttatggtaactttatatataacattttgaggaactgccaggttgttttgcaaagtgactgcacaattttacattgttaccagcagtctataaaggctgcagtatctccatatcattgccaacacatttattttctatctttttttaaaattatagccaccctactgagtgcaaagaggcatttcactgtgacttatatttgcatttccctaataaataataatgttgagcatctcctataatgattggccttttgtatatcttctttggagtacctaatttaggaaggcatttaacacctctgagcttcagtttccttgcctataaattggagtaattgacaaggtgattaaactaaatgaggcaatgaagttggagtacctgacacacagtaggcacttaaggaaggttaaccttccacaccactgatatttgaaacatgtcaacgtagacagtctggagccatgataaccagattccctttcccgtaaggctctgggttaggattggccaggggagatattagtgggaactctggaagacacaggtggctcaggagccacttcatgctctgaaggttggcacagtgcaccatggcagctcgtgcatgctgctgctgctctgctgtctcactttgttgccatgaggcagcaggtgcccctgcagctctgtcagctcccactggatctggtccttcaacttctgtaagtcctgggccaggtgtctgtgcacttccatggcaaagggcacagtttcttcagcagatcatctgtgttattaaaggtacatgggagacaagcttgggttccagttagtccttatggattccagcttatccatgctcccttctattcacatccaaattttttttcctctctgctgggtctagctgacctataacgacttcaggcttaacaccagaggcaaccaccttgcatagatttttccaccagctttttgtactgtgtatagcccaattcctatgagaaatgtctgattctctatcattcagagtgattctgattctctgattgaacctgtgagatgcaatcaccaagggcagctgtggcatctccccagctagagaaaccaggggctgggatgaaagttggtctccccagcaaaagtaaacgcatggtgacctggagttcttcccataccagtaacctcaggtctccccaggcagaggtgaacctccactaaaccctcctgtgtaagtttcctatgactgctataacaaatgaccactaacctaggggcttaaaacaacacaaatttattacctgtcagttctacaggttgttaatccaaaataggtctcatgggccaaaatcaaggtgtcgtcaaggccacattccttctgtaggctctagggaagaagtcattcccttgtcttttccagcatccagaggcttcctgcattctttggcttgtggcctcttcctccatcatcaaaacgagtagataagcatcttcaaatctctcactctcttacaatgaccctcaggtcccctctataaggagtcttgtgattattctggcctcacttggataatacaggataatttccccatctgcaaagtctgtatctgcaaagtgcccttttctatagtgtggcatattcacagattttgaagattaggacttgcacatctttgtggccattattgagctgaccgcatctctagatccattctccttacttcctccctgctgttcagtgccctaagagactgctgaatgaactgcatttaccagctctcttgccctcttgcttctggtaggatttagccaacggggggcaccagtgaagatcagagaacagaggagtccctgattctctgcctgaggattgaatgcatccctctatcaaaggacacactcctggtggccaaccctttccacacagctccagctccacttgttctatttccatttcttgcccctcaggcctagggatggtagccgcttccctgcctggctagctccaaggtaatgcaacattccttgttggtttcctttaaccctgtacacatctctgtaaaagtccctgtttggcataaatgtaacagctaaaactataaaacacttagaatacaacatagcaataagtattcgggtttaacaatggattcttagatatgatcaaaaaaaccccagtcaacaaaagaaaaaatagatacactgaattccatcaaaattaaaaactttttcataaaagaacactagcaagaaagtgaaaaagacaacccacagaatgacagatctgacaagggtctagtatctagaatataaagaactcttaccaatcaacagaaaaagacagacaatccaattcacaaatgagcaaagaccttggataggcatttctccaaagaagagagacacatggccaacaagcacatgaaaagatattcccaacattagtcattagggagatacaaatccaaacacagtgagatactacgtcacacattgtaggatggccataatcaaaacaaaacaacaagtgggttggtgaggatgtggagagtggaaccttcatacactgcgggtgggaaggtagaatggtgtggctgctgtggaaaacagtttggcagttcctcagtaaattaaatgtagaattaccatgtgatccagcaattccgctcctaggtatataccccaaataattgaaaacaggtgttcaaataaaaacttgtacatgaatgttccattccatcacccatggatcctcccagtcagctcaacttatgagcagaaaacatttgcttttagaccctcacaggagacaatgggtgtcattgcaaaaagccaatgcatggagcctatggaggggagggctgaccattgtccaggagtgctaatcacagcgtaacacaaagttcagggtttctgccagctgggttatttctcagtatgctggagggggtggaggttgcccttcacatgcctagagaggcccctgatttatggggctttaagaagaaaacaaggtcagaggaaaattggctgacccactgtgagtccaagtgacttcaactaaaacagacagagaagatggagatgataaaaaaggaaaattcagatttagtgtctgatgctccacctcctaaaaataggcaacctcccaggctctgtccttggctttctctttgccttgtctcttttggaactcactgttagacatttctgtgctaaatatttctatctgccagctacaaaccctctgctgggagtcatagcacacctccaaggcagcatattccaaattgaactcctctttccttccttcattcactgtgctcctcttgtcaccatcatctccaaactactcagcaccctggcctccctatctgtcatgctggcactgccacttcccctcaccctggctctgaacctcctagtctctggcatccacatcccttccgtttcctgggaccacagcctcacagctgcactgtgctcagcatttcacaaggactgtcacactcagccttcacatttcctagcaaattggaagtgaggcatctgacaccatatacccaacccgtattgcctgccaaagccattgaatctctgcttcctggctctccctaaggggcagtctaccattggacccaatgtccaagttctctgaaggcctggctccaagctacctgtcccctgctataagccttcaattcattatcatagaaatgttgaaaactccatttccctcattctgtatcagaagtttcttgcatatctattttgtgctgggcatggtgttagggactggtatcaaaagagtgagcaagactctcagggggctcacgatccaataggtaaagtaagtgtgacctcggactatagggtgaaaagggctgcaatagagagtgaggaagtgagtatcctctgggaccacaaataaggtaccaaccccagactcagtaggtcagggaaagccccaggtaccctcaagatcaagtctagattcctcagcaagggtgcgagcatacccacacctggcctagattcccttatctggcctctagactcctcacatgtccatgaagcacccacaaagaggtcctcctgcctctttccaaacaagccagcaccctcctactcctaactgttgttattcattcttctttctctgggttattcttgctccttacctttacatgtcaaactcctactgagcctttgagagccatagaaacactacctcttccctgaagccttccctggtctccagactcacacataatttctccgtgcattgcccttatcattttctacatggtatattgcatgtatcttccttgtcccactgaactcagtcagggcaggcacacattgctcatctttgagggctcccaaagggcctacctaccacaatgccctgcactgaggtgaaggaggaggtgagttaaaagcccaacagggccaggcacagtggcttacgcctgtaatcccagcactttgggaggccgaggtgggtggatcacgaggtcaagggattgagaccatcctggccaacatggtgaaaccctgtctctactaaaaatacaaaaattagctgggcatggtggtgcacccctgtagtcccagctactcgggaggctgaagcaggagaattgcttgaaccaaggaggcggaggttgcagtgagccgagatcgtgccactgcactccagcctggcaacacagcaagactccgtctcaaaaaaaaaaaaaaaaaaaggcccaacaggatttcattgtttacattgaaatattaatgggttacacatggtagatttgaagcattctgtatgcactgcgtacttgtactaaaatcctctgtccactcatctgctttctcattggtctgggaaaaagttaaggtatgtcacgttagtctatgtgtcctggggccttgagctacaccttgtagatctgtagtaaacatttcctgacccccaaccaagagcgaaaatgtcaaagtctttcacattacccttgttaagactaaattaaggctcttgcaaatataatcacatctttctctttcatacatttggtgagggagcactggcttttattctgggatcattgctctctgccatccttcccaatccattgctctccatttgtccacccaccgctaaatcttcacctcctaaaccagttctatttggactggccatcagcccaatccatacaaccttccttcccttctctcctctcgcacttgggcctctcaccttggctttactttggagaaagtttaaaaggccggtctcctccgtcccctttaataatattatgttatcttgatcagcatttgtatttcacattgtaagattctggcctgaattctgacttcactggggaaggggagggagttggaaagaggattgttgatgacggcgatattttattacgtgtgatggtcatgggttagacgttcagctcttcaagctggaggctgagggtggggaaggggagaggacactaagtatcatgaagtcacagtgcaagatatttttcaaggagacatcaaagcctttttccatggtgtcttgccttgaccccatttcacactggcaaaacacaaactcaaattaaagtaaaaataccaggacagctccatttagccagttgggctgctgggctaagtgactgactttattaaaatcgccaaatgcaaacattccaagatttattttccttgcttataattttgctgcctttccactggtgggctgtttatttctaataatttggtagaaaaaaacattggctcataccagtggaggtcttatatgccaaactgcaaaccagagcacattttactgaggaataaaacccctggaatacaggctccggggggcccgctgacggcaaatttacaagcgtagtacaattgacgccattataattagttccccccaaaagtcttatttttcagggcagagatccgactctttctctttacacatgaatatctccggactagagcaagaacattacagagggtgagtcatagaccggctttgggctttaaagattaacgcagatcctataaatctaacccacattcttttactgggaatgactgacttttatgaaaaccaaggattgtaaatcagaaacctaaatagcttactttgcagcagataaacacagatttatgtagtgagggagccctaagttaaccctttcatggggccacggcggacctgagggtatgtgtgcggtgggggtgggttccatcagcactgatgttcctttctaaacactgcacggtggagaggagacatgccacatgtttatctccagcagactgaggtgggaggcaggaggagtgcgtcttcttgagccaagtgagcttcctactgatccatctcagctgggtgcacgttaagcagacaagatttggcccctgattatttcaaaggacagtttccaacttgaagtgacacacacaccagggctaacctagaaggggcttctgcactcgtgctcgtatgcgagcctatggtagcctgggcttctaatcatcagctgtgtaatctctgacaaagcaccaaacctctgcggacctcaaccttctcgtcagcaacatgctgcacctgtcatgtcataaggattaaacaggacagttttgtaaggtgcttaaaacagtgctggactcacgctaggcactcgatacatattagccagtattattcctattgttactagagccactggttacatagaccgggcttctcaaactactgcgcacacaagtcgcctagggaccgaattaacgtgcagccctgatgcagccgcctgagacccgcctttgcagcagcctgccaggaggtgcggatgctgccggcgcctggaccgcgcgttgagcagtgcaggtgaacagctcgcctaacgcacaagccacgcccacaccctttctacacgctttctcgttcacttctcattgcaactccttccgccgcgtggacaggttcagcactctcggagtcgatgtcattattcgccatcgacgcgaacctcggcaaagagacgggtcttaccggtctccgaatgttctcaggccctaagcgcgcagccccgcacccgggtgcagccggcgcggtcccacgtgtccctaccgcgagccgctccccgcgtccctgctgccgccgcgcgcttaactctgcctgcccgcccgccccgccccgcccggccgttcctgcgcagccctgggtcggcctcgcgcttctgtgtttaaacaagcctcgcccttgtgttgcccactgcaactttaaagggaaacagggcccgctgatcccgggagggagagaaggacatctatcatttttatgtggcatttcaaaggaggaggcctaggcagtccacagacaaaggcccgctgcggggttaatggagaacccccatttaatcattaacgcttaatactaaacccgcccagaggaggcccgcctgaggggggtgcagagggtcgccgggaggccctggctcagcccttgggggctgaggggccctatgggggtcggacgggttcagggctgtcgtgggttgctatggagttggggctccgggccatccttgcagaagggggtttctgctgaagctcagggtgggagcgtgagaaaggagggagtggtcaccgaggaggcaccaactggggaactgagtgctttccacaggctccccttgccctgggaaggtgaaagcattagtttactttctaggcccgacctgaaatccgagtaaaccacgcaaatccacgcgcacctggcctgtggtcccctgcgaatgtggggcctccgcagtgcttcctccttctgccagggttgtgacatgggcatccccaggctctttggagcgcccctccccaccccactcaaccccagcactgaggcatccccagactctgacatatgctgacgccccccaccctcaggtgcccacctctcacccctctgtctgccccagctccccacccttatcacattttaatcacttacctggagctgggaataagctgcctcctcattgttttcccaaatgcttgaacaaagcctggcattgcacagtgagaaagtcatttcctttccaatgcccctccaaacctgaggaggaggaggagcagaaaacgtggccagcacaggctttgacccctgctgcgcacctgttcagccttttcttaaaagaggagagcagacctcaggccctaaactgaccctggtttctggccagaatttaatacgcaccgtagtgtgttaactcccttctacttaacttttaatttttttttattttgaagtttagcaccatccgtgatgttaactggatgtaaaacggagtgaatcatcacaaactgaacaacctgtgaaaccagcacccagatggagaaacagaatttgctaattttgaattcacaaaacagaatttttctgggctccgggaagcccctcccccatccctttccactctctatccctccttccagaagggcagccactctcctaactcccaacagaagataattttgcctgcgtttagttttccatcagtcatttaaatggactcacctgggctcagcttctctccctcaacctgttggtgatttccatttgtgttcagtggtatgtagttgtagatttttcattccctttgctgaagagtattcattgtgtttatttttatggtgactttctatgtgtaatacacagatgccggttttctatttacctccatctctacatgttcaaattacaaaacaataaaacaaatcgagttcatttaaaaaatcaaacacagccctggtgggacacagataccgcagcagtagtgtggacggtgcatgagtcgttaagatgtggcatttcaacctagtaatttagagagatggggcttctgatcctgtgcacatgcctgggttgggccagttttaaaacttgtcaaatgggagcttaatagagtctcctgggggctcccttgcaggcccagcaccacggtggcatcccccagttgcagctccctggtatgtattaaaaggacctattgggtttacaggtgtggcctccagtacctctcccaaagcactcatgtggtagaagtgggtgggcctgccttagggctctcaggacacactgctgacctttcctgcctccctgtgggaaaattccccaggaggagataagatcagtatagttagggccttgcagggggcctcctgccccaggagcaggatagaaggaaacagttcagatctggcttaagccaagtgcctacccctatccaccaacccccgcccccagggctctgtctccaactggagcttctgcaaatcctgctctcctttccctgctgagggagagaccctcctggaaatagcacccagccaggatcccctcagggctgtaagcaaaggaaggctgagagaaacttgagcccctgctttgggctcaattcgctcaattcggtgtagatttcagtttctccctcaagagagcaaaagtaactcacagaccctaaggagagatgatactgacttgtttaccttcagatagtgctttgaaagtcctgttgactcattcatcttggagatccgatcaccctgcggttgatctcccacacttactaggctgagaagaaagacgtctcttctctccttacaaacccaaatttgaatcccagctccccatcccttcatagctccgtgaccttttgcaagtcccttaacctctcccaaccttaatttcctggtgtgtaatgtgaaggtaatagtacacttcttgcagggcactggtgagaactaaatgggctggtgctgtccaagcatttggcaagaagcagctcactaagcagtgttgggctccatatgtgcaaaaagagggacagaaaaacctcactttgaacccaaaatatctagtttttaaccccagttttgggtgcttcttcattccagttcagttttttctttgaacagaagagagaaatgagagaaagaggcagagctctgcttgtcataccaaggtgattctggctggcttagggtctcaggtttcacctgcagtgtgatcctcccggggcttatttatttccaatgcagccttcgagatgcttccaaagggatatctcagcaccctcagcaaaggccccagtgcaggattctagcaaacacctgccgcaggatagggcctctgctacttgggaaaccttactccctactccctaaggaccacatgttctattctgggactcacaaacattattagacatttctgatgcttaaaagaaaaaatccaagttaaattccaaaaaatttatgtgcaacaattgggttttcctgtcttgaaccgagattaaccaacttgacatcatttgcctgggattttcctggttttagcactgaaattccccatcccaaaacacctccaatctcagataaaccaggataatggatcaccctacccaaatggcttcatcacattctgctctggttatttgctgcctcaccctaattaatagctacgtttattaagcagagactctgctaagcacatttcctacataatttcacctgactttcctaataatcctatgagtaaatattattattattattattattattattattattgaaactagcatacttcctgtttctgtgctaaacaatactgaaactaggaaaaataatttagttgcttgctctaggaaatacttcctgctggaaaacaaagctgctgccctgttttcttatcaagaccaaaagcttgctaatcattactcactctaagaccctagcctgacagtgcacactgatcaaaaggtccagtctttcaagagctgccttaaaatcacacagctcagaagagaaagccctgtcaatacccttctttctactcctaccttctgagactgtgcaggtagtgggcaccctaccttctagtatactttcctgaggttctttttgagaagtcagctgtcagcattatttccctagttttaatgaggcatctgaagctcaaagagatgaagcatttttttttgatgaacagtgagtacttactggttttgctggttgagtccctctcagggttagccagttcccccaaacagcaaacaagtttcccacaagaactcacacaagcaaaccaaccaatcccaaccacacacccacaaccccctcctctatggggctctcacactctgggccactgttctcttgccctagctaccttagggccaggaaccagacaactagggacagccctacaaccccagagcccactggaatgaggcacaccagccagccctccgcctgctgggcctgacttacctgtttgctcccttggaaaccacaataaagtttcctgcccatttccccctccccctccccctcctgccaggccctggtgcttccccgagtgcccacccccactccccataccccctgccccatagtgtgtcctgccccttctcctgggatttgtgagtgtagcactattccttttcaatggcatccatctcctgatctgttggcctcactgtacctgattaataataaaactttccttttaaaatacttgtgtctgagggacagagggcagctctggtcacaggggtcacagctaatgaaatccaaccccgttctgctgctctgtggccatggtggcaccgtgtgtggcatcaccaggctgggccatgctgggctgaggctgagggctgctaacaagtgtcctttgtgcaaaaccacccattcctatgggctgcaggctcctcttctgcccaagtccataagagtccaagccagtcatactgttcagctctgcacctgccgatgacctccgagcactgttgtgtgctcagcagccctgacacagcccctgcctcatgggaccaccaattggagggtaccccagggagcaactccccagcccccagtttctatgtttctgtactagtctgttctcacagtgctaataaggacatacctgagactgggtaatttataaaggaaaaaggtgtaatcaactcacagttccacatggcttgggaggcctcacaatcatggtggaaggtgaatgaggagcaaagtcatgtcttacatggtggcaggcaaaaggcatgtgcaggggaactcccctttataaaaccatcaaatctcgtgagacttattcactatcacgagaatagcatgagaaaaacccgcccccatgatccaatcacctcccccttggcccctcctccaattcaacatgagatttgggcagggacacaaatccaaactataccaagctgtcattaggaagtaccacagatagagtggcttaaacaacagagatttattttctcacagttatagaggctagcagtccaaaatcaaggcattggcagggctagtttctctcaaggcttctccccatggcttgcagatggccaccttttcacagtgtcttcacgcggtgtccctctgtctgtgtatgcttctgttgtctttccatgggtccaaatttcctcttcttataagcacaccagtcacattggattaaggcccaccctgaagccttcattgtagcttaattacctctcagaagattttttcttcaaacatggttaggttctaaggtgctgagagtgaggacttcaacatctaaatttggggcagggacacacttcagcccataacaggtggtgtatgcacatgtcagctcaagcacacaagatggaacacaagtgagcaagtggcttctgtgtgaggaaggtagagaaaattcctcaagtgtataaggctcaggatgggatccatcaccttggggcaaaatgtccagctctagtcccagtctgccatgtcctggccacagaacctcaggtggtacgcctcttctcaaagccatgctttcattgtttcaggagggagaatgatcatggtctcggaggctgacggtgaggagttaacagtgtaatttgtgtgtagcagttccaccagctgacatttgtgagaatgacaactttgaatgacaacttcctttttaattttttttttctaatttatttttgcttccctttagtgagctgtagggaaacttttggcattttccctgcctcctggggtttgttttaaagtccaagtgcttagtaaatgtcagcagttggatttaaagattcttggtaaaaccagcttgagagacacaaatgtgctcatagatttgtacatgattagacaactgtcaagtgcagtagaaagtagccattgggattattttccaaaggtcttagatgtctccaccactctgcctctttctatgagctacttaagctcaccctctgttacctactgaatgaatgtttgttcccctcaaatttatgttgagatcctaacccctgatgtgatggtgttaagaggtgaagtttttttttttttttttttttgagatggagttttgctcttgttgcctaggctggagcacagtggcgtgatctcggctcactgcaacctctgccttctggtttcaagcaattctcctgcctcagcttcccaagtagcgtggcctggctaattagtgtatttttagtagagacggggtttcgccatgttggccaggctggtcttgaactcctgacatcgtgatccacccacttcagccccccaaagtgctgggattacaggcatgagccactgtgcccggccgaggtgaagtctttaggaggtgaattaggtcatgaaggtgaagccctcatgaatgggattagtgctcttagaagagatacaagaggctaggcacggtggctcatgcctgtattcccagcactttaggaggctgaggcaggtggatcacttgaggtcaggagttcgagacaagcctggccaacatggtgaaaccccgtctctaggaaaaatacaaaaattagttggatgcagtggtgtatgcttgtagtcccagctactcatgaggctgaggcatgagaatcacttgaacccaggaggcagaggttgcattgggctgagatcgcaccactgcactccagcatgggtgactgagtgagattcggtgaaaaaaaataaaagagagagagatacaagagcttcctgtctctgctctcccccatgtgagaacactgcaagaaaacagccatctgcaaaccaggaagagggatctcaccagaacctgaccatgctggcaccctgatcacagacttctagccttcagtatgtgataaatacatttgtgttgtttaagccacccagtctatcacaatttgttacagcagctggaacagactaaggcacactctccactggcatttctcaaggaaatatgtagaaaagcaagacccattcctgtcctgaagagttagcatggactgggggaggccagatggtaaagcagtcagcaaacaagatagaatgaggtcttctcaccccagaaaatgccacttgacgctgtgagcagtcttatagagggtaattttagatcttattacccagcaggggtgacttaagagcagcaatatcccttgagcatgtctagactagggaggatgaaaggcagtccaggcgacatgggaaacgctggagaggtggtgaaggagagggaggacacagagaactggtgtggagacatgtttgcctggcacatggcaagaaggagagcggcagagaagaccaagaaggaagctgtggcttgaatgccaagttgggacatctggacacacctccttaagtaacagaaactaaaaccagtattcagtagaaattgtcctcatctaagttgggtttttggaagataactcaagcacctagcagagtggactaaaggggagcagcactaagcaggtggcccagctgtaggtatgccagtggttcagaaaagaggaagggaggagctggtctgggtagaagcagtggggacagagacactggggaggcggagctggtggccagggcagggtgtgggtggagagaagagtttcctgttgctgctgttacgaatcactacaaagatggtgacttaaaaataacacaggccaggcacaatggctcatgcctgtaatctcagcactttgggaggccaaggtgggcagatcatttgggaggccaaggtgggcaaatcatttgaggtcaggagttcaaggacagcctggccaacatggtgaaacctggtatctattaaagttagctgggtatctaaaaaattagctgggcacggtggcacatgcctgtaatctgctcaggaggctgctcaggaggctgaggcaggagaattgcttgaacccaggaagcagaggttgcagtgagccaagatcgcaccactgcactccagcttgggtgtcagagcgagactctgtctcaaaaacaaaaacgaaaaaaacaaacaacaacaacaaaaaaccaaccccaccaactccttgcagtgctgtaggtcagagttttagccaggtctgactggactaaagtcaaagtgtcacaggctgcacccctttctgaaggctctcgggaaaaatccatttcctcatgattttttttcagcttctagaggctgcccacactccattccctgtggccccttcctccgtcttcaaagccagcatctctctgactttttttgtgtgtgtgatcacgtctccctctgaccacagttgggaaagtttctctgatttaaacaattcatgtgattagattgggcccatctggacactttaggataatctccccatctcaaggtccttcattgaaccacatatgccaaatcccctttgccacatagggttacgtgatcacaggtttgaggaattagcatgtggctatctttgggggccttattttgcctaccatattcatttagccacaagctctaaatccaggcaggaacacctctcccggggagcccactgccttcatgctggtccactgtcctctctaagtatttgactctgaattacatgaacagtcctctttcttgcagcattcaacccaagttgtcagctccaaacctatctcttcaactcctctgccttctcctaaataatgtgatttttttccctcagtcccctgggctcctgctgtcaccctgacctctctgtctctgcccatatttccttcttcccagatcagcactgctcacaaggcctcctctcttggtgatgaaccctcagatgtctggaatatagaaaaaacttccttcagcaagctcttggttcagccaacgtctctgcaccccctgatgccaaggggagagccttctgcagatacttccaggccagcatctcctgcctttgcctgtgtggagtcatcactgtctctgcactcagggacctgcacatacagaaggaaggctctctctctatccccacatggttgctgctgagagcagcagaaggcagccaaatgcctaggcagacaggggcaggtcactggtgaaaccccatcttcaagccgaagacagtttaaagcctaaagctacaagtcaaatcctcggaccagtttgcaaacttgtcttcccatttgttgcactttcctctgattgatccccacccttcacctattttacatagacctaccctttcctaattggttttctacactgccatgcccacctttgagtggtgtcttcactttgaccttttttgcctactcacaaaccaatcagcatgcacttcccattctgagtccataaaagaccccagacccaatcacatggggggcctttcccaccttcggataggggaaccacccctgggtccactctttgctgacagctttccttttgcttaatgaattcactccactcactctccagtagctgcacacctaattcttcctggttgtgagacaaaaactcaggcctagctgagctgaggagcagaaagactgcaacattttggtggctcatatggggatacctggagggtgagtaaatgtggtcccaaaccctctttcacctttgtttctgaggcttctcatcctcagacttttttctgaaggcagatgaagcaccaaacctctggtgagccaattaagaatgaatgacgcagttacagaggacaggatacaaccctgccacctctctctctctttcaggtcaaagagatgttggctttgtttcccttcatggaggtctagccatcacgtggaaccagaataaggtcctggggcaactgaaggcatctggccgaggacttaattgccaggaggcccctagacttggctccacccctgaccaccccattatggcatcagccaagacccgcagacttttctatggtatttttcttttcttctttcatggtttgaagtggctcctatctcttcttttacagcattaagtgtgttgttgcaaactgcagaaatattaccaggtagaatgagcatttggcctagccatcagatatgcaattcagaacaatgtgattttcatctgttcttagaggcacgtcccctacccccatcccaacagccacaagcacacatggtggacaaatgggtgcaccgcagctacccgctcccccctcccctcctggctggggcatgtggctgtgtccaacgcatgcctgtgctgcatccaacagccacgcagggcaggagtgagccgtgtctgctgcctgggacccagggaaatcttaggtgccaggggccctgcacagccagctggtcagcattttctgcccaccgccccctcccaccacacacccattgaatctttcctctcatggctcagtctgaacgagaaggagggtccagtgactaagaatctctcccctttggaggaacccatttgcatagagcaagaagttttttccccccaggcaccttccctgccctgcacttaagctgtttttttttttttcttttctccaacatgtcggtagttaacacagccctgcgaatacaggaagcttttctatgtgaggttttttttttttttttttttttttccttttgaaaggcattttactaggccaggacccaaaatcacagaactcccttttctctcccttgtttgaggatgacccagctctacagctttactttagcatttgacttacataaggaagcagcagaggagcgaccctgttggctgttggctgctggctgcagtctggtgaggaccacctgggacttgatgagtccataaaccctcctgaggcagctttttgtctcaaactcaattccaagcttcagactgaagccctagtaaggaaaacgggatctgagggatccagaggcagatgacaatggaagtcaaggggcacagcacaggtgagcgtgactgactaattcctgctgattaagtcccccttatttcaaggatagaggtcatgctagtatccatgccataaatgaggtctggggaacccaaaggttactgatagcatgggggacaggcagcatgtgggcaaatgcagataattcccatcccctaggcaccccctgttaacatgggtgaaagcctcattggcacccatgggcagcaccctgccaaggtcactgggactcagggatgtaaggacccaaaaaacaaatggagatgcctcttctttctctccctcacataccctgagtattcactgggaagagaaagtaactagggacactttcttcccctctttcgagatgggtaaccaatcttcttcagtctgtacttctctgaaatgcctcctgaatcactgtgattcttttggaaaaaaaaaatgccttctttctgctttttcctcctctgtcctctctttggggatgggtaattgtgtccctgtacctaacataggacattccccttggatgtgtcccccaaactgggaagagttaatttccccaacccttaaaatgcttggcttaaaattgagcttgggtgaagggaactcagaagcctgaaatgccagcaaaagggtaaagatttcttaccagtcagacttctggtctccctctccctgtgcaaaccagttgaatgaatgagaaaatcactgtttatatcctctgtaagattttgatgcatggaaaaaaaggatttgtgaggctaatcttaagctgcagccaatctggtgtactttgtgtgtctttctgcatggttctgtcataaggaggaatacctgaggatagagcatggcctagtaccccatgagcccactgttcaagccagccccgcaaactggtcagtaacgaactgtgctgcaggtctccatcttgtcttatgtccttggcagcttgaccttgtaaccacgtggcagtcctttcttttggtctccaccattttacagtggtggccagggttcaatcctggctttagggaatgagtactttctgcttaatatctgtgacttttaccatttcctgattctcttcccttcgatgaacaacttctagcttcctttcttaaatcttcttttctcggccaggcatggtgactaacacctgtaatcccagcactttgggaggtcgaggcaggcagatcatgaggtcaggagttcaagaccagcctataatataaaaaatagccaggtgtggtcgtgcacgcctgtagtcccagctacccgggaggctgaggcaggagaattgcttgaactcgggaggcggaggtttctctgagctactttaaagattccagattttgtaaaaactacttactaccttataaaaaataccttgtacattcatggttaagtcataaccttagttgaggcttcttggtttcaactgtgaaggtacttttggtaaagttcaaaggctagaaatattggccacttggtgtggctaaagtctggtaacaaataatttaaaaggattttcttaaagagcactatcgttaaaagtcagcttaattaaaagtggctatctgagctgtaggtatattgaaaaggcctttgtgtttttctcttcatggatcttgtttttctggaaaaagattttttttctcagtcgactgaattacttttctccattttgtcttgccactctcagtacacgcgtgagaggccctaagataacttctgagagcatgggactcctttgcaaaaacagagaagctgccacagaccccattttttggggaaaaaaacctttgttttccttctggaaccccaggaattaaaaagcagctagatccctcttaaaactggttttgtctttcagctatgcttgttattaggccctagaaactgcatattttcctagccctgtttcttgaagggctccaccctgaggccagtaatccaattaggatattggcaaatgaaaaatcttacaactactggatcttcttctgtccatctgtgtaaccatgtatgtgttatgtgtgtgatggttatattaaaaagaggtctagtaaattggcttaaataaaatgaagtgcttagatcaaatattttttgaaggaaaaataaaagctgtaatgccttttagttcatgagactttaatctttgagaaataaaaacagttttaaagataattggtaaaatacaaatgtcttcaaaatgtaaatatgtggcctaaattatgcggataagatactaggtttgctaagtattttaagcttataacctcttctttggcttttgagaactgtttgacttgcctgttttataatttggtaaggcttggggacatatgaaattaaccacgcccttaactatgctggaaagagtcagattttatgtgcactgagtacatgattaaaataactcaccaggttttaaattaaaatttaaaattgctaagagttgccattataacatgcaattgaaactactgaaaagagatttacatgcaaaatgtgcaaggaaagtaacatgtgttttgagtaaaagattataagaagacatgggagtgtaaagttttgcctagtttagagggttaaaggattgttttgaattagataagataatgctgtggctcacgcctgtaatcccagcactttgggaggccgaggcgggcggatcacgaggtcaggagatcgagaccatcctggctaaaacggtgaaaccccgtctctactaaaaatacaaaaaattagccgggcgtagtggcgggcgcctgtagtcccagctacttgggaggctgaggcaggagaatggcgtgaacccgggaggcggagcttgcagtgagccgagatcccgccactgcactccagcctgggtgacagagcgagactccatctcaaaaaaaaaaaaaaaaaaaaaaagataatgctgaaggtttaaaaaaaggtggaaatcttgcaaaaagaaactctgtgtgtgaacatattgactaacctcaaaaaggtatcatatggattttccataaattgagcattgaaataaaagcacaacaaggttttattaaggcactgacttgctctttaagaaaaatagtaaacaataatgaatggtttttgtcttttaaaaaattattgagtcatcattttgactaaataaaatgacttacagtaatctggaattctacttcacaatatcaagtgctttgaacctctaacatatttaacagtcttcccaaaatcaaacttgagtttcaaggttgtctttcctgacccctaacttttggatgctacagagggcccctggagcgtctgaaggagaggtaaacaagattatttgacatgtttagtcacgtgggattgccaaaataaaaataatgtttaaccttcttcaggttatattttagtgaataatgttaatatatgttccaaaattgtatgggatttctaaaaatctaatgtctgagtatacgccattgatcataattaaggttattatgttaagctattttaaaccatagaaataaccaaatttctttgtcaatcatgtttttgactgtaactaccctggacattttgtcattcacagatgattgttgtcatgctttgatcctttgcaaaagctataggactttgacaggtgctgtcaaatgcaggtttctgatagctttggagattgtgacattggaatagaggggaacatacaggactcatgaagaactgaaatgcttatgaatatcaagcagaataagagttaactgaagacactgaagtatcagaaaattgaagtaattttttaaactttttctgaaaacactgcagacctttattttttcagagccaaggaaacttttttgagcatctacagcttctaacatgagtaaggtatactcttataaacaaaatttggagcatatttttttctctctgcttggtttctctagatttggaaactgtgagtattcttaagttatgggaatacagttatttggatcaatgcaataagaatccattttcttttgcaacaggatgcaattggagaaacaggttgttttaccaagtctttgactggaaatgtgtgcttccctttaaggaattgagcttgacttgcaaagccaataaaatccccttgggaaaactggcctcataccttgtcaaaacagttcctatacagggttcctaacctgtggtgagtaaacagtgtcatttctaacaggcccaggagccccatgttgtcttgggacttgaagaagagagggatttatccaactcataggtatttgagggtacaaacccatggctaggctcggctttaaaaggtcttatctgagattccttgtggaatggagttccatcaaagccaatttaaaaagcctacatgaaagataattattcttgttacactttatgcaaatgatcaagccaagactaaagtttattttgaaaacaactcagtcctatcatgatttgttttgacaaaaatgtggattggagagaaaaaaaattatgtttcaaaacttatatttgtcattgaattctaatctcagttgtttttaagtttttgcttacattttagactaagactgcttattcctgtgaactaaccagtggtctctgggtgcagcttagaagaaacagaagggatgggtaatgtaaaaatctagatcaacattctagttctgagcaattatcctgcaaatcctgccaggtgataggagtaaatagggtgcctattacctggaggtttctttgtttgggaaaataaggccagtggagctaaccaaagccaagccccatgaacccaactcttagcaagcaaaactatagccaccagttatctgggcattccagcagcctcaggatttttaagctgtccttacccccttgtttcattttgatacatctcttctaataacccggtttgtctcttcttgacttcaggctgtcagactccaaaaggtcatgcaattggagccttggataatggctcccattcaccaagttcctttagataagcctctgagggagatctgactgctgttttcccaaaacatcgccccctgtcagcaggaagcagttaagattggtcttcatccctatgctaatggcagtgagatatacctcttcagaggggggacataagagtggcaggaggcagccaaatgcctaggccgacaggtgcaggtccccgtgaatccccacctccaagccaaagacagtttaaagcctgaaagccaagctacaagtcaacccctcagatcagattgagaacttgtcttcctgtttggcatgctttcctctgattgatccccacccttcacctattttacgtatacctgctctttcctaactggttttctacactgccatacccagctttgagtggtgtcttcactttaaccttttctgcatactcacaaaccaatcagcatgcagtctccattctgagtccataaaaggcccaagacccagccacttggtggggactttcccaccttcaggtaggggaaccacccccgccccaccatcccttctttgctcaaagctttcattttgcttaataaattctactccacttaatctctggtgtccacacacctaattcttcctggttttaagacaagacctcggacctagctgagctaagaagctaaggaccacaacactgccacctcccaggcttggaggatagcacgaactccagaactcaccagcattggaagagtccataactctcctctgagcagactgtgatgcttcaggataagaccagagctcccgtcttttccccaagtgagcccgccccaagcgtgctttgtttttcaaagcctcaggagcaagaaatgcagaattaaagccaacagctcagctctgaccgtgatatcaggttgtgtttgtcccctaaccatacacaaacatgccctgcccttgcacacccagcgtctgcctgggctgtgttctgagcccttgcagtcagctcagcccacggtggcaaaacaaacacacagggcaattctgcagagaagagctgcctaggggcatttgggcccagattttatttgaagaaatgtgggagaagccacggcactctccccagagttcctgcaaacacagcattcatggctgtgaggactgggatggggacaagccacctctccagagccacctgccaccttgctcctgtagggaccctcagctccaagcaaacctgtttaaaagcaaacctccaagcagacaggcacctgtcaccacccacaagcctgaccttctccctttcctttggctctgctgaccccttcctgtctgtgcagttccacaacccctgctggccccctgacactgtggtcttcctggtccaatgctgggcaatggggaccctgagataaggaagacggagtgccagcacccccagacctcacattccaagggagaagtcagggacttatacagactaatatgattcaaggcactaagagcccaaacaatgggacacagcctgataaacagcctggagagtagggaggcaatcagggaaggtttcctgaaggaggagagacctgagcagagtggagagttggccaagcagaggaacttgagggcattgtcagcagaggggatggatgcaacaccaccttgaggagatccttcttccctgcaccttctcacctccaatctcaacacaaatttctctgtaccacccactggtgtggcccctggtgtatgctgctctgtgtagcagtgtgttcatctggctgcttggcatgaccagactgtgtgtgtgtgtgtgcgtgtgtgtgtgtgtgtttgtgtgaagagagagggagagatttatactctccttctaccctctgtgctgtccccagaacactctccattaaagcttgttgagcaaatatcaatgacaacatctccagcacagccattgaagcctcatgcttcatcccaagcctggggtccagcgcaggctctgccccttcccagctgtgcttcttcaaccgtgagatgtagctaatcatggcatcagcctccagggttcttgtggtgactatgtcaagtgatgcatacgtgcagagcattcagcaagtgcctggcacacagaaagtgttaaataaatggtagctattattattcttggtggtattctaaagctcccacagccactgtgccaatgccctggctggcattctggaggccccagggcacagtgaataaaagctcccatttaaaggccaggtcttgggggtgagtcctgccctggctatgcaacctcaggttggtgcctaggaggacccgggtctcctgtgaagtggccgactaaggctcttggaactttcccagaacaacgatctaactccccactgccctcctcccccaacgactgaccatagctcccagatctcccatcagttccctgctttggagtcgtggacactggcccagggggactggcctctgtgccccgagagcctctctggccccctccacacactgactcccagcttggcagcaggcagctgtagaatttacaactgtctgtccagccttggcctctgcccttgaaggtgggggatgagcctggccctgctgctggccagcgctgctccatggggagttcctgctgcctcccactttgctgctgagccacttcctaaaacccacagaggctgaggagctgccaagtcctccaggaaaggctgaggcaagtggtacctgggcaggcagggtggcatggtggctgtacacacgtgcttttggagtcttggatccaaatttcagcattgcccttccaagtcccagaaccttggacaagtcactcagtcactcagagccgctgtttcccagctataaaaatgggaaaataccagtgctctccctttgggctgatgattgtggaattacatgatatttgccctcagcctagtgcctatgtcaaggaacaatagatgtcttcttaaaaaagaatgtgctattagcctaaagctgccaatcaagttccagaagcaaacagtgcacaaaatgggcatctcctgaatcacaagtggccgcctttacagcttgacttggggacccaggaaggtgagagacagtaaacagaccggaggagatgctacctgggcctgcaggaggagcaaggggtgcaaatgtagggtgcaggtcccaaaggacccagggaggggaggaggggaaatacccactcctgggcgggccctgcagagggagtctgtgcactcagcacagagaaaggccctggcagtgggtttcccttgggtggggggatccctgatgctcagccctgcagcggtgcagagcaaaggggcgctgagggtggcccgatggcaccttcttatctgagtgatgtagctgggggctcagctggcctgtggagtgcctaggaacaacttgccagaagccagattggtattgagtgcactgtggctggagctgccattcggttggactccagggggtaaagggaggaaacatggctgaaatggcggggggaacccaggggctgccttgctgggcatgaagtgttttctggagcaccggagtgattagaactgcttccctccacaaggcaactcctctgtttgggctttcacaccgggggagatgctcttttcctctttcctgtgattttttgtggtgagtagacactggccttctcgactggaacctgaaggtcaagaaagaacgagggtagaaaggaagcctcggttcttagggaccacccaagggtcttaggatgaagcccctgggagggaccccctgcacaactccctctggatcccgtgatcatggagcgggagaacagctggtgaaggctgcaggggtttcacatcccaggtcttggccaatttgcttccaccacagacatgattctgagtgacagaaagtgtgctgctggcacaggaggccaacaggacgtccgggagttgtgaggctccaagattgagagggctatggcctccttactctttgagtcactactgaatgctgcctccttatagaagcctccccgcgccaggtttctctatgacctgtgctctctgtttcttccacggtgcaaattaccatttgtaattacgtatcaatttgctcctttgttctctagaatagaagcttctggaagaaaggggcctggtgtacctattctctatggtatacttgacatgccactagggggcaaagaggacaaaagggcttcagagaaaggcctagacatgcgttgctgaaagcatttgacatttgggctgaggtggtgggggagaaggcaacagcaatttctaggcacgggaagagttatgtcatgcaaagtgtaacctggcacagagcaggggagagactggagaccaggagacaagtttggaggccactgccatgggttagctgaaacagggaggggacttggagagtggggcatggcccaccagagaggagataggagaatcttccagaccctaaagccaacagagaagagccagttcatgcagacaggagatacagcgggaagtcagagcacgtgtccattcattaacggggtagtgccatcatccaggagggagtggggctgcagggatggagacatggagtggtcatcataaggaacgtgtgcttgaagctactgcaattctaaaacaaattggagaaacagattttcaccatagactttcattctaccactctggagttccaatttggcccagattctgatcacccaaagcagaaacatagaggagaaggacgctggccaaatgccctcggtgcctttgggggtccagtcagtctcccctccagtggctttgtgttcactgtcagcagagcacacacctccctgccactggaggccacagcaagtccctgcaagacccacagaaagctgaaccttgttagctttcagttcccaccagcacctctaggaagcccagcggaatgggggagagctcctgtactccccctgcactgccttctgctgctgttcgtgtcaaagatgatgataaaggcagggaaaggggatgaaaggggagtgagttcagagacagggacaacaaggagtgctgtccatagagccactgaatccacttagagaagagcccacagccttcaggctggcccctttcaggaatctgtaatgtgcccccactctgtgagtagcagaccctcctctgagtgtggaattacatggactcacatatcactgcttaacccactagggtccttcccatccacacaaccctttttatagcttgcaatgactgaaggtttagctagttccaagagaaatgccaaggagctggtcttaaacaagttccccttgtccttcactggcaacttgcacttccaactcgggttttctgactccctgcttgaacatttctgggctggcctcctggccatcagctctagatcattcgcctcccaagcctctctacttcctgtctcttcttcccattccatggaaaatgcaaaccttctgtgtagagcaaaggcctgtcaatcaaagtgcaactcacagacaaaagaatcaccgcagtgggtggcttcagaactgtgtggctgccagagctgcctgagtcagtggagactgtgaacctccactcgggtgaggagcaggctccctcctgggctcctgctctgggacaatgggtggggaaaagggaatgagtgtgtattctgtgccttttcattccgagctttaaacacatcatctatgtcgttgatccctcaccaccatcctgaaaggcagactctgttatccccactttacagatgaacaagcagatgctccaagaagtcacatgactttcccaatgccatcctccttaccagggacagaggcaggatttgagtagttttgaccctaacactgcttctctttcccaagcatttgacaggaagctgtctgcaatgctagcagctattaatgtcatcaggacacaaaatctagtaaggcgacaaaatatttgaaaccaggactgacctggagaatttcagtgtcaggaggccacctgtagggattggtggaggtcctgaacctccctgtgacttctggagcagccagcacctcgagccatctacagggtggggcagatttcctccatcaggctcaggtggcatctcctagcttttgcccagccaggacattgctagctgacatctccttcattcccatctcacccccactcattactgccaacatcattcacatatatcctccctcccttctgttctccttgctaattacacacatgtttctagatactctctcaattctggttgtcttcaagccaaatttagggctctggcaccaatcgttgctgccagggggcttctcagagactggaagcaccaagtgtgatgtctttgcctcaggaacatgtctgcaatcatgtctgctgagctctaaccccagaggttgtgattcttgggaactatatcagggcccaggaatttgcatcttaacaggctccccagggaattctgatgctggtggtctgggcattgcacttggagaagctctgaatgaaaccattgcagaatgaatgcaaactttttaagtgaaaaaggaggtggaaaatatacttagagaggtggtggcggtgggaagggatgctgggggtgggagggtgccgggaattaacatacatggagctccggctaggagctggttacttttgatatctcatcacctttgggccctacaacagccttgcaacagacaccttatttgcccttttcacaaaagaaggaagcaaaagtccaaggaggttaagagacatacccaagttttcatggactgtcagtaaagacctggaatttgaagctacatctgcctgattccagaagctttcacaacctgccttgccccactgatgactcagaaggtaccagctaccggatgcttttatacagggctgggcacagagtcagctttcaaaacatacctgctagatgaatgaagaacgagtgaatgaatgagaaaatgaaataataaaactgctttgagatcatggaaagtagcccaagaggttccctctgtgacctcatgctcaaacttcctctcccactgtttctttaatctgaaaggtgactccactaaatttgccccgttgataaggccatgcagctcacctgcacctgttatcagcaacctgaatccaaacaggaagccaaggctgagataagatcgaggaaggcaacgcctggaatcattacaaggctggaattagtttgttgccataagtaatctattgagcacctcctaagtgccaagctctgtgccaggccccaaggataacgcaggaaaccaggcagtccctgcccttgaatgtcttacaatctactggggaaggaaagtgggtgttgaagaaataattacgaatgggatgagtgatacagaaaggaagaagtatgaggccaggcagtcacagcaaaccttcctgaggacacaccctgtaggctgggagctgagcaatgaggagctagccagttcttgaagctaggggagccacctaccgctcttcacatcacaactatcccagagcaaaaaggtgcttgcttttgtgtttcttgcccctgctcaaaatggctttccacaggcgattacccatggtcaagctttgctttctctctgcttctactctcctgcattaccagggtttttcctccagcaataatggccaagccctgcacttttcactcaggcctcctgctgcctctcccagctgccttcagccagtgtctgccgaagcccccttgtagcggcctaggcagttgatttctaaacttttttttcttttttgtgaaaattatttttatagagttcgaaagtacacgtgcagttttgttacatggagatagtgtgtagtgaatgaagtgtgggctattagtgtaaccatcacccaaatagtgtacattgtagctattaggtagtttctcattccccaccacctcccacctttctgagtttccaatgtgtattattccactttatatgtccatgtgtacacagtttagctcccacttataggtgagaacatgcagtattttactttctgtttcttagttatttcacttaagataatggactccagttccatccacattgctgcaaaagacatgatttcattctttttatagctgcatagtattttgtggcgtgtgtgtgtatgatgttggctacgggtttgttgtatatgactttgcttattttaggttatgttcctttgatgcctactttgttgagtttttataatgaagggatgcagaattgcatcaaatgctttttccatatgttttgagatgatcatatggtttttcctcttattctgtttatgtgatgaatcacatgtattgatttgtgtatgttgaaccatccttgcatccctgaaataaaacccacttgattgtggcttattatctttttgatgtgctgttggattcagtttgttagttttttgttgttgttgttgttttgttgagtatttttgaggatctgtgttaatcagggatattggtctgtagttttctttttttgttgtgtccttgcctcatttaggtatcatggtgatactggcttcatagaatgagttaaagataattccctcctccttgatttttttgggacagtttcagtagcattggtatcagttctttgtatacatggtagaattcagctgtgaatccatctggccctcggccttttttttttttttggttgagggatttttttattattattactgattcaatctgactacttgttatcggcctgttatttgctctctatttcttcctgattcgttcttgtgaggttgtgtgtttgtagatgtttatccatttcccctagttttccagtttgtgaagatagagatgctcgtaacagtccctgatgctcttttgtattcctgtggtatcagttgtaatgtctccttttcatctctgattttacttatttgaatcttctctcctcctgattagtctagctagtggtctatcaattttgtttattttttcaaataaccaactttttgtttcattgatcctttgtattttttgtctcaatttcatttatttcttctctttgtaattcctttccttctgctagcattgtgtttggtttgtttgtttgtttgtttttgttccttgtggtgtgacattaggctgttaatttgtgttctttttatttttgttctgtaggcatttaccgctataaactttcccctaagcactgcctttgttgtatcccagaggttgtgatatgtcgtgtctccatttccatttgtttcaaaaatttttaaattttcatcttaatttcattgttaacacaaagatcattcaggagcaggttgtttaatttccatgtatttttattgttttcatagtttctctgggaattgatttctagttttattccactgtggtctgagaagatacttgataagatttcaattttttgaaatttattgagacttgttttgtggcctaacatatgctctatctatacagttctatgcactgtatattctgcagtcattgggtaaaatgttctgtaaatgtctgctaggtctatttggtctagatgcctaattaagtccagtgtttctttgttgaatttctatctcattgatctgtctagtgttgtcagtggggtgttgaagtgccccactattattgtatttctgtctgtctcttttcttaggtttaatatttaatagtatttgttttatgaatctggctgcattggtgttgggttcacatatatctatgattgttataacttcctggtgaatacattcttttatcattatataatgactgtcttttttttttcttactgttgttgatttaaggtttatttttattttatctgatgtaagtatagcttctcctgattgattttggtttctgtttgcatggaatatctttttctacccctttactttgagtctatatgcctttaccagttatgtgggtctcttgtaagcagcatatgtttagatatatttttaaatcaattccaacaatctatatattttaagtgcatttgatccactcacaatcaaagttaatactgatgtatgagtatttgctcgtcataatgttgtcacctaactgcgttgtagtctcatttgtgtaattgttttataagacctgtgatttttatacttttatgtgtttttgtaatgttaagtatcaaccttttgtttacatgtttagaacttccttgagcatttcttgaaggactggtctagtgataacaaattctcttagtgtttgcttgtctgggagatactttatttcttcttcatttatgaagcttaatttagcagaatacaaaattcacggttgagagtttttcctttaagtctgaaaattgaaccccaatttcccctggtttgtaagggttctgctgagaaatctgctgtctcatggagtttcctttataggtgattagacactttcctcttggtgactttagaatttttcccttactttggcttcagatagtgtgatgactatatgtcttggtgaagtatatcttgcaatgtattttattggagttttctgagcctcttgtatcaggatactaaatctctaacaagactagggaaatgttcctcagttatttcctcgaataggtttttccaacattttttcttctgactcaagtatacctatgacttgtaggtttggacgttttacataatcccatacttcttgaaggctttgttcattttaaaaaaactttttatttttgtctgactgggttaattcaaaagacttgttttcaagcttggagattcttttttctgcttggtctagtctattattaaagctttcaactgtattttgtagtttcttcaatgaatttttcatttccagaagttctatttgtttttgtcttttaaaatatctatgactttggttaatttttcatttatattctgaattgtttttctgatttctttatattgttttcaactttctcttggatctcactgagcttctttaaaatcagtattttaaattatttacttggtatttcaaatatttcattttggttaggatccattgctaaagactcagtgtgttcctttgtgggtgttgtaacagttttttcatactttcacaattgtttctctgcccttctcatctgaataaactatctctttttattattttttaatttactttcatctggataggatttttccctccttgatgttgtgtagggtcgtttggctttggttctgagtgctttcattggccatgactctatatgagttccttggttatagatagccattgtgtggtggctttctcatattctggttgtagtagtaatatactggacatgtaagcaggctcacagcctcctgcagagccagggtggcagaggtctcaggaagtatacctgttctccagtgcacacgtgtcagcagcttctgtgtgtggtaagattttgtgggtaagagctggcttcaagagaagcagatggtatatgcttgattttgtttactgggaaagtctctctgttgcctcaggcaatgggctgatctgtggaatgtaaagtggcctgaattgcctgctcagccccagatgcagggagaggggaataaagctgagtggagctggactgccaagcctaccacttggatactccaatggtgagcaaaagcactagccctgatgggggtggtgggggagctcccggtgaaatgcaccaaggtctccatggtgggggtaaggaggctaccccagatccacagcctgagcaagcaggaacatggtccactaccttgtcactgattgctaagctttcaaggattttgtgagctggctaaacaaagctatattaaaaattaagttagacatacaattaaataaatcatactatattttattaaagtcaaaggtcataaatactcaaaactcattacttcctaagtattttactcctattatttatgttctggaggaaatttacatctattgtatctgtatagtatttaacaatggtatatgtacagtggtatatgtaacagtggtactgtgcatctcttcccaattctgcattcagtgacatgaacttaatagttacaaatggccatgatgggagtatttataccacaggaattggtgtaagttgttttgtttattgtctgaatttaacaaagtgttgagaaaaatctaataatataattaaattatataattaaacttaaaagtgtgtcctatatagcagttttctagcattagacaactattatcggattcagcaaagaagttgctcacatcactgagtgaagtttcaacatatatcttaactatttcatttttgtctcatgaaaataccaaccaatcaacattcattagttgtacattcattggaatttttcaatgatgtgactgattttgctcattaaaatagtcatcaggcatttattcatagtctgattttgtcacagtatggagttgcaaattataaaaaccataaattttccatgaaataggaagtcacactgaagatatgactttatataggtatatagaattttcaattaagattattggatatttttattgtttataaattctgtgctgcaattctttttttttttttttttttttgtgagacagagtctggctctttcacccaggctggagtacagtggcatgatcttggctcactgcaacctccacctcccaggttcaagtgattttcctgcccagctaatttttgtatttttagtagagatggggttttgccatgatggtaaggctggtctcaaactcctggcctcaagtgatccacccacctcggcctcccaaagtgctgggattacaggtgtgagccacggcacctggcctgtaattctttatgtcagttcaatttatgataaacttatgttcatatgtacatatactttcttttttcaaaaactgggttgtccttagcccttctgccctgttttctctcctgtagcctgaagtgtttggagaattccacccaattatgttgaggagctacttctctgcccaggcaggtctctatccatttctaacattttccttcatgggttcacaaaccagttttcattttaaaggtaagccttccctctcctccacttttaaaatatttaaaactcacaacatttaaataaaggaaaatataggtaaataatggggaagccccatggccaagagcaaatctgaagcatcgtggctgcaggcccttcatggccagcatttttccctggctctgaagtacattggctgggaattctggagtactggcactgtgacccagacaccatacctgggcctctgcatctgccatcttctttcagacttttcactgggaaagcctgaggggctgtccctctcctgtattgtttgcttcaaggtccagctcacttctttcagaagtttctagacctttctagaaaagactgagaaggttcaaggtgtacagggctaataatactatcacggagctgaatctgaggtaagatgtctgccacctaccatttttattatcccgggtaccacaggattctctcattgtaatgtttgattatataattgggtctccctagacattgccagaaatacctgaagtcttatgtgggtcaggagtccatggtagtcagaagtaagacatttggcttttagttcagtgactcaggggaacatggaacagatatgagttacagctactgggcacctgacactttgctcagacatttaatgggttcccacttaatccttactgaaaccccatgaagtggatcctatgactatgcctgtaaacagatgaggacaacagggctgagagagttaactcaatgtgctggagtcccacaggtgatgagtggagactcaggttacaaacttgttctctcccctggtcctgctgacttgctgcccagtttgtcacaccctctggcctatgacctctcccactgtggccacaagtgcacttctgtaggtatcaggaccagatgggaccaatgacttgaaagaaatcactctgccagatatcagaaaatctgatcaaaatgtgagcaaatgaaagcaacttaatcattttctctgacttagtttttctgtttgtaaaataggttgttaagaagtctaagcgagaaaatctgcagagtgcctgacacacagttctgtagggtcaactttaattaatcctacatgagatggcactcataaaccacaaagaagagagactgccacatacggtgtgttcaataagtaattttccttgttattactaatattttctgacctttattagaacaatactgaacctcctgcttctaaaatacccacccgctgtagaagttccagtagctgtcctgcttttccaggacacactgggttacaaatcaggcatctgtggaccagtttaggatcctacctataatctttaatattatttgtactggagtagaagtgtgttctgagttccaagtaactgacttatacgttgtttgaaaacaaagcccatttgtagctatgaatactccatggccttcaaacacttgcagcagggtcagggggtgcacagaatcctttgttcaaatgacatcttatatgttaacctaagatataaaacaggttctgcaatgagcaagtacagttgaggaagagggggtagaggtggcctagagcctgcacccctcaccagagtcctgccaagcatggtataagactcatctcatactattatcagcttgaacttctaaagacaagccggattatttggtttattgagaatggttatgtgtccatcatacggggctacttacgacacatgaaatgcctttagctggaggctctgtcttatttttaatatgcctctgttaagcagaagtaatcatttcatgatcatggcaagttaatggggttactttgctgaaccctgagatattaccaatattacttcccatggatcaaacaaagtagatcaaagtcaaagttttcaaaatcctcctgcaaaaggaaatttctccaggcaaaactttgaggttttcacagttttgaaaagtagccttgactctcttctagtcacgacaatataaaaatccttttatttgtgccaggcaggaatatatttctcctcagaaactattttatagattacaggtcattttctactttcttttttattcctgtagtaattatcttcctttaagaaaatgttagcacagcgttcagtaggcatgttgaggcagataagccgtgcaagccaacccagctatagaacagagttgtttctgcaagccttctaaatcccaggacccacatagttaaatgtcagggcagcattgcattcaagaagccatagtcttgtggccaaaaaagtaattaaaaaggaattccaaaccctaccaggcctcctcaaaactgggacagggatccaaattcagtctacagcaacaatttcttctctcaccagctccctgcacccacccacctgctaggtttctggagcgtctctctctccataggtcttctgtgcttttcttcacaccagccctgcactgaggtggcaattataggactatcttggttgggcaaaggaatggtggtggggaggaaagtctgaatagcctctcttcaccttaataactttggcctgaggtttgctgtgttctaaattatatcctcattattgcctgattttgtgcaatagtacaaatagattatacaacctggcgtacttcactgaaccagctagttcagtgaagcaatatttagttctgttactttacaagttcttagtagcccaaatggcaaagaaaatcagatcccagtaacaataagagaattattatgaccactctttctcataggataaataagagactccatgtattcttctatttgcacgtttaatccattgtcattaaggttaaattaaataaagttattactctgaaaatgcaatgaaagacttctggtttctagtctaacatgtaaggagattggaataaaccacctgatactaacacgtaaaaaagctaaacaactagaaaagtcaatgaatcttagatctgtcagaaaagtaagtgcacagggcaaaaagctgtcgcccaaattggagagacaggcaggtggatacagagaatcacaacttatcagagtagaaacccacaagcagaaacttctctgtgaacaagtgcaaggataggaaaacctaattgtaactgaaagtgttgaaggaaaaaactcaccaactaagaattctacatcctgcaaaattattattcaatagtaaaggagaaataaggactttcttagataaacaaaaattgagggaatttgttgccagtagacctgccttgcaggaaatgttaaaaggaattcttcagagagaagggaaatgatataagtcagaaacagggatctgaataaaggaagggcatcagaaaataattaagtgaaggtaaaatgaaaacttttgtttttctaattcttttttttttttttgagatggagttttgctcttgttgctcaggctggagtgcaatggtgcaatctcagctcaccacaacctctgcctcccaggttcaagtgattctcctgccttagcctcccaagtagctgggattacaggcatgtgccaccatgcctggctaattttgtatttttagtagagatggggtttctccatattggtcaggctggtctccaactcctgagctcaggtgatcctcccatctcagcctctaattcttaattgatctaacagataacagtttattcaaaataatatcaccaatctactcgataatgtatgcttacattatataaatatgtattcctatgtatgcttacgttatgtaatatatatattcctatgtatgcttatgtataagtgagaagaatgacagcaatgatacaagagatggaaagcaagaattaggaatattttgttattataagatacttacactacctatgaagtggtatagtgttattcgaaagtcgacctggattagctgtaaagggatagggcaaactctagggcaaccataaaaaaaaaaaaaaagaagcataactgacatactaagaaaagaaagaaaatgggatcatatggaatgttcaattagaattacaaaaggcagaaaaaagtgtagaagacaaaaaaaggagtgaagaaaaagggcactaaatagaaaacagtaataaagatggtagatgataattcaactatatcaataatcatttcaaatatcagtgtctaatacagcaattaaaagacagagattgtcagagtgaatccaaaacaaaactcaactatatcatgtctacaagaaacccactttagctatgaagacacatatatattaaaagtaaaggaatggaaaaagatataccatgttaacactaatcaaaagaaagtaagaacagcttattaatttcagacagacccaactttagaacaagaaaagtaatcaagcaggaaaaagaggagcattacatagggataaaaggtcaatattccaggaagacataacaatctttaatgtgtatgtacctaacaaaaagagtgtcaaactccatgaggcaaaaaatgactgaactataaagagaaatagatgaatccattactatagttgcatacttctacactcctctaccagaaatggacagatacagcaggcagaaaatcagtaaggacatagctaaacataataccaccatcaaaacactggatataatggaaagctatagactacttcatctaaaaccagcaaattatatattttcttaagctcacatggggccttcactgagatagaccacattctggggccataaaacccatcttaacgtatataaagcaataaaaatcatacaatctctgctttcagtcaacagtggaattaaactacaagtcaataacggaaagttaaaaaaatcccaaaatacttggagatgaagcaagactttcaaataacacatggatcaaagaagaaatggcatgagaaatttaaaaaaacattttgaagtaagtaaaaagaaaatacaacttagcaaaacttgtgggatgtaccacaagcagcatttagaggaaaattaatgccattaaatgtatatatcagaaaagaagaaaaatctgagattaataataatttaaccttccatcttaggaaatgaaatgaagaacaaattaaatccacaataagcagaagaaaagaaatactaaaaactagagcagaaatcaatgaaattgaaaacaataaatcaacagagaaagttaacaaaacccaaaactcattctttgaaaagatcaataaaatcaataaatttctagctaagctaactaagaataaaataaagaagacagaaattaatcatattagaaattaagttgggcatgctggcacatgcctgtagtcccagctacttgggaggctgaggcaggaggatcacttgagcccaggagttccaagtttcagtaagctatgatcatgccattgaactccagccttggcaacagagtgagaccctgtctctaaaaaaataataataataataaacattacctatgtaacaaacctgcacattcttcacatgtatcctggaactttaaataaaataacaatttaaaaataataataaaatacaaaagaaattaaagaggggacatcaccttagatctcatagatcttaataggataataaaggaatattatgaataattttatatccacaaatttgataacctatgtaaaatgaagtaattcctttgtctcagtctattttgtgttgctatagcagaatactagagactggtaatttgttaaaaaaaagaaaagaaaagatttatttggcttatcattctgatggctggaaagttcaagattgatcatatgcagagatcacatgatgaaagaggaagcaagagagaggggaaagttgccaggctctttttaacaaccatctgacaggaaataatagagggagaactcactcacccctgaaggaaggcatttatctatttatgaaggacctaaccccatgatccaaacacctcccatgaggccctacctccaatactggagatcaaatttcatacaacagtacaagggtacaaaaatctaaaccacagcattccttgaaagacaaaatctgacaaaattcacacaagaaaaatagacaatctgattagagctactgttacataaattaaatcaataattaataacattttaaaacataaagcaccaggcccagatgggttactggtaaattttaccaaacacttaagaaagaaattatactaattctctacattatttttcagaggatggaagcagagagaatacttcctaactcattctgtgagcccagcattaccttaatatcaaaaccagacaaagacattacaagaaaagaaaactgcataccagtatctctctaaaacacagatgcaaaacctttaacaaaatattagaaaatcaaatccaaatatttatacgaagaattgtgcaccatgaccaagtgggatttatttcagagatgcaaggctggtgcaacatttgaaaatcaattaacataattcaccacagaacatcctgaagaagaaaaaaatcacacaatcatatcaacagatacagaaaaagcatttgacaaaacctgacacccatttataataaaaactcagcatggccgggtgtggtggctcacacctgtaatcccagcactttgggaggccgaggcgggcagatcatgaggtcaggagatagagaccatcctggctaacacagtgaaaccctgtctctactaaaaatacaaaaaaattagccgggcatggtggcaggcacctgtagtcccagctacttgggaggctgaggcaggagaatggcgtgaacccaggaggtggagcttgcagtgagttgagattgcgccactgcactccagcctgggtggagtgactccagagcgagactccatctcaaaacaaaacaaaacaaaacaaaacaaacaaacaaacaaaacctcagcaaactaggaagagggaaccttccttaacttaataaataacactgacaagaaacttccctctaagatcgggaacaagaaaaggatattgcctcttccctgcttttcaacatcatactggaaattctagctaatgcaataaggtaagaaaaggaaataggtataaagattaggaaagaagaaagaaaactatttttgtttgcagatgacatcatcatctatgcagaaaatttaaaagaacggacaaaaaaactcctggaactaataagtagttatagcaaggttgcagggtacaaagataatgtacaaaagtcaattacttttctatatagcagcaatgaacaagtagaagttgaaattaaaaacacattactgtttacattagcaatcccgcaaagtacttaagtataaatataacaaaatatgtataagatctacattaagaaaaccacaaaactctgatgaaagatatcaaagaattaaataaatgggagatgttcagttcatgaaaaggaagtcttaatatttttgatatgttggttcttcccagttttatctgtggattcaacacaatactaattgaaattgcagctagttattttgtggatattgacaaactggtgctaaagtttatatgaagaggcaaaagacccagaatagccaacttaatattgaaagagaacaaagatggctttgacactacatggcttcaagactttttgtaaaactagtagtcaaggcagggtgttattggtgaaagaataggtaaaccagtcaatgaaacataaaaaaagatccggaaatagatccacataaatacagtcaaaacaatcaatgaagcagaaaaaaatgatccagaaataggcccatataaatacagttgaccaaaagcaaaggaaaaccaatggatcaaagatagaattttcaacaaatcgtgatagaacaattggatatccacatgtaaaaataatgaatctagacacagaacttacacccttataaaaattaactcaaaataaaatatacgcctaaatttaaaaacaaaactatgaaactcctaaaacataacatagatgaaaatctagatgaccttgggtgtgacaatgactttttagacacaacaccaaaggcacaatccttgaaagaaatacatggtaagctggacttcactaaaattaaaaacttctgtgaaagacaatgtcaagagaatgagaagacaagccacagggtcaaaatatttgcaaaggatacatgtgttaaaggcatactacccaaaatattcaaagaacaactaaaacttaccaagaagaaaatgaacaaaccaattaaatgataggcaaaagacctgaacagacaccttaccaaagaagatactcagatgggaagtaaatttatgaaaagctgttcagcatcatatgtcatcagggaattgcaaattaaagcaacaatgatataccactacatattgattagaatggccaaaatccagaacattgacatcaccaaatgtgatgaggatgtggagcaacaggaactctcatgcactgttggttggaatgtataaatggtatagccattttggaagacagcttggcaattgctaagaaaactaaaaatactcttaccatacaatccagtgattgtactcccttgtattttcccaagtaaatttaaaacatatgcccacacaaaaacctgcacatggatatttatagcagctttattcataactgtcaaaaccaaaatgttcctcagtaagtgaatgggtaaattgtggtacatctaaacaatgaaatattattttgcactaaaaaggaatgagctaacaagccatgtaaagacatggagaaaacttaatcaataatgcaaagtaataattattgcatattgctaatgaaagaagccaatctgaaagcctacatactctatgattccaaccatatgatattacagaacagataaacctattgagacagtgaaaagatgagtggttgccagtggttagggaagatgaataggcagagcacagaggtttttaggtcagttaaactaatatgtgtgacactacagtggtggacacatgccattcatttgtcaaaacccatagaatgtacaaaactaagtgtgaaccctaatataaactatgtactttggatgataatgacatgtcaatgtaggttcactgattgtataaatgtaccactgtggtatggatgttgatactgagaaggttatgcatgtgtgggggaaatgaatatataggaacttctgtactttctgcccagttttgctatggacttacactactcttaaaaataaatgtcattgattaaagaatagctagagaagaccaaaaccaaagggaggaaactggatagtgatttgcaaagttcagattctatatttagttatttcactatctagataactttggacaaatcttaacctcattccatctcagtttcctttcaaaataaagattgtgaactagataaactcaaatatcccactaagtcttaaactgtgtgattctatgtaccagtattttttaaaagtgaatgcattagaattccaccagaaatcctaaatcagagaccagtagcaatattgaaagacattcatatgtgaaataaaatcaagatgaaaacataattgaacattctctcaagctagttttatattctccaatgttctgcctactactgcttgagtaatgttgttgaataaaaattaaaaggccataacaaaaaaaaatccagtgagaggcagatgctagatagtaaaactgtaaattcctctttttgctctgatgatgggaaattagtgaaattgtgaaaattgacaatgatttggggtaagaaatacctcttaaatttaatgattgacccctagaaatcagaaaagttttcagaaaagaagtcaactggaagacaagtcaactggaaattcctatgaacaacttctagactatattttcatttcttgctaatcatattcttatttatttaaaaatgagactttatatatgccagtactgaagattcaaaagaattgataaaatagtccctggcttcaagaagctcctactctggtctatagttatagaccagcatagttacagaccagcagactccagaatgctgtgttataagtaatctggaaggaagcttgcattgtggaagcacaaagtgaggaaagatcaagtcttcctgtaggtagagggtcaggggacaccacaccaaacaaagaagactagcaaggataagtatgcataatggctgaaaggtatgagtgtgcatgatggctttaggaaactatgaatacccagtgaggctgaaataagggaagcagcgaaataagattgggggtggaggtgaggatttacaagatgtttctgaaggacaggagcaaagtggtctggctgcaagaaaaggttatggttaaaggaataaggaaaactaacattaattctttatcctgtgaaacacaaatacccagttagtagactgggctctaccacaatctgaagccttacctcctagatccttgagtggctgccacctccacaaactccttcgttttctgtaactcaagagagagctcaggaatcaaggacttgacacatggcagaggccctaggtgtcttgagccagggaacctcggactggaaggagtattctatttccaagtggtgagaaggggccataaagaattcaaatttttcctcgatattgagttccttgatgtttgtaaagtttcacctgtcctttaaaaaagttataatttgaaagaaataaatactcaagtctctatgtacatagaatatctttttcagcagtagaatagtaatctccacaagacattttacaaggaactgaggtaatacaaagtactatttattaaaaaattgcccccacctttttacttttactttttacattatctttataatatcagctcgcctttttttcccactgtgctttttaaagacaagactagaataagtgcaaagaaatacaccacatttaacaacatttgagtctgttaagggcactggctttccgttctggcattaacataatttgatatttgaccatgggtagggcttttgacagctctgagccttgatttctctatcaggaaatagatgaaggtgatctcttaagttccttcctgctcaaatatcctgtggtcttatccatctttgcatctcttttgagaagcattgtgcttgacgcatagcagatgcttaataaatatcttgagtagatgagtgtggggtagtttgctgctattctcaataaagaaaatgtagttggaactgctttgctcccacttctgttggtgcatgaaggttaggataagcatataccctatcaaagggaatagtcattactattgtcttacaggcaattggccttggttttccacaaccaattaaaacccttttaaaatgctatggtggccaaaaaaataaacaaacaaacaaacaaacacacttctgggacctgtattgaacccatacagcaaatctatcctgcaagaagttgaatgtatggtttgaatttggaaatgagtatactgtgcagatgcaactcacaccatcttgtttttcagaggtgcgtgtgtacatatgtactcacatgaactcctacctgctatgtgccaaatcaacagtcatgagatggcaatgataatttcctatgaggcacatcagagactggcagaaatgatccatgtaatggatactctaagatccgagaagaacattccagtgcaaaggcacacagttagatagagcatcctgttggttatgtgtctctcctcaaactcatatcagtgtgccttgcacagactaaaatgcaaagacatgaaattgcagctgttcaatctgtagtggtaactggaaaggcaaagccaaaggggcaaatcacagcaattcagagttatacacatgaagtcaggaagcaagacaagagaggacagtaggatggccaggagacagaagatgtacaagagaactcataaaagattttagtaattacaacttaaacatatggagaaatagggtaggtatagggccaattctttcaaagagtttaaggtgccatgtaaatctttagagaaaccatagcatgagtagaaatcaatgggccctttcagtctgaagactaatgtctttctctagctctgggaaatataaaaatatttcctcctttcagtttgtcctctcttttgtgggtctcttattagaaagagtggacctcctttggagatttaagaatctatcctcaaagactctttcctttctcatgccttctgtctctttgtccttttgaactgtgttctgaaaaaaaaaagtccttccatttgatcctccagcttactatttaagattaaaatgtcagttaaaccttttaattatgatcatcatagtttaactcccaagagctccaattgttttattctatagtgtgttcttgttttagagatgtaatatcctctcttactcctctgaatattacatattttttaaaagtcttcttctgtttgttctattagctcaatttatttagtttttagcgtttttgttattgagtttgtggtttctctttcatggtattggttttcttcaatgggttccttggttgcaatttaagttttgtatctgtgatccactaggcccctgtctctccatgctctttctgcgaactgcaccatgcctctggtgatggaggccaggtcaactgaagagcaaattgtattaagggacatgtgctgccagtagcttttcatctcaatttacaagttctctgttctttttgagtttaaacttttatcaaaattacatctatataatagtttgaagactcaaataagactagaagccatgtcacaaaaagagcagtgcccagtgtcccaccctttgacttcttgaccagtaggaggcaactattttaagatgattctttcggcatttatcaccttatctctacgtaacttgcttatattggtacttcttgattttctccacaatttcaggcattacagtacctatagaattcacactataaaatatgagggcttaatctctctttcaacccaccctacctatagtcccataatttacacacaacacaatgcacacaacaaatatactcacatcctctctgttccccactgtttgaaatgtggtttcattacattttacttagctaaatatatggtgctgtcattgttatgaccgtgtaaataccatgcacaactgagccataaacagtagtacactatgattgctgttatcttttgtggcttttgtttccactactgttaattttttcttttatactctgtttgctcttctaagaagttatcattattcagaccccagacttcctaccatctaaagatctcctcagtatgaatggatgcatcaggtattttaccaatttcatcttgaagaaatttcctctagagctcctgacctataccaatctggactggctgcatttcagtccggtacacagttgccatactgggacctccctctaactgtatctcgaaatcccctttgctgctttcttgtgttggattccactgtctgtatcccataaattcctctttttttggtttacttctccattttagtgaagcacatcttccagtaagtatctgagaaaggatgcatggcaggtcaatagttggggaatctcagagatctcaaaagtctctttattctattatcacatctgtttgatattttggttgaatatgggattttaggatgcacatagcttttcttcaagattttaaaggtgttgctacattgccttcttgtttccaatgttgctatttggaagactgaagccattctgattcctgatcctttatcaggaacattctccttgcccttctgaaagcttagagaatattttttttgtgttctgatatttcacaataatcagtctgggcttattttaaaccattgtgttggagacttgtgaaatcatgacaatgtagaaatttatattccttattataaggaatgtccttgaattattttatatttaatttctttgcttttattttctgtttttgaaacttggatgatgaattctttgaaccagtctttaattttctaatctcttttctattttctatactcctgccttttgctctacattctggaagatttcctcaagtttattttccaacctttctattgggtttcagaaaccttgtgtgtgtatttgtgtgtgtgtgtgtgtgtgtgtgtgtgtaaatattcaagagctcttttaattttctgaacattctttttaaatttcttcctgtttttcattcatggattcaatatcttctcatgtctctggggatattaatgttacttttgaagtcttctacctgaattttttctatttcctctcatttgttttgttgttttttattttgacttgaaaactggcacataacaattgtacatatttgcagtatatagtgtgatgttttgatacatgtataccttgtgtaaaaatcaaatcaggatatttagcatatccatcacctcatagatttatcatttatttgggatgagaacattcaaaatcctctcttctagctattgtgaaatatacagtacaatattgttaaccatagtcaccctactgcactagaacaccagaacttattcctgctatctgactgtaactttgtacctgtttaccaacctctccccatccttattctcccttacctcccttccccagcctttgacaaccaccattttattctctacttcttgagatcaacttctttttcattacaggttttccttatatgtctgatgatcctggttttcctcccataactaagagtggggcataaaaaagttgattggctttgggaggcaaaggtgggtggataacctgaggtcggcagttcgagaccagcctggccaacatggcaaaaccctgtctctactaaaaatacaaaaattagctgggtgtggtagaatgcacctgtaatcccagctacttgggaggctgaggaaggagaatcgcttgaacctgggaggcggaggttgcggtgagccgagattgtgccattgcactccagcctgggcaatgagagcaaaactttgtctcaaaaaaaaaaaaaaaaaaaaaagttgattggaaaacataactttgaaacggagcaacaaattggaaggactacacagcctgatttcaaaacttcctataaagccacagcaattaagacagtgtggtattagttagacacactgacaaatgaaaaagttaatacagaaattgagccacacatacagggtcaattaatttttgacaaaatgccaaggtaattcaaagggggaaagcatagtctatgcaaaaaaagatgctggaataactacatatccatacagaaaaacagaatgaacctcagcctttacttgcccacatatgcaaaaactaactttaagtggatcatcgatgtaataataaaatctaaaattatttaataaaactgctataatcatagaaggaaatctttttgatcttggaaaaacttcttaaataggacaccaaaatcataaaccataataagttaataaatcaatttcctcaaaataaaaaacttcagctccttgaaaaacatcattaataagtaaaatgcaaatatacactagaagaaaatattcacaataaatatatctgacaaaggatttagatccagaatacataaagaattcttacaagtcagtaataaaaagacaaataatctaattaaaaaatggaataatgtgttcttgccactgcttctgcttttttcataacactttctggatgtccagaaacccagtagcatggaaattgagcaactttatttatttcatatattctaccattactcaatgacattctacttgagacatagatgcttaatgaagagaaatgtaagtaatttgaaaaaaaaattgagcaacggcctgaacagactctgctcaaaagaagatatacaaagagcccataaactcagtagaaggccctggaagcccctgagatcattagtcactggagaaaagcaactgaaaaccacagtcacacacacaataccatttaaacagtggctttggtctaattgtgtgccttaagattttggttttgatcattttaagaagacatttatagtgccttgacataggccagtcactgcgctgcagacaaatatcatgtcattccacagtcatcagcccagggagacagtgctagtattttcccagtttcacagctgggaaacggaggctctgagacgctgagtgacttgtccaaggttctgagacttggaagggcaatgttgacatttggatccaggactccgaaagcgtgtgtgtacaactaccatgccaccctgcctgcccaggtacctcagcctttcctggaggacttggcagctcctcagcttctgtgggtttttaggaagtggctcagcagcagagtgggaggcagcgggaactccccatggagcagcactggccagcagcagggccagactcatcccccaccttcaagggcggaagccaaggctggaaagacagctgtaaatcccacagctacctgctgccaagctggtagtgggtgtaaggaggggagcagggaggctctcggggtccaaaagccagttcccctgggccagtgtccgtgattccaaaggagggagctgatggggcatccgggagctgccggggaggaagggagtggagagatagagcactattctgggaataggaaaaagatgttgattggaagctctgagcctgggaatgaggtgtgaaagtgacaggtttcttgcaaggtgctcaggtcttttctcttgggccactcacactctctagagaaggatcttccatcttctgcctggaggtaatagttctgcccgccagagttctagagactgattacaatttttcattcatttaggtaaatgtttatttaacttcctggaatgccactccaaccctcaactctctctggtgttcccccacattccatcctagctacagctcaagatttctgctatggccgtagcgatggtggcagtggctctaggaaactaatcacttcttaaatactcagtgttttgtgctgccttcatccctccttccagaggtacctgacactgccaagcctggcacatttttccctgtaagtcaggttgtttcctgccttttcccatttcgtctttaggagtcagttttcttgggtcagttgccattggtccatctgtttccagaatccagaattttgttacagttgccctttccccagtctgtttgtccctgtgggtttatgtgttaagaaaaattaaatctctttacagttcatttagaagggttttggagggagagtaagaaactgtgggtgtttgatctgccatctttactgagaagtcgctccctctcctttgggtaggttccatagccatctggacactgccctgctcctctggaccgcttgtccactcactgcttttgtctgaatgtaaatacttgaaactaagtcctcaattaaccacacataagcagtagctggggttcccctttcccttctcacatctgtgacctctgggctcccagcatcttccaatctttccccttccacagatgttcctcctgcgtatgtctgaggcatgggttttctgcaagctttttcttttccctgtgttgatctgatccatttcgattctttcaggagttaaaaaaaaattcttgtcctctgatggcactttttctcattgttattcataccagttatagttttattattaaaatattttttcctacatttcatgagatttctggtggaactggggatagttgcaagtgcttagtcagccttctcctccagttctgaagtttaaactatttaagcctccacctttttggtggttagggcaaggtggagtttatggaaaacttagaaaggtctttgccacaccaagattattcacccatattttcttctagtacttttgtgggtttttaaaatatttacatctttggttcatttaaaattccatatgatgttagttgtataccggaatttagatttcttttcaaatgtttagctttttgttcaaacattagctattgactaattttctgatttgaaatacacactttgttaatttgtatagctttataataggttttattgtttcataggttaagttcttcttaagtcttttaaaattatttcttggtataattttttccattaaataaaattttgaagtttggccaaatcaaaaaaaatctcacttgaatttgggtatgcctgcattacttttctattcatttagggagcattagcattttaatgcattaaaagccatatttcaactactgggatggatctaagttatctagtcagttgaagtaatcatttactttaagatgtaataaaattgtttcaacatcccaagtcacacctgatagaagtctcagcacgctttccaggctctctggggtgtcacggcagtcaaaggggttggtgtttatttttcccggagtcagttccatattcctgcttccatggaattcttgatctccagtctggctctgacccccgcacatctgtcctttctccagtccacaacactccactggaaaccatctgatcttttcactggcactaactcaaggccatgtgcatggtagataggcaacatcagggtagtgttacaaatctgagccctggagtcagaatgtctgggtcaacagcttgacttcacacttgtaagctatgcacttgatcaagttacttaatgtctctctgccttaattcctcatctgtaaggtaggaaaataggatttttgtgataattaaatgtagaaagttaaagtgttaaagagttaaagtgctcagggcagtgtctggcaagtaggtgctcaataaatatgagctgttataattatcatcgaaggtttggaggctatggaaatgggttacataaaaacacagcacaacaaatgactataaactgaatattggaagtgtattcttaaaactccttctacttgtcttattacaaaaggaaggttccctctctctctttaagccccagctgggcccctaactttgatctcgtcccttctcctccctgtttttcaactctagtcaaatctcactctcttaattagtccattatagtttccaaggcatgaggacttatctttccaatacttaaccagctcatcatttgtttggctaaacaaaaccagctcaggctgcaaaaaaaaagagcttatcttccctttagactatagaagaatataaaagaatgtagttcaaaaactaacaatgattttcctgcacttcgtaaagagagcatatctaaaaggtacagctctccattttctcaaaactctttttctgcccatgaatagaattttgttgttttctctatatagcacgtcttatggttactatatataaattgttattatgagtagaatttttattcactatattttcttactggttattgttagtatgaaagaaagttattgcttctttgtacatttattttgaaactagagtcatattaccactgtttcatatagtttctaatagctttctcagttttattgtcttggattttctctggcatataatcattttatctgcaaataatgacaattttgtttgctcatttccagtatttacaccacttattttggtttattgtgctggcttggacagacattatgtaaccgtgattataatgatcactgatagtgctggttctatttgctaatattttgtttagggtttataaatgaaatggctgtagttttctttttagtataattttgatagattttgttataatactttgctggctttataaaaacaagaaaagcaaaaaggagtagctcttttttctctgagttctaaaataatttaaataattcttgtgttacctattcgttgatggtttgatctgtgtggactatatgggcctggccacttttaggataaggttcttcacaatcatcttatagcctattttaggtttcctatttctacttcatatagagaacttatttttctaaaataattatctatatcacccaagttttaaaatttatttgcacagtttttctttatatactttaagttttagggtacatgtgaacaatgtgcaggttagttacatatgtatacatgtgccatgttggtgtgctgcacccattaactcgtcatttaacattaggtatatctcctaatgctatccctcccccctccccccaccccacaacaggccccggtgtgtgatgtttcccttccagtgtccatgtgttctcattgttcaattcccgcctatgagtgagaacacgcggtgtttggttttttgtccttgcgatagtttgctgagaatgatggtttccagcttcatccatgtccctacaaaggacatgaactcatcattttttatggctgcctagtatttcatggtgtatatgtgccacatttccttgatccagtctatcattgttggacatttggtttggttccaagtctttgctattgtgaatagtgcctcaataaacatacgtgtgcatgtgtctttatagcagcatgatttataatcctttgggtatatacccagctttacaaagttttctttaatactttaaaaacttttccctgcatctgtggttatctatcttttcttttgactagttttgggtatttgtattttcccacctttttcctttttttgactaaggtaggttatgatttattttcttattttatttttttaaatatcttgaattaattaaacaattctattgcttttggcttttccagtttaaactcaatttcacatttcatatttattctttccttttgctttaggttagataatcttttcctacattattgagttttgtgtttattctatttcactctttgttgagtaatgacagaacttacagatgtaagtttttgcctaaggacaagtttagcttcaacacatacattttagtgtacagtagtcttgttattgttgttttagcaaaacaggtattttaaagagactggtatatttcccaaatggttggcaagttaccgtttgcttgtttctacttaatttctagctgtattgcattttggtcagaaaacgtgatctttcctcttcctacattttaagctatgttgaggttgccttcatggaatgatatggattttatgctgagtacacagttaagatctgtaattgtttcataagtacttgaaaagaacatacattctctaatgtgataatgtaacatgtaatatgcatatatagcatctgtcaaggactgagagaggttcaaatttgcttctttttctcacttgcccctttcattgatctagtttgttgtacaagggaatggttctcaaagtgtggtccctggaccagcaagcaacagcatcacctccttagaaatgcaaaatcttgggccctaccccagtcctgtgaattagaaactggggccggcactagcagtctgtgttttcagaagctctctgggtgattagaatgcacactcacattcaagtacactaggagaaggcatgggatgtggatctcattttgtcttcctttgttctgaaaaattactctcccccgtcccacttgtttgtgatgctccccttttcaataacttaattctctttataaactattcattctgtaccattaatctgtgtcacactgttttaatttttatagttaataatcaaaggcaggcaaattggaattcggtattatgtttttcctattaaatttgcaaagatttaaaaactcaataattttcagtgttggcaaaaatacaacgaacaagacactctcatacagtggtggtgagaatgtaaagtgatacattttttcctgaaaagaacttatggcaatacgtctaaaatatctttgcctctgcttcaataattccacctgtagacattcattctaaggaaataatcagaattggtttaaaaattatacttacattgttttttgtttactctgttatttgtttttaatgaatagacatttttggaaaagctttcggtttatggaaaaattgagcagaaaataaagtgttcccatatgctcctccctccccaacatttgccttattactaacatcttgtattagtatggtatatttgtaacaattgacgacccaatcttaatacattattagtaactaaagtccatagtttatattaggacccgctgtttatgttgtacattctatgggttttcccaaatctgtgacatgtacagaccatgacagcatcattcagaatagtgtcctaaaaatcccttgtgctccaactatttgtctttttaaatagaaaaaaatagaaagttccaacaatatgagcatgtttacataaactatgatatatttaattcaactaaaatattatgcaaccattaaaaatcatgttcctgcaaaatatttaattgacttgggggaaatgtcaatgatatattactaagtttaaaaaaagaatacaaactgtatttgtaatatcatctgagctttattattatttatttattttattttattttatttatttatttttgagatagagtctcactctgtcacccaggctggagtgcagtggcgcgatctcggctcactgcaagctccgcctcccgggttcatgccattctcctacctcagcctcccgagtagctgggactacaggcacccgccttgacacccggctaattttttgtacttttagtagagacggggtttcaccgtgttagccaggatggtttcgatctcctgaccttgtgatcgcccgcctcggactcccaaagtgctgggattaccagcgtgagacaccgcgcccagcctattattatttaaataataatatatgttcataaaaaatactcaaaggggccgagcacgtgcctcacacctgtaatcccaacagtttgggaggccaaggcgggcaggagtttgagaccagcctggccaacgtggtgaaattcagtctctactaaaaatacaaaaattagccgggcgtggtggtgggcgcctgcagtcccagctgcttgggaggctgagacaggagaattgcttgaacccaggaggcagacgttgcagtgagccgagactgtgccactcactgcagcctgcacaacagagcaagcctccatctaaaaaaaaaaaaaaaaaaaaaatcaaaaaacaaataaacaaacaaaaacgccacagggggaaaagactgaaagctttacatcagaatgctgaaaaggtctgtgagaagctaaaagtagcttgtagggtcaggaacactgcctctggcatcagccacctgagaactgcttgatcttgggaaaatcacattgctttcttttttgtctttatgaaattttctaaactaaggatggattgtttttagaatgagaaaaaaactaataaaaaaactacaaatagtaaaagaggaagtgacagagaagcaaaagaagacacaatggggcaataaaggagtttaaatggcaacatttcctacccaaagtgactggaagagaaaagagaagtcattgacttgcacagccaaaactactagagggctggcccgaggctcagcttggggcagggctccaatggtgagcctcatgccccattccctctgtctctcagatcactatctggatttccccctgcagtagcccaggcctcactcacgtccttcccgcttcacaagctgtgagagtttgccagaattccccccagtgaaaatttcatctcatctcattggttctagttgagtcacatgctcatgtctcaaccaatcaaagtggccagagaaaatgcaacttgttgagtggtttaagcctggatccctcaaccttcagaatcaaggatgaaatcagcttccccagaaccacgtggagtgacattaagtaaaagagtgattccctaatgggaactactgggtggcaattaacaaaagatgctctttgtccctgaagggaggtggctccacagctctgccagacgttttgggtgaatctctgcagcacccatgtcactcctgaagtagttttaggggtatttgttttcacgcccacagtagaggtggctgtattggtttgtgctgaaccaagacctgaccaggcagcaaatgactggtcctcaggacactgggaccacaggcttactgttaacatctttcagtttgtgctttcagcatttcacatcaaaaggattttataaaatgccctttttaaactttctgagactattagtctgagtattgggaggcacagagacggcatccctgaggcaggggttaggggatgggagatcttcttttctgtgtaactgaagtgcagtgatgtcttttatgacctccccaaagacaaaagatgagtataacaatactcttgccaatttgctggaaagtttatcgtttttagtttcacagctggagatcctcagcccatttcattatccttgggctaaacagagtcctcattttatggctgttgtgaaactgtattcttggaacaatgacaacctctgactcctctaaagtcatggccagttgaactcccttgtgtcattgggattggcaataaaaacaggttggatactaagcagatacacctgccgctcaggcatctctcaggtgccaaaagatagactgattgtgtggaccaagctccatgctctgggacgaagggaatagaattgaattcccttgggaggttgaagcttcagggagtatagatcaaataaacctcccttctgtgtaggctgtccttccatctgacagtgaaatgatccagttttcttgggctatgaatatggacagacctttagccccaccttagccaacacatgaaaaagtatataatcctggcaggaacccatatagaagaaggcactagaccaggccatctgcaccttgtcatttctttaataaaatgggatttcattacctcggccctgtcagtatttttatcttgcctctgcctctttacacttggagggggttgctgggttacctgaaaagagactgtttttcaaagcaaaatactgcattactattactaatatcactattagtaatagtaatgtgtccggaattggtgggttcttggtctcactgacttcaagaatgaagccgcggaccctcgccgtgactgttacagctcttaaggtggcacgtcttgagtctgtcccttctgatgttcagatgtgttcggagtttcttccttctggtgggttcgtggtctcgctgggctcaggaatgaaactgcagaccttcgcagtgagtgttacagctcttaaggcagcgcatctggagttgttcgttcctcccagtgggctcgtggtctctctgggctcaggagtgaagctgcagatctttgcagtgagtgttatagttcacaaaagcagcgtggacccaaagagtgagcagtagcaagatttattgcaaagagcgaaagaacaaagcctccactgtgtgcaaggggacccgagctgattgccaatgctgacctgggcagcctgcttttattctcttatctggccccacccacatcctgctgattggtagagcccagtggcctgttttgtcagggcgctgactggtgcgtttacaatccctgagctagatacaaaggttctccaagtccccatcagattagttagatacagagttttgacacacaggttctccaaggccccaccagagcagctagatacagagtgtcgattggtgcattcacaaaccttgagctaaacacagggtgctgattggtgtgtttacaaaccttgagctagatacagagtgccgattggtgtatttacaatccctgagctagacataaaggttctccacgtccccaccagagcagctagatacagagtgtcgattggtgcactcacaaaccttgagctaaacacagggtgctgattggtgtatttacaatccctgagctagacataaaggttttccaaggccccaccagagcagctagatacagtgtcgattggtgcactcacaaaccttgagctaaacacagggtgctgattggtgtgtttacaaaccttgagctagatacagagtgccgattggtgtatttacaatccctgagctagacataaaggttctccacatccccaccagagcagctagatacagagtgtggattggtgcattcacaaaccttgagctaaacacagggtgctgattggtgtatttacaatccctgagctagatataaagactctccacgtccccaccagactcaggagcccagctggcttcacctagtggatcccacactggggctgcaggtagagctgcctgccagtcctgtgccgtgcactcgcattcctcagcccttgggtgatcgatgggactgggcaccatggagcagggggtggtgctcgttggggaggctcgggctgcacaggagcccatggagggggtgggagactcaggcatggcgggctgcaggtcccgagccctgccccgcgggaaggcagctaaggctcggtgagaaatcgagctcagcgccgatgggctggcactgctgggggacccagtacaccctccgcagccgctggcccgggtgctaagtccctcattgcccggggccagcagggctggccggctgctccgagtgcggggcctgccaagcccacgcgcacccggaactccagctggcccgcaagtgccgcaggcagcccccgttcccgctcacgcctctccctccacacctccctgcaagctgagggagtgggctccagccttggccagcccagaaaaaggctcccacagtgcagtggggggggggctgaagggctcctcaaatgccaccaaagtgggagcccaggcaggggaggtgccgagagcaagcgagggctctgaggactgccagcacgctgtcacctctcagtaatagcacagccccatccttgctgtacattgtggacattatcttgactcctcacaataactctccaaggtaggtctcatagtcaccattttaaatgggaggaaactaaggctatgtcttgttaggtaatttacccagttcatacagttctatgtgatagaactggagtttggaaactaagcctgacaatgccaaatactttgtttcttctcctcattatcaatagctgactaaaatgtaattttgtcaacctgatcttgaaaaaatttagcctgattttatttttatctgttattcctaaattaagcagcctcagtggcattacaagccgaatccttgaggtgactggtcaccagaaggaatccagccttctccatgcataatcactctacagcagccttccagacccatccatgggaatccttttcttgaggtctgggcaaaaccactccaagaacaaaccccccaatctccatcagagcttctctgccccgtatttgtctgacccctcagttcagcagtgatgatgaccagggcaagtcaaatctatgtctgagcctgtggcctgaccccattgtttgtacttatccgatgtgaaatgctagtacttgctttgcaattttacattttgatgcaagtgaaaggtttgaaccagctgtttaaaaaaacaaatagctttaaaccccattgtaaagtgatgacctcatgtaggaaaactggttgggctcttgccctaggaggggctgggggtaggttcccgatagacaagctgctccttgtgaaccactcagaagctggctcttgctcagcggctgtggatgagccatgagagccacatctgtttttaaatcttcaagatgaatggagttgaattttctattctttaaatgtggagaagaaaagaacaaaacgcttcctgtcagtgaagtcctgtgtttctaagtggggtaacttcttttttattgaacgaaagcttttcaagaagcattccaaagaggatataccagaatctggaactggcatatgaaaatatcacctctagggaacaattcataaaaccaccaattactccgtggactccttttggctctgtccttgctttagatgataggtacattctcacacccctgagctcctcagaaaagcaggagggatccctttgtgccctcgtttataccctgctagaggttaagcatagatgatacactgtcacctcactggaacattttaaacttgaaaaaaaaaaaaaagagaaagaaaacctattaaaattgtcaacattcccacagtaattgagttttctaaattcattcaatagctagtttattcatttaatcaaccattttttgagtccctactatatgccaaatgctgctgtagggtgaggagttgaagatataagatccattacaatcatccccctcatcctcaggaatacatgccaagacccccggtggatgcctgaaatcacagacagcaccgaatcttatatatacaccacattcttcctctacattcatactcatgatagcttaatttataaattaggcaaagtaagaaactggcaacaataataagaataattgtaagtacactttaataaatgctctgtgaatgtagtctctctccctctcagagtatcttattgtaatgtacctactgctcttgtgagatgataaaaagcctacatgataagataaagtgatagggctgggcgtggtggctcatgcctgtaatcccagcactttgggaggccgaggtgggtggatcacctgagatcaggagtttgagaccagcctggccaacatggtgaaaccccatctcttctgaaaatagaaaaattagccaagcgtggtggctggtgcctgtaattgcagctacttgggatgctgagacagaagaatcactggaacccaggaggtggaggttgcagtgagccgagtcagaacagcatgcactttaaagcttatgaattgcttatttctggaattttccacttagtattttcagaccatggttgactgcaggtaactgaaaccatggaaagcaaaaccacagatagagggactactatacctgtactcaagtcgacagtctagcagaagaggaagagaaatagataacttgaagtccatgtggtcagctatgctcaggacactgggggataggcctgggggtagggaaggaagtgatgaccaaagatggcttcctgtaagaagaaaccccaatctgagctttgaaggacacgatggggttagcaaaacgtttaagacagaagaagcagcctgtacaaaggtggaggagtgagacaggagataggagatgtattgcaggggctgtgggggccagggcacgatgctggtttatgatagtgttatccctgtgataagtcccacacctttggtccatgggagcatctcagcactgggaggcatctgtgcatgtgtctcctcatagctgtagactctctgaagatgtctctatggatgtggacactcttcccctgcatgttatgactgtctgtttcacactttccaaagcacatgcacacacatgcaggcttccacacagaaatttcaaacagattgttatttaatgactacagtcattcatccaaacctacactactggttgggtgtttggtctgtcttatctccatttatagcacagagaaaggtatcatcaaccagccttcaagatgtcatctcagaggccttccctctactggtagggaaccccccgccccaacacctctctacactttctcccctccagaacttctgcctgtttaactcttttcctctaacaatgtccccacatcccttcttattctggctactctcaccctcaggcaaaagtcagcaagtggcttgtccttttggcactcacagcctccctggatcagtgttgagtgaagaaagcccttccctcctcagccaggtgaaggaagggagagctttgggtcaggaagctgtgtgtggctggtgaagatgatcatttactcctggttgtgcttttcctgatttttcctttggtgcctcttactatctctggaaaataaaaaaacacacaacttacgccaggagcatgagatctctgccaagaagccctgttgaatcctttgagagtcacaatctctccgagtaattctgaacttattggtccagacatggatttatccctctactcatcttcatcttctttgtgaagcccccttccattcatgccaccctaatggaagtgtccagtcattctttcttaattctccctgattggagggaagaagcgttgtccaatcacacaccaaacaaaattagtaatcttaaggggttccatgcatgaatacctgctaggtgctaaccacagggttcaattttgttcattactcagtggctagcacggtgtcgggcacacacaagttcttcactaaagcgaagttcttcaataaagaaatgattcccaacactcacaatgaacctggaagttaggtatgattatttccaatttataaatgagaaggctaaggctcagaaagattatcatagtcatttagctgataaatggtagtttggttcctaacaaaggtctttctggccccaaagctcatgctttttccagaaaaccatgaagtcatccacctgccaactcactaaatatagttcattatgtcaataaagattaaccctttacatggacacttaactgcaatggtcttggtgctgcataacgaagctgtggacttgggcaactcttcatgacccaacttgctacttctgagttgcctccctctctagagtttgtctccttcagcctattcaatgcagcacctattcattcattcattcattcattcattcattccacaaattttctggaagtatctaccatatgctagatgctagagatacaaaaatgagtccaacggctcctgccttcaaggacactagaattcatcacagtatattagtcgcctatgtgactaccttaaggacagagagagttgtatgatttttgtggttgtttccagctcccaacagaagacctggctgatgagaggccctcagtaagtgttggctgtattggattgatatggtgtctaatgtaatgatgagtgttatatataaagctatgttccatgagccacaggcattcttttggggacatgcatattaattatttttttcagatcattgagctgtcgttcaataaatgacacaactgccttaatatagaaaattgctagaggagctagatttattttctttcctcacactaagaagcaattgtagtaattccttatgtaataaaccagtaagaactaatttaatttaaaaaaattttttaaactggattacacacaaatatggtagaaagttttaaaaacttacaaaaggatataacattaaaaataagtctcccacttctggccctaggcacccagctttcatccttagaatgcacggctattaccagatttcttgaatattattccagagatcttctgtaggcacacaagaataaatatgtgtacttctatgcatgtctgcacacactgccccccacacaaggtggtatacttcgcacaatgttctagactttgctttgttcatttaatgctgtgccctaaagaccttttcatgttatgacatagatattattctcatttttaaatgactgttatacggatcgtaccatcttatccattccttcattaaggtacattcaggttgtttccaaatgtttgttttattactaacaaagccacagtaaatttccttatccatatatcattttgcactctaacagctgtgagataaattcccagatgcaaaatgtaaataaatttatttcacttttaaaatttaaatttaaaatgtattattataataaataaaattgaatacattcccagaagtgctggccaaaggatatatgcattttaagataaataagatgcatttaacgtaaatgacatagcctaattgctctacacagcagttgtgctaatttgcactcctatagcaatgcatgacagaaattttctcctatggtcaagacgactgacttaccaaatttttttgatctatgctaatctcattgcaattttcatgttcctttatcttattatgagatcttatttacttcttaatagtccagtttaatgttaagaaaccataattcctgtcatgtcaaaggaactgcgatcataaattttgagtttatctgaactactgttcaccagaagttaaaaataacagtgttattagttacatttttatatcactgccaatctcaaagtgaacttgagataacttaataaacacacaaaacaatgagagagatagaaacaacatttttaaaatcaagacaacagaaagtagaggcaaaatggtaaaatgaagtaagagggaagtttagtgaaacaaaatgcatatcttcaggtccaaaaatctactaattttggtccactgttttggccttaagcttcttagaggtcaaagcaaaaaggaaaatgtaatcaattttaaaatgtacattgttaaagaaaagaaaatcaaaagatttttggcttttaaatctaagggaaattcataaggtttattgcagaagggactccagatagtatctcaacaagattcctaaaatgaaagaaaaagtaggggttttggagaacaaagctctgacgccgtctatgtagaatgctttcctagggccctttgtctggtaagagctccccttttcctccgaggaccaactctctgactcttcatagtcctggtagggatatcaatgaccatgccctattccttccaccttgaatactgctgtacaacaaaccacaccaaaatgcagaggctacagggcagtcctttagctcgtgcatctacaggtagatcattctgtctgagcttggcctcacagttctattcttggctgggttctctcccaatccaggggctgtctggccattgcaggggcatttgggtatcttggtcctgtcccacaggtccctcagcctttagtatgctggcctggcatgttgtcatggtatggcacagctccgggagtagaagcagaggtatgaagatgcctttttcaacctcggtttgtgtcatatctattaatgtctgatggaccagatgaatcacatagccacactcagaatgaaaaggtggagaggtgaatttgtgggaggattgcaaaatcacatggaaaaggctgtgggtaagggaagtgtgagtgccacaactcatcacaggggacagtgatctaggcttagaaagtggggaggaagtgcactttccactgggttgcccaactgagacttcggggagccatgtttttcactacttgctgcaggagggaatgggtattcaaaaagaagaggagaggggtggatcagacacatgcagaaagaaagagcccggtgctataaagtccctgaagctcttccagtgtgtctgcaggtcactccagtacccaaaccagcccctgagctagtactttttcctgtttgctatatcaggcggtactcaagagtgaatgctgcagccagtctacctgggtacaaattccagctgtggctgaataactgtgtggcttggaggcaagttgcctcatttctttgtgcctcagttttttcatctataagatggggataatgataatcttacctctcagagctgttgtgaagatcgaatatattcatattgggaaggacttagaacagtgcctggcatatattaataaatgtgtggtaattattttttgctgacattagtttgaattgtgtccctgtcaatagattggatttcgtgggtggcatctcaggtggatttgatggaaagacaaagctgtctctcatgggagctgggctcctactttcacccaaaggcactgaactgcatcccaattgccaaatctaccaaccaagaaacaataaacccaataccttccacgggaattaccctaatctgtgactggcctggtgagtgtgtcatttatagagtcaccataaccacagaacgtggtacatgccagcaatcttcggggaccttagtgctccccttccagatatagagcgaggtttgcctgagtccaggacctggccgagtgggccagattgctgtgtgggtttatggaacagagtgtgatgataatgggcttctagattctttcggtgcagactccacctccctgcctgcagccaatacggagccctgacaggaaatacaaagccgctgacagccccagacttgtccgcaccaccatcagggctctgagcagccgagctggagccccctctccctccaggtcggccatccggctgggtcggctcagtcaacagcagtttacagtttggctgactacagcctgactccacaaggggaataaagcccagcattgtgctgggcttgcaacatctttccccgtccagagttcctgatgtgtttgttacacaggatctggtctgaatgtttcctttgtcgcagaccttcacgtgctgaggtgggtctgccttctccgcggcagtcctgggttaaataaatacattaaggcaacatacacggcttgacactggagccagcctcaataactcaaataattcatgtggcaaaagatggagcctctgtggttttgaattcatttaaagatggatttctttgttcacttcctttgctcgaggagaacacaaactgggaaggggccgccatgctccaactcagctggccatttttctccagcaagtctgtttgagagtttctaaatcccgtgcagatgaacacagaacatgaccttcagccagttataggataccatgctgacatcaccacataaatatacactcccgagaaagctgtgattaagctccgcgcagatttttatcacttttccagtgcaccggcaggctgcttgttcgccatgcacctttacaaaactcataatatttagaaatgtgctgtgttagccccagaggcttaaataaactaaagcctgtgaaggttttaatgtaacaagttaccttcacatgtgaaattacgagtctacatgatactcaataaggccaacattgtacacactctgttcttttgggatcttatgtacatttatcctgacatatctgtttcagttttttaagaacggaaaatatttctatttcaataccaccatacatgttcatgacactaaagaatgagtgagattgtatatttaaagaaattcagagtctccgccgggtgctatggctcatgcctataatcccagcactttgggaggctgaggtgggcgcatcacaaggtcaggagttcgagaccagcctggccaacatggtgaaacctcgtctctactaaaaataccaaaattagctgggcatggtgatgggtgcctataatcccagctacttgggaggctgaggcaggagaattgcttgaactcgggaggccgagattgcagtgagccgagatcgtgccatgcactccagcctgagtgacagagcaagactacatctcggaaaacaaaacaaaacaaaatattcagaatctctactcaaggagtttgtgctttaaggccaacagaaggatgggtgggagggtgctgtcattgtaatctcctataaaatcaccaagttttcattttcttttcttttcttttttttgagacagagtctctctgtcgcccaggctggagtgcagtggcacaatctcagctcactgctcactgcaacctcggcttcccgggttcaagcgattctcccacctcagcctcctgaatagctgggattataggcatgtgccaccatgccccgctaatttttgtacttttagtagagacagggtttcaccatgttggtcaggctggtctcaaactcctgacctcttgatccacccgcctcggcctcccaaagtgctgggattacaggtgtgagccatcatgcccggccttcatttacttttaaaagtgcagataaaagatttgttttatgagtatagcagagattctcaactgagacaattttgccccccaggggacacttagcaatgcctagagatattttttggttgttacaactggagaagcagggtactattggcatctagagggtagaaatcatgatgccaatatctatgtatgtatccttccatacacaggacagcccccctcaacaaagaattgctcattccaaaatgccaacagtaccatgcttcagaaaccctaaggtacagtacatttgggaggaggggttgggacagcatatgttctaacaggctggatgactgtaaactttttaaggtgctatgcaaacactaaccttgccttctagtcaatttactggctgctaaacattgtttcaaaattctgactctccatttatcctaagcacattgctataaaatgccttattgatgaggcttgcctggcccaaaatctaaacagggctgctcaagttttctctttttaaaagagaaaaataaaaaacttttcttttttactttgaaatgatgttaaactaaacatgtagtttctaacatagtagacagtaccttcaccctgctttcccccagtgacagcatcttacataactatagtataatatcaaaaccagaaaactgatattggtatgatactattaaactacaatctgatttggactttactactttgctcaagttttaaataataaaacattttaaattttatttctcccaaaatattcaactttattcttgtagaaatgcttaccatgaaaaacaaaacaatgatgatctttctgcttctaaatgatcctcattgccaaggtgctacccgttgcgagaaaagaaagtgaccggtggaaataattggcttgtagttttattaatcagtctctaccctcttcaaaacaaagactcccatgatattttctggctgtcagtgccttcttgttgttgttgttgttttgatcggtttacatgtccttcaaaggctcaagtattgaacattaggaccaaaggtaacaaatttctcaaccttcacccccacacccctcaccccgacactacagcctcctggaagcactctgcagaacttccctgccaatatatatatatatgtgtgtgtgtgtgtgtgtttactgggtttacaccgtcggtgcccctgtttttcaggccttcagattcagactagtactattgtattatagtaccaagagcagaagataaatgagatgtcctagccatatgtgtatgtgtgtgtatatatatacatatatatacaaaaactatatatatacacacacacatatatatacaaaaactgtatatatatatatacacacacaaaaaaatatatatatatataaactatatatatagtttttggatgtttttaagggaatcttttacaaatacaaatggagtgccctgctgcagacccacccgagggaaggtgggaaggtgttgtctttactgccgcacagctattaagaccttcaggtgtaatgatcgggataagatacatgctgcttctaccttcagcatccttcaagagcataggagaggaggcattgtgaggacctgggccccaagtgggattccttatgttgttctaacctcagaaagaaaaatacactcaaagacagccagaaaaagccctagcagaggggctttagcgtggacttttagagcaccatctgagaaggtcggcattcagtggaagagaaagcctcagaccatggagaactgagttcaagggttggtcctgccactttctggctatgaagccttggagaaggcactgaactaagcttggtttctctatcaataaaacagtgacactggtatcaatcccggtaaatacagaaggtggtgtgacggtcgctgacctgcttcattggaaggtgtcttttataataggagaaatgaaaaaaatagggtgtcctcatatagtgaaagtaaatagagctacagccacacacatcaacatgaagaaaccctgcaaatacaaataatacaatgtattaatcagatttctccatggaaacaaggaaagagaaccaatatgttatatacatatataatatatggatgtaatattacatatatgtatataatatatatgtatgtaatattacatatgtgtattatatatgtaatattacatatatataacatattgttctctttattaatacatatattgtattatatatatgctatgtaatatataattacataattatataatatatacatgtataattacatacctacataatacatatatgcattacatacatatatattacatagcatatacacacatacatataatatacatgtattacatatgtatattcatatagtgtgtgtgtgtgtatgtgtgtgtctgtgtgtgtgtgtataaaatgtattatgagaaattgactcacacaattatggaggctgagaagtcccatga

SEQ ID NO: 2344 - DNA, 58353 bp, Homo sapiens
tagcacaaccgcctaagcggcggaactctggagagtgcggaacctaggatcctaggaaactgaaggcaacggaacctgggggcgatggaatccgggagcggtggaacccggagcctgtagaacttgaatctagaggaacctgacagcggcgccgagggggccacccggactctgtttggaacggaagcacagtgtccgccgcttcctggttgcgggtcagcgcccaggtcctgggctggccgccgggatgttgccctacacagtgaacttcaaggtgtcggcgcgcaccctcacgggggccctcaacgcccacaacaaggcggcggtggactggtgaggacgccgagcttccaggtcgccaggatcggccaggaatgtgtgagggggaagggggaaggacaagaggtttcaccccctggttagtttggcctcgctaaggcagggagccgccctcacgcaatgagcttgctttcagttggtggatttttgttgttacaaaagtgataatagccccgtgtgggaaattcccccatgcaaatacatttcccctctttctcgcgtatttctctgctgttttctctgcacctcgcccttttgccgttccattcctctctcttttcctctcctccagcttccaggcttctctctctccaccattaattccctgtgcactttctctttcccatcctgtcttttctttttcgttgtcttgtattcctgttgtctttcaacaatgtgccagaccctgtgctaggcgcctgttctttcacctgtccttttcacctcttttcgggctcctcctgtgtagaacattcctgccttcaacaggtcgtctttattactctctcctttcactataaattactactgcagctctgaaaactactcattagacaaatgtaaagcaaaattctgtggctgtgggatgttgttaggaggactgaaacgtcttgtgcagtgtttgtcgttttatttagttggaaggactaggattagtcgcagtatccccaggcacattgtggatactaaggattagaaatcggataagcgaaagacgtatgcctacaagaacagtcagagggcacaagttcctttttatgtcctcgggtctctattttcatatcttttagaactttttttatccgaatgaaaagtgaatttcaacaagcattttaagcttagccagatcttttatttaagtgggataatgataaatactggcctttgggtttaaatgattttattaatggtggtacatatgaattagacttatcatttatttaggcttggcaagaaagaagtcgtcctgctttgttctgtacttaaactttaacattactgttttgctaggggctggcaaggtttaattgcttatggatgtcattcacttgtggtagtgattgattccattactgcccaaactcttcaagttttagaaaagcataaagctgatgttgtaaaggtaagtaaaatcccactttgacgctaacatgttgtctagtctaaagtttaatactgtgtatcactaagctctcattaagtcttacgtgtaagtgttgaatagcttttaaatataacaacctatttggggtagcctagaattttcatatatatgacttaatgtcaatacagggtgagttattaaatgctagttgttagatcattttaaggcagatgaaagttctaccatttacaagaccactcagtcattccttagttttgagcacttaccatatgctatggatatggagatgaaagccctcagataattctccatcttataaggaagactcacagcgtgatagtgtgataagtgagacttgcgtaacacgctgtgagaaaacagaggagctgcatattgcctggttgtgaggagagtcacagaagtctacagtttcaagactagtagacagtagttagccaagtaaaaaattgacaaggagcattgcagggaaaagcaagaatatacacagaagtaagtagcgtgccataaagatggctaaagatgggacacttgtaggagtgatgaaataagaggcagccagagagattcagctgtctgtcctgaagttttgtaagattacgaaggagtttggattttttttttttttagacagaatctcactctgtcgcccaggctggagtgcagtggcatgatctcggctcactgtaagctccacatcctgggttcacgccattctcctgcctcagcctcctgagtagctgggactacaggcacccaccaccatgcccagctaattttttgtatttttagtagagaccgggtttcaccatgttagccaggatggtctcgagctcctgacctcgtgatccacccgccttggcctcccaaagtgctgggattacaggtgtgagtcaccgcgcccagcaggaatttggatttttgagtaggagattgatgtgaccatattcgcgtcttagaaaaactctggcagcagtggaggatctgctgaagaaatgcaagactggaggcagtaagatcatttaggagatttctgcagtaattttggtgggaaattctaagggcctaaaataaagctggggcatggagaagtcatgtttaagagcagcaaagaggtaaacctgatagcctttatagtgatcagtataaaggagagtaagagaatagagtgactccaaggtttcttttggtgtaattgaatgacagtgtttccagttatcagaggtaagcatctgtgaagtcagtgaatttttaagttttcaacatgcaaaatctgagatgcctgtaatatattgcattatagtgatccgggctttaggagataggtcaggattagagatagagatttggagtctttttcttttttaaataatagctttattgagatactcataccataaaatgtactgacttaaaatgcacaattctgtggcttttagtatatccacagttaatgcagccacaattacaatgaacttttttacctcaaaaagaaaccctatatccactagcagtcatattccatttcccccatttccctcatcctttggcaaccactgacctactttctgtgtctgtagactggcccattctggggattttatataaattgaatcatataatttgtggtcttttgtgcatgacttctttcacttaggataatgttttcatggttcatctgcgttgtagcatatatcaatactctgttactgatgaataatattccactgtaaggatgtatcacatttattttattgatggacatttggatattttgtactttttgcctgttacgaataatgctgctttgcacattcatgtgcaagttttgtgtgaacctgtgttttcatttcccttgagtatgtttctaggggtggaattactgactcatatggtaactctgtttaactttttgaggaactgctggactgttttccaaattaacattctcattagtagtgtatgaggagtctaatttgtccaaatcctcaccaacgcttgctgttctctgttcttttgattataaccatcctaatgggtatgaattgattctcattgtggctttggtttgcatttccctgatggctaaaggtgtggagtatcttttcatgtgcttattggccatttgtatatcttctttggagaaatgtctatgcaggtcctttgcccattttaaaattgtattatttatctttttataattgagtcgtaagatttctttgtatacagtagtcctcccttatccagaagggaaatgttccaagaccccagtggaagcctgaaaccctggatagtactgaaccctatatatattgtgctttttctcatacatacttacttatgataaagtttataaaccaaaccctgtatatactgttttgtctcatacatacttacctatgatcaagtttataaattaggcataataagagattaacaacaataactaataataataaaggagaacaattataacaatacatcagcattactactcttgcactttgggggcattataaagtaaaataagggttacttgaacatagcactgagatatcacaacagttgatctgataatcagtatggctactgagggcaggtggtgtatacagcatggatgttctggacaaagggatgatttatgattaaggcaggatggaacaggacagtgggagatttcatcatgctattcagaaaagcgcataatttatgaattgtttatttttagacttttttgtgtcatatgtttggattgatacatgatttgcaaatattttctctcaatttgtgggttgtctttttactttcttggtggtgtcttttgaagaacaaaactttttcattttgatgtagtccaatttattattttgtattgttgttgcttgtactttttgtgccatatccaagaaaccattgctttctccaatatcaagaagatatatacctttgtttttttcttagaattttagagctttagcttttaatccattttgagttaatttttatatatgatgtgaaatagggaaaaatactattaatttttgtttattgatcatatcctgtaatctagctaacttcacttagtagatctatttaatagtaattttgggtaaattttttttaagtagacagtcatgtcactgcaagtgactgcagtttaatgttttcattgataatctgtgtgtcttctatttttcttgccatgttgcattggctaggacctctactacaatgaatgggagagtagtgagaggatactcttgtcctgttcctgagcttagggggaaagtattcagtctttcatcaagtctgatgtaaggtatagggtgttttgggaaaaatatatttaccttctctttccctctctgtttcctttcccctacactgccccttggcatttctggagcttttatttctttatgtaggtccaagtttcagtctggtattatattcccatcgactgaagaatttactgtaagttcttaaagtgcctgtctaatattggttgattctcttagcttttatttctctgagaaagtatttcacctttgttttcgaaagataattttcaaaggatatagaattctgggtttataatttttttttctagtagtactttacaaatatcattccattggccaggcatggtggctcacacctgtaatcccaacactctgggaggccgaggtggatggatcacctggggtcaggagtttgagactagcctggccaacaaggcaaaacctcatctctactaaaaatacaaaaattagccaggcgtggtggtacacacctgtaatcccagctacttgggaggctgaggcaggagaacagcttaaacctgggaggtggaggttgcagtgagctgagatagtgccactgcactccagcctcggcaacagaataagactctgtctccaaaaaaaaaaaaaaaaaaaaatccctccactatcttcaagcttacatagtttctgatgaaaaatttttgtttttgtttctctgcattatatcttttttcctccgattatcttcaagatttccttaaccttggttttcaatagtttgattattaaaatatatatatatatggcttggagtttacctaaatggaattcaacatatacatatacaaatatatacacatatacaaacatatatatacacatagagacagtcaattcttgttatttgtggtagctatattctgtaaagttgttgtatacactgaattagtgaatactgaaactttgtttgctcctaggggttaggttcttgtgaggctctggtcacaacattttcatcaactgatcaatagataaccttgctttatatgtgtttccgtttaaagacatattaatatgtcagttgatctattaacattgaactcatagccaacaacacatgcctgagcaaagattatcacatatatatatatgtatgtattttttgcaagacacatcacaacttctcatacttagaaacggtaggcagtatgcttggggacctatttaaacagtgaagtcaccagcaaaaggaacaaaaatgtgaaaaatgtggtactaaataaatcatgagatgaacacttgttttgccattggaaaagctaaagcaagaattcttgtttgacttcagctgggaacacacatgtatgttcggtgacatttttttcaccattctgcacttgtccacaaaagcactgcaagtattgattttgaggttgcaaattatagtgagtaggtaaattgacaaatacagaatctataaataactagaatggactgtgtacacatatatacactatacatattctattcatacacattctatacctatgaacttaaacatatacacatacaaatatgcatacacacatacatatgcatatatacacatacctcatttaaaaatttttgcctgagcaaaagatctattacaggaaaaccttaaggcctgttcacgctcattttcagaaaacgttgtttccatctttttcatgaatactactgcaattggttggcttactttcctaccttagcattatatatgagtgtatttatatctgtacacatatataggtatatacatttatatgtatttatagatttgtggtatttaaatctacttattaaacagaccttggacactgtactaagtctgagaatagaaatgcaaacaaagaccacatggtgtgccctatggaacttacagttgatggactcatgaataggcaaaaagaatgtaaataaaataagtacaaattgtgtagtagtaaatgctttgaagaaaataagcaggatactgagaagagaggggtggtagtgaccagggaaggcctgactcctagtgaggactatgaaatttttcccttattctgtcagtattcattgttcaagaatttaatcagatttgccctggagttcatgtgttttttattttaaaaattctattgttaatcatgttgctataggcatgaagcatttttttttttttagagaaaaacttaatgttttgtgaaagagagagacagctagagttttttgtttgactttgccttctcctgactttccctctgcaaggtttttgtgtttctaagttgtcttcttttagttaggagactagaatacagaaaaacattctgctaaatatgattttaggtattttgtcataaattagatcttaggaaaactgattttcaaggcatcctggggttttaacctaaatttcccaaaatattaaggctgtgaatcatttttcatcacaggatctttgtgatgtgtcaaagaaaacaattttgtaactgcagttaaagatatctaccaaagtaacacaaatgctgccttcaaaatgaaaaccagttttctgtttattcttgctaaatgtttatgtaatataaatgtagtatgggttctggttgatgttttgtgaaaattatgttctgtttcatccagcgcaagtatttacttgatctgatttcttcttgatacaggttaaatgggccagggaaaactatcaccataacattggctcaccatattgcttacggttagcttctgctgatgtcaatgggaagatcatcgtctgggatgtagcagcaggagtagctcagtgtgagatccaagagcatgccaagcctatccagggtgaggaaagtctgctcagctaagtgtgtatattgatacacttactcttggagtggttttttggttttgggggttttcccccattcatttaattttatcaattccaagttagctcttgattgtgttttgcctattctgctgatctaaatctggctttctgtccttactaatacacttctaggcatatttcttcaaatctcaactgatttgtgctttggtaaaactcattaattgcaatatcagcctcattcaagcatgataagaaaaagtaagtggtacaatcttgtaatctaagctacaatataaggaaaattggccactgctgttaggaactagccatcagtgcttactctacattaagtaatttgttcattatcagagatgaacaaaattttattctcattttcatatagattgcttgtttgttcgtttcatgttactgacctaaaaccagtacggtattctttttttttttctttttttttttttgagatggagtgtcgctctgttgcccaggctggagtacagtggcgctatctcggctcactgcaaactctgcctcctgggttcacgccattctcctgcctcagcctcccgagtagctgggaccacaggcacacaccaccacacccagctaattttttgtatttttagtagagacggggttttaccatgttagccaggatggtctcgatctcctgacttcgtgatccacctgcctcgtcctcccaaagtgctgggattacaggcgtgaaccactgcgccctgcccagtacagtattctttagacttaagtcctccagtggctctcttgactgaatgaattttttaaatgactatttaaaaaatatttattaaatacttactgtgtactaggtactgaactagatctttgcatattctgtttattttttgaaaaaccatgaagaactgtaaagttccattaagtaattccacagaaacattaggaaagtctgacatcttggttgtggctaagagagtttcatattgattttatagttttaagtaatgattagggcaaattgccttttattttctttgaagtaatatttcagattacttcaaaatttttaccttgagagtttaaccagacaacttatttttatatagaattagttttttctctggaatattgatacacacacacacacacacacacacgtcacatttggggctggtggttaagtttttaaagattatattttaaaaactaaatatcaaggacaagttagccaaggactttggagagtgtggtttctgaattttgcctttctttatcgggtctttccagatgttcagtggttgtggaatcaagatgcttcccgcgatttactgcttgctatccacccgccaaattacattgtgctctggaatgccgacactggcaccaaactatggaagaagagctatgcagataacattctttctttttcttttgacccttttgatccctcacatttaacttgtgagtaacagttgcttgtggaaaatgagttaagtgagatatttataatatagtaatgctatgtgcatgagatatacacacacattatacatctataatgttaaaatgactgagcgaagtggagaagcatgtctagtccatatatctgcagctcctaatacacatactcaatcataagttcatatcattgcaaatatgataaaaaattaaatcagcaagctacaccttcactgtgttgaatttgtgaatagtattagactagccagggacagagagttactttgacactccagacttaattagttcttctaagaacatttaaataacttgaatcaagggtttcattcagtctgtggccaagttaagttcttgctttttaataaattgtcctaattcacgccattcattttgagtgccataaacagatgcatgtaaagaagaaataagcctaagcaagttttttcttgcagagatagtttttgctaatatgcttttaatgttttcctgagctaatgatctaaaaatgagatgtgctttaggtatttttgtggctaaattgtttagaaactatttaatcatccaacagatatttcttgagctattgctactcttctgggaaccaagatgtctcagaacccaaaaggcaggagccttcacagagtttgcattctagtgagaagaagtcatatcataaactgtgaccacaatgaattaataaattctagtgtagtaagaggtgacaggtgatataaaggcaggataaaggggatgcagaagaatgggggatgagggcatgcaagttgtatgagataaagtggtcaaagtaggcttcactttgataatgatcagaaatgtgaaggaggtaagggaattagctatggtaaggaatgtttttcctggatttgaatgactcaaaattgttttacccatcaacttttattgaggggtgtgtgtgtgtctgcacgtgttaaaggaggaagagaaaggcagacaaaattgaaattataataacatgggaaatgtggctgtgtaaatacactacagggtgcttaggcttttatgtatgtaaatgtttgtatatggacgtgtgcatacatacactcacttggtcaccagtttacttactcacataggtgcagtgctggggaaacacctaggagggctggcccagttggcagagtcagggaaggagggcatcacaaaagaaggaagcaaaggggaccttgaaggatgagttctggaacctgaaaaggcaacaaggctttcagctaacttgattgcatcagctctttacatctctgtaatttggttgatgaaagcattgtgtgttccagagtgtcagttgacctaacatctttgatttactcatattgaatgtgctagggttgtcataactcttgaatgcatcctttttccctgtgtttagagcagccttgctaagggctgggacccagggtagtaaggtttttctgctcatgtcttccagtattaggcccattgttgagggagattattttttcagtcataaaaaggcataatttgtattgctaaatatggtgctccctccttgactatttttgtttcatgtacacttagtaagtcactgtgggcccactactgttttctaaatattaagggaaaagaatattccttaatcatcttaaggttcgatctgatgcttgagaagaaaaagggaatatatttagactgagtagctcaggataaaaatttggtatcatcaaataaaatatatgaacttagctaattgtgatatgcagagcctcttaagtatggttttttgtttttttaagttatgggatatgttaaagtttttttgtttgtttgttttttgtttttgtttttgttttttttttttgagatggaatcttgctctgtcacccgggttggagtgcagtggcactatctcggctcactgcaacctccacctcccagttcaagcgattctcctgcctcactctcctgagttgctgggattacaggtgtgtgccaccacgcctggctaatttttgtatttttggtagagacggggtttcaccatgttgatcaggctggtctcgaactcctgacttcatgatctgcctgcctctgcctcccaaagtgctgggataataaggaaagatttttaatgaaagtccgtgccctgaatttatttagaagaacaaacacttgttctttctgccaataaccttatgttatctttttaatataagacataatatagaatgccaagcttggaggcctctgatgaattgtaatggaccacctgtttctcttcaacttagagaacattcccattatgttatgaatgcataacattgccagttatatattattaaaattatcactatattgctctcaaaattgtattggaataaaactgtatgctaaacttcattaaactttaatcagagttttgcttttctcaatatagtgcttaccagcgagggtattgttttcatctcagacttctccccatccaagcctccctcaggccctgggaaaaaagtttacatatccagcccacactctagcccagctcataacaagctggccacagccacaggtgccaagaaagctctaaataaagtaaaaattttaatcactcaagagaaacctaggtaagttacaagtgtaaaattaacattcatctacttatctggtatgaaagcatcatttttggagatgtacaaagactgatgtttttcttcatctcactttttctcatttctaattttgaatttattagaggaaaaaaatatttatttttgtcccctgccctaagaggagattcagcatttaacattgcctttgtttccactagctgtgctaaacttccccactgacttttatagattaaaatttttgaattctgatttttacttgtgaaaatcgcaatgatcctaaagttcaggcaattgaatgcattaaaaatttgggcacaaaagctggatactcattttaaatacattttcctgacttaggtgctgtgcattctcattcagcagtaaaatcggagtgtttttcttatgcaggtgaagatgtctcccatcctggttaagagccaaggctccgggggaagctttagctatgagactgagaaacttctttaatcttactcaaatttctctctcccagtctctaaaataaggctttaaagtatttcatagggttgttttaaagatcaatagatccaataatgtaagtaaagcatgtaatgtcattgatacatagtaatttatttagaagatgtcggctgttattaagaaattacaactgaataaaagtttattttaagtaatttgatgtattcaaaataggtttctttctttttcctatagcaataatctgtatattattgctttggcaggcttttttgtttgttttggcattcattttcagatagcctttatttttaatatgccaagattactctctctaggcttggtgagtaactacttgaaaaatatgtggtaaaaatataaattgctctacaaatacattttgcacttgtgtgtaagtatcacttctatatattaagccataggctggttaagttcactagttaatttatctctcaccctgtgccaaaatgacttaagattacttcttaagtatcttaagagaactttctattttttatgtattccctctcataaacaagaaattatttggcagtctgaatagttttataagttatgttttatatttcttaagttttctctcatatgaattatatgtatatcttgagtattggggaaatacattatttcttcaagtagaaccgctctgggtgctttcacatctattaattcctggactcttactacaattctggcagtagtaatattcccattttacaaataaggaaaactgagtcccacaccaatttaaataaagttactcaagctcacccaactaggacatggcagtcgggattttaatgcaataaaaattcctctttctagtcttgtgaactaactttattttaaatttcaaagccttttaataaaattatgtttgtaaaatgaaatgtaaaatgaaaatagtacataattgtatgtctattcctattgaaatatatttaatatagaaaaggtcattgaatgtatgcaacaatcacaaattattaaaatgatttttcagaccctaacaatctcttaaaatccttatagtttcacctgttttatttacacacaagaaaatgctgcaatataagtgaaactttgtttcaaaaaagatttaagacagcttaaaagtgaatgaaggcagccaaggggaagttacttgcccaaagccatacagatagtccagtaactcctggtccaggggccctaattaccctaaatgttgatgtttttcatcctgagtcttgattttaacagtttgcctagtacttttaatgacaaagtaaaagtaaaataaaactgtcttatgcatgccagctattattatattatcatttaccatgtcttgtgtaatattaataacttaatattctactacttaatatttcaaaaacttagaaacactgacatttctacccatcctatacaatattattagcatttggattttggtacatagtagagatctaagttttggatgccaacccatgttggtcacttcagggaatagttgtacatttttattgtcaatttttatgtgtaaagtacaaaattaaatcttttattaggtctgatataaatgaagtctttgacccaagtgaatgtttacttttttcagtgctgaattcataactctcaatgattgccttcagttggcatacctgccttcaaaaaggaatcacatgttgttgctctatcctcgagagattttaatccttgaccttgaggtgaatcagacggtgggtgtgattgcaatagaacgcacaggagttccatttttacaggtatctacaattcataaattatattccccaaaattattaagaatgttatattaaaagaaggccataatcttgcataagtcttgtcttcagttctccactttctcttttcaatttatcaaaagactagcaacactattttagattgttttttttgtctgcacttttgattggtttgatttaccctagaaattgtgactgatcctgagatatttattgaactatttaagtcacatgggtaaagacaaattattttaggattataaatggatattttaaatgtacatttagttttaaagtttgggatttgtctatttttttttcttttgcccatattatctaaatatgagtttgagtttcacagtatatactttattaatctattgtgttttaaaaaataaatatatcatctatttaaaggtaataccctgctttcagcgtgatggtttattttgtctacatgaaaatggttgtataactttacgtgttcgaagatcttataataacatttttaccacttcaaatgaggaaccaggtgagtttctgtctcacaataatgttatatttttcttcaaaattattttataaagcttgatgtggcaaataccagccaaggtatatagttaatgatactccttgctttgaggaagtttaaaatatggttataataagaggcataaaaagtataagcccaagattaatctcttgatgttaaaacagtgcacctcctgtatacatcaaagagagtaaaattttgtgtttcttgatcatatccatgagccaagtagatattattttttggaattttttttttttttcagtacaagtccaaccttgtgtgcctttattattatacccccttgacttgttggctgtaagaacttccattgtaaagtgacagaggttattaagtctcagttgtcaagtcagtcttatcttggagaatggaaataatgtttttgtgaaattatatactgtgtaaagatcaaagtgattttcacatcttttggaaagtacagttattttcaggcttatagactactacaaattatgatggaaatttattcattaattatatatcactgttgatcctttttcaaagtatcgtctttattttaaaatattgaaaaaagatatcttgattatagttgttattttggaaattaaacttagtacagtcattaagtaaattatatttggaaaaaatttagtagtaattgtaaaaagtgaagccatgcttgacattgcattcatgaaggagtgatgcccaaatttagttgaggttttatttaaattgaaacaaacagtagtggtatcgatatggctgctttctgatatttaaaacaattttatgtgaagatccagatccagttcaggagcttacctatgatttacgaagccagtgtgatgcaatcagggtgacaaaaaccgtccgtcccttcagtatggtgtgctgtcctgtcaatgagaatgcagccgccctcgtagtgagtgatggcagggtcatgatatgggaactcaagtctgcagtttgtaatcgaaattcacggaacaggtaaatgaatcaacaggatcatggttttgttttttgtttcctgtttccttttataaaaaatttccataatcataaaaataggagggctggttttctataaaaatatttttaaggtaataattaaggctttagattattagggaattatgtaaatctgctagagctatttcacctatgggtaagatgaatgaataatataaaaatagatagaatgccataatctggacttaatactttgaattcctaatacgtaatgcagattttaagtatgtaaaaccttctaattattatgtctttgcagtagttctggtgtgtcacctttatattcaccagtgtctttctgtggaattcctgtaggagtgctacagaataaactcccagacctttccttagataacatgattggtaagcttttttcccctctaactccatgttaagtattctttctgaagggcaaaattaatagaatcactcacttgtaattattttaaagtcaaaaaagttaatacttgagaaaactagaacatggaatcattctttcctaaataaatcagaggggtttaaaatacttaggtagaaaagtgcctgaagtagcacgggtttgcattatagttgttagaaatagaaaacgttcattcgtgagagactgatgtaaatgaaagcaatgacattaggcatctggattttggacctagagccgatgctgagctatgccatgccaactcagggccttgctgtttgctggttcctcagcttggaatgaagtacatgcttcctttctgtctgctactcctaattcaaaattcaactcagatgttgttttctttaatctcccaagtctaatttaaatgctcttcttttgtttttcctaacagttatcagcatattttaattgtgggtttttttcttctgtttcatctcatcaattgtaagcatcacaagggtggtacagtgtttgattctattttgtctttcccagcactcagcacagtaccttgtgcatgcctgttttgtagtaaatatttactgaaggaataaagtaactgagcagtattagaaaagattattttaactttttgacatgaattatttttatgttggggattctttcaaaaaatcatttttggagataaagtgttcaaagttatttaattatgaggccagtatgtattaaaggaagaatgagagtttgtgatttcaaattttatgctacttgaaattataaggctttgtaaatatgccaagcaatttggacatctaatttttttacagttgtggctatggtttataaaggattttctgttttattatttattctaccataatataattgaaaacgatattatttaggagggtttttttgttgttgttgaaacgctaaataagtgatgcactagaaagagcattggccaggcgcagtgactcacgcctgtaatcccaacacttttggaggccgaggcgggaggatcacttgaggtcaggagttcgagaccagcctggccaacatagtgaaaccctgtctctactaaaaatataagaattagccaggtgcagtggcatgtgcttgtggtcccagctacttagggggctgaggcaggagaatcgcttgaacctgggaggcggtggaggttgcagtgagccgagattgcaccactgcactccaacctgggcaacagagcgagactcgatctcaaaaacaaaaaaaaagcattacattattaattacattaattagatcacatttattgggtacttcatactgtgttaagtgctgtgctaaatattctacatattaccttggtacagctttgcaatgtaagtaatattatctccatttgatacatatgagaactgaggcccagagagattaaaactttaaaccacacagtcacacagtcacacaatggaagagcccaagtgtgacccgggtaatcctggctccagagcctgctccttagcaatggcctccagtcctgacagctccactgtcatcttgggtaagaccatcattcatctctaggcctcagttttttcacgatttctgccagttatgaaatccttttgttcagtgatacttactattatatctaaaattatttctctccactatctattctaccagacataaatccatatgaggaagcctggacacatgttttgcaaaatttattttatcagtaacacaattttttgagttaattcaccttgtctactcttaatatgaaaacttaaagtgaaaagaattataaacacacacaagaacagcactaatcagttatatggagcccataggagtttgaaattttatgctgtttaggtatctaagtgatataaattacaggttttttttttttttttttttttgagacggagtcttgctctgtcgcccaggctggaatgcagtggcgcgatctcggctcactgcaagctccgcctcccgggttcacgccattctcctgcctcagcctcccgcgtagctgggactacaggcgcccgccaccacgcccggctaatttttttgtgtttttttagtagagacggggtttcactgtgttagccaggatggtctcgatctcctgacctcgtgatccgcccgcctcggcctcccaaagtgctgggattacaggcgtgagccaccgcgcccggccaaattacagtttttaagagacaaatggatacggattgtatagcagttcttgacaatgtagttgattttaaagtgttaaataaagcttcgtacttgaaaacattttaatttaaacttttaattaaacttttaatttgaaattcactgtgttcttagtgaaaattcaaagcaattcaggtaaataaagaggctgatttatattcactggataaatgctgatacttattaaggcctaatttgccctacattgtgaattgcctcttatgaaaaatacttgaagaaaaatgtggcattccctggatgtcaactcaaagccaacatatgtatgtgtggcacttacatgttaagcttcccattccttcatatttcatcttttttattttattttattttttttgagatggagtctcgctctgtcaccaggctggagtgcggtggcgcaatctcggctcattgcaacctccacctcccgagttcaagcgattctcctgcctcagccccatgagtagctgggattacaggtgtgcgccaccacacccagctaatttttgtatttttagtagagacagggtttcaccatgttgaccaggatggtctcaatcttctgacctcgtgatccggttgcctcggcctcccaaagttctgggattacaggcgtgagccaccacactcggcctccatctttttttaaccaaagttatgtagagagattgatattgagtatgtggctaatcctaagggatcattttaataggattaaaatgctattttttctatatattttgtggattttaaaataacattattaaaacaactttacagcttcaaaaggttgtatttatcacccactcttagtaattatttatacttttcctttcacactatatacatgtttgtgtttatgtgtgtgtagacatgtatgtatatactcatgcatattctttctatttttggcaagttaatcccaatattctgtagtggtttataggaaggaaatttgtatacctttttaatgaacagtcttgatttcattgtactgtttagatttagcttttgttagaatgatttttattggagtcatctttttagtttgagacttgctaacctaagtacgaatggtatatgtgaaaataatgccattgaagtcttaactattgacagtgatggtgtatatattatacacgtgatttatgaatatatatatttgtatttgttttatatttacttataaaacattttgtaattacactgacacattaaggtttcttattagaaattatgaataagttatttaaatctgtttttcatgaataccaattttgtatgtactttacagagtacatcagattgaaaagtaaccctttcaaaaggcagtaaaatgagaaaaatgtggtacagtagttcactctgcagaaactgttctctaatgcaagttctcttgctttgttctgaagcctgtgtagtgctttaataccaggaacattgactgaaacagtgtttcttagaagacataggtccctgcattctggatagcaggactcgggagtaatctatcctttgaggtgttagttgatgcaatttaagtcctatagccaggtacagagtcattgtgtccttaataactacagccactaaagtactacattaactacattatacttttagacctgaagagcatttctactgaaaattttctttagctttttaagatcagcatacactgtagttaatatatttgttatttttattacaaatcagggcaaagtgcaattgctggggaagaacatcccagaggttcaattctgcgggaagtgcacctcaagttcctgctgacgggactgctttcaggactgcccgcaccacagtttgctattcgtatgtgtccaccgttgaccacaaaaaacatcaagatgtatcagccactgctggctgttggtgagtatttgacctggtctttttttttttaactcactttataagatgtttaggttttctagtttctagaagatcctttattctttttgaggatgctttaaaaggagatagagactaagtgaaactgtaaatactcatcctggaacttaaaaaaaaaaaaatttctgtccttttattccaactgtcttatattgaattggaatgctgagtcttcatccacctgagactggacagtcgagtctctgacgctgtccattcatctcggaaataccaggaggctcatccctgcagtgctgaatcccaggctccttgtctgtaattggaccaccccagtctttatgtcatgtcagttttcgttgggtctttattgactaaaaatatagtcagggttaatagcttaataatagcagggttcttcttttgccaagagttatatattaaatattatttaaagtggctatggtccctataaattaagatttgccttttggtgtgaaattgtgtatttgtatgttataggtagaaaaatttatctgggttccaacttgctgtcacattgatttcatagtaatgtgatgaacctaattttctttacagcatagagaaaaaaacaaaatttagtttgctattaagtacacattattaaaatacatttctccaaaacttctgaaaaacagtgtatttgtttgaaactcaacatttcttcttaagatgctatcggctggcttctggctttctcccccagtctattaacatgtgatttgtggtgaaaacctcaccatatttattctgtggccaacatggctgacttctcagtgttaaagactcatttgggtattactgtttggtagtacccttctgtttttttctgtgcctatcttttgaaagcgatttgatttttatgattcaattgtctatatatgtgtcccgatttatataatgcagataaatgtttaatttttgctttagaaactgttgattaatatttcaccactaatagattttaattaggattcatcagtgtgcttcatatgtgcatgtatgtattatgtcagtgttcctgatttgtcagttaggattttgtcaatttcttggggaaaactacttcttgggatagctatgtaataagagctatggcaaggtctgagctttccattgtagaataagctgtattggtatgtagtgaatatcatttactgaatttagtataacaaagtaaaaatataagtacctaaaagtttgtctagaggtgtcactaagaaagataaataagagttcagctatggaattaattctccttgtggtgcccctagtgcattagatcataggttcagcattgttaaaactttcagattgcagaaatcattggattattatgaagttctgttaattgaaaaattttagtaatttagttattttctcagtgccaaaaggtattattatgaaatagatgataaatgtaaacaactgtacaatgtgtttttctagaatagttttgcaaaagatttctggagttttattcagcaaataagataatattggaatttgcccagcatttttacttccactctgttgctttgcatgaattcattaatctttaaatcatgtgcagtgcaaaagtgattgtccatatagactgttcacttttcttgcttaacttataaaaacactatagagactgaagctttactttctcatgtatgtccgtgtcctttacatttaaactttagacatactacctgagaccatgaaaagctttagaataatacctgtaaactattaattatagtgatgacagaatactaatagttaaccaagtgcttactttgtgccaattactgtgcttagtgctttatgtttccccatttaatctccaacaactagattttctactcttcccattttaaagagatgaaaacacagatttagtgtgggcaagtaattcatccaagagtataaggaagagccagggcttaagcccaggtttctttaattgcagaaaccacagttaaccattatactttactctcttgtcaggatttatttaataaaagagacaaaacaaaaagaaaactttggaaagaaaaatggataaccctggttagtgagctctgctagattgcttatttgaggaccagctataataaaccttctgagtctcaaaaagtataaattcccatgtgtataaaagcttaggaaagtgtttcttcaaattgtatgtgtattaatgtaagttttaaggtctttctgtgaaaaatctattcctggaattaggcaaggcttttgagcacgtgaggttaggcccattttttttataaggaagtggaccagagaaattcattcttctttgtgtgtttgtttaaacacatagtttgggtttcttttataaaagataaatgtgttaagtgattaaagtcttgagaaaagacttttcttgcaaagtgctggaactcccactgaattaatgctcttccatgatgtcattttgaaaggtacaagtaatggttctgtcctggtgtaccatctcaccagtggtctgctacacaaagagttaagcatccactcatgtgaagtcaagtaagtatgtcattgtgatgatgacatcacaaacatcatatcagaaaaaaaattctcatagacttttctacattgagtactctgtaatatctgcagtggtgattatttgaaaagtttgaataatattcatgtccaactaatggctatgttaatcaaggatgataactaattctttgctgtgtaaagaacataagcagtagagaatgttttctcttttattaggttggtgcaaaagtaattgcggtttttgcagttttttttttttttttgttgttgttgttgttgtttgttttgttttgttttgttttttttaaatggcaaaaaacacagctatttttgtaccaactaatattgttgcacctcatttatttctcctaagggccaggctgttttctcactggatatccttacgttgccttgttcaggtttattttatttatttattttgctcaaaattattattttttattattttaaaattttttttactttaagttcctggatacatgtgcagaatgcgtgcatttgttacatagttatacatgtgccttggtggtttgctgcacctgtcaacccatcacctaggttttaagctccacatgcattagctatttgtcctgatgctctccctcccctcacatgcccccgccaacaggccctagtgtgtgttgttcccctccctgtgtccatgtgttctcattgttcaactcccacttatgagtgagaacatacagtgtttggtttttctgttcctgtgttagtttgctgaggatgatggcttccagctccatccatatccctgcaaaggacatgatctccctttttatgactgcatagtattccatggtgtgtatgtaccacatttcctctttctttttttttctttaattttactttaagttctgggatacatgtgcagaatgtgcaggtttgttacatagatatacatgtgccttggtggtttgctgcacctgtcaacccgtcatctaggttttaagccccacatgcattaggtatttctcctaatgctctccctccccttgcccctcaatccccgataggccccagtgtgtgatgttcctctcgctgtgtctatgtgttctcatcgttcaactcccacttatgagtgagaacatgcagtgtttggttttctgttcctctgttagtctgctgagaatgatggcttccagtttcatccatgtccctgcaaaggacatgaactcattcttttttatggctgcgtatttttcatttctataacgatccatcagtaggactgcttatgacaaattcaaataaagtcattttaattgttaatttgtcttatttattctttgtttaaacatcatcagaacgctgcatagcatttatttgatttttaggacatgatctgcttatgagttctgtgtatgcagagctgtccgagggaaagctaaattgacggaaaagtgcttcttgctttctgttccaaaatgcctacctgtgctgtccatagcattatttcgctgaatgcaaggctattttccttttgtgtcctatcagtgatagatcgtagagttacatatataaaatatgaatttccacttttttgtttgttttttgatacagtcttactctgtcacccaggctagagtgcaatggcgcgatctcagctcactacaatctccgcctcctggtttcaggtgattcttatgcctcagcctcttgagtagctaggactacaggcacgtgccaccatgcccagctaaattttgtatttttagtagagacggggtttcaccatgttggccaggctgatgttgaactcctcacctcaagtgatccatccacctcagcctcccaaagtgctgggattacaggcatgagccaccacccccagccagtttccagtttttttttatgatctttcagtgaaagcataagaagtcattttctgttttctgtacattaaataattgtaggtcttgtgtataaaaattctcagtgaacccttagcaaacacattatcctgagtacatgcattttcttaatggagaagggttaaccttttttttctttttttttttttttttgagttggagtttcgctcttgttgcccaggctagagtggaatggcgctatcttagctcactgcaacctctgtctcccgggttcaagcaattctcctgcctcatcctcccaagtagctgggattacaggtgtatgccaccacgcccagctaatttttgtattttttagtagagacaagatttcaccatgttggtcaggccggtcttgaattcctgacctcagatgatctacctgcctctgcctcccaaagtgctgggattacaggcgtgagccaccgcgccaggccaggttaaccttttaagtatcacagcttctgattgtgatggaaatctctgaaaagtttgcattgtcttactgtttcaagtgcattgttgtgtggtgcagcccaggtgactgtttattgccaccttacgctgttcctatacagcatctccccagatacatttacgtggaataataatgtctttaaaagctttgggcttttgaggtgcagtgacacaggtatctgtttggactctttcaggctgttattcatctcttctcttctgttgcagtgtctgtagcttgccattctggcacttctagtagtctctgcttacactgctgaatcttctctctctctctttcccatctcctcttctctcgacatttcctttcaccctgccttgtgtgtctggtgtttccttttatggtcagcactaaccaatcgaaactctccatttaatcactacttattctagggattatgttaactattaatacttcacacgtatcatttcattgaatccccactacaatcgtatggggcaggtattgtatttccagtctacagagtaagaaactgaaaattacagagtaatctgtgaaggagctagatggaattcactctgggcctttgaagcctcagaacctgaactcttcacttatacttacagtgcatgtgctgcatctcctgctaaaatacgcacataggttagtaggaatcatgttggcagtaaaattaaaatgttggctgagccaagatttgtgctaagaatttcacacatgcttctgaaaaatcaaacatgttgtcttttcaaacacagaaagttttaatagctaattaatcagagaggtattaattttaagtaaggtttattatcctggattagtcaggttatagatgtcactaaatacttgacttatacatgttaagataatatttatggttgagtaacattgaaattgattataagtgttacttgggatactaactctgagggatatactacttatcagataaatgtgaatgatcatacaaagatactccatttttatatgaatttttcctcttcattgccattttgaaaataatttgtattttatattcagagatactgcccaagagaacactaaaatcctgctttgtgtttcagttaatgcaattttagtattataatcaaaagccattaagaaaatttcacagaaatacaaaaattagctgggcgtggtagcatacacctgtaggctcagccatttgggagcctgaggtgggaggatctcttgaacctgggaggcagaggttgcagtaagttgagattgtgtcactgcactccagcttgggtgacagtgagaccctgtctcaaaaaacacaaaacaaaacaaaacaaaactttcacgatgtattataaaaatgtctgaatttattagcagtaaactcaaaacattttagattttcatgtccaaataaggttaacttttagaaagttgtttttctaccttttattaagtgtgtttttaaaaaatcataatctaaagcacttgaaggttgtatatactgtgccggggactcatgacagcagatagcacaaagtgtgtgtgtttttaaaaccatgatgttttaacttgtgatgctttatgaatatctgttgaatatcttctctatgcttataaacagagaaagcctttgaagcttataatgcaatggaagatacttagaagtaaacaaaatagagaggtatatgtagattttcttaggtcattagtttgtgtctttgtctggtaggctgaaactactgtcatatgactctctccctggccagattttaatagtcatactaatactgatgtgaatcctgataattaaactatcttgtcattacatttgtagataaagttttggttagaaatgattttgtatgtgttaggtatggtaatacagtctcaaataaaaggtcatgttaagataaaaggtcatgcttactttttaattaatttgtgtaataaaatttaggtctttggaaaacttatttttcaaataaatgaacctttcaaataaaaaagagaattagtttaacctttatctcatttcctattataggggtattgaatggacaagtttgactagttttctttcttttgctacctcaacaccaaacaatatgggattagtgagaaatgaacttcaactggttgatcttccaacaggtttgtttttaaagatccaaataggtttgtcatattgaataaacatgttgccatttataaaacatgtttgaaagtacttctttcaccttggaatttttttttatatttcatgcttatatatttattcttttattctctaataattgccctagaaaggcctcatcattgtttacatggaaatgttgttggcacaaatacatggtaaaatggaggaccattagcctgaacagacagattcattaaaaaataggataccggttctacttttaagtgcattgttatatgtaaccaactttaaaagatcgatttaaaaataactctgtcaatggactttattagagtctgtgctggaaattttggcttttataggaaacacttagaaaatttataggttaaggattgtttttaaatgctcaaatttaaaacttgtaatagtctctggctgaatgaatagagaaacttaatttgggattttgaagattctacagtaggaaacgtcccaataaggtaactttttcagaattgaaagcctaaacccagtgaatttcaaaataaagaatttgaaaatataataaggaaagagtttcaaattattttctggtgtatgcagtagtttcaaagaggtttttttaaaaataaaattgtgatgagtttctttaaaatggtatagcaacacgaatcatatgtagatgatcttaaccaatgagagcatgtgtatgtatgtgtaaaatgaattaaatcaaataaatggttgtaaatcaagtaagttgtaaataaatgaagtacatggttgcttttttatgttctccatatgtattttcaagctctcaaagatccagttgttcttacttctcagggtatgttgctgaacttccaggaatcattcccgtctttagtccagtgttgctgctctagtctcattggaagtgacctgtccactgactctcatccccaagttcctaatttgccagcagaatggtactggccctgtgtctagtgatcccagggataaaatgctgttgtctagtatcattgacttaaaaaaaagaaaaaaaatccctgttttatttgttttggtcagctcaagttcaggactgttagataacttaaaatctgctttgcacagatgtatttttaaggaacaaacatctacagtaacagttacagatttccttaagtgggatatttgagttcatagatggtagacttttatagcctgggcttctaaggagggcagcagactagtgcagtcaggacaggacatgggctgtttggggtataataatagtgagtatagtgagattccacatgatggaatctcaacaaagagtaggaaggcgtttaggccttcagttgtccttgaattgagtatgttctctcttttgtttaatgtagataaaaatctaacacaagatactaaaacatacaaggtagaatttatactttttttattcacagaaaatcatgtaacttcctttgcgggtaactcattctttcacagcatacatgaacaccgtagttattccctagtttccagtttataaagatgttttgagaggaacatgttcaaaatatttaactagtattttgcacatgggacaagaagatcttaaatacatgtttcaagagtttttcccccactagttagtatttggaaacatgggaatgtttgtattaaatattactttaaataagtagttttcgcaccagacaattgctgtaccataaatatcttaaaacttaacattgtttttttaaatttctaaaattgaattatagaattcaagaaactgtgtgacaaatgaaaatgcctttttacaaaataaatatctgaatatgtgatatattattgatcattagtttgtaacacttttaagaatattctttgaacttacattattagaaacagcttagaaggaactgggcgccgtggctcacacctgtaatcccagtgctttgggaggctgaggcagatggatcactagaggttaggagatcgagaccagcctggccaacatggtgaaaccccatctctactaggagtacaaaaatgagctggcgtggtggcgagcgcctgtaatcccagctactcgggatgctaaggcaagaaaatcacttgaacctgggaggcggaggttgcagtgagccaagattgcgccattgcactccagcctgggtaacaaagtgagaccatctcaaaaaaaaaaacccgaaaaaacagaaacagattagaagcaaatggaagaatgaataggagaacagagggtaggatgggtaggactgatcaaattacattggcgtggcttcttgtttttcatacatgttttatgcactgttctcacttttttaaatatttgcaattaaaggtaggagcattgcttttcgtggtgaaagaggcaatgatgaatctgccatcgaaatgattaaagtatctcatttgaagtaagtgtcaacctaaaaaaaaatctatggtgttatcacaatgaaatctcgtggatttttttaatctttaagaaaatgggaatgtgctggaatgcatatggaatctttttagtgatagcaaatggtgatatgcagcccaaagaaaatattttgattacaaaattaagttgctatcacttttaattctctacttctaaaaagatgaagtaacttttgcatgaatcgttatttactttcggataaagttcttatgtacttctatctaagcatggagttactgagtgaaagaactcattttctttatgtataatttaaactcattttgcttccagaaattgagtttttttgtttcaggggaaaataacatgtaaagcagtattattaaaaatagaaactgaatgaaaatcaatcaaaattacaaagaaagagtaagctttctaaagtagttttcaaacttgttttggcttttctaagatctttgcatttccatataaattttagaatcagactatcagttttatcaaaaaatcttcctgagattttgattgggattgcattgaacccatcaatcagtgaggggaagaattggtatcttaacaagttttgtaactcatgaacatggtatgtctctccacttatttaggtcttttaaaatttcagcaatattttgtagttttcagtgtgtaagtcttacatattatttgtttattttgtgttttctttgatgcttttataaatgacatttttaaatttcaattatttattatttgtatattaaaatacagttaattttctgatattgaccttgtgccttgtgaccatgctaagcttagttattacttctagtataggtgcttttgttaattctttaggattttctatagagacagtctcgtttgctagtaaagacatctttacatcttttcgatctataggccttctttttgcttgcactaattaggacctcctgtatagtgttgattagaactgagatgtcagctacgagctgacatctttgctctgatcctggaccttatggagaaagcattcagtctttcaacattaagtatgatactagctgtagattttttgtatatttcctttatcaagttgaaaaagttttattcctagtttgctgagcctttgtattatgagtaggtgttgaatttatcaaatgctttttctgtattcattgatatcatcatatggtgtgtgtgtgttattttgtttttctttttgaagttcactaatatggtgaattacattgattgattttcagatgttaagccaacatgacattcccggaataaactctagttggtcgtgatgtattactgttttgacatattgctggatttgatttattgatatattattaagagttttatgatatattattaagagtttttatatctatgttcatgaaggatattggtgtcgtttttatgtaatatcctttgttttggtatcagggtaatactgaccttgcagaacgtgttgtaaagtattctctctcctttttttttgaatgagtttgtgtagaattgatattattcttactaaatgggaaaaatttattaggaaacccatctgaacctaaaattttctttgtggcaaagtttttaaatacaaattcagttttgtttttttttttcataaatataggactatttagattctctttttttgagctttggtaattggtgtcttccaagtaatctgtccattttgttgaagttgctgagtttattaatttattgaaataagcttgttcatcatggatctatgatcagtgattatctttcccactcctaatatcagtaaattatatcaaccaattttatttattgatcttttccaagaaactacttttgattcatttgattcttctctatgatttttccattttcaatttcattgtctgtcatgcttatcttttgttcttctgcttactttttaaatatgctctcctttttttacatagttttctaaaatagaaacttagataattgaattaagttgattctctaaaatgtaatgtaaacagttaatgctatatgagcaccagttttcctgtatcctacaatttttgttatggttatatgttttcattttaattcacattataatctttaaaaatttccatggggtgttattcagaggtatattttttaacttcaaactatttgggtgttttgccaggtatctttctgtaaatttctactttctgttggggtcacacatggtcctgagtggaagaatctcagtcctttgatacagggagtacagggatcttcctactctgtcacatttcctctatgtcagccatcatttgctgataatattttagttcctcataatgcttattgagtaatcagtgctcaaattatatttgttgaattgcactcgttgatgtcattcagtacttctttcaggcttaacagaaagtgaataaagtggcatttgttgaataccaactgtagtagaatgatagaaactttacatactttttcattgaatgtttaccataatctgtatatcaattaattgaggtacatgatgagattctcctgtcatgtgtgagaagttgagcctcaggagggttaacataagttgtggcatcagggtttgaatctatgccactctttcttccaagttggactccttgcctaattgtgtgagactgtatgttctcttacaggtcacttagagctttaccttcttatgactgttaatcatggtgctaaatggtagtttaaattgtctatatttagaatgcgtcagctgagtttttcaatttactgaactttttatttgctctaattcatggtgaaatttttgcaaaaaggggcttatttagtaattttgtttattttaggcagtatttggcagtcgtattcagagataaacccctggagctatgggatgttaggacttgtacccttcttagagagatgtccaaaaacttccctacaataactgctttggtaagttacaatttaagaatttaatagcttatttaggtatatatgtatgtggtgaatgttttgcttaagcttgaatcaaaatcattactgccaatgtcatttttttggttaaaaatgtgtgttcagagaagatgatctaaataaatggagataattcttattttcttggataaatcaacctaatatcatattagtgcaattccaattcaagtttcatttggatattttgaggaatatggtaaacatattcaaaaatgtttatgaaagaataaaggtcctaaatagctaagtcatccttgaataaagaggagtaaatgtgggaggtgtgggtggggttggcccttcctacctgatattagtacatcttacaaaaccatggaaataaaatcagtattgtattggcacaagaatagaaagtgagtcaacctaataaagagctcaggaacagacccatgaatatttggggacttaatatacagtaaagtagcacaaatcaaagaggatggacagactgtgtagtagacggtgttgggaaaactgtctcactttatggagaaaaatacttgatctctacttaataccgtatagagaagtgagtgtcacaggactaaagacctaaatgtaaaaatgtaaagctataaaattgaatataacaaaatacaaaatattgctgtgacctagaggcaggaggagacatcagaagctcaaaccaaaaggcaaaaaaaaaaaagaaacaatgcatttaattaatcaagattaatgctttttgtttgatgaagatgtcaaagttaaatacagaagacattttgggaaaacaaattttccagtgtctaaatttaactagaaactcctgcaagtcaacagtgaaaaaaagcgggaaccctagtgagaaaatgaacaaagtctgtgaagagctaatgagaggcagagaaacctaaaaggccaacaagccatataaaggaatgttcaaactcatcagttttcagagatgttcaaaccatgatatggatctaccgtttagactaacaaaaactggacagccatatagtgttaagtacgggtggaacatagggtatgggaatccttgtgcattgctggtaggaatgtagaccaatgcagccattctgtaaagcacgctggcagcacttgggcaaacacagacatcttctgtgtccgctgagctcttggtcgtaaatgaacttttgcaaggatattgactggtgtgttttgtcatgatgtgagtttggagaccatctgtgtgtttttactgagagaggagacagattaacaattggctgatgcacccatggagtattacgtagcatgcagaaacaggaggaagaggacttaaatacagtggaaagagtaagaaacaggatgaagtatatatatatatatacacacacacacacacacacacacatataaacacaatactatttaggtaaattagataataactacatgttaagaacttatacatatgcgaggatattggactaaaaggctttacaataggtggaatataaaagaatatataaataaaacaagtgattttggaggaatctatggatgataaaggaccctggttcgagaactgtgattgtcttatcgtgtgcacataagagatgggggaggagacgaggaataggcaatactatcattgaattcattattttcattttgtaagtattttataaaaacatcaaaaggtcagaccttttggaagtttgccataaaagctccaattaaaatgcattcatttagcctttctctaagtaggtaaaatctaaagaacaaatgtggattcatgtgtagtaataataaatgatactgggcagtggtgtgtgtgcccagctcttctggacgattctttgacagaaggaaacctagcacttctaggtttgtctgcatttgctttacaggagtggtcaccatctcacaacttgaagagcctgagaaagaagcaacttgcaactcgagaggccatggcccgccagaccgtagtctcagacacagagctgagtattgttgaatcatctgtgatcaggtacagtacagtgtttcttgacactgtcatttgtgccattagcatcatgtctgggaagttgacaagtatcatcggaaggtgtctatggtagcaagttggactctgcttttgaacatacttagtttcatctttcagtacatacccagattactaaaaagataattttatcatttttagtattgtactatactgtttgttataactaataacatatgcagtaatattcacccatcagcatctagtagtaaatgtgctcattccgagtgcccttctactccatacacttcagcttctgaaattcaaatgaacatagcatagacatacagatagatcatattatcatttatacacaccaaagaaaatgtgttgggaatcctaaatttgtgtatcatccccatccataccaatcttacagataaaaggcttcagagataatgttgggtcactgtacagcctcccttctgttgagcacagttctatagccaaaatctctatgaattttatttttcttgtgttaagtttagatcaccatttctctctgtgcagggtaaacttcctctgatgttgtggctgttaaggagtgattcatgtttacccataattagctgggcaaatattagtttcagacttttaaaaaaatagttttggacctcctcttaatgcgtctgtactttgggcaagttaattaattatgagtatcactctaggggaaaaaaaaacatctttatcatatgtttcactatcccaaagcttgctgcaggaggcagaaagtaaatctgaacttagtcagaacatctctgcccgggaacattttgtatttaccgatattgatggccaagtgtatcatctcactgttgaaggaaactcagtaaaagacagtgctcggattccaccagatgtgagtacaaccttgattaaatcttcatcaagaagattttgttttgttggttccatatccagtgaaggcatagttaagttggaaacttcagaaaagcctaatgtaaataaactttatttaaggagatattatcgattaaacttgttccatactgctagagaataacgctgtaactattttgattaaatgtttactgtgtgctactcatttttatccctgtaataatccatgaggagttatctccattttacccataacaaaactgtgggagaataagtaactttcccaaagttatccagcttactcatatggcagagcagtgttttaaactcaggcctgtctgacttcagtatctgtcttctttccatttcaggcattaccctgaaggatttgacttacaatctagtattatttttggataatagtaatcaggttgtaagtgtaatagtattattaacatttactaacttacatatattcttatggccttgtggaatctgtaactaaagttttgccattaatcatttgtgtcagcatgcatctcatagatagtttttaatagatggatcatgaaaatgtttatgttaattaatgcaggctattataatggttaaatgaaggcatgaggggattttttaaaataggtatatttattttaaattgctatctaaaaatggaatgctctagtagaatgccaacccccataattttataggtggctttggggtctcataaagttacaatctagatgttggctgtggctacagtcttttgaagtgtaatgggacagaaggatctatttccaagttggctgcctcacaggctattgcacattaatgctggctgttgacgagggaccttagttcttcatgtcgatctttccataaggctgcttgagtgtcctcacgacatgacaactggcctcccctagagtaagtgatctgataaagcaagaaggaagttgcagagtctattatgacctggtttcagaagtctcttcaaaggcaacttcttaattaaacattctattttatggctaggaaagtagatatcttaaaatgttgcttcatattatatacagaatttcatttctttaatatttttttttattaatggactttattataatattgatttttaaatccagtttttgttttgtttcttgactattaccagagtttttacggtattcagtgtgtgtgctagtccactaatggtcaattattcaaaccactagagttttcttactttttaccatggataccatttgaatttttatgttgtacaataaatgcaaaaataaaatttcttttaataaatagagaagtaattgagcagtaatattatttaatagctaacatgtattgactatttactgcatggcaggcattgctttaaggcctttgcctttataaatttattaatactagcaacaactcaagtttcatgaacttaccctactttatggacaataaatccaagacagaaaggttaagtaaacatgcctcaaatcacataccagtttcaagctgggattcaagcccaggcagtgtgactgcagagcccaggctgctgagccctccatgataccacctctgagcatctattagaactgcaagttcctttcttcctccaagttagattgactacagcagcatttcattcttatgttgtgcttctatatgtaacttctgagcaaagctttctgtgaatttaaactgcatatgcctttagtaaacagcatctcttcaccttcatgattccacaatgttccaaaacgtgtcagtgaagctctggatccttttttcaatagaaaaatcacggcacaattagttataaaagagctttaagtttcccttggaatggatttagttatccttttgcagtgagagataagtttgagttggctctctggaaaaccttccctttacttctctgtttttcttactttaatttcccccttttttttttgaggtatttgttcctcaaaagacatcccctctctttaaatctagttccagtaactacttaatgtctatgaagttgaaatctcctatttcttcatagttgaaattgataggcaatgtagctctttgttagtgtctaaagtctgttttaggatttgatgactaaaagcatactaaagcacagccctttaaattaagttttattaaaatatttattataatgtcttatacagcatagtgaaatttatatttgtttgttgctgttgttttctagggaagtatgggtagtattacctgcatcgcttggaaaggtgatacattagtgcttggagatatggatggaaatttaaatttctgggacttgaaaggcagagtatccaggtataagccaagaatgaaatcttgttatttcattaaaaaaaagaaatgaaatctttttgttttgttttgttgagatggtgtcttgctctgtcgcccaggctggagtgcagtggtgcaatctcggctcactgcaagctctgactcccgggttcatgccattctcctgcctcagccacccgagtagctgggactacaggcacccaccaccacgcccggctaatttttttgtatttttttagtagagacgggatttcaccatgttagccaggatggtctcgatctcctgacctcgtgatccgcccacctcggcctcccaaagtgctgggattacaggcaggagccagcacacccggccaaaaaatgacatcttgatatggttccattagaggcttgtgacttggcaagaaggatcagtaaactcgtggaggtgtagcttggacccttgggtcccttcacctaaacttgggaggatgggccttgagccaagcattcttaggagatagttatctgcaagtggcccctgcagaagtcttagctgaccttaaagggcaggccctttctgtcagatgtggcccccagtcccagcaagtaaagggttctcccatcatcagacctgttagaaatggaaatagtgagagatgttagacatagcttctggtgaccagatctcactctacattgtattgatgtttttgtttctttgtcttcagaggaatacccacacaccgaagttgggtgaggaagattcgttttgctcctggtaaaggaaatcaaaaattaatagcaatgtacaatgatggagctgaagtgtgggatactaaagaggtaggccctctccatgaggataaaacgtaaataaattgttagccataggaactgtgctttgttaaaaaacttctttctgatttagaaatgaaaagtacttaatgagttcgtcaagtttcccataacaaattattttctttactttacagtatttgtgttctaaaggtaacaactcaagatttatttatttatttatttatttatttttattttttattttgatatggagtttcactcttgtcgcccaggctggagtgcaatggcgcgatctcgacttattgcagcctccacctcctgggttcaagtgactctcctgcctcagcctccctagtagctgggattataggcatgtgccaccacgcccggctaatgttttgtatttttagtagagacagggtttcgccatgttgggcaggctggtctcaaactcctgacctgaggtgatctgcccgcctcagcctcctaaagtcctgggattataggcgtcagccaccgcgcccagccgatttatttattttttaatattatcactgtctctgagacctttaaaatgctgcctatttgtggaagatagattgccagaggctgttcagttctaaacttgaactgggcctttgccacagactgtcttccttgaccatttaatctagaataataaagatcttccttttctgtctggaagtgatgcccaaattcactcttgaaggttcagatggtgagcagtttaagaagtggcagaaatgtgacctttcgtatattggatgtggactggtgtacgtcagataaagtgatcttggcctcagatgatgggtgcatcagagtcctagagatgtctatgaagtctgcgtgctttagaatggatgaacaagagttaaccggtatggaatcctaatgatagggggctttgaaacctgtctttactttgccacaagctcttgtattttggggagagagctgctgcttctgtttcatttcagtcttattttcttagaatctgagtttaagaaaatatattaacttgaagcttgagtgtttttactgctgagatgctgcaatctttgtaactatagatgtcaatcattctcaattcaggttttttaagtgccccttttgactcttttctttggtttgttaacaagataaaagatgtttatgtttataaaaatggcttactcagaatttaggcaaactcatcagaggacataaatctagtgataaggctgctggctttttaataatggccttatgtcttttgcaaccatatatcattgaaaagtcactttagaaagtgttctgagtattatgaattttgatgccaatctgtgactagtaaaatgaccagtcaagcaaattagcagattgcagtatcttgctctgttttgtatggttgttttgacattgctttttaccagaataaaaagcattttagtagaatatactccatatatgacttctaaaaaaaaaaagaatgggacaattgtgaatgcatccatttatcagtttaaaaggcagcttttggctgatgcaatacagtgttcatccttggaagatacttgatcctacttggagtggaggagggaacttcttgcctgagtattctcccagcaaaactttggtgcacactctaggctgatatgtagaaaatttcatgagacttttctgaacctttgtagagtcaatatttggcacttcagacacagtaaggttttaaaaacctggtttttcactttgtgttcatgcttgaggcactactgagttgctgctaatgttagcagggctgcctttaacttagttaggtatgctttggtttttgtcactgcccacccctgcccactgcatttgggcaccaccacttcttactatgtaactgactgccatcaggtgaagccagaattcaagacctacattcccatgtctgtccttgtgtcgtttgccagctctggggaagcaccaggatggcctcctaggaaagggcaagcattggtattcattttaaacctaaaggtattgaggacattgaaggaacttcaagggtggtttttgaaaaaattggttactaattctagataaagaagtgtggaactgctatctaaatgtttgaagagcttttccttcacttttaatataaaatttgaatctaaaaagctccaaagtcaaggtgtagcttgttcttaaattaaactgactacagaaatggagtccattgtattaacccatgttcaataccatacttgaacatctggcctgtggccagattttagatcacatgtttcttttaaaatttttctgatttttttttatattcttttcaatctctaatgttacagcctcagccagaaagagaaaactaaatagcaattgggaaaggtcatgcaattgtgtattcattccacaaattgaacttcaaattcagaacaacccttaataaatgttaaagaatgaaaactatggtagtgtaaatgtggagtgaggaaaaagacatctgtgtgttcacctccagattcatggccgatttggtcttgaggaaaaaaagtttgaggtagtatatttctattctgaggaattagaagtatatttggggcttactgacatgggataaaaataaaataggtcctaacattggtgtttcctatgttttcttcaattctccttgaaaacaagtagagaacgtaaaatattgattcacatctgtacattttcttagagcagcttagataggccacttcttcctccaataaagagggggcagtcagacaaattagaagattagaattcctgtttttgagttggagaacctttcttatcggctgcctaatatgtcagggacacaaagagccatcaaaataaatcttaatagtctttttagcagcatctaaaaggaatgcaagaatatgagactgtttaatagcattctggtatcatgcagtttccacaccctttaaatagtattgacttgatatcagggactgttcaacctaatttcctccccagtgttttttttttttaattttattattattatactttaagttttagggtacatgtgcacaacgtgcaggtttgttacatatgtatacatgtgccatgttggtgtgctgcacccattaactcatcatttagcattaggtatatctcctaatgctatccctcccccctccctccaccccacaacagtcccaggtgtgtgatgttccccttcctgtgtccatgtgttctcattgttcaattcccatctgtgagtgagaacatgcggtgtttggttttttgtccttttgatagtttgctgagaatgatgatttccagcttcatccatgtccctacaaatgacatgaactcatcattctttatggctgcatagtattccatggtgtatatgtgccacattttcttaatccagtctatgattgttggacatttaggttggttccaagtctttgctattgtgaatagtgccgtaataaacatacatgtgcatgtgtctttatagtagcatgatttataatcctttgggtatatacccagtaatgggatggctgggtcaaatggtatttctagttctagatccctgaggaatcgccacactgacttccacaatggttgaactagtttacagtcccaccaacagtgtaaaagtgttcctatttctccacatcctctccagcacctgttgtttcctgactttttaatgattgccattctaactggtgtgagatggtatctcactgtggttttgagttgcatttctctgatggccagtgatgatgagcattttttcatgtgttttttggctgcataaatgtcttcttttgagaagtgtctgttcatatccttcgcccactttttgatggggttgtttgtttttttcttgtaaatttgtttgagttcattgtagattctggatattagcccttcgtcagatgagtaggttgcaaaatttttctcccattctgtaggttgcctgttcactctgatggtagtttcttttgctgtgcagaagctctttagtttaattagatcccatttgtcaattttggcttttgttgccattgcttttggtgttttagacatgaagtccttgcccatgcctatgtcctgaatggtattgcctaggttttcttctagggtttttatggttttaggtctaacatgtaagtctttaatccatcttgaatgaatttttgtataaggtgtaaggaagggatccagtttcagctttctacatatggctagccagttttcccctccccagtgttaaaggccactgctaagcacatttttcctaagtaagcatatatagaaagaagctttctgaaatcagatttctgcacaaacctttcctcttcatctgccacagctttccacagtcattttcggtaatcttggggcattcagaaatgtctcacaatgacttgccgatgtggggaggtctggggatgctaaacaacctggaacgatctggcgcaatgaagaattgtcctgccccaaacgccagtagtgttccttagctctctttttcaccgttcattgaatcacactgaacaaaatcacaaaatatggtcctttccttcccagacttccagctcaccttaatgttgccatttccaagtggtggaggaataacttttttctactgattttcttcttggctctttgcttactgattttctgcattcctgtcatgtaggtagctaaaaacctgggtgttatgattcatacctcacataactttagcccagatggagcagaatccgtgacaaacagcaatgatgctaactgcttttgcattctaattgtgtaattttcagaggtgaatgagctcttgcatgtgagtttctccagatgtgagatgatctcctattactttttcatggctgatctttacctttcagaagaaagatttcaattcatttgagggagggaagtagttaagggtcactttcagtttgttcatgctcattgggatgctgtcaacaatattttgcttttggagaaataacatatttgttttaaaaaataaggtatttccctccttttattcagacttggtaaatgttgtcttgcttgcatgatgtaaacactcgatgctgccttctacgtggattctcttgtatcttttcgtttgttcattgattaagaaattaccacacagcatgagaactttccctgaaccattccaagattattatgtatagttaatttttttccctgacatttaccatttccaaacatactgtgatataataccaacaactatctacatgaatctacctaaaacatatacatatgctatctaaaatatgaatggggctgacttgagaattatatagattgtcgtctatgaaggatgaatagaaagaaagttaagtaagctagccacctgcatccctttcagtgttaagtgttcagtgcttctgtaggtagttagataagcctcatttttccaagatgcaatccttcctttatagcccagatgtaaaagaaaagatgactaagtggaaattaaaaaaaaaaattcaaagcaaaagaaaatctttaataagaataaacgaaagtgttcaataagcaaagccaaatacaaatgattacctggaggaaagtaattcacaagtcacagactgtctacagaggggcaaaacagataaacaaatgatgcttcaacatatgaaatgatactcaactttatttataataagaaaaatatttgacctcctactggtaaggataaaagaagaaaataattttaaaaagtaaatttttaaaaagagaaaaatacaaattaaaattgtttcttacctatcagattcaaaagcttgaaaatatactctgttggcaaggctatgaggaaacaagcactctcatccattgctaacagtaagatccctataggaaggaatttggcaatatctaacagagctacatgcacatttacctttttacccagcaatcccagcgctaagaatttatcttaagatgtacattcataccctgtgaccaaaatgcacacaaagttattcatagcaaaattttgaaaaaagccgaactgcttagccgtaggagattggttgaataaatctggggacatctgcagaatggagtaatctatgcagctgtaaaatagtgaggaatagctctgtgacctgatgtagagtgatatccaggatatgtgtaagtgaaaaatgcaagtgtaaaagagcacgtatagcctgcttgtgtacaaaggcggattttatacataggttcatgcacacgtttgcttactaaaacacacaccacacatacacagaataatccagaaaccaatgagaatagttagaagatgtagatggaaaaatggagagtatggggatagcagtgaaacttctctatctttgttatacagtttcaagttttgaaccatttatatattttatatattaaaaatacacagtgaaaacaagagtgaagaaaaagcaaaccctaaaattgaatgcaagacacagttgaaccaaactgtgtaacaacaatattggtaacataaccacacacacacacaaaaacagttcaaataactaaaacacagaacttcccattcactgcacacctttagtggtttatattctaaggacagaattgctaaggaatgttgaactttaccggggtagttgatggtgacactagtaattctgaagctgttttgtgcatgttgtagtctggaacacattagtaaccaaattgcagttttggggagccaagatctgtgctgatagaaagggagatatggatgggaaatggcggtggtgggaagaaacattccaggggtggatttgggttggtaaaaaatcatgacttcttgaacatgtatgttccctggctctgctcacagagagttttcttgcaatgacactcaatggcagtgagcgcacatagcacccagattttactttgcaagttccatttccaggctaaaaggagccagagctctttggacaaaaagtttatttcaggacagaggcacaaaaggtgcaagatgggtctggggcatcttgtggtgccagaattcaagtaaggaattgaaaaaccaaggaggacctgacataagaggcttctcctgtcaaactgggggtagtctgagcatcacgaaaactaatggtggtattgatgtaagtgcagaataccaaagaaaccctcactccatagtaatagtcacagtaaggaaacgggaagtgggcaagaagcaaaagctcaggtggacagaagaatgccagctgacaaatgcggaaagaataagattagaaaatcaccactttgcagccccgatacaataattaattgtatacacaagcaaggatcacttgtggatgtcaaatcactgagtaaaaggatgtttgagaataggaaattcaatctgacaatatttcctccacatattacttactaattaattatacagtggagaaggtgccctgataagagctctggtgaataccccttatctagatgatcagatttagtgtttcctgtaaccagacagctaacatgttccttctgatgcaatgcagtgaaaagtacacagcatcctttgttcagactctgtcaaaaatgtttaacccgaatctgataatcagaaaacagacaagttagaacgtagggcattctccacagcagctgaccaggactcttcaaaaatgaaaaggtcacataaggccaaaaccaaaaaggaagaggaccattctagattggaatagactaaagagacatgacaatgcagtgtaccagccttgactggacccgatttttaaaaataatacagctgccaggacatttggggaataacaagggacttttgaatttggactgcattttaagtgattttactgaatcaatattaaaattcttgggtgtaaaaaaaaagtattattaaaaatatttccaatcactttctggcttttaaattgaaaaatccacataaaatattttgtgtataatttaatttttatttaactacatagaataaagttttctaaagcagagttttccaatagaaacataatgtgagccacataggtaagcttaaattctagtatccacattttaaaaagtaaaaagagatgaaattgattttaattaaaattttatttaagccaatatatccaaagttttatttcaacatataatcagtattaaaagttactagtgagacattttacttttttaaaattattcattcttcaaaattctgtcagtattttacatttattgtaaaatgaattgccctcaaaatttataggacaaattttcagcacaaacagttaagctctatttagattttataaaattttcagttgaaaaagtaggcatgtattcaagttgtttcaaacatatttaaaagttatccaatgactgaatcaataatcactttttaagtttaaattagacaaacattcatttccttcattatactagccatatgttaagtgactatcatattggatatcatactggataattgcacagtccagagttgatgtggatcactgatacgatttggctctgtgtctccacccaaatctcatgtcaaattgtaatctccacaggtcaggggaggcagctggtagggggtgattggatcatgggggcagatttcccccttactgttctcacgatagtaagtgagttcttaggagatctgatggcttaaaagtgtggcacttgccccctcgctggctctctcctgctgccatgtaagatgtgccttgcttccccttcaccttctgccatgattgtaagtttgcctccccagccatacggaactgttgagtcaattaaacctcttctctttataaattaccctgtctcaggtagttctttacagcagcatgaaaacagacaaatacagtcacttaaataagccaacaccatgtataagtttgtgtcattttacataattgtgtctattcaagggatccatggataaagcctcttcaggattctggaggggagttggtagtaaggccaagttgtaaaagccagggcacccctagaaatttggagctaaggtcgagtccgatagagtgtagggtggtcagagcagagctgctgggcattgcagcctttaggtcttctgcttctttgcactgaaacatgttgacaactaggcaaatcttgcttgttagtgttctaagtaagccagctgctggatgtgggggatgctagggcctagagtctaagaagatagcccctgtgttcaacagctacctttataagtgagacctgggaatgctagtgatcacaggtggcatgatcccttcagtgacatactcaaggttgataggccatgttagttgaatagtctcggaaaaacaaaagtacatacaggtaaatatatttatttttaatatttaaaaataatgaactttgttgctatttgttgaatcattgcattgaatcctttattcaagtagtaccagagttgtataccacacaggatacttaaattttaaaggggaaaagaaggccgggtgtggtagctcatgcctataatcccaggactttgggaggccaaggtgggcagatcacctgaggtcaggagtttgagaccagtctggccaacatggtgaaaccccatctctactaaaaatgcaaaaattagccaggcatggtggcaggtgcttgtaatcccagttacttcggaggctgaggcaggagaatcgcttgaacccgggaggcggaggttgctgtgagccgagatcgcaccaccgcactccagcctaggtgacagagcgaggctttgtctcaaaaaaaaaataaaataaaaaatcaaaaaagggggaaaagaaaaatatgttaatcagatttgaatgcagagactctctctgctcttggcttgtgtttcctaagcggtgactacattgaatatactctcagttgttccagatttacctgttgctctctgctgactgctctgtaaatggtttatagctgaagcttcactgtagtataaaacttcattttatttttaaaaacctttctttgttgtctagagcctgtgtggtgcccctatctccttgttccaagggcctctcttgccttgaaagccttcttattacaccagccttggaatggacagtattctttggacatttctcatgtgtaagtttttcacttttctttttctttcataatttacttggggttgaaagacacccatgaaagtcagccatggcctgtactccagcatttaaagggaatggagcctttaaagccgagagaaggcagagacactacagaattgccaggctgcctctgggttctcgggcctttgtggaagtgtgggtcagtgaggagctgtgagggcgtgtattgctctcaggtggctgtgtgcttgtcttatggtctgaacatggatgtgtcgtgatgatgaaaaggatgcgtgtgaagagggcaatggaaggcaggagaatttggagccgggcacgttctttttaaaagcagcatcattagcttcagggatatactgtgtcttaaaaatctcaatatttgcctcattgcaaaaaaatattcacagaaactattagtgtttattaattaaattcacaaatattactgaactcctgccatgtgcagcacggatggaggatttaaaaataatgccaggaagtgtctgttctccaagcactgtctcctcagaatattcattctgcagagctctaaatgagcagattcctttagtaacattgttaagttcttcattaaaaggaatctaaacctgatagattttaaagcctgcttataaatttcctggtttcttgaaagccaaggagactttctttactcattttcttgtttttgactcaataagataaaagcagatattaaagttgattggtggggtcctgagtagattgttgttattttggtctataaccaggtttctaaccaagaactacgaagaaggttatctctatattaacacaacttttttcaggtgaagaaatacgtggttttaagtgaagagataatgaactcattcaaaattttttctttacagtgactatccagaaaatgaagaaataaagaatctcctccaagaacagttgaattcattgtctaagtaagcactccatgtttcattagaagataggaatatgagaaagaaaaatgcaattcaactttaaatgcaattcaaaattaaaataagttacgttttagaaaatattagtggcccaagaagagaccattctgtttagaggtttgcttcccgttagagtctgtgttttgcagaaaaagtacttattcagtagttacagtgacagagcatctgtcttcaccaagttcatgagcaccagctgctctgatctcacatcaaggcaggactagatgcatagtgggagcatccttgtagctcagcttgcctctactacaaacctccatgaagcctcacagcgggagacgaatcgcagggtgattctgggtctgcttcccgcttctaaaatgagttctctgtgtcaggtgctggtgtgcacaggtctggctaagaaattaatgtgctccctagagccaagggcatttaacagaatgtactgggaataagaaaggaaaaaatatgggtctacaaggagttcttggggaaagcgtaacacatttttgcaatctagaatctgttacatataattatagtatttaacaaattaagcatgatattttattgacggaaaattcaaaataattagttttttctatgcaaagattaacatttatgtttaaatgggaaactatagatttaaagaatgtcttcctttctgatttgtgaatattcagtattttactattttagaaatacgaacttataaaagcacaagccattcttccttagatactttatttttggaatagtttcagaataaattacgaatgtcatcttctttaaagtatttactgttcttgatgattttttcaacaatggcattcttgttccagtagttaggcagctaatactttcaaaaactgttgtaagcctataaaccagaaatgagagcgctgcagctccctgtggtggctgaaagctgctgcttctccaagccttgagaacactctcagcccccttcaacttttataatttcagggtcatggtaaagtaccttgtcttgtgtaaattctaaacatgttatttgactggaatttttcatttcaagagtatattgatcaacccccatgctttattgtttgattgaaaacttttgtctcacttttgtccggatttcttccacagtgacataaagaaactgttgcttgatccagaattcactctcttgcagaggtgcctgcttgtttcaaggtaatattgtttgatgtattctgtataagagacaggatttcaagttaactcatttcttttaagggtttttagttagaaacacttagattttagaaaaatgtatcagttcatcctttagatttaacttaaaataattttgacagtagtaataacaaatagggaaaaatcaaattgcattttaaatgtgagatctaggccttctctctggaaagcacttcctcctacagctttttaaaatatgtgttttaaaatatcagatacaggtatatttaaatataccaataaattatatttagaagcgataacctctatatcctgacttacagtagagtttgtcacttataaaaaagactcctctccccacagaataaatagcacattactttcataccttatctagccagttatcccagaggaacttcttcctaatgtgaatcaatggcccacattgaaaggtgtgctaatggcaaaccaggtaaataattgttcttaacacagaacagaaagatgctggagtctgaaggggtcctgtgcagtcaggcccccgtattgttgaaggcccagtagcagggcaggagaacttgctgcctccccctttcaccctgtcaggccccatgccagtatcccagtggatatgtgacaacactcccttccagtccctcagtctactctaggaagccatccaggccaggtgtgctgagtgcagtcaaaactttgcttcatccttgccaggctctatggtgatgaatcggagctgcacttctggactgtcgctgcccactacctgcacagcttatcccaggaaaagtcagccagcacaacagctcctaaagaagctgctcctcgagacaaactgagcaacccactggatatatgctatgacgtgctctgtgaaaatgcctactttcaggtagtctgcttcacacagcaaaacctttagagctgtcatcttgattacttatatctttgtcaatatcttaaacttgggaaactttcaaactaagttactgttcagtaatagaaataagcccttgaaaattagctgggtgtggtggcacgtgcctgtagtcccagctactcaggaggctgagggaggagaatcacttgaacccaggaggcggaggttgcagtgagctgagatcacgccactgcattccagcctgggcaacagagcaagactctgtctccaaaaaaaaaaaaagaaagaaaagaaagaagccctcggtacatttgcattaaaaaaaaagcctgatcaagatttgaaaagctcatagacagttactgcgttgtttactaaacattaaaattttattattaaacaggcttgtttaatttgtcttacatttttaacttggcttcattttaattctgtcattaatttcctataaataacaaatactttatacacttggtttgaatttgctgttcacatgataatttctttaacctcctgcagaatccttcagtgcacataggtttttcatccggctctacttaagtgtcagtttctgtaggcaggcaggtatgcatccaagtgataatatctatcaacatttttgctgttcaaattcttattaaatgtttggggtgctgtaaagttgattatctagtaacctgaaaagtcaaagtagtttattaaaatgatcttattaagtacagtaaaatttaaataattccaaactcttataatccaggcttaatttttcttttttttccaattctagaaatttcagctagaaagggttaatctgcaggaagtgaaacggtcaacttatgatcatacaaggaaatgtacagaccagctactgctcttgggtcaagtatgtcagtttttataactctacatgcttcattaaattgctagttaattcgtatttcagagcaatatatctgtatgtatatatttcataatattttccccttgtatgtacctccttccctgtagacagtttaggctttctttcaaaataataccaataaacctcatgagaaaaaacatatggttaaccagcttgtaatttagacttccataatgcccagtggagcccagctatttgttttgttttgtttttgtgtctgaattgactggtacaaagctaaaataggcaattactcgagcacctagatacaccagcctctggctttatgtttgtctcaaaaaagtagtgtagcacctctgtttaatgtttgtatttgtaaacaaaatattcaattgcattttttgaaaatgagtgttttcctttagttttctaccttatgaattttaaaaagttatgttggaggaaaatgttctcataattagaaaaaccgtttctcttactagacagacagagctgtgcagttgctgttggaaacaagtgcagataaccagcattattactgtgattcactgaaagcctgtttagtcactactgtcacctcgtcaggcccctctcagagcaccattaagttggtggcaacgaatatgattgccaatggcaaattggcaggtaaggcacacttgatatgtttgtcatctctctgaaaaatgagaccttgttcccagcaaagtatctgattagtagggacatttctttctcttttacatatgctgaagaaaaatagaaaaattattgctacctataaatcagatgaatataattgtctaaaccagaattaattgtttacacttttcagagtgaaagggggcactgttaataattgctgagataataggcataaatccaacaatcctaggcaaatcagaacaataaaacctgtgagagaactatgctctccctacttattctccagactgtattgtgcttcctaccctggttacttgagtaataacagtaaaactcttaatattatgtttcagaatttaaatcaagaatgtcttcagtaggtataaaatgggcacgactagataaggtcaaatggggatttaactttttaatgacttctcaaagaaggagctgcagtgtcacttaaggggatgcgcttttgtctttcagagggcgttcagttgctctgcctgatagataaggctgcagacgcctgccgctacctgcagacatacggcgagtggaatcgggctgcatggctggcaaaagtaggtggttccaagtttcaataggtgccctcaacattcgggatagaaagctcagtcctgaactttggacttatgacttagaaacattttttggcctgcaaagctgctttgcaaatactgtcttggaacctttatccttttcctattctttatgagtgtaaattgcattacttatttaaaaatggatcttgcattggtagcaattaagtaaaagcagctgcctcctctttctcccagagtctgagccgaaactacagtccagaggtatagccaggccctgggtcccgtaggcacagaccgttatcattattcagagtatgcagcagcttcagggcagtgtgctagtcaagcagagcatagcctgtatttcatagaaacagatctcactttaactgaattattattttttctttatagagtgcaggatgtttttgttgttaacacaggcgtctttctcaggtccgtttgaatcctgaggagtgtgccgatgttttaaggcggtgggttgaccacctttgttctccacaagtcaatcagaaatcaaaggctctcctggttctcctctctctgggctgcttttttagcgtggcagagacgcttcacaggtaaaccgagagttcacatgggctgctcaggcctgcccgtgagcagtcacttcatgttctctcgcggttctagcaggtcatggtactcgatgtgtaaagtgaaaggagaagtatacatttcaggtttgtcaaaaaacccaaaggagaatggaactgtccgtattcattacatcttcattcggtctaggagctatgctagtttcctactaatatgctgatcagacttaacaggcacctagtaaaagggaatttaaaagtcttcagagaattggggtccattcagctttgactagagcaactgagaggaggcccagagagcagggggagaggcgacagaaggcatggtgaggtggagacatcccgtctgaaaatctggaagaggaacaaccatcactaattgtggagcatttcatttattcaaaactaagggaggtagattacggaaatatgacaaaagattacttgtcaactctggacaggggtacatgggcacttgtcatatctctgtagatttttgtgtatttaaactatttcacaattttttaaagtattaattttaaaaagcttgtgtttggagatgtgagtattcttccctccttttttcaacaaactagggcttagaaaagtgcttgtatcttaatgcagtatgcaggtttccagggaaaatgtgtaaatgtctttatacccttcgatgctgctgcccaccagtgatgtaaatcacaaagcataactcttgttttgttctgttgagcagcatgagatactttgatagagcagccttatttgtggaagcttgcctcaagtatggagcatttgaagtcactgaggacacagatatcctttgcaaggttgtttgtagtgacgaggaagaaagtgacatgcatgggttttggaatttcccttagttgtgctgcctggacaggaactatattatattgtgaaagatccatgttctgattttctgattcaccaaagccaggaaagagggagaaattagaggacaaagaatcagataagaaggtggctgcaccatgggtgtcagctttgactaggatggagggaggcaggaaggactatagaggacagggcccccaagtcttgtctgaacttaaaaagaagatgaaggaatgatttgggaaacaggtagaaggacctggtactttgaaatagtactttttcaagaccagacattccatggaataaattttatatatttatctagaaaaaatatactggaataactaaaaaagtctcacgatcacctctagtgacaatatgatatgggacaaaatacagcacttaaagagaggtgttgctcaggccagccactataatccacccatcagccagaacattttatttcttctaaatggcacttgagcaacattggtttctttgaaaagaatgaacttgagaatgcaactcccaggaccagaaaagaatgaaactgggccagtgcttgcatggtcctgctgctgctcactgcactttgcttcaaattcttacatttgctctcatttctacatggcaggtacttggttctctctctctttctccctctttctctgtgtgtgtttataatttttttttttttttaacagagaattaaaactaaactaaaaattttttttttcctttttttgaggtaaggtctcactcttctgcccagactggagtgagtggcacgatcatggctcactacagccttgacttcctgggctcaagcagtcctcccacctcatcctccccagtagctgggaccataggtccacaccattgtgcctggcttttttttttttttggtagtaacccgggtctcactatgttgcccaggctggtcttgaactcctagttcaagcagtcctctcaccttggcctcccaaagtgctgagattacaggcatgagccacccagccctgcactgaaagttttttaaaattaaactgaaggctgagcctactcaagatcatgtacctagtcactgggaaggtgactggttcagtgtatgcattttgaggatcaaagcatcagcacagagtacccaataggctgtttaaaaaaataaaaataaataaaaaaaaaccaataggacagggctttctaaaaacccaacaaccagatatagggaacattcagaaataaatatctgcccccaaactgccagcctctcagactttcaaatggaatgaggatatgcaggttaagtttctcctctcttatcattcatcttccaatcttcagttgagtgtaggttatgggaggatgttggttgggtcttctggaaggagaagctttggactcagctggtacgaaaggtaatgatggtacagactgagacatggcctactatggccgggaatcaccctctgcccgcgaaaagtctcctgtgttcatcctgtgctgcccgctgtggacaccaggtcccttccgagcagccagcagagcagacgcgactcacccttcctgcttctgggagcctgtgaagagtctcatcacagccctttttactcttcttttccttaactatggtttacagaaactcatcactgctatatatgcagattatgcccggagtttgaagaacctcggttttaagcagggagcagttctctttgcttcaaaagccggagcagctggcaaagacttattgaatgagcttgagtcccccaaggaagaacccattgaagagtgacagcttaataaatgccagggaatctgacctggaaggcagatgggagggggctggtctggctgtggccaccgtcacagtccaggatgaagaggagtacagggtcctgtgagctgtttgaccactgttctaagactatgtgtgcccaaaagcacataagcatctatgttgagagtaagtttgtatcctgcgttggtctcagaaagaacgtgaatgcttaagattttgaaagtacataatattttatactttgggagagagctttaagagtccctggaaatactttttaatttttttaacttaaaattcaagagactgaatcacttttctcattgattaaatgtaaagattattgagaaacctatagtaaatgaaatttgtgagatgttttctcaaatatatgctgtgcctgtacttatatacagtctttcaagagagatacaaacaaggcagaaacatttaaactagtattaaaggtagtttaccaaagcattttttgttttcttaccttgaaaacacagaaccgttaattccttggtttaagcagttgctaagttttgtaattttaggctcagaggaccataggaggttttaagatttatgtttagtccgataggtgaggtctttgatattttgaattttaactccttttatgatacatcacagtaacctcatttttgaagtctttctttgtactttaatgttctctctgttctaatagttgaagtatgagatgtaactattataaactgttgctgaaaacataaatgtctgtaacttacaaacatgataaataaattaaaaattccatccagg

SEQ ID NO: 2345 - DNA, 116637 bp, Homo sapiens
cacagactttttattttattatttatttcttttaatacaaagctttggcattagcaattttatgaaaaaataaaatgtactaaaaataaatgcttgtgtggcatgattggtaaatgatgcacaaaaataggttcttttttccttcaaggcaaaatcagtcagaaagcaggttttttcttcttcaaaaccattctaccctatggaataaaaggaaaaaagaggtcataaattaaagagtagtcaaatgtttaaaataacagagaagtgaccctaactgaagggtggcctggctgtccccagctagttcccaacccctctggtaaggccaggaagccattaagtgttttcccaaaatcagcagtttcagatctgcagttgactgactcatccatcttagaggtgctttaatactcccaaaaggatgaaggaaaaggtcaggcccatggcgtgttgtttaaatacacagggacaattatcatacaatttacaatttttcctggtttaaacacatgttctgaatgctgagggtgctgaaatctgccgctgttgtctttaaaaaatgctcctcttacctctcaaacaagaatgtcctcacttattttgaagtgatagggatgtatggctgtctcacaggaatcctccagaccttgtgtgtgtttctgtccttgcatcaggtgtaaaaacagcctatgaccttttgacaagcccctgcgctgcccgagctcctgctgccctctctgcagccctgtgctgtggggctgtcctggctttctgatgccttggattcctgctcatttccagggtccccaaatcaagctgttagcgttgatctttttctttctgctgagctccagatctctgcttcaaaccatataagctttggttattacacaactctctagcaactcctgatttcagctcctgctcgccaccctgacttgctccttcaactccctatttttacctaatctatcttcctgccttcatgccctaccacagcaagcaacttcgcagccactaggaatatctctctgctgaaaggccttagagcccattaccagctctttataagaatcaagtccaaaatctgtctcctgcctaccgtcaccaccacctacagcagacacaccaaaccacacaactcgctgatcctgctctgtgcggtcctcactgtgtgccctaattatgcccaggctggttcctaagtcactcttccatgcagccttttcagctcccccaaaggtaaggcggcagctccgcaggcatgacccagaagggcctttgcgtactccctcactctccagccacatcagtacgcacatgagggcatagccctgagctctggcggggccagaccaggtctccattaccttcagcactgcgagccccgtgcttggcacaagcccgggagcctacttgggaaacagcatctcaatgaatgagggggcgttgtcaacttttttgaaaaacctctggtataaaggatattcacaacttcacataaagttctgtaccttattatttcttgtagttcctatttaaggtaacacattttctaatatttcctcagaaaaactggatattagatataaagaatttttaggggtaatttagttttcaaatctactttatcttgttgcctcttaaagaaattataggctgggcctggtggctcacgcctgtaatcccagcactttgggaggctgaggtgggtggatcacctgaggtcaggagtttgagaccagcctggcccacatggcaaaaccccatctctactaaaaatgcaaaaattagccaggggtgctggcaggcgcctctagtcccagctactcgggaagctgagacagaagaactgcttgaacctgggaggcagaagttgcagtgagccgagatcccaccactgtactccagcctgggtgagagagcgagaccctgtctcaaataaataaataaaataaagcaaaataataaccactgccaaagagagcagagaagtgcaagttcccactgcctttaatactcatgttgcaactgcatttttaggaaaccaaatttgtctccttcaaccacattatttggcactatcctcctctctgaagtagtcaaatgcaagcagtttaaaggaaaaggttggaaccagaggtgctgggtttgaattccagtggccttcttcctatggcatcccttcagagtcactcaatccctcgaagccctactttattcttttgtgtacatatatctcacactcagattggctacaaggagaataaataccaagagaaagaaaaggatccactatccagcaatacacctcaaacagaggttaattttaaatcttttctggaattgttacaagacgggctgtgtgagcaaaaggttatcaggttgagaactaaaaattcaaaattcttttttttttttttgagacggagtctcgctctgtcgcccaggctggagtgcagtggcgggatctcggctcactgcaagctccgcctcccgggttcacgccattctcctgcctcagcctcccaagtagctgggactacaggcgcccgccactacgcccggctaattttttgtatttttagtagagacggggtttcactgttttagccgggatggtctcgatctcctgacctcgtgatccgcccgcctcggtctcccaaagtgctgggattataggcgtgagccaccgcgcccggccaaattcaaaattctttagacaagtgtttctcaaaactaaagcatacaacctattaatggttataccatcaatttaggagttaacgactaatattaacaacaaggcacaggactgactacatcagagaatactgcatgcagtcagggaagtgtgtgaaatttgtttcagttacacatgggagtactgggtcacaacacaaaatgtatctcttacagtaggaagatggtttttagaaagtctgaaaaacactgcttttgatatttaaggttctaaaagaggtaactgaaagagaacccaacagctctcctcggcctctgatccctcctaggaacaattcaagagggaccctcagcacaggacgcatctcagagccttctacctgatctgaggtcggcctgtgaacaggtctatcctgtagcttctgtctgaagaatcaggtcctggtgcaggctcgctagctttcaaagtgtcccgtgttttggacggacaattttaactactacaaagttgtttctttctttttttttgagacagagtttcactctggtcacccaggctggagtgcaatggggcgatctcggctcactgcaaccttcgcctcccaggttcaagtgattctcctgtctcagccttagctgggattacaggtacctgccaccacacccagctaattttcatatttttagtagagatggggcttcaccgtgttggctaggcttgtcttgaactcctgacctcaggtgatctgcccacctcagcctcccaaagcgctgggattataggtgttagctaccacgccaggccacaaagttctttcttatatcaagtggaaatctgcctccctgtagatatcgccagagctccagaaatacagagtaagcatcactctgtatgcactggttagtcaacatgaggctcttttgagtattaaaccaggcaatacgggtaaaagagaccagtgcaggactaagatcttggtaggcattcaataaacagtagttattctcatctttgttattctcatctttaagagtccttcaaacacctggaaacagctctcatcttacccggtcccctctcttccaaaccaagcatccccaagacatcaaataattaaattttcagacccttttatgctgagtgtgctagtttctcaatattcctcttaaaaagagtactgagcactcaagcctgtaatcccagcactttgggaggccgagacaggtggatcacaaggtcaggagttcaagaccagcctggccaagacagtgaaaccccatctctactaaaaatacaaaaaaattagctgggcgtggtggcgggtgcctgtaatcccagctactcagaagactgaggcagataatttcttgaacccgggaggtggaggttgtggtgagctgagatggcgccactgtactccagtctgggtaacagagcgagactccgtctcaaaaaaaaaaaaagagtactgagcaaaataattcagaaatactgagagtaaaatagaaacatcattctttttgtataaataaaggagtttatatatataaatttctactactacactaagaggaggaagatcaccgggagctttctggtggacctgctacaagaagccagggcttcctgatctccggtcatgccactggatcatttgctctagttatttcgtcacctttaccacttcagattcatttcctcatgccaagatttttttgaatcttgaataatgagctaccgttctctgcaaatcttagaacgtgatttctatgaatcagaatccagcaatgggaaaagggctctaggggatacctagtcacgcctcccactaaacttcaaatctctactacacatttgtatatgttcctcaaataaaaataataaaaatatttatttttcttattttgagggaaaactagagtgacacaaatttcagttggtaaatgttgacatttcacaaggtttatatgaatagccaagtagagcagaagacctcttttgggaattgaaattcagtaacctcgcttacctaggtactaagaaaccgaggtgtgagaagccaatatgtaaatatatttaccttgcatttattcacttctttgactaccatcctgtttatatttgcaaagtttcaaaatttaccagatctgtttgcagtgttaaaaaaatttaatgtataatcagtcgcagtactaaataaacagtatttcatcataacagaagggcagtgactccaaacacaagggctttttgatggacttctgattgaagccaacagcacgaagcccttggtcaatgcaccgagcgtggtgaggaagggatgggggcttgcaccccttgtggggatcctccttgtgtagttagcaacccacccatgacagggggccctagaccacctgggtcccacacactgccctgacatcttgcccacagggtttcaacagtgagtagacagggtcaaggacttgcttgaacagtaatatacaagaacagtgactagtaacactgccagaaaggtaaactattctagtaggtatatgcatagaggtggagtttagtatcaatttttggacagtcattaaaatgccaagagatgaaatctatttatatatgactatcttacaaatggatgaggttacccagaaaattaagccagggcaattaaggtgaaaaaaaaaaaaatcttattttggttgtaagtttattggtagataaaggcaaaaacagaaataaaatagatgttgaaaaattcattaataacgaataattacaaatttgtttgctaaaataaacttttctctggaataaaatcagtaggaatttttcattgatatttttgagaaaaagacattgggtaagagtactattatctttcctatcatctgccacaataaaaactgcctttaaaaagattaagtaattcatgcttactgttaaaaaaaaaaaacacaacacataaaagcacaaattgaagaagacgttgccccagattctaaagtaagataatcaccacattctggtgagcatccttgctcgtatccacatgcgtgcatacacaacatgcacgcacacacacactctctccatttttctctctaaatgggatcatgaatattgtccttcggtggttttgactgaaggcacagaaataataaccaaatgagcaactgtgaaatcaaccctctacaactgctaatgggagaagggttgaactaagtaaggcatggatctaagatccatgacttagattctgagtcatgcaggtatttaggcatggaactaaaatattacggcccacatactatgatttctaataggtaacatgtctactgagcactctcattttaatctgatgcatgaactgaacatcagacagattctgagtggcagtcaggtgactattaaactacccaataattctcgaaaagtgcctagtgtaattatttgcttgtactggttatcactcatttgtgaactttttaagaagtaggcttgtattactatcttgcctgatgggttagcatgggaataagcaaaagaggtggctgtgggtgaaataagtgtttccctctaaactcaggtttgaatcacagctactcacagagctactatggtactgtgtcccacttcacagaagaaattaaattcacttcccagacaataaaggcagatggtcatctgactcacacaacttcaatggcactgcagtggcattggcttggctaacatttattgagcacttcttatgtaccaggcactgtgctaagcattttataggctgattctcataacaaccctgcgatatggtcctagcattatctgtttatgaatgactacaaggagcttcaaataaatataactgcccaggtcttacaactgaaaaacggaggagctgagagtcaaatccaggtgtgtgtgacctagagtctaaggaattaggtgcgccatgctgaaggaaaactgcctgggtggccaacagcagcagctagtggttcacctgctggatgaggtgcagtgctcctctgaaggctggggaatgccacccgaccctgacatctgtgagcctcaacatgtatggctcacagatgccagggggcacttcttccaagtatctagccccagatgaggttagattgaataacacatgccactgcaagtggaggccacttgcccattgtttctatagatgtcaattacagtttctatagccagacaatgggcagtcaattacatcaactgcatgaggtaatcagtttggttattactcatcaattaaagtatcaggacgtaattgaatatggagatcacgtgaattccacccatatcaacctaggttcaaatttgggcaggaccccagggttgctttcatctctaattagttttcatgaatattggtaaaagaaaggactgaacgatatcctcagtaaatgtccaaaatttagaacaaaacaaaacaaagcaaaaataaaaaaaccctttctataccttatccctatggaaagctactcttggaacagcattggatcaaaatggaccataacagtcatctagcccaatcctccatcctctcaaaacacctcactacagcacccctgacaagtgacatccagcctctgcctacattcccagtcctgagcgtgccctacagcaaaccatcccgccactaaccaaccccaccgacagacgtccttccttttaccgacgtgaagcctgccgtcatggagcctgctctttggtcgccattttgcccatggagatagcgcttagacttattttctcttcctcctcacagctgtcctaacatctggaaacagcgggtctttcaaactgcttctttcctgcaggccaagtacccaaggcactggtcctgaccacaggcacggccgccggggcttccccagaagctagacatgccaggctccagatgtgtgtgatgaacgcaaagtgggctcttcccatcagcgatgaggatgctgacagccttttacactctaagactatactgctcctttgccacttgcattacactgctgattcattctaagcctgtggctaatgaaaacctctggatcttttctcaaacgggctgctcttgttgaataaggtgaattcccaatctgtgttactgactaaaaatatatgctcatgaaataaagtattttgctagatacgatcccatcaggatccgtatgaaactggtagaaagccagttctcaccaccttcatgaaaactgctccatgtgttttcctgggatcatctggcacatgcaatccaaaaacaatttgttacttactcattagcattcaagctagctgtggctctgatgatcatgtagcagagtgtgagggcactgaggaggccaaaactggcaataataaaccattcttctgttgacaaaggaaagggaggaaatcactctggggagaaggtttaagtcaaatcgatgccaacatttccctcaaatgcaacgaagcagacgtcaacggaggtgtaagccaagattggcccaaggaagtgaagcaggaggtttgccagagagctactaactggagaaggttagtggaagtactggtgaaagctgcaagggagaaaggaaagcatggctcaaccatttcttccatttaggtcctgaggtctgtgaggagtgtagccaccaaaaagtgtgcggtgaaaatatgtatataaaattgcacaaggacatagatttttttcattgttaatgtaaatgacagtaaagtagactaagcatatttataaccttctttccttcttcattctgtcatttctgcagggctttcattcttagtcaaaggctgaggagcacggagcagcagttctccaggtcctgtgggtgctcccagccgtctgcgagccggcctcccatggcatccatggctacattcttctctcttatgcatgggcttacttaggatatttacgtaaaaaggacatctcactggtgtctcaagaaagtagaaactactcttcccaacccctgccgaggagcagcactggctgtccaggctgtgacaagcacaagtaggaggggcgggcgactgaccgggtacttggccaccacagagctgaaaacctctggtgcttacaacaataaggatgtttactagactgtctctctctctccatccagatattctcctttaccttttcagagcctatgttgtcaaggtaacattttaaaaacagtatttattgagaacctctaaaacaacctaagaaccaatctgacttgctaaaaagtcttaactataaaatatttctttgagtacacactgactagggctgttttaacaaaatgttatacaataaaattacctatatatgtgcaagaaggcagagagaactctttacacgtggactgccaaatgttttatgcacaagctgtatacagcatgtgtgtttctcaatctgggttccacaaatcctaaccctgcatgcagaattgtgtgtgcataggcatttttctagaaaaacatacttttgttagattttaaaggtggtgactttcaaaaggtcacgcagcactgctcctggggacttccggtccagagagtgctctaggagcatttctctgcccaccttagcttgtgttattaaaatgcttagtaaacccctatcttttagacaccagtgcagccacggcctctcaaattacaaacttcctcatcagtagattgaagctttttatttaatcagcatgaacattcaaaaacacatataaaacccaccatttttacctgtaatgttttaagttagggaaaatgtatatggcatttataaaaatcaagagccgaatgtcatcatcatcaaggaacttaacacagtatcctcttttttcttcttggagacttttatatatgatatgcagactaccttgtagaacttcgtcacatctatgcttccaaattctgagtctaccatcccgtatttgcatgtctttgtgtgtgtgtgattgcaattttaaaaactagtaacaaaaggaagtaaacaccatcataaaacacccaatatgctggcagcatttccacagtgcccccctgcagccggcctggctacctctgcccccagtgcctacttagcacagtgcctggcacacagtgggtgccagcgggaggcactgtggttgctacggtgcccagggcttcggagggaaagcagaggtagctgtggtttagttcaatcacgtgggttttatttattaacatcatgtgcaaattctgctaaaggtgattaatttggtatatgaagtaactttttttcatcaaagtataagattttgaaaggacatttctacataaaatgtaatgggatcagtacttaatgtagtaagtagtaggtgctcaataaatgtttgatcaatgaaggacctgaaaaactcactaataaaccaacaacctttgtgtcctttattactactcaatcaagttttaaaactgtagaccataaaacctcaacgccaaagtaagaaaaccatgaaatgctattaaacgaatcgagagatggtgagaaatgagccaaactacactcaaagcacagttttctctattgcatagctgaatgaagcctccctgagtttacacagatgacagaatacaacctgggcaatcattttctaataataatgtctggttggttaaaaacatgaatactttgattgaacagaccacacgagtcttaacatgtgaggagaaacattttgtaacagtgtcatccatttcactgactcccagactggagaagggtcccacgagcctcagggcgtgacgtgctaggcaagcagcagcaggtgctgggaaaggcaacagcagagcagcaaccaggaagatgggtgaaaggttgttagatgaaaggaacatgtagagaatggaagcgaagagaagagctggcttgttgagggctgaatgtctatgatgcctacacacacgctgtcagctcactcacaccgtcctgaggcaccgccatcaatacactcagcatttctttcctgctagtcgacagtgcaatgtgaagacgttcataactagctcacggtatttttttttcaggcagattgtcctttggcttttctcctacctcatgtacaactacaccaaagagttaagtgccaagagaccaaacttccataaaaaatgtaaaataaagtgcgcaacaggctatgttccaagaactgtgaatttttaggttcaagttctagatgagtttcccactaagtagcctgtagccccggaggtggagagcacgagcgctcacagcatacaacacaccagcaatactgctgggggactgtgtcaccttccaacatctccctttaaatgcctgtttgtaatgcaatgatttcaaaacaaggtttataaaacagcgactaagacagacctctgaacagctactcatcaaatgcagctattcctattaattatacacaaacacaccagctacttatcataaataaagtttcattcttccaaatacctgttttaacagcaacacacatcactttcttggttacagtctgtgttgcaggctgaggcgagtgccttgactctcctgatggtcccgaatgcccacataggcagccacatgccctgtgcctgagcggaggcccccacttacttgttactgcaatgttgatttctcctgttctcggagtgagctccccatcctgaggaagaggtgagatccccgaagttcgaagtggctcaaggccaagggagttgtcgccggcgaggtcgccgagggctgatcttcggttaacagcttgggttctggtgagcctttccatatcgaatgctacgttatcagtacatggcaaattcggctgcaaaatatttccaggttaaaaataattgtaaggaaaacacaacctttcataagattctaaaaaagattctaaactttgacgccctgttgcaaagaccttaccaggttcttttcctgtgatgtcctctcatttatctgcccacctacctactccttcttctctcaccctaagagtttttcttcaaaaggcacagagatctcctctcagaaatgttacaaaggaaaactaaaattcattgcagatcagagaagactggtcatggcccacaggcacagggagtcgtaatcattaacataaagatagcaaacatccagtttaaaagagtaaactattactttgcttcatggtaaatgtccatgttgaagaatcccaggtaatagaaaacacctctttcatcctactaacttctctaaaagccccatttatctggtagtcagtttttaagtatggtctgcctttaaacacaagaaaagcataaaaccaagaataggtcaaagttgaaaagacttttgaactataagaaaatgatctgtttcaaaacctaagcacctaatcctgagggagaggtatagagctgcttggggccaaagtctaccaattaaaaagtgagcaccaaaagtcttccgttgtaacaatgtggctatttgtttacctaacaacctttggttctctcagcaggcagcagcaggcagcacatgagaagcacagctgggaggggtggttgtgagaagtttgtatgtttatagagagaagtttcagccaaccaaacctggaactaatggcttcctgggcaaaagaactgtttcaggtcatctcaaagccttatttaaaacagcaaaaggcagtgtactaagtgatgcttaggctcacacccagttaaaagaggtttttttatgttcattacatttaaggatccaatgataacctgcaatacattttaggaggatttttgttataaacagaggagaaaagtattagcacttaatatacttaacaaacaggctgggcgcggtggctcacgcctgtaatcccagcactttgggaggccgaggcgggcagatcacgaggtcaggagatcgagaccatcctggctaacacggtgaaaccccgtctctactaacaatacaaaacattagccgggcatggtggcgggtgcctgtactcccagctactcgggaggctgaggcaagagaatggcatgaacccaggaggcggagcttgcggtgagccgagatcgcaccactgcactccagcctgggcgacagagcaagactgtctcaaaacaaacaaacaaacaaacaaaaaaagaaggcggcggctagcggtaacaacagagggtaagttactgtttttcaagtttctacactgttggccaggcacggtggctcacgcctgtaatcccggcactgtgggaggccgagaagggcagatcacttgaggtcaggagtttgagaccagcctggccaacatggggaaaccccatctctactaaaaacacaaaaattagccaggtgtggtggcaggtgcctgtaatcccagctacaagggaggctgaggcatgagaactgcttgaacctgggaggtggaggttgcagtgagctgagatcacaccactgcactccagcctgggtgacaaagggagactctgtctcataaaaaaaaaaaaaaaaaaaaagagagaaagtttctacactgtgctaggcatcatggcagatgctctatgttagaccagtctgaaatgggggtgagtttgctccctgggggacatctggcaacgtctggagacatttctgactgtcgtggctgtggtgccatgctactagcatttagatgctgctgaacggtctacgatgcacaggacagcccccacaagaagggattgtccagtccatggtgtcactaatgcccgatactttgagaaatcccatcactactgacatgatctctggagacaaaggacaaatggggcattactgcccaactgtatacactgaaactgtgtttgacagtatatttaaaataagatgacttcgatctcctttgggttgcaagctaaaatgagttcatctgttggatcaaactaaactttttgttccataaggagatcattctttcattcttttttgagaccagaaactatgttattttccaataaaaagcataaccctggctatacatgcttctcttaagcaagggctaacgaaggtccttggttactcaagtcagtgttgacctggcacctgccacagctggactctggcacgcctggcgacagcccctgccaggctgtggttgtcaacagttctccttgggctccagtcactgcctgccttctctgcttgcaacttaccaaccctcaagagatcaaagtcaaacttcaggctaaagaacataagcaatgacatcgttttatattatgccaagcacagaggagtttatgactggaacagagtcaacagcatacagcctaccttctaaaggtaggtactggaatgaagaaaaatcatgtccttctctctttcttcatcccatactcatcgaccaacagaagcacccttttaaaagtggaccatgccaggtgtggtgactcacgcctataatcccagcactttgggaggctgaggcaggaggatcacttgaggccaggagttgagacccgcctgaacatcttgtctcttcaaaacataaaaaagtggccaggcacggtggctcacgcctgtaaccccagcactttgggaggcagaggcgggtggatcacctgaggtcaggagttggagaccagcctggacaacatggtgaaaccctgtctctactaaaaatacaaaaaattagccaggggtggtgacgggcacctgcaatcccagctactcagaaggctgaggcaggagaatcgcttgaacctgggaggcggaggttgcagtgagccaagatcgtgccattgtactccagcttgggcaacaagagcaaaactccctctcaaaaaaacaaaaaagttagccaggcatggcggtgtatgcctgtagtcccagctactcagaaggcgaggtgggaggactgcttgaacccaggagttcgaggttacagtaagctatgattgcaccactacactccagcttgggccacagagtgaatccttgtctcttaaatttaaaaaaagaaaaaaaaaggcctagtagagttatttaccttctcttccaggagttctctgagatggattagacttcttagtaatctggtaaaaaggtcctgttgggcttacatggttacatggcaaatatagccagtgttttcttctgtgtcttagtcatgcctcctattatgccaattatgttatattgtattacacatacatataataatatacaaaagtggtaacaaataaaataggaaacgtaccacaattcccagggccttcaatatattaagtttgcacataggacaggtacaatgttcactaagccagggatccacgcaggatttgtggaaaacatgcctataaaataatggagaattatgtcacaagttacataccaagaaacttattaggccaaaatggaaagaaagggaatttttagttaagttttcttttccccctttcaggacatattttaagccccaagagacaaatattgggaatttattaaaatataacttgcagaaaatctcctgagcccaacctcatatgtacaacaccgtgtaagaactgctaagtaggatttggttgtttgggccttttattttaccaaattccaaaaaggactaatggaaacttagaaaatttattaagaatgaaaataatcacaccttataaaccagttatgctttctacaatagctaacatagaaaaatggagtttcaaaaagatactaaatcatggctaagtgaagagttctctgtatagtgattagttttttggcaccctgattgaatgtcatttaaaacatcatttttaaaaacttctaagcaacttatgttgaatgtttataaaagctacagggaagctgaaactattttaaggggtaaactgtgcctagattcaagtaacactcagcaattttcagctgaaatgttaacgggggaggatgggagattttctctcttattcaggcaagtagaaagtcacagtcttgtgactggaaataagtcagtcatacagggttttgcattcttaaaaaaaggaacttgtgccctccggaagagctgcagaaattacttctcaagctctagcacccggcccagcagccttctgaagctctagagtcctggccaaacagggagaaggtgggtgccaggacagacgttcagggcagctttggaagaaacactaatctgagtttgggataagataaaagaaatttttgtttgtttgtttttgagacggagtcttgctctgtcgcccaggctgaagtgcagtcgtgcaatctctgctcactgcaagctccgcctcccgggttcacaccattctcctgccttagcctcacaagcagctgggactacagcagcccgccaccacgcccagccaattttttgtatttttagtagagacggggtttcaccatgttagccaggatggtttccatctcctgacctcgtgatccgcccgcctcggcctcccaaagtgctgggatgacaggcgtgagccaccacacccggccaagataaaagaaatttttaagtaagatgccaaattgaatcatggtatatacctttacaactttgattgtcaatttctaagttaatgttatttacagctgtttaaaaatgcagttttgatttataaaaagaggtctagagaactcagtttctactgggatctggaacaaacattcatgcttacaactttggcctgaacaatatacacacacgtctgcctatcactgtttgatggccttatactcacttctttggggacaagagtaaagatcttgaagaatgaatttatcaatctagtcttaaattcacagacaatgaaataaccagaaccatcacccctgaaggcatttatttaaaccttaaagcttttacttaagggctggaaacccaccaatccataggtaagccccagatacattcagtacacctaaggcgttatgtcttgttactcgtagcctctgtgtgtggagtggttccttactccagggtgtccccagggccagctggactttccagcaggggtcaagtgcactaatgctggctactgaccaacaaagaccacaacaggcttaacccttttggggcatacaaactcccttagatctgatagaagttacagaacctccctctgaaaagtcacggggacgcaaatgcctagtaccttgcatacattttcaggaggagtacggacctatgcactgggttagcgctagggtggggtggccgggaaggtgctgcaggtcaggcctacacagggtggacgatgggacttggctgactgacaggtaatggaagacatatgatgctgtgacctctgatcaaggctctggtgcaggaatgggaggcatcccgctgggggtcgggggaggcctaggtgccttgacttctgatcagggctctggtgcaggagtgagaggtatccagatgagggtggggggtggctgggcttgctgaactgttggtggggacctggtaaagccgcagcaccacctggggggatggaggtgcggctctggtgctccctactggggccagattttgctttgcccttttcttattgttccgtctttcttttctcttactatccagaaagaaccaaatggtataatcctcatatttcatttttaaagctgcatgagtacagtgttctctgcctgtttctttaacctgaaattagttataaatatgtttgggttcttgagtaactgtttccttctaggattattgatataaaagaagtgcccacccctctgttttactaaacaattaaaaatttctcctctaggctgtggggtactatgaagaaaaacaaaaaagaccaactggttctctggtgacaaatttagaaaacctcccttcctcagctaaatgaaaatctgaaatatttttggtctttaaaaaaaagttcctttgggctctccatccaccccatccctctcttactcctgaccctacctctgagcactgaacacccttccctcctgtctttccaaattccccgctagtccagcttctgtgcaactcacccagagatcttcagtctcaaattcccatggcacatccctcgcttccacaaagctgggtggctgttctcttcacccatggccctcctctcctgtctcttctgtgatctccacaggcagctgccctgaacacggcacctttttctcctcatcacccattgtctaaccctcctgctagtctcttcagtgcaactttcactgaactcactgtggccttttcttcccttctaggcaaagttctgctacaacagtctggtgctcggcaaaccacctttctgctgtgcagaggtctcagctaaggactgggccaggggcgtttaatctaccttgggaagtgtctggagcagtcaatgcaacacagcatgtgggccaaggctgagcacctgcagggccatcacacgggcagagcggccccgccacctggccattcccgcacgcctgaccgcgctcaccctcactatggctctgggctctcattatggaaggtgctccatggacacccaggaggcctcagaaagaggcacctggggcaagtagggccttgaaaagaagttccccactcacgtgataaaaacacacataaataaaaaacaggcccgccacacacagggtgggtggtgcatcgggacggaaagcaggtaacgtggacagtgaaacctgaaaagcacaagcatactgagcgccaacaaagtcctttattcctatgagaaatacttggggatacagaacgagaaacaaatagaacatgaaaggaacaaacccagcaatcatgaaattcagcgccctcccctttcctatgtcccacacatgccatgaactagagtgagcagaagagtgctgcgggaggggaggcctctatattgaaggtgagttgctctcacagctctgcagcctcttggtgccatgtaagaacctggcaaatataaaaggatgcaggattattaaaggtcccagacaagaactctcttctgctagctggggctggcagcagtctctgtctctatggaccctcggctgcagtggagcctcagacatctgcagcggccggccccccgctttagctcctgaagtggcatggaaacatacgttcatccacgcggcaactccacttctgaaaacgtacttctaacgactacacactccgatggccgacctttaagaggtctaataagaccaggtgacagttcctcggtttctaagacctgctggctaacatccaaaggagaatcagccgtgatcactgagccgaggaggaggcccctccgccatgccaactgccatctgtccacagtaaatagtgcgacagaagaggaaaaggaaacgtcacgtggcaagaagcaggcaatccatgagcggcttgacagctctggatagaaagtcctagctgagcttgtgaatcgttaaggaaagatggacacgagggtgtccaggcccatctccctccctcacggagggaagaggcagtgggcaggtgtgacagcagacgctgtggggcagtacttggagggcgatggctttgaaagagagttttaaaaactggactgggaaatgcgagtgtcacgagatgccggcgagtggagacagaacactggaaggagcagccagccaagagaacgaggccccgaggaagggagagagcaggcacgcagcggcgcggggaggagcggcatggaccgcagcagacggcctctccggcctgcgcacccgggtcagcacgctgagggaattaaacccattgcttcctctgggcagtcaatggtgaagcggtcctctgagagtgaagaacaagcgtgtgagttaaggtgttgaagtagagtgaacacacctgcaggtgctgctgtgccgaatgcggagcgccagccaggcggggaggctctgtcttgccaagtctgttcagagtcccgtgggaagacggtgagggaacagaaccgcttagcaacatgaggtacagaaagccacagcaggtaacaccgactctgggcttcaaagacaataggggcggggaggcgtcccaaggcagaaggaattctgtaagcggcagtttggtgagcgcgaaggcgcagctgcgagtggcatctgctggggtgaggcttgaagagccgcgcacagccatcctcagctcagcggttctcatctggaggcagttttggttgtcacaactgtgtgtgggtgggcgctactgacacctagtgggtagagggccaaggacactgccaggcccacacccccacacaatgacctggtcccaaatgtcaacagtgccaaggctgagaaatgctgctctagcttaaagactgtcacaagtaccgcttgatgtgtaaagttaatttttgctacacctgataactgcactgtcgctacatggcagtgagatggtgtgctgtgctgagcaggctgtgtggtgcagtctcagggaaagttacagcttggtgatgcgtggagtgtaagaggaacaaacagccgctcagttccacagcaacagggaaaactctacactcagccagggcagtaagcacagctagtaacacagtgacccagtactgaaagacaaccaagtaacagtaccatagagggtgcagcgaaattccgtgaaccgtgccaaaaattctaacattcacaagcagaccacaaacacaaaccacttctatggtggcaggtgcagcgcagaaatggttcagatcaaccatggcctggaccttggtggcaggcgtggctttgcagcacgagaatcgggcgggaacttataattaaagcgcatatgcccggcctccacccgggatgcttctgaaagcctcccactgactctgatgcagtcaggtctggaaagcaatgaactaaattttaaaaagagggccagacgtcaggctcatgcctgtgatcccagcacttcaggatgctagggtgggaggatacttgaggccaggagttcagagcggcctgggcaacatagtgagaccccaactctacaaaaaataaaaattatacaaaaggaaaaagataactccgaatgaaactggaaaagtcaacactgaagggatgaagataatgggattaagttcccagaataaactactttaggccgagcctcccctgagggaagatcccctcattctagtaatatacccatgaatggttttggaggcccgtagttttaggtgccatatggttctggaggatcctgggctgaaacagcaagacagaatttggagagccttggcttctcctggtcattccagtgttgaagcaggcaagtgtggatgacgcctccctgtgtcccgctggcccttctcctgatttgcactggcgtgtgcatttcctttagcctcacgtttagaccgtcaatgactgcatgtgaaggaagactggctgttccacagtttaattttctagaggacagcttacatttagttttatagattttcctttatatgtaaactagaatgactggacttccagaatcttggatttctgtttcagtacatgtaattcttcttcagtttgattttttttttttttttaaaaacagatcttcctagactcaaaatagattactttgtaagtaaaataagaccagtagcctcatggagataacaactcacaattattttattaattcacatgctccatattataaggctggagttgtgtggatgtcttttaaagggaagggaggaggaagaggcaaactctttggttttaggcttcttggcaggtgatttcctatttatccaattgatactcagaactgtgtatcttagtttcatgctccccagcttgagaggagccacaggagaaaccaacatgctgtttccagggcaaccaggcacaggcgagtcctttcctcatggaggaaggcttggtcccatgtggggagcaccacattaaaggcaggccttgacacagctctgccatttctgaattgtgcgaccctggaacctgctatcggctcaccatccttcactgtacaacggggaaaacacaccctcttaggactgctgggagaattataggagacagtgagtatagtctgctcagagcagagcatctgaaccacagcaggcacaaagcaggtatcagttctttccattttgcataatccaggtttagaaaaagatttaatccaagtccctggagttgttgtacccagagccaggtgagctcgatggaagtctcactgaagggcttggagatgtagtctaagatggagaggaacaaggggctgtttttgaaacccacaggaatcacaaaacaatgccaagcacagtgactcatgcctgtaatcccaacactttgagaggacaaggcaggaggactgcttgagcccaggagttcatgttcagctgtgcgcaacatagtgagaaccccatctttaaagaaaacaggccgggtgcggtggctcacgcctgtaatcccaggactttgggaggctgaggcaggcagatcacctgaggtcaggagttcaagaccaactggccaacatgatgaaaccccgtctctactaaaaatacaaaaattatctgggcatggtggtgggtacctgtagtcccagctactcgggaggctgaggcaggagaatggcatgaacccaggaggcggagcttgcagtgagccgagattgcgccactgcacactccagcctggggtgacagagcgagactccgtctcaaaaaataaataaataaataaataaaagaaaacaaacataaaaagataaacgaaaccatagaacaagaattctcgacctcaacactcctaggctgtgtctggggagtctggaggccgcgtgccacatcgcatattggctacacctcggaaggccgtgcagcccgcacctgctgaacagcaccactccctgctggcctcagccccatggccagcaatgcacagcggacttggcctccagaaagccacgaggtgggtggcgctcaaaagcaagggagatgcccaccctgaaaaggaggcatacaaagcacattaatatcattctttctcaaacaaatgaagttgacatacttgcaggggagaattcggacgacatcattctgcttatagctctctatgcagactgcacaatgatcaaagtctgggtcagtttcctaaaatgaaaagtacagaaacaaaaagtcacacgctgcaagtatataaatggttgggatgcaattcagctcagaatctttctgtggctactatggtaagcaagtgttataaactgaaaaatgattaaaattattttgtttttatttgcctaactatattggcccaaattatgtctaagtcaatctattttgttttaaaaattataacaatctatattaattttgttatgatatgtcttacaaaaattaagtcggaattctaattttttccaggttagaatcagcttggaccatcatgatctccccatccctcattccccctgcattacttattggtctgaagaggtttcactgctatgtttgacacagcctggaagctcaccaggatgttcacttaaacacacacctaagtacagacaggaaagatggtgagttgagtcccagcagactgctgtctagaaacccaccccaagaatgggagctgtgaatctggtcacagatttgggatggagaagggtcattggctcaattcaatactcggtcttcattaagagtgagaaagagtcagccaggtattcagacaccagattaattgatttccttcctcctaggactgagaaggggttttgcaaaagttgtcataaaacaaaacatgccaggaacctaagccaagaaaacagactatttgctgtgtcactgtcacttggactgaaactcagtggacaactcttgccaggtctaggaggtacaaactaagatgaattggctttaataattaaaggaaataactgtgctggcccgggatacaaagtcagatgggtaggttaaatccgctccagggaatttcatactattgtggcagctgaggctaccaggccaagaaggcatctacactgtcaccgtggtcaccactcctctgccattgaaatgcaagccgttttgatgctgcttctattttcttaagtgatttcccccttttctgtttctttggtgtacaataaagttcactaagaatgtctccaccctctgaagctgtttcaaaggcaactagatacggtggtatcaaggcaatgggaataaaatgggtaaagtccaagaaattggtaaaacttaggaagacagagaatcatatgaaattatccttccaggcacaagtctgtgcttaaatattagaattgggtgtggggcaggagacagttttcgttttatgccttttgagatgccattttcccattctagataaccttgaatactctgaatgtaggggcagcactaagatgcaactgtgtccttctagcggagaagcagggctctaccataactagagctctgaggcgggatgtcagttagaggtctccgccacagcatcctgacactgcctctctcccttggtcctccaagccaccagggatgaccctgacacactttgctcttctttcaaactgctcaacccattgtaaagagagcacctttttaggtgaaactccctagaaatgcaggtcttcaactctccatgtatctagtgaaaaaataaaacaacaaaagagacatagcaaagtcccaggaagtataggaagaaaacacatctcctggctttttaacgcacaaatggtcccaccagaattctctgaaaatgcatgctaggttttagcagaagaaacctctgtaggaaaacacagctagagttactgtaagaaggtagtttaaaataaagcattaggtagtgtagttggagaaaatctaacgaatgaaatgtaaacaattagggtgtgtcctctcccaccaaacaaaaacaaaactgctggattacttttacggtgctgaagttgtttcatgactgtaccttgtcacccttctttactgtcctggttgtcaatttactgatggctttcttggctgcatctccgagacgacgctatgaaaattgcaaataaaaacagatactaagtgtaagatctctgaatgacgtactttatttttaagcaattaaaagtataaagtctctattttactacatccctctccatgtcctacatataagagaatgataaaatagaaaaaatggtggctgtatcaagattcagcattctggttgaaaagtaaaaagtgttagaacaccctgttaggtcaaacagaaatatagaactataggtcttcaattctccagcagtaaaaaagttaggtgtcataattgctgcattttgtgtcgaataaacatttgaaacatcacagcactatcaaacctacttcttgcacactccagagccactcctgctgctccaatggcttttggattctgctcaacgaatgatcaccattaggtgtgtaaatgccgtcttattaagggaaaccttgaccgctccttgaaattgcttatcgcatcatcaagtgtgaagagaaggaatgcgtcacagctccacttctggctcgctatactatcatcctctgggatcctgggaaggtgtacttaccttccagggttgagctgttttcattatctgtaagggtgagggcagagaaactccaaggctggatttatgcaacattctcccagacactgctagcactgcttggcaccaacaacccacagatgaagagatggtgatccctaccctggaaaagctcactgaactgggacagctgcgttaatggtgtatactcaagcatgcccagggccaggtggcagcacagaggaggcgactaggaggggtggggcgaggcaggggaggaacgtcagggaaggtcttgaggagtcgaggcctggactaagactgggaaggggttagatgggaaaggcgtagggttaggagggggttccgggtgtaggggtaggagtgggttccaggcaaagtaataatctagtaaagataaataggtgtaaagaacaggtatgtgaagaaaactaaggtgagcatctgctttcctgttcaaattagaaagctttgtgcatcagagggccctaggaacactcacactgggacaaggggcaaaaaccgcgactgtcccaggcacatcagggagacgtcactctagacacatccaggccttacactgtgggaaaaggcagatgccgctcctgacggagcaaggcggggaccaaaacaacggacaccttaagaatgttaaaaacccatagaaacatgtaagaaaaaatttaggggaaagttttaaacacacaaaagaacagagaatgatttaataaagccttccctatgtatctaacatccggcttccattaccagtactttacttctatttttcatctgtttccctctttactgtgttagatgattttgaagcatatggcaagcatcacataatttcacccataaaattttcactaagcacctctaatagacacgggcttttgttagatgccactgtctttcctaacaaaagtaacaatgattaatcaacattatccaatactcacactatactacaatttccctaggtgtttacagaatgtctttaagcagctggcttgtttgaatcaagatacaaaatccacacactgcgtgtggctgctccgtctttgaagcctaatctatgagtcccttctgtcacgctggttttaaaccaccttatggagatataattgacttaaaatagactgcatatatttaaaatctacaccctgacatatatttaaagttacagtttgaagttgcatatgaaatctacgctgttttcattacccatgaaaacctaactacaatcaagacagtgtatctaccacatccccaaacttctttgtgccccttcctaattccctcctcccgccaccccatccctccatgatctactttttgctgtaacagtctgcaacatcatgagttttacataaatggaatagatacagtatgtactactgtgtgtacggcttctttgactcagcatgattatcttgagattaagccaccttggtgcatgtttcaacagttaactcctttctaatgttatctagtatcccactgaagagatggcccacaatatcctttcacctgttgatgggacatctgcactgtggtccagtttttggctgtactgaaaagctgacaacaacattctcaattctttgcatggacatatgctttcttttttcctgaggtaaatactgcaagtagaaagatgggctcacctgatagttgtctgacttttatttaagagactgccaaagtgttttccaaactgggcatattattttacatttgcaacagcaatacatgaaaattatagttcctccacattctcaccaacacttggtatggtgagattttgtgttttgttttgttttgttttgtttttaagacaaggtcttgctctgcttcccaaactggagtacagtggtgcaaacacggctcactgtagccttgacctctggggctcactcaagtgattctccagcttcagcctctggaatagcaggaactacaggggtgcaccaccatgaccaactgattttttatttttatttttgtagagacgaggtctcactatgttgcccaggctggtccgaaacttcttggctcaagcaatcctctcactttggcttcccaaaatgctgagattacaggtgtgagccacggcacgcagcctccttacagttttaatttgcatttccctattgtaatgatgttgaccatcttttcatgtacttattggccatgtgtacattgtctgtggtgaagtgtctgttcatgtgttttgcctatatgtgtacattgtctgtggtgaagtgtctgttcatgtgttttgcctatatttctgagttgttttgtattattgacttttgagagaacattatatattccagataaaaatccttttgcatgtatttcccctcactttatggcagtttttaatttgatgaagtcgattaatcattttttcattggtagactgtgctctagtatcatattaaggaagctttgcctatttcaaggttacaaagacttccccgttttctcttctagaaattttatagtttcgtactttgtatttagggttctgactcattttgtgtattctgtcaggtacagatgaacttttttttttttttttttttgcatatggacatacaattgttctagaatcatttgttgaaaaggttgtccattctccacagaattacctttctaaatctgtcaaaaaccagttgtccataaatatgtgggtctatgtgcggacactattgtaccatgcatctatttgtttaccattaaggaaatacaatcctgtcctgatttctgaggctttgtaatagatctgaaattaggtggtgttaaccatcccacatttcctttctattctaacatccttgtggtttttcttgatattttgcattcccatatgaactttaggatcagtttgtccatctctatgataaaagacatcagggatttacaatgagattgtgctgaatgtatacatccacttggggagaactggcatcttaacaacattaagtcttccactgaacactgtgtatgtgtctctccacctacttagttcttgattaatttcctcagcaatagttagttttcactacatagggcatattgcatattttgtcagatttattgttaagaatttcctatttgttgatgctatggaaaatgggatttcttaaaatttaactttcttagagatagggtcttgttatgttgcccaggctggactcaaactcctgggttcaaataatcttcctacctcagcctcacaagtagctggaactacaggtgtgcaccatctgcttgatgaaaatgcattttttaaaaccaattcaattattcattactcatatatagaaataaaattaattctttcatattgatcttgtatcatggaaccttgttaaatctactgttggtctttttcatagattccaacatatcttctacacgaaatttctacagaaaataatgttgtctgtaaatgaagacagcttacttctccatttccacaatggatgtcttttacgtcttttcctttttacttactgtgctggctagaatctaaagaacaacgcagaaacagaagtgatcagaggacacattcttctcttgttcctaatgttagaaaaaagaatttagtcgttcaccattaaatataatggtggctgtcagtttttcatagatgccctaatagtttgaggaaagtttaaaaatcaggaatcgatgttggacttcggcaaatatcttttctccatctattgagatcatacagttttagcttttttggcctgctaatatggtaataatacattaatttttgaatgttaaatgaaacttatattcctggagtaaacatcacctggtcatgatgaatttatatatattgttaaatataatttgctaaattttttagaatttgtgcatctatgttcaagaggggtcctggtctgtagttttgttttgtagtagttctgtctagttttggtattaggaatgatactggtgccatacaatgaaattggaggtattcctgccttttccatataagttaagcatttgaaattaaaatctgaaatgctcctaagtatgaaacatttccagtgccaacatgaaactcaatggaaatgctcactagagcattttgcatttcagaattttggatttggtatgctcaaacggtaagtataatgcaaatattccagaatctgaaaaatttctggtccaaagcattttggataaagggtactcaacctatagtttgtttgatattgttatcatagctgccccttgaacaacatggaaacacccatttccatcaagtcatctcctattaatttaattactctggtgtagtatctatttgctcttgaatttcttcaacatcctcatcttgaaaccctttaccccctaacttttttttttttttttttttttgccatatccacaatctgtttcatgatttccttgactggctctatcataaatcctgtgaaatcatgtactacgtctggacacagttttctcccatagaaatcttttgtttagactttcatggcatttcctataataataatgacatcttcaacagtgccatctttccagacttttgtgatgttttatctggattctattctacagcattaaatgctttacatagcatactgtgcatactaagccgtaagggtccttaggaccccctgctctagaggttgaattagaggcatgtctggggtcaagaaggccactctgaagccttcagtattgaattcatggggttctgggtggccaggggcattatccaatatcaaaaaaacgttaaaaggcagtcctaccctggcaaggtacttcctaatttcagggacaaagcactgataaaaccaattcagagggttcccactattcggtcctccctgttttgcaattaaaaaccggcagatggtatttataatttcccttccaggctggtgtttagtagctttatcaataagggcagtcttgatcatagacctgactgcatttgcacaaaacaaatgcctgaagtcttaattctctcttctctaccttactaataaatgtcctttgtggcactttccccccaaatagggcactttcatcaatattaaaaatccgttcacaaaaataacctttctcctcaatgattttcttaatgaaatctgggaacctgacttgactgctacttcttgatcgtcaaaagctacttctcctgttatcttgtcatttttaaagccaaatctctttctaaacttttcaaactaacgtttgctgccattaaattctccagtgctatatcctttgctttccttttaagttgtcatataatgacttttcttttcctcaaatcacattggatactacaggtatgccttccttatagaaatcctgcacccacataaaggctgcaaaaggtatttagcaaaaagtataaagtttttgtgcctgttggtgtagctatagcaatggcttcatgaatagatttttctgtccttttatgtgttttacaatgatatgctaagtcattctttgtgaaatggcagcacctgcagctgaagacctctatctatggtacaaatcaagcaatacaactttttcttgtaacgtcatgacttctctccgcttcttgggagcatttccagcagcactatggcacttcatacaggtcccatggtgtaatattcaagattcatgatactgcactaaacacattgaaaactatgtgagaaccacaagaggtcacttttactgcaataatcaacctaatggagggacgaactactcataagcgtatgtcacatgacatttcaagtggacactggcaacactggtgatcacaatagcaacaggtggctatgaaattattacattaatacagtacgtactactgttaattttatgcggttatgatttaacatggtttacatttcttccaactgtgaatggtgccatgtatttgttttaataatttttaactttttacaatggatttttgtatattttatgatagtaaatgatcaaatagactagtatctacatgtattttatacatgatgacatatatttctccatttttctgtgatctcttcaatttctttcatcagtatttgagaatattggttaaatttattattcttatgtattttatttttatgtgactattgcaaataggactgctttcttgatttccttattacccagtttgttactggtgtacagaaatgatactaacttttgtacacaaactttgtattctccaactttactgaatttatcaggtttatgagtttttggtgaactctttgttttttttctacatatggtcacataacctgaaaagggagacaactaacattctctttatgatatggatgccccttcctcccttcctcctttccttccttcctttctttcttctattttttttcttagagacagggtccctgctctgtcacccaggctggagtgtagtggtgtgatcatggctcactgcagcctggacctcctgggctcaatccatcctcctgcctcagcctcctgaatacctgggactataggcacacaccaccacacctggctaatttctatatttcttgtggagaaaggggtctccccacattgcccaggctggtcttgaactacttggctcaagtgatccgcctaccttggtctcccaaagtgctgcgattacaggtgtgagccaccgagcttggccaccttttatttctatgttctgactgctccggctatgacttccagcactatgtggaacagagggggtggtaggtagaagtgggcatccttgtcttgaaccagttcttaaaggaaagtctttcagcttttcctaatcaatatgatgttagctgtgggtcatgtgtatctttcactatattgaagtatgttacttctatacctaatttgcaaagagtgttgaattttatcaaacgccttttctgtgtctattgagaatctggtatttgttgttcctttattctgttgatgtgaaacatcatgactattgacttgcaaatgccaaaacatccttctatccccgggacaaatcccacgttatattgctgtattatctttttgatgtgttgttggattcactttgcttcgtactgggttgaggctttttgtgtctatgttcaaggacattggcctgccattttcttatttcgttgtgcccttgtctggttttaatattggaataatttgggtctggtagaatgagttagaaagaattctctcttctttcattttttgaaatagtttcagaagaactgacgttaattctcctttataaatttgataggatttggcagtaaagccatctggtcctgagtttttgttgagggatcattactatttattgttctgttcatgttttctatttcttcttggttcaatgttggtaggttgtatgtggctaggaatgtatccattttctctaggttttccagtatgttagtgtataattcttcacaaacctctaatgatcctttgtattttgttggtttcagttgtaatgtctcctttttcacttctgattttatttgaggcttcttttagccatttatctattgaaaaaccaaatttcattgtgttgatcctttgtattgtgtttttagtctctgtttcatttagttctatgctgatctttattatttctttcattctaccaattttgggtttggtttattcttgcttttccagttccttgaggtgcataactgggctcttcatttgaaatatttctaattgtctgatttaggcattcattgctataaacacttccctcttagcactgcttttgctgtatcttgtaggttttggtatgttttatttccattttcatttatttcaagaacttaagaaatatctcttaatatattcatcaaccttatggcagtgatcatgttgtttagtttccacgtagatactgtttccaaagttcctctggttattgagttttattccactgtgttctaagatgcatgatatgatttctatttttaaaaatttgttgagacttgttttgtggtctaatatatagtgtttctaaacaatgttccatatgttgaggaaaatgtgtattctgcagcaatttgatacagtgttctgtaaatgtctgttacgtccatttggtatatagtacagttcaaatccaagtattctgttaatttctgtccagatgatctgtccaatgttgacagcgggtgtattagtccgtttttatgctgctatgaggaaataccccagactgggtaatttataaagaaaagaggtttaatcaactcagttccgcatggctaagaaggcctcaggaaacttacaatcatagcagaaggcacctcttcacagggcagcaggagagagaatgagtgccagcaggagaaacgccagacgcttataaaactatcccatcagatcttgtgagaactcactctctatcacgagaacaacatggagttaaccaccctcatgattcagttacctcccactgggtccctcacatgacacatggggattatgggaactataattcaagatgagatttgggtggcgacacagccaaatcgtatcagccggatactgaatttcccaaccattattgtattggagtgtatctatcccttgaggcctagtaatattagctttacttatttatgggtgctatggtgttgggtgtataaatattttgaattgtcatatcctcctgcagaattgatcccttcactattatctatttacgttttttaatttttattttttacataacgtctgttttatctggcataagaatagctattcttactgcttttgctttctgtttgtgtagcatgtttttctctaccccttcactttcagtcgatctgtgtgtctaggtatcacacagttgtgtcatttaaaaaaatctattcagtcaggctgtatcttttaagcggagcatttgatccatttaggttcaaggttaacattgatatatgacatcttgttactgaaatatattgttatctagctgttttgtaaattctttgttttattttttcttctgtctttgtggtttcatggagttctatcatggtgccatttgattcctttctcttcttcgtgtaattgttttatgagacttattaattttatactttcatgtgtttttatgatggcaaatatcaaccttttgtttccatgtctgggactcctttgagcctctactatagtattagtccagtggtgatgaattctcttagtgtttgcttgtagggtccagccccacggggttggtgggtttttctccccatgtgtggagacgagagattgcagaaataaagacacaagacaaagagataaaagaaaagatagctgggcccgggggaccactaccaccaagatgcggagaccagtagtggccccgaatgcctggctgcactgttatttattggatacaaagtaaaaggggcagggtaaagagtttgagtcacctccagtgactgataaggtcacgtgagtcacatgtccactggacagggggcccttccctgttaggtagccgaggcggagagagagaggacagcttacgtcatcatttcttctatgctcttttcagaaagatcaaagactttaacactttcactaattttgctattgctatctagagggcggagccaggtgtacaggatggaacatgagagcggaccaggggcgtgaccgctgaagcacagcatcacagggagatggttaggcctccagataactgcgggtgggcctgacatcagtcgggccttccacaagaggtggtggagcagagtcttctctaaactcccccagggaaagggagactccctttcctggtctgctaagtagcgggtacatttccttggcactgacagctaccgctagaccatggtccgcttggtaatgggcgtcttcccagacactggcgttaccgctagaccaaggagccctctggtggccctgtctgggcgtgacagagggctcacactcttgtcttctggtcacttctcaccatgccccttcagctactatctctgtatggcctggtttttcctaggttataattgtagagtaaggattactataatattggaataaagagtaattgctacaaactaatgattaatgatattcatatataatcatatctatgatttacatctagtataattcttgttattttataatattggaatagctcgtgccctcggtctcttgcctcggcacctgggtggcttgttgcccacatttgcttgtctgagaaagacccgttttctccttcacttacgaagtttattctagctggatgaaaatttttctccttttagcactttgaaaatagcatcccattctcttctggcttgtgtagtgtatctttccctatctgctgagaaagtctgttgtttgtctgatggagcttcccttatagatgactaggtgcttttctcttgttgattttagaattttttccttcacactgactttaagcaatctgatgactatatgtcatggtgaagtctttaagcaatctgatgactatatgtcatggtgaagtccttttgcaatgtatttgcctgttaatctttctgcctcttgtatctgaatgactagatgtcttgctaaacgagttaagttgttttcatcaattatttccttaagtaagttttctaaactccttgctgttttcttcttcctctgaaacaccaatgattcagtttagttgctttatatagtccatgcttcttggaggccttgttcttttgaagtttttcttttctgtatttctgtgcgaccagattcatccaaaacacttgtcgtcaagttgtgggatgtttttcttccacttgatctagatcagtggcccccaacctttttggcaccagtgactggttttgtggaagacaatttttccacagactggcgggtaggggatggtttcaggatgattcaagcacattacatttattgtgccctttatttctattattattaaattgtaatatataatgaaataattatacaaatcaccataacgtagaatcagtaggagccctgagcttgttctcctgcaagcagatggtcccatctgggagagatgggagacagtgagagattaggcattagattctcatgaggagcactcaacctagatgctttgcatgtacagttcacagtaggcttcacactcctatgagaacctaatgccacccctgatctgagaggaggagcagctcaggaagtaatgctagcaatggggagcgactgtaaatacaaatgaagcttcagtcactcacctgatgctcagctcctgctgtgtgtcctgtatccatggtctagatcattgttgggaactcctgatgtaaatcattgttttttgctttttgttttgagatggagtcttgctcttttgcccaggctggagtgcagtggcacgatctcggctcactgtaaactctgcctcccgagttcacgccattctcctgcctcagcctcccgagtagctgggactacaggcacccgccaccatgcccggctaattttttgtatttttagtagagacggggtttcaccatgttagccaggatgagtctcgatctcctgacctcgtgatccacccacctcatcctcccaaagtgctgggattacaggcgtgagccaccacgcccggccctaaatcattgttaaagctttcaaatgtatcttgcaattccttcaatgagtatttcatttccaggagttgtctgtttttaaaataaaaaacttatcttacttgacattttgaggatttaaggatccattgttggagaattactgtgtttttttgggggggtgtcatattatctttttcatacttcctatagtattatattgacttcttcacatctgcacaaatagttgcttgtccttatttttaaattttagttgaagtgggattattttttattttttatggtttatttattattattatactttaagttctagggtacatgtgcacaacgtgcaggtttgttacatatgtatacatgtgccatgttggtgtgctgcacccattaactcatcatttacattaggtatatctcctaatgctatccctccctcttccccccaacccatgacaggccccagtgtgtgatgttccccatcctgtgtccaagtgttctcattgttcaattcccacctatgagtgagaacatgtggtgtttggttttctgtccttgcaatagtttgctgagaatgatggtttccagcttcatccatgtccctaaaaaggacatgaacacatccttttttatggctgcatagtattccatggtgtatatgtgccacattttcttaatccagtctatcgttgttggacatttgggttggttccaagtctttgctactgtgaatagtgacgcaataaacatacgtgtgcatgtgtctttatagcagcacgatttatagtcctttggtatatacccagtaatgggatggctgggtcaaatggtatttctagttctagatccttgaggaatcaccacactgtcttccacaatggttgaactagtttacagtcccaccaacagtgtagaagtgttcctatttctccacatcctctccagcacctgttgtttcctaactttttaacaatcaccattctaactggtgtgagatggtatctcattgtggttttgatttgcatttctctgatggccagtgatgatgagcattttttcatgtgtctgttggctgcataaatgtcttcttttgagaagtgtctgtctgtatcctttgcccactttttgatggggttgtttgatttttttcttgcaaatttgtttaagttctttgtagattctggatattagccctttgtcagatgggtagattgcaaaaattttctcccattctgtaggttgcctgttcactctattggtagtttctttagctgtgcagaagctctttagtttaattagatcccatttgtcaattttggcttttgtggccattgcttttggtgttttagacatgaagtccttgcccatgcctatgtcctgaatggtattgcctaggttttcttttagggtttttatggttttaagtctaacatttaagtctttaatccatcttgaattaatttttgtataaggtgtaaggaagggatccagtttcagctttctacatatggctagccagttttcccagcgtcatttcttaaatagggaatcctttccccatttcttgtttttgtcagctttgtcaaagatccgatagttgtagatgtgtggtattatttctgagggctctgttctgttccattggtctatatctctgttttggtaccagtaccatgctgttctggttactgtagccttgtagtatagtttgaagtcaggtagcatgacgcctccagttttgttcttttggcttatgcgggctcttttttggttccatatgaactttaaagtagtttttttccaattctatgaagaaagtcattggtagcttgatggggatggcattgaatctataaattaccttgggcagtatggccattttcacaatattgattcttcctatccatgagcatggaatgttcttccatttgtttgtgtcctcttttatttcgttgagcagtggtttgtagttcttcttgaagaggtccttcatcccttgtaagttggattcctatgtattttactctctttgaagcaattgtgaatgggagttctggagtggactttttttaatcctgaggatgttactatgatgtaatttgagtaggattgtttgactttgcttctgagtgtgttcagtagcaaatattctaggatttccttggatataaacagccttagtgtggtggctttctcaaatgctggttacagtagtggtgtatcgggtgggtgagctggctcataacctcctgagaagctggggtggcatgagcaatggtggtaaaagaagtcatgagaagcttttcttattcccaagtgctgtgcacttatgtaagcagatgttgtaatgggctgtgtgggtcaacctccaggccagcaggtggtagttgcaggtcacagctggctacagttctaacagtagggtttacgacttatctttgttaaccaagagaagtacttaagtgtcccacgcaatgggttgggccagggaaagctcagtggtttgggtcttacactcagccttgggggaggggaggggactggtggggagaggtgaagctgggtagagctggactgggcaagacagccatttggtcccccagtagcaggcagaagcactggctctgacagggatctagggacagttgccaaaccctgtagaaatgcctaggcaaagatgagagcaactgacattgcatcaatgtcccagcacaggaaggcaagggcaaacccattgttaaaaccaggcaaacagtatgggacctgcctctctctctctctccagaaccatcaggactcatttcctcatcccaaccacaggaatcagacagaccatatatctgccttcagcctgcaaatttgctattgggtccaaaaccacacctctcaggcaaatctcctgctccagtcccatgatgggggtgcaggggtccaattctagtgcccaaagctggaggcccaagctgtactcatttatcatttctggctgtgtgggcccctttcctaccaaagacccagtgttccaatcctggcatgagactttataatgctaacagatgctgcttctgctgctgctgctaggccacaggattcccacacagtttgctatgagctaggactgagactggagtcctcttatcagccaccaggtctgggaaaatgcatgggatgcatcccaggttgttccttctcaatgtctctcagctactccctaagtaagatccagggcttgggaagctcaaggtgctctcctgtggcctggattgcacacttccccagtgggaagatggactgcagaggaacactgactccccatctcctgtattggggattttctgtttttagccagactctgccaggagggctgtctcccaaatttctctttcccagtgtctgaaatgttctgttcaattcctgtattccttcttggataaaagttaatgatgtgactatctgcacactattttgctttttccaagtgggttaggcatgctggaaaagcctctaatctgctgtctttgggggaaaaacccatacaaagattgtgttttctatttctgtgaataatatcactggcattttgatagggattacattcaatctgcaggtcacttctgatagtactgtcattttcacaatattaattattcctatccatgaacatgggatgtctgtttttgtttcctcttcaatttctgtcatcagtgttttagttttccttgcagacgtttcacctctttgactaaatttattcctatgtattttattcttttttggtggctattgtaaataagatggacttcttgatttatttttcagtgagttaattgttggtgtatatacacagaactgatttctgtatgttaattttgtattctgcaactttacttatcagtcctaaaaggacttccagtaataacatgttaaatagaagtggtgaaagtgggcatcctgtgtttttccacatcttagtggaaacgttttcagcttttccacgttcagtatgatgttggttgtgggtaagtcatatatggcctttattgtgttgaagtatgttctttctatacctaacttgttaagagttcatatcatgaagccacttatcaaatgctttttctgcatctactggcattaccacatggtttttgttcttcattctgttgatgtgatgcatcgcatttatggatttgcatatgttgaaccattcttgcatccctgggataaatcccactttttcatcatgaatgctcttttcaatgtgttgctggattcagtttgctagtatttcgttggggatttaaaaatttatgttcatcaaggatacttgtctatatttttctttattttgttgtatcctcatgtggtattgctattagggtaatgctggccttgtggattgagttcagaagagttcccttctcttcagttttctggaggagtatgagaagaattggtattagctcttctttaaatgtttggcagaattctgcagtgaaggaatcaagtgctggacttttctttaatgggagacttttaattacagattcactttaattactcataactggtctgtttgatcaggttttctatttcctcttgaatctatgttggtatatgtgtctgggaaaatttactagtggttgtcaattttattttttcaaatctttttatttcactgatcatttgtattgttttttagtcttttttaaaattttatttcttttggagacagggtcttgctctgttgcccaggctggagtgcagtggcgtgatcttggctcactgcaacctctgcctcctgggctcaagtgattcttccatctcagcctcctgagtagctgggattacaggtgcacaccaacacgcctggcttatgttttatttatttatttatattatatttttttgagatggagtctcgctctgtcacccaggctggagcgcactggcgcaatctcggctcactgcaacctccgcctcccaggttcaagccattctcctgcctcagcctcccgagtagctgggactacagactcccaccaccacacccggctaatttatttattattatttttagtagagacggggtttcaccgtgttagccaggatggtcttgatctcctgacctcgtgatctgcctgcttcggtctcccaaagtgctgggattacaggtgtgagccaccgcgagtggccttatgtttgtatttttatttgtagagatggggttttgccatgttacccaggctagtcttgaactcctggactcaagcaatcagtctaccttggcctcccaaagtgctgggattataagcatgagccaccatgcctggccctttagtcttgatttcacttattcctgatttgaacttcattatttttttttgcttcttctgactttgggtttgctttgttttcacttgttttttgagacagagtcttgctctgtcaccagactggagtacagtggtgtgatctcggctcactgcaacctttgcctcctgggttcaagcaattctcctgcctcagcctcccgagtagctgagactacaggtgcgcgccaccacacccaggtaatttttgtatttttagtagagacggggtttcaccatgttggccaggatggtcttgatctcttgacctcgtgatccgccaccttggcctcccaaagtgctgcgattagaggcgtgagccactgtgcttggcctgtttttgcttttatagttccttgagatgcttcattagattgtttattgcaaatctctattgttttgatgtaggtgttaattgctatgaacttccttcttcaaactgcttttgctgtatcccataggttttggtattttcttttcattttactgaagaaattttaaagtctccttcctaatttactcattgacccactggttgtttaggagcacgtttgtaaatttccatgtatttgtacaattccaaaagtttctattgttactgatttctatctttatttcatttgtggtcagaaaagatcctttgtatgattttaatttttaaaaagttcttaaaactaagaaacgccatctcactatattgcccaggctggtcttgaactcttggactcatgagatcctttctgcctcaccttcccaagtagctgggactacatgcaagcaaaactgtgcctagctgatatcaaatcttgttttgtggcttaacatgtggccaatcttgaagaatattctactggtgatgaaaacaatgtgtgttttgcagctgttggatgaaatatattgtaaatgtgttacttccatttggtctaaagtgcagtttaaacccaatgtttctttattttctgtctagatgatctgtctaatgctaagagtggggtgttgaattccccaactattactgtattagagtttatctctctctttagatctagtattttttatatatatatatatatatatatatgttttatatatctgagtgctccagtgttgggtgtatatatatttacaatgattatatcctcttgctgaactgatctctttatcattatattatgatcttctttgtcttttatttttcaatattttattttattttgttattattttttctttttttgagatggaatatcgctttgtcacccaggctggagtgcagtggtgtgatctcaactcactgcagcctctgccttgcaggttcaagcgattctctgcctcagactcccgagtagctgggattacaggtgtgtatcaccatgccgggctgatttttgtatttttagtagagacagggtttcaccatgttggccaggctggtctcaaactcctggcctcaagtgatcacctgcctcggcctcccgaagtgctgggattacaagcgtgagccaccacgcctggcctgttttatctgatacaagtacagccactcctgcttagtttttatttccctttgcatggaatatcttttttgcaccccttcatttttagcctatatgtgcctttagaagtgaagtgagttggccggccatggtggcttacgcctgtaatcccagcactttgggaaaccaagacgggcggatcacctgaggtcaggatttcgagatcagcctggccaacacggtgaaaccctgtctctactaaaaatacaaaaattagccgggcttggtggtaggcacctgtaatctattcaggaggctgaggcaggagagttgtttgaacccgggaggcgaaggttgcagtgagccaagattgcaccactgcactccagcctaggcgagcaagcgagactccgtctcaaaaaaaggaaaaaagaaaaaaaagaagtgaagtgagtttcttgtaggtagcatataattgtgtcacggtttttaaaaatttcatttcaccagtttatgtcttttaagtggtgaaatttaatctgcttacattcaaggttattactggtaggtgaggacttattcctatcaatttttaattgcctctggttgttttatatatcctttgttatttttgttctctcctattgtttatcattaaggtttggcggtttactgtagtgctaagatttgattcccttctctttctcctttgtgtatctgctctctaccagtgactttcatactcctgcatgttttcctggtagtgaatactgtcttttcaaaatgtaaaactctctcaagatgtataactttctcaatttttgtctaggaaagactatttcacccccatttctgaaggatggctttgatggacacagtattctttcttggctggcaattttctgctttaagcactttaattctatcattccattctctcctaggctgtaagatttctctggaaaaatctgtttttagtctaatagggattctcttatgtgacttgatgctgttctcttgctgttttgtgaactctttcactctcgacaatttgactgtaatgtgacacggggaggatgttttcagatttactcttatttaggaaccactgggctacctggatctgttgtccatatatctccgtagacttgggaagttttcagattttatcacatagattttttaatgcctttccccttctctccttctggaacacccataatacaaatatttgtttgcctaatgttccataagttttgtaggcgttcttcattatttttcattcttatttctttttttttgtctctgacttgttaatttcaaataacctatcttcaagttgagagattctttcttacatatgatcaagtttgctgctgaaattctccactgtatgttttttcattcattgaattcttcagctgcaggatttgattcttacttctcttttattcaatttcctgtttatattgtgaactgtttccccaactctattgattgtctacacgttttcttgtatctctctgagtttccatacgatcataattttgaattccttttctggcaattcattaagttttttcccattggagtgtgttactagggaattacgttcctttgatggtgtcctacttccttatttcatgtttctcacgtccctgtgttgatgtctgtgcatctggtggaacaatcacttctttcaaattttctagagtggctctcctggacaaagattttcgcctacagtttaatcttagtgtgccagttgggaagggtgtggtgactatttctggataggtgcagtggtacagtctctgtgcagtttcagctgaattcaacatcagcaataaccatgggtgcctcagtggtataagctgtggatgtctgctgcagtggtgtaggctgttatcctttcaaaggcctttggggacctactattcttgctttccccacaatgaggagacttagccaaagtgatccctcttggtgtgaggtctgatgttacccacaagcagctgcagcagcactggattccaggagcaggtgctcagaatgacaatgggaccatgtcctaggctcagagtctcacaaatgtatttgtggcacctgtggcaaagtgggatatgttacccacatggtcaggatctgtgactgtcaggtacccactggtagcttggacctaagagtctactttgtagctgtgattctatccctgggaattagggcataacactggcctgactaggtagaaggggcattctggaagtttgggtcaagggtctggctgcaattcaggaacatgagtcagcagggctcagtggcaacttaggtcccatggaatgaagcaccatacagtattgactatagaccctgggatggcagggctcagcagtatcttagatctgtgaagtccagtgcaatgacagcaagtatcctagcttaggggagcagagctgttgtgtggacccagcatgggaggggaggatagcacagtgataattccactctccaagaggaaggttatctaagcagctgagcttcttgaagactagtacaggttcaagcaagcagggtactagagttctacggcctgtaagggcaaggtgtctcagctcagtcaccgctctatttctctgggacatggtgtactatatcagctcatccctggcatgcacaactgctcagtctggccaaggcaccaactccccaaaggataatgtgctgcttcagctcaggcccagggagcatactcttttgggtgggccaggcaccatttccctgtgatgctgggagctgcttcagcttaggtactgggatgtgtgatcactctggatggccaatgcaccacttcctgggaggcgtggcgctgcttcaactgagacactggggaggcatgattgctctgagtgttcaaggtactgttttcccaaaaggcaggatactgcttcagctccagtccaaagcagctgggggaagaacaggtggagcagctccatctctgctggcccccgaggaacagagccaacagttgctcccagctcagcctggagatgtggggccactgtgctggggtggtttggtggcagcttagccttagggacaaaggggagccatgactactcacccctggagcaagacacacttcagtcacagctccaattccaagatggtatagcacagcagctgtgtgggccacagggattgaggcacagtgtcagctccttctctgtggggtgcatagccgggtggactcagctgggcttagtgcctgtgaggactggtgggaaccctggtggtgaggtctgtaggtatccacagtgttgaaggggctgctgggatcctctcacttacctcctcaccacagtgagctcttcctggttcccagctgatcctggttagaggatgggacagtggaggcccagtgtttccttcccatctctatgtggctatctcaaacgtctgtgctctccagagcttctgtcattcctcggatgcacccctgtactctccctctgttattttcattaagttgtttatttattgttcaggctttttttgcaaggaggacaagttctaaggatttctaatgggtcattttcctaaggtaactcagatctgggttgttattattattattattaaggaatttgaggagattttacaagaatctcattgcttccattctgttcagatcagaattctaccaaagagttctgaacagaaaagttcctgatgctatttgaggcttggagaattaaaatcttgcctccacaggatgtccaggtagggtctctaatatttcagagacaagaagggcctgaattaggcaagcagcagtaggtaaagaaagaagagcgcaaagtcaagaaagatttagcaggtaaaaccgacagaacctcatgactgacatggaggcacgaagaggggggtttgaggagaggtgcccccagacttctggctcggtgatgagccgtgtgagagcgcctgccatcacactgcattatggaatagccaaaagcagagagcaggtgctggtggaagcagtccagtcttcagcaagctgacgtgaatgcatgtaggttatctaatcagagacctacaaatatttaggtagatcatattttccacctctgaactttgaacacctcttatagcacaaggacaaaatatctcttctctgtgttaggtattaatgtcaataccttcactgtaatttttctttggacttggcttcagtattactaccttcttctgaattatcctttgagtttttaatcagtcctttaacatttcccatcactttgcgacaggtaaacctgtgacaggtataagtgtctatgtatgtgtgtacaatttgatctcttcctggaatctgtctaaaagccactatttttttaaaatttttcattctaagtctatttgcatccggctaactctcaagtacctacgatgaggtacaaaattcttccatgaagatcactttttattaaagtctcttaccttcacctaaacaccatgccattaagtcactgtttttcaaggtgtggtccatggggcagatgcattaaatctaccttgaatgcttagtaatatataataataaaatctatactaactaaggtttattcggtacataccatgtgctaggtactgttctaagcccttcacaagtactgactcgtgttatcgtcacaatcattttatgagaaaagaactataatatcccattttacagaagaggagattgaggcagagattaaataatttgcccacatcaaaggctagtaagtaggccctatccagacttgctgaattaaggggaggaacgatcttggaaatttgcaattttaaaaagtgctccagcccctaaaaggagctctcacatgattcttttgtatactaaagtttgagactcactaaatgaagtacaaaccctggtttcaaagcattttcccgtaatacgctacccactcactgatattctccgtacttcacactgtgccctattcctttaataataaaactcctcaaatttacacctcatcacacacagaatgttagaaatgacaaaaccacagaaaggcatcattttacaaaggagaaaaaccaagccccagaaagagatgaggagatctgtctgaagttactaaaagtattcggactaggaccatagatctcctttccacttcagttcttcctccactataaaatgctgaaaagactttctatagcatacagcttgaggggtttgttaggggccagattatcttatctcatctggtcaaagctgcaacaataaacaccattctatatttgaaagcaaagtgacaaaatgtttgaattggcagaaaacaagttaaaacaattcttacggcttaatctaataggaatagttggttcaaagccaaatggttcagagtatattgaggataggtcactttgatgaaattcatctcaggttttgccattcggcaatcagaactctctcacagaattagagtaagtctgtatctgcacagagtagggttttctttttgtaaacactggtgaaatctaggtataaaatctttccccaatgcaaagtgccttgtagtctgcaccctccttcattcattcaccaccattttttcccatttttttttctcaaaagaagcctctgttaactcttttgcaagacaccatctgcctgtgcccagatcactcctctcctctctacataaccttattttattaatatcatcttcctttgctcttcaatatttcctcttttcatagctccttctccctaagtctctcgcaccagaaaagaattgtatatcactccactgctaaaaaaccgtactgatggcccggcgtggtggctcgtgcctgtaatcccagcactttgggaggccgaggcgggtggatcacctatggtcaggagtttgaaaccagcctggccaacatggcgaaaccccgtctctactaaaaatacaaaaattagtcgggcctggtggtgggcacctgtaattccagctactcaggaggctgaggcaggagaatggtctgaacctgggaggcggagcttgcagtgagctgttaatcgagccactgtactccagcctgggcgacagaacaagcctctgtctcagaaaaacaacaacaacaacaccaacagaaaccatattgattatagaataaagcctaactttcttatgtgattcatgcccttcatagtctagtgacaatttattcatctaatatcagctcaacactcacaagtctcctgcccactattcctgatgtttcagtcattcaactctttcatctctctgtggaaaatgatccatttgcctgactctccttcatctccatctgatgaagtcttaattcatcctttaaaattcagctccaaggtcacaacctaccttctctgtgaagtgtccttgactccctgagagtaatatcactctgcccccaaagaataactcctataccacacagtattttgactgcatctgtcattgcaacagaaggtaagctcattcttgaattcattgaaatatttactgaggcagtgtgatgtgccaggccccatgctaaaccccaaggatatagaaatgaattatcttgcaaacactatgatcttaagagcatattttgtgctttaaaaaaatcagatcttaagcccctgacatgtaatatttagaaggtatataatacagtctctgtatatgaaaagtgttatttatttacaaaatggcaggacatgaaaaacaaggtatcagagtatttgcagtatttttttaaaactggtaagataataacttctcagctcaaacatctatttcccctttccagttcttctggaattgttaatccttaagaaacataatgaacaaaattcactctgccatctaaaatgacaaaagaagtctgttttggggccatataatccttttctgtaggacaaatcttggcagtatatacaatacttcctctcttccaatgtggaagaaaaaaaaaaaccttttgaacccaccagttttcaaagattaactgtactcatgcaaagttttaacctttctctgacacaggaatgttccatatatttccacattctgacaggcaaatgcattctccaattagctactgacctttcatgatgaaaatgggcaataagagtgtatttcatttcagcaaccctgagatacttataaagtcaaagaatattatatacacatgttatggcaagaagcttttacaaattttaaataccttaaaaagcacatgcattttcactgggaagttttaagaatacattctaaatattcaggagtccattaagtggcagaatattttacatctgccccgttcctaaacagtaaaatgaaaatttcattgttctgctttagaaattaaatttgaccactttgaaattaaaggtgcaatattaaccatgtaactgttaaacattttacatttttcagaaaatccttaagcatttattcaaaataaaggtaacaaacatctaccgttttgtgtaaaataactatcagtgacttaatttgacagcgacatttaagtttaccatcagtggtagtttgaactatctacacctatagatagtaattagatacattctgacagttttccaggaagagcaaaccacagacacttagtcatgaactgaaaagccaaagcattagattcttatatcacatgcaaaatgttctcaattgtgagcattttactatgcttagaaagttatttacaatatatggatctctttggtagcatgttctacaggaagaactgcttcatgataacagtttgtgggggccaggtgtggaggttcatgcctgtcattccagcactttgggaggctgaggcaggaggatcacatgaggtaaggagtttgagaccagcctggccaacatggtgaaatcccatctctactaaaaatacaaaaattagccaggcatggtgacacacatctttagtcccagctacgtgtgaggctgaggcaggagaattgcttaagccgaggaggcagaggttgcagtgagccaagatcgcgccactgcactccagcctgggtgacagagtgagacccagtctcaaaaaacaaaaacaaaaacagtttgtgagagaaaatcagagtctgtccttaaactcactggttttcctttgctaatattatggcttctcttttaaaatagccaaaggtttcaaccagtctagctgctgccaccttcttattaaactttaataagctaagctttttaagccacataaaaatttcatcaagcatttgtcaaccttggggaaaacggaaggaggaaaaaaggtcagaacatcactttccaccacagtagcatctggagagacgctttggaaggatcctgcatgcagtcagccgcaaaataaatgctaggaaacaagctcgcagtttgtggcctgcaccagatggtgattatgtttcctccttcatcagccccggccccacactgggtgctaattaaagcactatcttccaatagcaggctcctgggacaaccgtgagcctttgttccaacgtcctcagggtgagctacacccagtccactaacacaggcttgcctgtcaacaacaccactccagagcagctccttctcattttactttcagtgtttcgtatgtcaacatattttaaaaacaaatcttttagttttttttttttttttttttaacaggtatattacatgttataggagggaaaaggaggtgggctgcctggggccctcaagacatgagaaacgggtggtggcttccaagcttccttacttcccccatagattcctgacaatgtgctgcagaagcctccaacctggaacagccaacaggaccagagcagcccaccacccgaccccagaaaaagccgagaaaagcccaactccgctagccaaagtaccaagagaaggatggcctaacatcagaaaacacttgcagtaatattcattctactccagccaggcgccaagggcaaaatcacaatcctcctcccaccctggtctcacagagcccagtgggaataggctctcccagcccggctcctcaggaagaaaagctgtgcccactggtctaattaacacccagagaacatgccacccaacagcagaatattttttctaagcaccaatgaaacactgactaagacaaactacatcctacatcataaaacaaacttcaagaaacagaagagaactgaaatcatagagtatttctctgagcataatggaatcaaaccagaaatcagtaacactaagataatagtaaaatcttggcaggacacagtggctcatgtctgtaatcccagcactttgggaggctgaggtgcacagatcgcttgaggtcaggagttcaagaccagcctgggcaacacagtgaaacctcatctctaccaaaaaatacaagttagccggacacggtggcatgcgcctgtaatcgcagctactcgggaggcagaggtcagagaatcacttgaacccgggaggtggaggttgcagtgagctgagatcgtatcactgcactccagcctgggtgacagagtaagaccctctctcaaaaggaaaaaaaaaaaagtaaaatatctaaactactggaaattcaataacatacttctcagtaatgtatgggtaaaagaagaagtctcaaaagaaaaaaatacataggactgaatgaaaatgaaaatacagcatatcaaaatatgtgaggcatagccttaaagaagtgctgagagagaaatttatagcacttaattcttacattagaaaacaggaaagccttcaaataaactaatcacagacttaaatgtaaaacataatataaaacttccaggaaaaatagtagaaaatctttgggatatctagggataagtaaagaatttttagacttgacaccaaaagcacaattcataaaagaaaaaattaataaaccataaaaattagaaatttttgcttttcaaagaccttgttaagaggttgaacaaaacaaaatacagactgggagataatctctgcaagccacatatttgacgaaggacttgtatctggaatacataaaaagctctcaaaattcaacagtgaaaaacaatctaggtagaaaatgggcaaaagacatgaatggatatttcactgaagaggatatacggatggcaaacaagcacataaaaaatgtctaattagagaaatgcaaactaaaaccacaagagatgttactacacaactcaacaatcacaagagatgaaaacaccaagtgctgtcgagagtgtggaggaactggatcagtcatacatttctagcaggaatgcaaaatggtatggccactttgcaaaatgagtctaacagtttcctacagaactaaatatgcacttatcttaacagcccaaaaacttcactcttggaatttacactgaactcagaaattacacatttatcccagggaaacgaaaactcatgtttacaccaaaacctgtatgtgattgttcacagctgctttatttgtaatagccaaaatctgaaaacatcccagatatccttcaatgagcgagcaattaaacaaacggtggtacatccaaaccatgggatatagttcggccataaaaaggaataaatgactgatacacataacaacttgaaagtatcttggccgggcgcagtggctcacgcctgtaatcccagcactttgggaggctgaggtgggcggatcacaaggtcaggagatcgagaccatcctggctaacacggtgaaaccccatctctactaaaaatacaaaaaattagccaggcacggtggcaggcacctgtagtcccagctactccggaggctgaggcaggagaatggcgtgaacctgggaggcggagcttgcagtaagctgagatccagccgctgcactccagcctcggcgacagtgagactacatctcaaaaaaaaaaaaaaaaaaaaaaaaaaaagtatctcaaggtaattatgctgagtgaggaagtgaagaattccaaactctagaggttacatactatatgattccacctatataacatttttttctttatttttttgaaacagagtctcactctgtcacccaggctggagtgcagtggtacgatcatggctcactgcagcctctgcctcccaagttcaagcaattctcgtgcttcagcctcctgaatggatgggactacaggcgcatggcaccttgcccagctacatttttgtatttttagtggagatggggtttgccatgttggccaggctggtcttgaactcctgacctcaagtgatccacctgccttggcttcccaaagtgccgggattacaggtgtgagccaccgtgcctggcccatgattccacctatttaacattcttgaaatgacaaaactatagagatgagaaacagattcctggtagattagggaagggggaaggagggaggtggctgtggttataaaagagtagcacaagggttccttgtgatggaactggtctgtatcctgaccgtgttgttggtcatgtgaatctacacatgcgataaaactacacagactaaagacagacacacacatacacaaataagtacacattaaactggagaggtggggagatttcagtgtatttaggaagatcagtggattgcatccatgccaatttccaggttatgatactgaccacagttatacatgttgttaccacaaggagaaatgagtgaaggggataagagacatctttgtatttgtattatctcttacaaatgcaagcaaatctacattttcacaaaacgcatataacctgaaactaatcacgaaggaacacaacacgtcggataaactcaaatacaaaataattgatctgtacttttcagaaacgtccatgtcataaaaccaagtaagaagagacaactgaatgcaaaatccaatgagctccaatcaatccaggattttctttgctataaaggtcattattgagccagttttacaaaacccaaaaaaggtctatcaatcagataatgtattatatcaatgttaatttactgattttgataaccacactatggttatgtaagagaatgttcttgtttttataaaatatataacaaagtatttaagggtaacagggcatcatatctcaaacttactctcaaatagttttgttaaggtatatatacaaaggttgagggtggtgttcacacccataatcctgacactttgggaggccaaggtgggcggatcctttgagcccaagagtttgagaccagcctggccaacactgcaagacctggcctgtgcaaaaaaattaaaaaattagccagtcatggtggtgcataccttcagtcctagctactcagaagattgaggccagaggatagcttcagcccaggagctggaggctgcagtgagccatgactgccaccacactccagcctgggtgacagggcaagaccctgtctcttaaaaaaaaaaaagttttttaaattaaaaaagtatagttacatagaaaaggaaatacagtaaaacattaacagctgtagcatctgagtgaagggaatacttgccacttatcttacaaattttttgttaagtctaaaattacaaatataaaaattttcaaaataaaaaaaattaaaagtgcacagggagagcctggcacagaaagcttcaataaactgcagtcagtgtttgggtattttatatgtacttccacagtcagcgtttgggtattttatatctactttcacagtcagcgtttgggtgttttatatctactttcagatgagaaagaagctgagatgctcaagaaactgtccaacagggtgaggggtcatggtgaactggtggtgcaggagggatgtgagctgagacctgttccatgccaaagtctgcgctttttccgctagaaagaggaaggataaaaatcccagtgtgcccatccccacaggaatttgaatgtaccatgttaggagaagacagcgttatacaaaaactggcttcaaatcactctccaagcaagtcacttcttagttttctacacaaaaagtctaggagagggacctaacacctggaacctggcacctagggtgtgtattctgtccacagcacatcaatcaaactcagtcaccaactgagggccaccatctccaggccctcacaccggggaagcacactgcttttcctaggtttattcactcaaccaaaatagatgcgctgtcagtggaactcctaggatgactacatagacagacatcttctattggtcttcccccactcacccttaccccatgtctgagcttagatgacagaggtttttcattgatttcattttctgaatagataatactttcccagttcaaaattcacatgggaaagaatttcacataggaaggggaagagtgaagtctccctaacccccctccaagttcccatttgcagaaacatccaaagttactggtttaaaaatgcaactttgtgctatttctccaaattaacagaattatctagataatactatgatatcaagctatctacctgactagaatattctaggtgatcacaataaatttagtaccttttaggttattttaaatatcccttaaatactcatgtagacgtttccaacatattaaaatgactgagtgagggtaacaacattttttaaaagaaaaaacatgttagtaagatgcatggtcacgacagatgactgtgaactctggctgttacgaaccaatcactgttgagtactgagctcacctggttcctgtcgcgtgcatttgtgtacctgatcttctgaatgaagtagaatatgagccatgctgaagaaataatcatcaaaacaataaaggatattgacacgaagactagagagccacggctgaagttcttcggtggcattcgagttccaacagctattgtcatttgtacagagatgtttttctccagataactcaaaatatccttacccctcaattctgttatcatgacagcaataatatctccagtgcctgcaatataaaataaatatataactcaagtgacatttaaaacttatggaaacatcaaatgtatcaacacgctacttaggtaactactataatgtctggtaatggaaagggtatgcaaactccacttctcaactgaaatgtagatgcagctgggtatgctggcaccaagtaggaacatgtaatttgttgtgtggtacttaagacttaaacagacataaggcatagaacgactgcagtgttaagaaccatattaacttgtctgacaactacatttttaaaaaaagattattaaaccagccaaatgtgacaacagacagcaacataacattatacagcaagagaagtgtatcaacatcatggtagatttacactgtaaaaccttttctattttaaaatgatcttcagaaagtcttaattccttaagaaatggagtaaagtgctgtttttatagcataaattggtacttcttgcactaatctaggaacattcatggagtacccactgtctgtagaactagtgccaggaacaaaaacaagtacaggataccaagctttctaatctcactgagacaggggacacacagctggtaacagagctacaaagtgccaaatggtgccaccttttattagtgacatctgaaactaacttgggtcttatgtccagacttgagtggagttgaggctccttgctagtttaccccagaactcttctggaaatcaaacgttccagagacaggtccaggcttcaacattctggaccagtttggcatcgaaatacctccagcctctaacagttgtccagaggtctgcccacaagcacaggctatgcaagttaattacgaggacagtcttaagttgccttatagttacctagacctttcccctacataatttccagaagtagtaacagtgaaggaattgaatacctcttcctatggacagcaggaaactgctatccctttcctcctccacaaaggaaataacttcccactgtcttttaaggaaacagagaaacttctatcaatctatcagcgattgtcctttcataagctgaagctgccggtggcaacatgtagcttctacatttgccttctccagagagcccctgagagagactaggggtcattagaagggaaataaatattttattttgggaaagagaaaattataaccacttatttgaatttgaataaggtttgtacatatcaatgtaaaccaacaaaacaatcaagcagaagtccccaaaacttgtccttttcaatccttcttcaatgaataacacattgaaatatttggttttacatgtttcatttaccatatttagctaaaagaaccatctttgtgttacatgcagtcacagaagactacacgcaactgaaaagaaattcaacagggctgggcgtggtggctcatgcctataatcccagcactttgggaagccagggcaggtggattgcttgagctcaggagtccaagaccagcctgggcaacatggtgaaaccctgtctctcacaaaaacaggaacattagctaggcatggtggcacatgtctgtggtcccagatactcaggaggctgaggtgggaggatcactggagtccaggaagttgaggctgcagtgagctgagatcacgccactgcacgccagcctgggtgacagagcaagaccctcaaaaaaaagaagagaaatacaacagtaaaaggagttttatggaaaatgtaacccaatggaacatatacctttttactaccttactcaaaattgttacagccactttattagaacagcagtttaccagaataccgattaaaaatctacaaaaaactataaaattaaagcaagcaataaacatctaattaatatctaattacctttctgaaataagagttgtgatcagtaaattagagacaatcacaaaataatgctaaaccgctttaaatttccctttagaaatctcttaaaatgttgttcaacgggccatgatctgtggtataagataccaggtatggctataaagtaactgagacggatcccacaaacgacatatgacaatcagtctcattgctttataatcacaccaggtacaaacggttttagaaatcagttgaggctccctcttgaagactcaagctggaaaaggagtagggaaaggagtagggaaaggagtagggaaaggagtaggaaaggagtagggaaaggagtaggaaaggagtagggaaaggagtaggaaaggagtaggggaaggagtagggaaggagtagggaaaggagtagggaaaggagtagggaaaggagtagggaaaggagtagggaaaggagtagggaaaggagtagggaaaggagtaggaaaggagtaggaaaggagtagggaaaggagtaggaaaggagtagggaaaggagtagggaaaggagtaggaaaggagtaggaaaaggagtaggaaaggagtagggaaaggagtagggaaaggaaagctgaacaggtagccaaggaaaccaatccatgtgattctattcaaagaacactaaataagaacaccaactaatttcaacgggaaagctgtttgggaaaagaagtgtgtaattatttcaaccatccattcaacaatatttattgagcacatactatgatcaggctcctttcacctcttaaagagagtagaaaattacctgctcttgatgcaaaaatccacacgccctcaggagcaaagggggaaccttttggactaggaagagaagccgctcgcggtggcgtcattacaccagcacagagaagagccgggcagaggagcccgaccctgccgatcgggcaggaggacagcagaacgaaagcccgccaccaacttgcaaaggactggagttttaggtcttaaatcttttacagaatctggcgaaagttatataggagtcccctcctaggagaaagggccttctccccatactccacccctaaagcctgatagggctcaaagaccctgacctaaagctgcctcagacacttgacttttaaggatctgaggagctctggcccagtttcacgccaaaggaaatgtaggcttcacaataaagggccggtcagaggaggcagtgactgaaaagagtgaagaataattagactgtaacgctgtaaatatcaaagcacatttgggacatgccccaccactcccatgtcccaggccctgggcaaacactgctagtaagtcacggatgcggccacgctcccacgcacttccacgtctggccgccagtactaactgtcagagatggcaatccagtgaaagcccatctgtgatccctgcttccaactattttcttgagaaacttcccccactgttattctttaacaggaacttctgtttccacactgcttgagtctggctactttaataaacaattctattctttccactttcatcctgagaattttcaaacccatagagcagttccaatactgtgagaacactcatggaccttttatttagatttgtcaacattttgtcctttctatatgtatttatttttgctgaaccaattaagagtaaactgcaaacacatgacattttattcttaaatacttccacggtccctcctaagaacaaggctagctacgtggccacaattcatttacttatcctcaagaaatttaaccctgtgttctttaatagatggtccattttcaggtatctgtggtgatgactttaatagctgtttaacttgtttagttttgtgtccaggattcaatcggggctgtcggcatcatgcttagctgtcatgtctcattagtctcctttgatctagaatagttcctcagtcacttccggtccattcatcacaacactgacctttttaaagagtccaatccagatgttctgaccatgcccctcaatctggatttgactgtttcctaatgattagatctccaaattaaatatttctagtaagaataccacaaggtgatggcgtgtccctcctcagctcgtcacttcaggaagtgcaggccgggttgtacctttatttttggtggcaaattttatgacttggttattttggtatctgccaggtttcctcactgtaaataaatgttttcctcttaattaataagcaatctgtgggctgatacttccagattgtgtgactagccagttccccaaaaacctttcactcaatgctctcagcatccactggtgtttgcctgaatctgttacgacaatggtatttgtaaaattctaattccctaatgctgtgatttcttctacattttgtaaactgattctataatcaaaggcattaacaacactttctacttatctttgtttcccattaaaaaaacagaaatgctgggtgggcagtttttcggaaaagagccccccatccccatcaattctattttttaatgaggaaaaaaagtgggaaaatatgataatactgctataatcctgactacaaaatcagttttgagaggccaacagaaggaacctcagaattaagctcctttgggctccggaatcggagggtctaggttcaaatcccagcatggtactttaacctctttgaacttcagtttcttctttcaaaaaatgacaaactacctgcaggcttcacagcagatgttcagtaactgctgcagcgtaatgagctgtattagtctgttctcacactgttacaaataaatacctgagactgggtaattgagaaagaagaggttcaggctgggcgtggtggttcacacctgtaatctcagcactttgggagatcaaggcgatggatcacctgaggtcaggagtttgagaccagcctagccaatatggcgaaaccccatctctactaaaaatacaaaaattagctgggtgtggtggcaggcgcctgtaatcccagctactcgggaggctgaggcagaagaattgcttgaacaagggtggtggaggtttcagtgagccgagactgtgccactgcactccagcctgggaaacagagtgagactccatctcaaaaaaaaaaaaaagaaaagaaaagaaaaaaagaaaagaggtttaattgacacacagttccacatggctagggaagcctcaggaaacttacaatcatggcagaaggcacctcttcacagggcagcaggagagagaacgagtgcaagttggggaaatgtcagatgcttataaaaccatcagatctcatgagactcactcactagccatgattcaatgacctccgcctggtcccacccttgacatgtggggattatagggattgcaattcaaggtgagatttgggtggggacacagagccaaaccatatgatgagctaatcctacttgtattattactcacagaaagcaaaagaaaatgttgtgggaagaaaatcaaaaggcctctaaccacagatttttggatgcccattctctcttcgccccctgcccactgctcagaaaatgcccagggatctgctgaccaacacagtcctgccagctacaaaagaatttatgctttagtttagaaagtgagtctacccagctgggaagagtctgatctatgccctcaccctcttggcttccctccactcctcctgggagtaaaccccggggcaagcccagtgtagctgagcagctgataaaggaagatccaggaagagaacaaatgagctgtctgaggcaccaggctgcaagaggagagaggtggctttaccataagcatttttactattggttactcacagtggcattagttattcctatataacctattatacgtaaagcagaacaccatatactttaagtgaaaaagattaaaatcactttgaggccgggcggggtggctcacgcctgtaatcccagcactttgggaggctgaggcaggtggatcaccaggccagaagatcaaaaccatcctgactaacacggtgaaaccccatctctactaaaaatacaaaaaattagccgggcgtggtggcgggcacctgtagtcccagctactcgggaggctgaggcaggagaatggcatgaacccgggaggcggagcttgcagtgagccgagatcacgccactgcactccagcctgggcgacagagcgagactctgtctcaaaaaaaaaaaaaaaaatcactttgaagttccagaaggactgctgctgaggcaacagctaggtgtattcagggtcaagctgcacatggggcagagccctggctgcctgtgtctcagggagactgctggctcctgatcccaagacttctcatctcactccactgacttaatgaaagtccttctcaaatgttcatccacaactttcagttcttcaaacccaatcttcattcttctcttcactgatcccttaaagaactcaagggggaaaaacagatacattctacattcttttaggaaatgaatatagcaataattctgacagatggaggttatatcaattatagatttcctgctgagacttgtcagtagttttcctaaaatatagacctgctgtcactctgctttcaaaagcctttgatgtatcccttctgtcagaaaaataaagtgcaaactctttcactggacactcaagcactggggagccacatggccctgagggtaactgagtcacggaacggtgaacactctcggacccagtgaaactgttgggcaaagtgactggaatagtggttcatgcaatctgggcaggacggagaggtgaagccaggagggaaactgggagaaaactaagaaagggtccagggaactggaagcttcaacaaaactaaatgacaggaagagagggggagaaagggaagaggcactggtcaggacacaggacacaggagtttgcaactcgagatgtaacaattctgggagatgatgaggcccagggagcagctatgggaccaggctcctggagaagtggaatgactgacgggcctgtggaaggaattttcggttaggtgttcactttccaggtggattctcaagttgcccaggatggtggcaggaccgctgatgaacggggagcagtgacaggcggggaagcacgtgactacggagaggaagaacgcggtctgctgcacaaaactgaaagtgaagtctccccacgtggaagtgactggtgtggacgtgctgtacgccaccaccacaggatccctcagcacccacagacgcacagcaaagaccaacctgtaattttgcaaatgcttgaacctgaacctcctgccatgcgtctgctgggaagccgaatgtgtaagccactgagtggtagtcactcactgataattcctgaggacagtgggctacagcttgtcaccaaaagccaagggtcttctcttctttcttccttgaacaggaagttcttcaatcacatacaagtagggccaaggggccacagtacagcacttgaatgtcagcttttcttcttatgctatctcttgactgtatgtcaagagaaagaaaagggggcaggagcaagcacctgcccagaacagaaagctttcttccttcacacacagaggcagaaggggggtgggcactgaagaagacaagccaccaatcagtggagagccacagactctcagtgaagaatttccaggggttgccaactttcaacacaacacaggaactcccacaaattactgatcctctcaactgagtagttctgtccacaggtcacctggatttaagtcttaggtcttccttccttaaaatctaattttttttttcttttgagacggagtctcactctgtcgccaggctggagtgcagtggcgcaatctctgcctcgcgggttcaactgattctactgcctcagccttccaagtagctgcaatgtcagacacgtaccaccaaacccggctcatttttttgtatttttagtagagacggggattcaccatgttggccaaaatggtctcaatcacctgataggatggtcttgatcacctgatctcatgatccgcctgcctcggcctcccaaagtgctgggattacaggcgtgagccactgcgcctggccaaaatctaaatttctaaacatctgtttgtggctcgtggttctctcctccggaaaaacaccactgaataaacctgtttttcatttattgatgtataaaataccatcaaccacaaggtacatcattatgtatcatgaagaaaaaaatctgtcaagcaactctaagatgtcatggaatacaagaaacattcccactttaagttgagcatcccagaaccaatgagaattcttcaacataacaattcttaaaatgtgcaaagacagcctccctgggtccccacttcagtcttttttccatactaattctagagtcccaaatcattcatttaaaaataataataattattattatttaaagaatctaaaacttacagaaaaattcgaaatatcatataaaaacttttaaaacctagaaccattcaagagtaagttcctggcatgatgcctcatcacccccgaatatgtggtattttcctacaaacaaaatttataaacataatacaacccccaaataaggagcttaacactgatgtgtcactgccatccaatcccgaagtccatccaagcttctgcgactttcccaataacgtcctttacagcagcccaggtccgagtcacatgctacactcagtcgtcacgtcatagccatctccgtcagtctgcaactgtctctcggtctttcttggtgtttgtgaccttggcactttcgaagactacattcggcccagttgatctgtcgaaggtatttccctgtggctagattcaggtcaggtgccgctggcagtaacaacacggaggtgaggctgcgctcttttcagtgtacaccaccaggcggccgagagcttttttttatttgccattactagtaaagttcactttgataatttggtaaaggtgatgtcctccaggcatgtgcactgtgaagttcctcttttcccctttgtaattagtatgtattctgtggggaggtgctttgaggctaggtaaatattccatcctcatgaaaccttcagtttacttttactttttaaatcagtacagattcatggttcctattttattcaatcagttgaaacagctactaacgttattcattttgatgctgaaattctaaattatgcttcataagaccctgtgtacagagctttcctaacttattcttttctggacatcagttttccagtgtcttcacttacgtaaatgtgaactacaaatacaatgctttcagtatcaagagtagcatgacactaacatctccttacatctgattatggccacagggatacagcctaagattccaatgtaatgtttggaagccacggcacacatcaatgtacacggagctcacgtgactgaaggttcccaggcattctccttctccatttgaactgttacttaagccacgtctccacttaagccacgtctccacaaacctttgctatactagttttaaacaacccatttgcaggttgacttaaggaatactcctcttatctatgtttcaagatttcacctccctagttttgtgcctctttcaagtaagatgcttacatttatgctttcttacaagcttttgataaaagaattttaaatgggtgggaaaagaaacattaagtagagagttcggcattctaaccaagggagattcaggttgggaggaaagtgggctacagaagctttcacgccaagcaccagaactctaaaagaccttcaaatctgttatttacattaaagaatttataaatctgagagttcagtgagctgaataattaagtaaatagatgtaggatggcaagagccaggtttttcatttaggagtgggagtttagtgataagaaaggagagagagctacaatgatccatgtggcaatatattagaattggagacataagtatgaactcattgttagcttaatatcaatgcagatgattacagatagaaatatttatagatatgtagatatgcaggagttaggatacacgcatgtatttccttgttctgtcagctgagaaggcccagaagcaacaggcatctcggcagtaacatcacatctaatgcccggatcttggtttttaataccactctccaataaacagaaaccagggttccttggagaaatggctgattctaggactgatgtgtcattactgataaagttcaataatgctcaaggggcagaaaatatatgcaaaaggagcctggcacatcttacagcaccagaaagtaagaaagtgctcaaaaactaaactaaaccaaaacaaaaaaacaaaaatccaacacccacaacaatggaggcatgtcaaaggacacaggagccaacataaagaatccccagtggccaaagctaggataatttgagtaacagagttgtactgtactataatccagagtgtaaaataaatacccatgggtccataatgatataaataaatgactgaataaattaataaatggagcagaggcaaatcacccatgcagaaaaattccaaataattatgtagatactctaccctaagggagatggagcataaatccccacttattaagtgtgggctgtgcacagtggtgtcaaaagttatcatatggcagggggaaaagagttaacttcacagtggagaacctgacagacactacctcagccaggtgaccaaagtcaacatcactggtgatacttcacactgatagcacataaacttggtatgacaggatgcatgctaatggtactttacaaatccctgtggtcttcctcccaaaaacccatatccctagcctaattataagaaaactatcaaacatgtcccagttgaaggacattctacaacatgctgggccagcagtcctcaaagctgtcaaggtcatcaaaaacaaggaaagtctaaaaaagtatcacagccaagagaaaactaatggatcatgatgactaaatgtaatgtggtgtcctgggtgggatcctagaacagaaaaaaaactaggtgaaaactaaggaaatatgaataaagtaatagactttggttaataattatgtaccaacattagttccctgtggtacaacaaattaacatgtcacatggtacctaacaggaaactgggtgcagggtttgcagacattctttgtactatcttcccaatttttccataaatgtaaaacagttctaaaaagtaaagtttttttttaaagactcattatataaaagggaacaacttctcatcagaaaaaaacgtaagccagaaaacaacaaacaacacctttgaagtgctgaaaggaaaattctgtcaacacaaaaatttatacctgtctttgaaaaatgatggccaaaaaaagacactttcggataaataaatgttgagagaattcatcatcaggagatctgtgctgcatgaaatgatttaaaaaaagggaaatgacaccaaacggaaacttggaaattcagaaagaaataaagaacagcagaactgttagtatgtaggcaaacataaaagcctaccgttttttcatgagttttgccattcccactcccttcacgaatgaggggtcccttttcattcttcctctaaacgctcctcaaacttaagcatctgacagtgggtctcaacaggggcagtaaagctctcctgggggtgtctggaagccctgtgggaggggtctccatgctgtcgcaggcgcagaggtgtgccaccagcacttagcaggtccacacctgggaggtgaaacactctgtaatacaaaagacagacctgcagagcaaaaggactgtcccaaaatacccctgccttgtcctccacttccatcctgaatcgagaagcactgtaagcatcaatgcggggtagagatcctcacccagacctctaacacctatagcctaaggctgcatgatcctccttagcagctgtgccagtgagaccaactcttgagatcctaactccaaggtcaggtccatcatcatatgaacttctatcagttaagaacatcctccgtcctggaacctaggaaactgatttctaaaacagtatttcaaacccatgtagatcctttatatgattttaccttcctcctcttctgctgccagtgaggaaagagaagcacagaaaagacaaaaaagtaaatcaagtgacaacttcaaacaacccacttgggacacggagactgcaaggaaggctagaggacagtctcatgtatctgctggtgaaggcactctccagttccacttcagatttaaagaaaaaagaaaattaagagcttatggaagttttaaaatggaaccattgcatttattttattaaaggctatttttatttttttaaagctactgcttaagtgtttcagttttagattttgataattatgaattttttttaaaaaaatgtatgaaccagatggaagatacagtagaagcatgtgcaaactcaggcaaaaatataaatgcaatttaaacccttacttcctgccacagcagtacacttcaattccaagctccatcttttctgaggtagttaaatccatattcaattagaagctaaaaaactttaaacggtaaaacaatagtatacttatattactcattttcttgataggcatttagaataaagaaaatagatttacgttaagtggcccaaattactgatacgtaaaggtattctacaatgtgtttgtgatttctttttacttgttttcataaagtattttttgtattcacagtgaattttctatattttacaaagtgtgacatttttctattcaatgctagataataaatatagagctaaatacgtttttaagagaatatgatggaaaaaaggtgaagagccattcaactaattttgttcaaccatccaaaaaaaaaaaagaaaaacccagtaagaagcatctgatattgctgattgataaaaagattaaaaagcaacattattatttggttacatgtttatctaaattacctcatcttcctttcaacaatggaaagaatgtccacaaaattcttacagacatacagataaaactacagctaattctatcagacagtgatttaacacaacttaagatgattaaacaataacagtaaagtctatataaatctttaaaaaccaggaaaataaatccataattttcagacaagtatgcattattgtaaactatccaagaacccataacgtccccttcatactaccacagatccgctaactacatgacaaagaactcactctgctaaccagaggtaacaagtgaaaccacacaatgagtagcctttcctgtcaatgacgtcatggacagggcactggaacagacgtccttcagtcaccaggtgaagggcatgctttagaataaacaggaccaagctcttggttgacaaggcaagaaaacaaaatacttacacttgtattggtacatacagtatatagggaatacttatattccaatgtggaattttaaaattaggtataaaacatagccttaaatgaaaagaaagcttaacaaccaaactaaataacttaataaaatcatttcagagcaagccatatttattttgttcagggcattctgctgaccactgcagagaaccgaaagacatgacacaaactttaactgcatgaaaccctgggcttttccttactgccagtccagtatgcaaagaatgaccacatgaaaggaaaaggacaatactgtcatggaggcacagagagggctctgaagactgcaggagccttggactgtaaactcagtaagggcaatgatccgggtttctctccttttgacttttaccagttcttactagttcacatcaaaatgcacagcacagagagctgccaaaccactgcttctgccctatgatgaagggagggcaaaactggcacaggagcaggacggggtgaaagcacgggtctctgggtccatcccttgagactgtctggggtggggtggggggaggatcctggaatcagtgtctttccaattagcttatgtgattctgacaccagggttcttgaatttctgtagacagcactgccctacagggtgagaagggttatctgtggaggaagggaactgagtaacacattgatgagcctggaaagcaaggagttgccagtgtataatgaccttctctgagtataagcagaaacagaaaggcagagagttatggcatacgaaagtcagaagaggatcataattctggagatttaccgtgaatgcctggctgaaaagacgagactcagagaagcttctgatagtgtgtgtgttctctgtgctacttaacctgcacttctcaccccattcttaggacaggctttcagctagtgcagctcgctggactgaaacaggacctttctataaccactgtccctctcatcctgagcacccactccattaagaaccctagcagccaggacgcgtgccttcctgctccactcttcctctccacacgtcacctgtggggcttctgttgccaccactggttccctccacactcccacccaatgcttcctgctggttttccaggtcccaatcagatggcagagaagaagctaggaaccctgctagctgcttgagacagctgccatcattcactggggctccggctgcccggctctgtggctgctgccggtgtgagactgcacaccccagtgcagcgctggaaagcacagcttaggccgcatcaacctcatcgagaccacgcctcccttctttcaaatcctcccgtgttactaagcgacagtccctgctttaggcacacttctgctctgaattgaatttactattaccctatccaccatgttgagctgtgctgtttttttcctgtacttaaaattacttttgttttgcttttccccacctcagatccttcacttacaaggggcctttggcctagaatactcttctcaactcctcaactccgactcggatgctgtttcctcaaggcattcctctctgaccccttggacctaagtcacttcccacagtcatgacttcgtactcaatgttcatcttctctgcttgttataactccatggaaagaggcaccatgtgtgtcttgtttatgcttggagctctaacaagagttcaaaaaacaattagcatatagaatccaactccctctctctacttgcagttacctgattttctccatttccttccgactccctctcctctcaccagatttttgattcatgtggttcgtctactgagaggattttctctttctggtcgaatcctaagtaatcctcattatgcagggcctggcacaatgaatgcctcctacatgaagtcttccagacctgggtcagaacccctttcgtaataacactacagctgatcccgctacgtaggtatgcaaagttatgcactgagtggttccccaattacttcaggcgtgtgtgtttccctaagggaggaagtgttcccggcaaacactcactcgtacatccttctacaaatccctacagtgtccatcacagaatgcctggcatatagcaggtataaatcgatacctgttgattaactatttttttgtactagatatattttaaacaattaagttatatggaaaaacaccaggagaatgaagaaaaagtatacttagaaatttttttaaagtgccaatctcaaaatgaaagaaaaattgatttcataattttataaaagctactgcttattccaggcataagaaaaattgtacaactgttatacattacagtttgttagctcaataaattttgcaatcaccctcttttaggtagacgaggatgccagtttaaggactccgttacccgaaatcacaaagctgataatcaacttggtctaagattcaaatcccaatcttgtgactgtttgacatttatgccaaattcttttctctattttagaggtactatatcatccaactaaaacatttttttcttctataactaaaaatgattgagaatgtcataaaaaattaaaatctgtgataaattattaaatatgattttggaagatgaacaaccagaagaaactgagacagctatggaaacagtgatctataaattggatgaagtatttcaataatgtttttctaaggtgatgaatatgtgacaggcagcatctccactgagaacagcatgaaaccaagaatttattctgtctgaaaaacaggagacaatgggcaacagcctagaagttcaaagggaaaacagaaagtgctcaaagaaaaaggataaaagctctaaccaagaaccaagaatcttttcacacactaagatgagtagtttgcagataattcacaaattcccaaacaaaatggcatttttactaatcttaaaaataaaagcaatattatattgcagaatttttttaaacaaatgggtttacttccattgcttttgtgaacaatacagccatgtagtccaacgtagctgggactacaggtgagtgctaccacgcccagctcatttttgtatttttagtagagatggggttttgttatgtctagaacaggctgacctagaactcctggactcaagctacaccctgcttaggcctcctaaagtgctgagattacaggtgtgggtcaccatgcctggccactatccacctcttttttttttttttgagacaaggtcttgctttgttgcctaggctagagcgcagtggcacaatctcagctcactgaaacctctgcctcctgggttcaaggattctcctgtctcagcctcccaagtagctgggactataggtgtgtaccaccacgcccggctaatttttgtatttttggtagagatgaggtttcatcatgttggccaggctggtcttgaacttctgacctcaggtgatccgcctacctcggcctcctgaagcgttgggattacaggcgtgatccacacccagccactgtccactttttaataccattctatccttatatgctcttttaatttctatcttgaatactcaaaatacaaataaaagtaaaaaaagatcacctcataaatacttgctttgtctctccaagtaagaatacttgaggacatacaactgaaacctgtttcagtttaagaatcttgtatttgtgttgcttttgaactttagtttgcattatactttttaaaaacagccttaatgaggtataatttacatcctacaagactcatctttgtaagtgtacaatgagtaaaattacagggatgtgcaaccatcatcacatccagttttgggtcatttccatcaccccccagaaaattcactcacgccgtttttaaaaatacatgttccctttttggtgttttatttttgttttttaaaagatgggggttttgctgtgttgcccaggcttagacttgacctcctggggtcaagggtgctcctgcctcagtctccgatgtagctgggattactgatgcttgccaacatgccagctccctcatgctcactgcaattaatcttcatgcccagctctaccctacacagccactaatgtgctttctgtctctgtatgtttgactttcttagacatttcatataaatggaatcatataatagtagccttttgtgtctggcttctttcgtttagcataatgcttttgaggtttatccatgtgtcaagagttaattccatttacagctgagaataccaccagtgtgaactgtccagatccacttacaggcaaattttcttcctccttggccatccctgaaataacaagaccaaccgtcctcttcctcctaccccctaagcctactcaatgggaagaagataaggatgaaaaccattatggtgatgtgaccaacttccacttaataaacagtaaatatattttctcttccttatgatttccttaataacattttcttatataacagcatataacatatataacaaagtatgtattaatcgactatgttatcagtgaggcttttggtcaacagcaagctattagtaattaaatttagggctgggcacggtggctcacgcctgtactcctagcactttgggaggctgaggtgggtggatcacctgaggtcaggggtttgagaccagcccggccagtatggcgaaaccccaactctagtgaaaatacaaaaattagctgggcatggtggcacgcacctgtaatcccagctactcgggaagctgaggcaggagaattgcttgaacccaggaggcggaggttgcagtgaaccaagatcacaccactgcactccagcctgggtgacagagttgagactccatctcaaaaaaaaaagttaaatttggggggaggcaaaagttatacgtagctttttgactgtgtgggggtcagtgtccctccctaaccttctcactgttcaagggccaactgtaattgctaaactatattcaattttatggacatataacttgtttgtttattcaccagttgatgaacaactgcgttgtctctacttttctggccataataaacaatgctgctatgagcatttgtgtgtaagtctttgtgtggacatttcattgttttcatttctcttagatatctgggagtgggactgctgggtcatatggtatttttatgttcaatgtttaaataaattgccaaactattttccaaactggttgtaccatttcacatttctactcgcaatacataaggattctagtttatccacatcctcaacaaaacttggtactgtatgactttttaattatgatcattctagaggatgtgaaatagtattgttttggttgcactgttgttttgattgcatttgtctaatgatcaataaaatgtctaattattaaaccttttgcccgttgtaaaactaggttgtttatcttgttgatttataagagttctttatatattctggatgcaagtcctatatcagatgtatgattgaaaaatattttgtttgtagcttatcttttcattgtttttcaatggtttcttttcaatgacaaaggtttttaattttgataaaatctaattttttttataaacagtgtttttggagttataggcaagaacttcttgttcaaaatcacagactatcttctaaaagtttacagttttacctcttacattttgtctaatatccaagtgaagtcatttttatatagtctaaatcccttcctccctccctcccttctttccttcttccttgaaacaatcttgctctgtggctcaccttagagtgcagtggtgccatcatggctcactgcagcctcaacctcctgggctcaagtgattctaccactttagcctcccaaagtgctgtaattacagcatgagccacgaggcccggcttctttttttaaatttgcatgtggataacaattgtttcagcactggttgttgaaagactgtccttccctcactgaatgatcgtggcacttttgttgaaaatcaattgaccgtaaagatatttatttctagattctcaatttggatccactgatctatatgcctgtccttctaccaataccacaatgccttgattactaaagttgtgaaacggagtgtgtaagtcctctaatgctgtgctttttccaaaatgctttggctattctaggtactttgcatttccatataattttaggatcggcttatcaatttctacaaaacacatgctgtgatttgcataggtacataccacaaggaatttatatatccattttaagataactgccaccctgacaatactgaacaatggaatcaaaggatatgaaaggtctctccatttatccagattttttttttttttgagacagggtctcgctctgttgcccggcgagaatgcagcagcaccatctgggctcaccacaacctctgccttctgggctcaaatgatcctcccacttcagcctcccgagtagctgggaccacaggtgaatactgctacacccggctactttttttattttttatttttttgtagagacagggtccccctatgttgcccaggctggttttaaactcctgggctcaagtgatcctccctccttggcctcccaaagtgttgggattacaggtgtgtgctaccacacttggctgagattttcttgaatttctctcagtaatgtttgtaggttcaatgtgcaattcttacatttctttttaacaagtttttgttgttaggctattgagaatgaactcttcttaatttcatttttggaacgttcatagctagcatatagaaatacaatggcttttgggcaggcccagtggctcatgcctgtaatcgcaacactttggaaggctgaggtgggcaggtcacttgaggtcaggagttcgagaccagcccggccaacatggtgaaaccatggtggtgtgcgcctataatcccagctgctcgggagtctgaggcaggagaatcactttcacttgaacccaggaggcagagattgcagtgagccaaggtcgtaccactgcactccagcctgggcaacagagcgagactctgcctttaaaaaaaaaaaagagagagagagagaaatacaattggtttttgtataatgactttgtattctacattctttcaagacttgtttattacatctagtggtttttaataaattctatctgattttctacatacacaacctatgaataatgaattttatttctgcctttcccaactggatgtcttttatttctttcttccctgtgtacaatggttaaaaccacaagaaaaatgttgagtaagtataatgttgaatacaactaatgagagtggacatccttggcttgttcctgatcttagggagaaagcagttagtctttcactatcaaatatgatgctaactgtggcttttccacagatgccctttatcaggctgaggatatttcctaatgtgttaaatgcttttttttttttaaatcatgatgggtactgagattttgtcaaatgctttttctgcacctaccgaaaatggttagttggctttttcatttattctattgattttcagatgtaaaaaaaaaaaccatatatcccattcctggggtaatgaatctaatccattttatatattactagattctatttgctaataattttaaaagaatttttgtgcctacattcgtaagggatattggtatatagtttccatggatctctttgtttggctttgatatgaaggtaaaaaccagctccacagaataagttgagaaatgttctctattttctgaaagtttgtgaaggattagtattattttttctttaaatatttgatagactgcaccagcgaatttcatgggaagatatttaatccccaattcaatttcttacttattatagctactcagatatgctattttttcttgagtcaattctgacaatctgtatatttttaggaatttgttcatctaaggtgtctaatttgtcagtatacagaaaaaagtaaacatagcaggtttgaactactatccgtcgaaaggcctgcttacaatcttggcccttgggtggcatctgggaacatgggtttggggaggattcccaccattacctaataagagtgactcactgtgagtgtgactatgtggtgagtcctgtgagtcctcctagtgagtcactgaacctgtggatggtcatggggaccccagacatagttaccataaagttcttcacaatattcctttataatcctttaagtttctgtagagtcagtagtgatgtccttttttagttgtgattttggtaaactgtcttcttttttattgttggtcagtctatctaaaggtttgtcaattttattgatagttccaaagaaccaacttttgggtttcgttgactttctctatgacttttctgtctcacttatttctcctctaatctttattaactcctttgttctactggtttggggttttgtttgttcctcttttttatagtttccaaaggcaaaagtatctttgtttactgacctaggtatttaaagctattaactttcatctaagtactgctttcccagcatcctacaaattcggatgtgttttcattttcgtttggttccaaatgtttttaaaatttccttttgaattttttattggacccgtgtgttatttagatgtgtgctgcttaatttcaaagacttgggaatttcccagcttttctttagttgtggttgaagaatacactttgtacaatttcagtctttgaaaatatattcagacttgatttacagccaaccatatggtctatccgagagaatgctccatgtgtgcctgaaatgaatgtgtattctagtcagtatgtagagtgtgctacatatgttggctaggtcaagttggttaatagtgttggtcaaggtttctatatgcttgctaattttctatctagctattctatcaattactaagagtagggtgttaaaatctccaactataatgattgaaatgtctgtttctccttcccattctgtcagtttttgctttgtgtatcttaggtctctgatatatgttggtgtgtctgacagtgtcccacaggcatctgaggctctgttcattttccttcaattgattcttccctctactattttgaatctgctgttgaaggcctctagtgaattttccatttccaaaattgtactctccaattccagcatgtctgtctggctcggctcttttatagaatttttatgttctttactgagaatctctatttgttgactcattgctgccattcattattgtcatactttatttctttaatatagtttcctttagtctttggacatatttatattaattgctttgaagtttgtctctgctaaatccattatctgggaacacttatagacagtttctatagacttttgttttcctgaatatgagtcaaacatctctatattttgcatgtcttataatctgttgaaaagtgaacattttagacagtatattgtagcaactctggattctgatattttcccccttaaagttggtggtgttgccttgtctgcttgttcacttttgtttagtaacaggctgggttaaacacatgaaatctattttcactgtgatgtgcaaccatgatgtttccactcagtttcttcttgttctatgttctttttcctccttctttttaataagactggtttcctaggaactgcccagtcactggctctcctctgctagcccacctctgtgaagtcacttccacagacagtgacactggactctggtgtcattcaccactgcaaacagaaactgccagtccttgcagcctgctccacactggcagaaactccacacagcatagcttggggagtttgggaagcagcaccctgctaaaccacaaatttccactgctcttacctgaagtctagaagtttttcaaagcataaatgtgtctcagattattgtcccttcattaatatccagaacactgaaatggctgtttcgtcaattttgtccagttttatagttgcttttttggaagaggatttgctgatctcttcacttcgtcttaaccggaagtgctacccctacttctctgttatttttaatcctaccttataaatatttcacaaagtttttctctaatgattattttgaaatacttcaaataagcaaaaattacaaagaatataatgtctgtctacccccacactcagcttaagaaataaaacattatagatacatttacttctctctgatcctatttcctttcttccctctccagagacaaccattaccctaaattttgtatttcttaatcttatgtatgtttttcttagtttatacctatatacatgctcttaaatgacttaattaaaaagttttgcattttaattgtattcaaatgatatccaactataaatattcttctataacttactgtgtttgggagacttattcatgtaaatacatgtagctttaatccactgacagttaactgctgcataaacgtgccacaattaatccagtctcctatgacagatgcaggtgttttcaataatctgctgttacaatgctgtaacactctcctacgtgtcgtccatgcacatgtgcgagagtaacaagggtggaaagaaggacagagagaggctatcagtgcttgtgtgagtatatgaaatctgcccgctggctctcacacggttggaggtgaaatgtgagagaagggcaaacagcagttgtgctccaccgtaggcatccatggccctccacagagtctagatttagagtcacaagaggccttacagaaggcctctatcctccaacccgcactcaggaggcagcttggcctatgtcacagagcacgtcagtggaaaacctgggactaaaactaggtttcccttcttcactgccttctttctcaaatcaagatctgtaggccagcaacatcagtgtcacctagaaacttgttaataatacaggctcttgggtcatattccagacttactgaatcagaatttgcattttaacaagattctgagctacacattcaagttttaaagatggaaaagtactctagagtatgtatctggagtgaaattaatgatcgcagtgtgcagattcttttaactataccacataatgccaaatttctctccaaagtattgttccaatttacccaatttactttcccacattatgttttctaactgtctatgaatctaatcacaacataaagccgtttcctattgctcttatgcacacctccactgtttgccttaccttccacttcctaaatatatcctcaaactatacccctgcatttctttaatttgtgctgttatacactcatctgtgataaaaagagttacatggtcaaataggtttgggaaacactagattactcaaaataaaacagggttttttgtttagttttgtgtttgtctttgagacagcttctaactctgttgtccaggacgcagtgcagtggtgtgatcacggctcactgtagtctcaacttccccaggttcaggaaatcctctcacccaagccgcccaagcagctgggactacaggaatgcaccatcacacctgctaatttttgtatttttttgtagagatggggtctccctatgttgcccaggctggtctcgaactcctgggctcaagcaatcctcctaccttggcttccccaggctcagggatccatgatcgtaccaccacactgcatcctgtgcaacagagttagaccctgtctcggggagggggaaaaaaaaaaagcctgttttgtttttttttttattttgattaacctagtatttcccaaagtgcttggattataggattacaggtgtgagccactgcgaccagccaaaacaggttctttaagacttctcagagacccaaaaatgttaataagtcctaggagcccctaaatgtggactacatttcaagcattttctgaaacttactgtttccccatgagtcctctaggaacatatctaaacaaactaacatttcaaggaacacagctgggaaatgctgcattgatacaggcttcccatcctttttaaatacaagtaatttaatttttttttaagatttcaattccctcataattcccagatcatctcatacttttattaaaagactctcattctagctacttctctgtggttttgtgtaagtaaaacaacattaataagaaagaaaaatacattttgctcagttgaatttctccctattcatttttcttcatgttttaagtaaagaagaaatcagcatggaatgaagataagttacattaggcccacatctttaaatagtttttcttccctctgagacaactgaggaaagcaaaccggcacctgctctgaaacctagcagaaaaactaccctcgagtcctgtgtttccacatagatgtccagctaaattaaactgccccttaattttcttttgctttccctgaataaattaaaagttacacgaccccagtgatctccggatagtgaaaaatcacacattttattttattctttgtgtttttctttagtttcagtttttgtacaataagcatgtgttacttttgcaattggaaaaaatacaccttacttcttttcttttcttttttttttgagatggagtcttgctctgtcacctaggctggagtgcagtggtgtgatctcagctcactgcaacctccacctcctgggctcaaacaattttcctgtctcagcctcagtagctgggattacaggtaccctccaccgtgcccagctaatttttttatttttagtagagacaggggtttcagcatgtcggccagggtggtttcaaactcctgacctcaggtgatcctcccaccttggcctcctaaagtatatcttacttctaaaaggcttagtttgaaaggaagaaaacaagtcagagggcactaaagttgaaatccatctgcaccattctatcaagatgtgtggggaagtaccaacgactctcaattaaggtgggcaagtctttgcaagaaacttgctaaaaataattatgtaaaaattacacgatgaaaagttagttctttaaataagccaaactctaaaattctcatgaatgcaaaactaaattttatctggatttcaacttaaggagacagagtggtgaaactaacagaacatcaacaaaactagggtgtgagccctcttctgttggcccttacctctttcagtccccttcctagtctgtaagatgggagagaacatacatcatgcatggttattgtaaagactgtctaaaaaatatatttaaaaactcatcgcacagcgcctggcatttatatagtaagtgctcaataaactgcaactattgttattaaacaatcagaaatatcctaaatgcttccagaagaaataaagaagcattgttactactgaaattatattaattactaagtcaatttcaacatttatcctgatgaaaacagaatccttcccagacaggcaatccttgagaatccatgacataacctgggcgaatgattccaaatcaaatacattatttgtcaaagttattaagcaaaatgtagaaatgcaaaacaactaaggatttaatcacagccagttatttaataagtccaagctttacagactgctatcaccattacttacaaaaaagaagaaattcaactatggggaaaaaacatgcatcccaacaaacaaatggcaatactaataggattatgttggaaattacatggcttcagcagaggcagaatgcttacctataaagcaatgatttctaagaagaaaaacaaaatcaacaaccctcatttttgtttacctggatgagtcatggtaactggctcctctttggatttattattgtagatgactacagcaactgcattgtggaaagcggcccgtgatattttctctttaaacgtgcagtttcccctctgcagcaaggcaatccactgtttgatattaggagggacaaagaaccgggtttgtggatcacagcccagatgatcagcaactgaaaagaaaaagaaatacacacattaaagataaataaaactgaccaagtctttatcaaagtgtcaactgctttctgaataccacacagagctaaagcacgtgaagcagctcgctgccagcagagctatgaatacatccacaaacaatacaatgaagctgaatcagtacctatagggagagatgctccatgggacggttacctataatgcaaattaaaacaatgaaaatttcttaactttacagactgataaaaaataaaaaaggactgataatatccagtacagggtggtaaagggaggaggaagaaaaggccaacacagacgagaaacccaggtgactgatgtaaccctgacaccctgactcttactcattcctgttcatgtactagcctctccacacaccgccaccaccgctatccccacagtgagaaaacaggagcctggactgggggccagtgaggaggccaaaataatcctcggttcagttactaagtgatcctgttgaaattcaaccatgttagagcaaatttcttcataaatgtctaaggaaaatttaaaagtttggttttggcttatatttgaaagttgaagtagttaaaataacatctaagtagaataaatgtattattcctctaatttatgttagcaaaagtcaccccacaactccgtatcaagatacacttactgtatccatctgtctaacaggttacaagaagacactaagaatgttggtactacaaattacatggccactgttctggattttttgggatagtttatttaaaatactcataagtacatttaaatctgtcagagtaagcgcctcaatttttcactctgcacatatggccatcatggttctggcatcctctgcaaatcttaagaagaagcccccggctgctcttcccactcccactttcacatttataacaggttcaaatgagagagaagggcagcccagaaggggagagaagtcaccaaaggtagagtctgcagactgctggcgcacagtggcagagggtgccagccctgtgccctgagtcagccctgccggtcctctgtgtgccgggaaggaagtaaggaaagggaacacagcgcatggatctaaaaaggtgacaccagaagtaaataaatcataaaagcaaggcgaggtgtggtggctcacgcctgttaatcccagcactttgggaagccgaggcaggtagattgcttgagcccaggagtttgagaccaccctgggcgacaaagtgaaacaaaaaatacaaaaaaattagctgggtgtggtggggcacatctgaattcgcagctactggggaggctgaggtgggaagactgcttgagccatgatcgcaccactgaactccagcctgggtgatagaacaagaccttgtctcaaaacaaatcataaaaacatgaagtattaattgtagtagataaagagatgacgccagtgggaaaatgttggctttctacacacctggaagcacatgcctagcaaaagaaactaaatgcttacacgacttaaattgtaaaatgtaaagatgccagtaacttcagagaactattacatctaccattcccacttaaatatctttccccaaattttctttcaactattgtggtgagagactgcaccaagagtgtatttgctaccagaggtctcctaatacatgaaatggaagatgaatgttttcacaatttttcatgattgatattgtatacgaccattacctacccttttccttaaaaggtttctgcactctgaacctttaacccttcctcaatcaaattaaacggggatagaagcctatgtcatgattttaggagtcaactattgaaagacacagacgatgcactataaaactttaaaatcctgaaacagattgtttactttcatcactatctgtttcaccgataattatgctgtaaaataaaagcagctcagtgacctgttacgataatctcctcttagaaaaatgtctaatactgtatccaaacggggaataaccaaggaactggttttaggtgttctgttcgttatttttcaaaacatactgctgcacaaaccctggaagaaaacgcaaaatcaagaatatctaaagtgatgtgtacccctgccttctgtgcaacacatttaatcatttgtctgtgacttatctcttcttccctgtggtctcgcatacatgcacaatgtagtaaaaagcaaacaacatagttatggaatcagcaagactgtgctccaaggtctagatcaactgcttactagctgtgtaactatcacaggtgactgaaattctcccatctttaatttgtacttatttataaagatttagatagtcttatctcacagaattttacacgtgaaaaagccaagagtaatgctttctggccaggcgtggtggcacacacctgtaatcccaacactttgggaggccaaggtgggaagaccactcaaggccaggagttcaagactagcctgggcacatagtaagaccctcatctctacacaaaataaaaaacaaaaaaattagctaggcatggtggcacgcacctgtagtcccagctactcaggaagctgagatgggaggatcgcttgagcccaggagttcaagattacagtgaactatgatcatgtcgctgcactccagcctgggtgacagagcaagactctatctctaaaaaacagtaataattccttcattcttcaatgcttaaaaaacactctttccctttgtttgtttcactgacattcatcctatgttgtcttggtgatccagtttggtccccttgggagtttctgtgccaaaatatgtgagctaccccacgctcagcagcaccccacactcctctgctcttagtaaccaccactcacagatcccaagcctcatcttttttacctctttcgacagtgtcacagtccactcagaagacagcagttcagtaatattcataatattctaagaatgaaaagacacagcaaggggtgcaaccacagagcaaaagttatcaaacatactgcaggaggactttaaaactctgctaaaggaatcccgcccactgagaacagattctatgaacaacagcatgatcaaaacaaatccaacaacggcctgtataagcaaaagaatgttcctgtttcccaaaattcatctaatcatcatccataaaaggtctctgaaaacattcatattggtagtacaatacaaaataagcaaggataggaagcttctgttcaaaaaagtggtatttattattcagaagaaaataagaggttttcataaacaggaacttaatactgtagtatactcattctacctagttattccctcctgtaattaagaaaatataaataatgaaaacaacggttctataacaacttttcatgactgatgactataattaagtagtattactccaaaatttaataccagttgtttacacttgagcaatttattaagtgaagacatattatggtgtaaaatatctatataattatgagcctttaaaatttgtcaatagcaattctgttaaaattcagaataacggtacttccgtttttcttacctgccaacttttataagaggatactatctctgaattatttgcatttattaattatagagccaggaaaaacttactagaggttctgataaaaatttcaagatagataatacaaaatattttactacagaacttaattttttttttcctctagggctttttcctgctgagtccaaaagtattaaaagtaatgagacttatttacctcttgacaggcaccaaacaattctgggctcctcacctcaatgaatagtaacttatgtgctcagctacacgctaagtaccaaagagagatacaatgtggcaaacgccttgctcttgactcttaaagagcctccacatggccgggcgcggtggctcacgcttgtaatcccagcactttgggaggccgaagtggacagatcatggggtcatgagttcgagaccagcctgaccaacacagcgaaaccccatctctactaaaaatacaaaaattagctgggcatggtggtgggtgcctgtaatcccagctactcagaaggctgaggcaggagaattgcttgaacccaggaggcggaggttacagtgagccaagattgtgccactggactccagcctgggcgacggaagtagactccgtctcaaaaaaaaaaaataaaagcctccacattcactgaggcatcataattggcaccagcacagaagctgacgttagagggtgccaacacgaagtgcacttaagagactgaaggagggaggagggcaggacgatggtcaagatttagtgttagctggagcccacatggaacccctgaaacttgcgcagccaggaaggaggtggatacgcaagttgccagcataaaaacacagagcaaagactaaactcttctcttgaactcttgcaaaattaagtaagacgatatgtaacagagcctacaacactatacaaatttaagaaggtcaagttcagaaaagatctcatttgcaatgagagaaggagaagaatattcaggtaagaatagtatgtaaatatttaaagggctgtaggaatgaaatctctattccacaccccactgtgttcggaattcgtgggttcttggtcttgctgacttcaagaaggaagccgcggaccctcacggtgttacagttcttaaagatggtatgtccggagtttcttcttactggtgggttcgtggtctcactgacttcaagagtgaagctgcagaccttctcagtgagtgttacagctcataaagaccgcagggacccaaacagtgagcagcagcaagatttatctcaaacagggaaagaacaaagctcccacagcgcggaagtggacctctgcacgttgccgctgctggctcgggcagcctgcttttattcccttatctgaccccacccacatcctaattggtcaattttacagagagctgattggcccattttgacagggtgctgactggtgcgtttacaaaccttgagttagacacagagtgctgattggtgcatttacaaaccttgagttagacacagagtgccaattggtgcatttacaatcctccagctaggcacaaaagttctccaagtccccaccagattagctagacacagagcagtgactggtgcctttacaaaccttgagctagacacagagtgctgattggtgcatttacaatcctttagctagacagaaaagttctccaagaccccacccaactcaggagcccagctggcttcccctagtggatcccgtgcggcatgcccacactcctcagcccctgggcggtggatgggaccgagccccgtggagcagggggcagcgctcgccggggaggctccagtggcgtggacggaggggggtggggctcgggcatggcaggccctgccccatggggaggcatctgaggccccacgagaatctgtgcgcggtggaccgcggcgcgtgcaggcccacagtgctgagggacccagcgcaccctccgcagctgctggcccaggtgctaagcccctcactgaccggggcaggtgcagggcccgccaagctcacacccacgcagaactccagggccagcctcggccagcccagagaggggctcccacagtgcagtggtgggctgaagggctcctcaagcgtggccagagcagacaccaaggcgaggaggcaccgagagcgagcaggggctgctagcacgttgtcacctctcaccaccagtctgaaactctcctcctctttgattcatttgatttagtaaaacctcatttcttagaaatgtaaacacgccacataagaagcactcaccatgttgtgtaggctaagggtttccttcctacccctgagaattgtcagtctgctgcaggggcagaagtgatagcctcggacagtatttttctgcagtgatggtcaaaacaggcggccgcacagcacagtggcaaagatgtgcctctccctctcagagcctgtgtgtgtcacttcatcctcctgaaatgccagtcccaccactcttgctcaccaccttctgagcctcaggattctgccaaaatgtcttctccagaacgctttcccagcctcctaagactgagttgggtgcttttttcaagttgccatggcacccttaggttacatccatcttggcatttatcatactgtattagtaactggctgtttacttctgaggctttccttccggaatgtgaggtctagcatctcctgcgaatatgtctggcacatagatgtttaacatgattgatgaaggaaaaggggaaaaacaacagggaaattaagccaaaactggcattaaaaaaaagtttgtggcaaagagttctctgtttcacgtggtaatatcctgactacggtaatgttctatcagttgcttcctacaaaagaggtaaaaataaaaatgagactaattagttaccccggatttagattcctccattgtcagctatggtctggttgctttcctactcctgaattagattataatttctttattctttaaatttcctgcttctaccctatctttccttattttcctttgtcaaattctaattttatgattcaaagaaaaaatacaattcatcatttctgttatcaatttcttaattttatttttaatggcagctactggacttaggtggagctttcattctctttatccacttccatggatataacttattattttactgcttctacactttcacttaaacctaacatttctttttattacttagcttcattgggtgtttagtcttattgaaaatgtttttttctggcccggcgtggtggttcatagctgtcatcccagcactttgggaggccaaggcaggcagatcacctgaggtcgggagttcaagaccagcctgaccaacatggtgaaaccctgtctctattaaaaatacaaaatttagcttggcgtggtgtgtaggcctgtaatcctagctactcgggaggctgaggcagaagaactgcttgaacctgggaggcagaggttgcagtgagccgagattgcaccactccactccagcctgggcgacagagtgagactctgtctaaaaaaataaataaaataaatctcaggccactctttgttctccaaactggcctgccccagccaagcgctctcctctctccactcccacgtcccacttcctccaggctttcctcctgcactaccacagtcattctttgggtctttactgcctcttcttcctccagtcgaaccttcaatactgacgctcccgagtactctgccttccctggcgtgggcccaggactctccagggttcatgttcaccatgtcaacagcacactttttttttttttattggaacaacaatgcttactaacatctcatgctgagcagccctcttctgagaaattatttttcatttttacttctatgaacccagtttctaatagacacagctaaatcaggtcaacagcatgctaagaatcgggagaggaaagtggaaaattacacacacagaagggaattcattcccttccattccaagcaaaacctctgccttgatgagttaataggagttctccaagatttcaactggtttacatggaaggggcacggaagggagtctgtagtccggtttacggcaaatcactctgtatctaatttgtctgtttccaggttgctctgccctgcttctaggctagaggatgatattattatcaaaggctacaggattaacctccgaatctaggcaatttctgcttgactcacataggaagaaccagtgttccatgtaacaaaatcaatgacttagattgattaaaaataatgaggccaggtgcggtggctcatgcctgtaatcccagcactttgggaggctgaggtgggagaatcccttgagcccaggagttgaaagctacagtgaactgggatggcgccactgcactccaccctgggaggcagagagagatgctatctcaaaaacgggaagagggaatttatcctgtctcagaacagggctgtattttgcggtgaagaattcagcacctcagcagtgtcaccaggatctggttccttttcatctcttccctttgccatctgtagcttcagcttcatcctaagagtcccctctttatcataagatgactgccagcagcaaatgaagtcacacagctccctgttcatattcagtgggagacagaaaaagccaaccctccaggtatgtaatttaagctcttcacttctgtgcagctcaccctaggtcatttatccttctgtgccccacaccctcttctgggactcaaacaggtgtcacttaaagcatgtggctgcatggaagtgatcacagatgcctgaattacataaggtttctgttttctgttttaaataagcagaggctggtaggcaattaacagctcacttcaaacctcaaggtaaccttatacagtggctcttaattcatcagaatccacacttggcaattcaaacccaccaaaaaggacaaaacccaaaaagaaagcttctttggtttccaagcgctttgacacagggagacagctaaggtaccacccctctgcctccttccctcactcgagggaaacatgagctatttgggagtggagagccccacttgaagatcagcagctacagcaagcattcttgacaaggctctggggatagaattcagggctgagtgacatttggatgaggggaaatcatctttatttctgctaaaatctaactgaaatctagcattttatttatttataaacacagataacaaaccatctgtaactctgtaaccagcagcaaccacattacagttattgcaaatactgcaaaatactgataaggtgattaggcccaccactgaatcctgtccctaatgttaactgtacaagtattaccatgtcacagacatgttaagtattttaaatactttgatacattgtttcagtatacttgggtttctttaatcctatttactcctgcacttaacactattctgagaagcagcccacaggttaaatcagactgcaaaaggagtctcaactgccacgcttagtctatttgcatatgtatatgatatagctggattcatctctattattttattgtgttcttatttattctacttttctaagcttctttatactttttttccctctcctttctgcctctgaatatattgaccgaatttcatttcccccttttcctcatctatatattcaagttctatttttttagtgcctacccttaaaatgttaacatgcatacctgataaaaggtctacaattaatcagtacctctattctcctcctgaatacctcaaggctcttagtttcctagggctgccagaacaaagtaccacaagcatggtggcttaaacaacagaaatgtattctcccacagttctgaaggccagaagtccaaaatcaaggtgtaggcagggccactctccctatgtctagctctatctagttatttctttatacagatatgtagatacaaagggatttattataaggaattggctctggcaattatggagacagacaaatcccaagctctgcagggtgagctggcaggctggagacccagcagagccgatggagttccaggccaaagaccagcaggctccgcgcccacaagagtcaaaggtctcagccataaggcagtcaggcaggaggaaacccctctgactccagggagtgtcacttttttgttctattcatgccatcagtggaatggataagacccacccacattatggagagcaatctgctttattcggtctacccattcaaacgttaacctcgtccaaaaccaccctgaccgaaacacaagaattctctcaggatactgtctgaccaagtatgtgggcacctgtggcccagtcaaggtgaaacatagaattcaccatcacagtcctcctcacagctcacttttttccttctgtgttccatttccctcctccttattctacatccttcagaagttctttcaatgaggatctgttaggtaaacttgtattttacatctgaaaacatctttcttttgttctcattcttgagtgacaggttaattaagtaaaaaattccagactgttaattttctctcagcacttcggggttgttcttgcactgtcctttttatttttatttttggagacagggtttcactctgtcgcccagggtggagtgcagtggcacaatcagagctcactgctcaacttcctgggctcaagtaatcctcccacctcagcatcctgagtagctgggactacaggcatgcaccaccatgcctggctaatttttgtatttaccccaacatgaggtctcactatgttgcccaggctggtctcgaactcctgaactcaaacaatctgcccacctcgacctcccaaactgctgggattacaggcgtaagccaccaaacctggccaattctagtacttttaaaaagtaaactaaatgtgtttcttgtttttctcctaattgacaattcttacaattaccaattgtaaataaaaaggtgatacattcttacaacaaattatcacctttttgtatagatattatatttatttatttatttatttatttatttgagacagagtctcgatctgtcacccaggctggaatgcagtggtgcgatctcggctcactgcaagctctgcctcccgggttgacgccattctcctgcctcagcctcccgagtagctgggactacaggtgcccgccatcacacctggctaattttttgtatttttagtagagacggggtttcaccatggtctcgatctcctgaccttgtgatctgcttgcctgggcctcccaaagtgctgggattacaggcgtgagccaccgcgccccggcctttgtacagaatttttaagaaggtggcagcaaaataccttctggacacctaaatgctggatgctgcagtcaacatggcaggaatgtcctaacagtggaactgcagcagatgcacttgtcagcagccgtccatcattgtttgtctgctgaacttagttactgtgtatctcaaatggattttgattattttttacatccttagaacgcaaatatatctgttggatgttctccatgacataataaaaagcatcttaagagtaagtttaaatgacggctaatacaaatcactttgcatgaaaagtcaatttcaaaaataataatttctattataaatgatgcaacagatacttcatgcaagatgctacagatctaaataactgaaaattagagcttggtcctcatacaaagttggtgtcacagtgcaatataagtgttaattgtttatccacatcactcttcgttccacaaaggaattacagtactgagtacaactcttcccgaggctctctgttctcttggctcctatccatcaagttttcctcccacctctctaactattctttctcactttccactgctagaccctcgccaaggtctgtcccaggccctcttttctcagtggacagtatcatccactcccctgccttcgactaccacctgtgtacatcacaatctaaatctaaatctccctcttgagcttttctgtttaatattcacctgcctgcttgacatttctccatgaatactgagcagtccaaacttattagcttcctctcacatgtgacgtctttccagtgtagagttctggctaacagcatcatctactgaaacacaaaggacgaaaattcctgttggaaaccaagtggccatatggagactcaacttcccactgctgctgccacacatagggacacaaggacaccacccttgatccagagcagcgcctgaaggcactactaactcttgggcagaaaagaatgtgggagcaagcttgttttatttcatcacttctttcttctagtatgagtatttccagtactaatgactcgatgcaatgacagtaatgacaaagactgggctatctggaccataatttaaaatgtaatgacaggccaggagccatgcagctcacactaacagggaagaagccatctgtccagcaaccaaaggactttaagctaaattggtgaggagggagggaggaagagaatacaagggaaatcataaaatcagtccctacggaggattacagaaaaagaaagactgagagagattgctcacctgagaaaataagaggtttaaagtgttcttaatctgagacgtccataaaccaataaatacaagtaataagaaaaaaccttaaagttcaccttaaatatagaaaataatcagtgacacttgttgaggcaggtctcaagattggcctataatgatggaaagcacactattattcagagggaaaaaaaggattttatgtcaagataatgtacgtccttcaaggaatcccaagtaaacagaagcactcaagaacacctctgagaggcagaaagctaaattagacttcgatgcgggagcatgccgaggtcaactggccaaatggagtaaagataaaggtttttaacagatctcaaaactggcagacaggatagggcatggacagggattgcaaccacctagagctgcagaagagatctcacccctccgcttccattcactttgcctcccacaggacagtggccaggcatatcccggtgaacagctgcccgaacccaatgcaggccccgaacagaagtgacaagtcacatggaagaaagcaacgtatcatttcagagtttacaaaatcctgggcaaacaaagctcagtaacaaatcatcttgatgagaaagaaaatgacacattttatgaagaaagcagcaagaacacacaagacaaattaagctttaaggaggactcaaacaaaacctgaaaaggcaaacacaagatgatggtacaggcttacacagcttttctttaaaaagcccagaaagttgaaggttgccagtaatgataggaacaagcaaagctacttctcacaaaagttttattatttttttaagtatattcagagcaagaagagttggaaagaaataggtttactgcccagggccaactaaatgatggatggaaacatttctcaagacttttttgcttttgctttctctaccacagagaataacctgagaactgcaacaagcacggctacatgacactgacaatgagtgcagagactgtaaaaaagcaaatacattctttttttttttttttttaatttgagacagagtctcactctgtcgcccaggctggagtacagtggcacgatctcggctcactgcaacctctgcctcccaggttcaagcgattctcctgctttagcctcccgagtagctgggactactacacccagctaatttttatatttttagcagagatggggtttcactatgttggccaggatgggctccatctcttgacctcgtgatctgcccgcctcggcctcccaaagtgctggattacaggtgtgagcccctgcgcccggccagcaaatacattcttagaataggtttctctgttacctatttttacttcatttcagtagaacagctgtttatatcttatgcattcatgctggtttcttcaattaatcactcatattgtttcttgagatgatttgtaacgacccagctttctttgtcctaggatttgcaaacttaaaaaatgatacaatcgctttcttcccaatttctaggcactttgcattatatcaccaaatgcaaagaattccttccaccccgtggcatgtcaccctccaggccagggtcagatgcagatgcccacttagcttttgagacaatgcacattcctttcgcatcctccctctccctctaacttctccgatatccagttgtccccgcaccctttactgaaaagactattctttccctctattgaattgtctgggcacccttctcaaaaatcaagtgacaaaagggtttctttctggttctcagttctactccactgatctaccatgtctctatcagtaccacactgtcttgtagtaagttttcaaattgagaaatgtgaattctcttaattttattatttgttttcaagattgttttgactactgtgagtcccttttacttccatatgaagttctggtattttcacaggatggtctgaatgtgtaggtcaatttggagggcacaggtaccttaacaaaacaagtctttggacctatgaacatgaaaagtctgtttatttacatctttaattccttgcaacagtgctttgcagttttcagtgccaatattactttaaatgatattgtgaaatttttattttctaattgtttgttactggcatatagaactacaactgacttaatttttgttttattgatcttttatctatgggtgttcctaaatgtatttgagtttttaaaaaattactctgctggttattggtaacaagaaataaattttggccaggagtggtggctcacacctgtaatcccagcactttgggtggccaaggcgggcagatctcatgaggccaggaatttgaggccaacatggtgaaaacccatctctactaaaaatacaaaaattagccaggccctgagatcgagccactatactccagcctgggcaacagagtgaggttctgtctcaaaaaaaaaaaaaaaaaaaaaaaaaaaaaaaacaaaaaaaaacagcaaacaaacaaaaaatgcaattttttttttctttgagaaggagtcactctgagccaccatgcccagctagaagtaagttaagttttactggcatttaattaaggattaacactggctgctttcctcaacctgaatgtcagatgactttgtgtgtgtgtgcgtgtgtgtgtgtgtgtgcgcgcgcgcacgcgtatgtgtctgtgtgtctgtctgtctcatgtggtataccagttgtcctaaataaagagagggatttctgaaatgcaacagggatggtagtgactctctcattcatccgtttgttttcagataatactgccaacagtataatagccatacactactcagttacaggatttacagacgaaatgatccactttttactaaattgtccctcatcaaatggacaaatgcctttttttaaaaaccccagcaaaaataaactggtagagctgatacttctctctttttagctactataaagggttaaaaaacaaccatcaccattacaactggtgcgtggctcatggctgtaatcctctcactttgggaggctgaggtgggtggatcatctgaggtcaggagttcaagaccaccctggccaacagggtgaaaccctgtctctactaaaaatacaaaaattagccaggcatggtggtgggcacctttaatcccagctactcgggaggctgaggcaggagaattgcttgaacccgggaggcagaggttgcagtgagctgagatggtgtcaccgtactctggcctgggcgacagagcgaaactgggtcttaaaaaaaaacaaaaacaaaaacaaaaaaacaaacaaaccatcaccaccaatcagatttggaaaagaaagtcaaaaaactagaaaatatcatgaagactatcagaaatatagatttattcccgctgttactcttagcctaagtgttgagccttaagatagtatctgtggggaaaaaaaaaaaaaccctaatagtgtatgtatgacatttatgagtttaatgcataccctggggctacatgtggatgtgcaacagagaaagtctgtgtcctgttactatagagaatgggctagaagggagccacagaccagaggaggctgcaacaggtgtggagagaaacagaccacattttagagatatttaggagtttggatcaataggacccagtaattacttagatatgggagtggggggtctaaagagggaaatgcctcagtttctggcaaaacacactgggcagaggtggtgttaccgacagacagcaaacactagaggaggaaaagattaggaaagatgaaccatgttggacacgttgggcttgaaagaagactcagagaaagaagacaattcttcctctcttaagagtgtcttatggacactcaaatgtattcccaataaaatgtgtatatatgtgtacaaaagacacatacaatgctcatgactggactgcattgttcttaaccaccaaaaagcaggaaacccacaggcccatggacagcagaatgcataactaccacatattcataaagcagatcaccgacaaaaccactgctacatgcagtaacatgaattcatctcactaacatgatgtgagcaaaagaaactagtcacaagaaggcataccgtgattccatgtatattgtgatataataagaaatacatatttagtcttcatccctggtttctgtcatagaattcctaacacgttagtaatttcctgagtgacaggggtgagaggagcatgttttcttattcaaaataagcccctttcaaccataccagcgtctgtgctaataaggtgactcttggaagatggggtctggttgccagaggaaccaatcatgtaattagaggactgaaactttcagcccaactcccagcccctcaaacctctggggaggggcaaggggctaaaggttgagccaatccaatggccaatgacttaaatcaatcatgtctgtgtcggggtgggcacagtggctcacgcctgtaatcccagcactttgggaggccgaggcgggaggatcacccgaggtcaggagtttgagaccagcctggccaacatggtgaaaccccatctctactaaaaatacaaaaactatccgggcatggtggtgcatgcctgtaattccagctactagggaggctgaggcaggaaattgccggaacctaggaggtggaggctgcattgagccaagaccgtaccactgcgctccagcctgggtgacagagcgaaactcagtctcaaaaaaaaaaaatcatgtgtaatgtgtaatggagcctccctaaaaactttaaacaacagggttcaggtagctttgggctaggcgtatgccaagaggattattacacccccgcaataccgcgacagaagctcctggtcatgggacccttccagaccttaccctatgtacctctccatccggctcttaatttgtatcttacataacaccctttataataacagggacagtaagtaaagtgttttcctgagttctatgagctgttatatagcaaattatcaaactgagtagggcgttacgggaacctcctgaattgtagccaagtcaagacagatgtgtgggtaccctttgtcccactacctacaaccggtgtctgaagtagggggcggttttgtgggactaggccctttacctgtggggtctgcgctaactttaccaggtagttagtgtcagaattgaattaaactgtaggacatccaattgatgttgaaaatccacacatttggtatcagagtgctgcaggtaaaaagctgtcctttacacataagttaaggaacaggtataaactacggtgtcaaagcgaggacagaagttactgctggggagcgaggagggaaggagccgtgactggaagggacctgaggtggtctgcaaagctggccacactcaacttctccactaggttcatggctacatcagtgtgttcattctgtgggaagtcatcaggctgcagacttacggttgtgtatttttcagtgtatgttacagctggtaaaaatgtgtgctaatttttaaaaatctggtcactttattccccaggttaaaattcttcaacagtattttaacacatgctacaacacagatgaacctgaggacatatgctaagtgaaataatccagttacaaattatgaggaactaacctagtcgaattcatagagacagaaagtagagtggtgttcgcaggggctgcggcagagggggtaatggagtcttgtcatttaatgggtatgtttttattttttatttttgagatggagtcttgctgtgtcgcccaagctggagtgtagtagtgtgatctcggctcactacaacctctgcctcccgggttcaagcgagtctcctgcctcagcctcctgagtagctgagactacaggtgcacaccaccacgcctggctaacgctaatttttgtatttttagtggagatggggtttcaccatgttagccaggctggtctcgaactcgtgacctcaagtgatctgcccacctcagcctcccaaagtgctgggattacaggctgagccactgcacccagctggtataatgggtatagagtttccattttgcaagacaaagagttctgtagatgggtcgcacaacagtggaaatgtacttaccatgacttaacagttagatggtcaatttatacgttattttaccacaattaaaaaatcttaaaacaccaacaaaaatccctccaatagttttccattcctcttatataaagtccaaaatcctaacaaggcctggaaaacactgactttttcaactctactgtgccccactctcccccttactctctaactcctttcaaattccacaagtacatcacagtttttgcaccttttagtcttcgtgtatatttccttggactgaaacatcctcctttctgccccctctcagtgtaatatctgctcatgctgccgtctcagctgaaacatcatttcttcagggacgccttgaccaccctagactgagtctcttctgccatttatgctctcagcatcccgatgctttcccaagactatgattaaataatcgtgttatgacctgtgtaacggtctgctttccccagataggacacaagagctgactccttttacttccccccaccagacagcaacagcatgcaggaacttcctgtcctgtctggaactcagtaggtgcttaataattatttgatgaatgaatacttgaggcagctgtcccacaggaatttaggatttttctgatccagatgaattagtctgctgataacatgcaaatgagaaggtgcatcactgacctttaaggagtcatagaaaagaaatgttggaaaaccaacccgtgtacagagcactgatacgaaacaatgaaggtgagccgtgaaaacaactgacccattagggtcctgctaagccttagaaaaatttcacaaatgattactgaaggaataatctgcagacagtgtgaagagaaagctgtaatggtggggtgccagcacaggcctgctacgtgagagaggcagaacgacggctccctcaaagacgtccatctcccaatccccaggacctgtcagtgaatacatcaggttacagagcaagggggaactaggttgcagatgaaacaaggttgatcatcggctgactttacaataaagagattctcctggactgtctgggtgggcccaatgtaatcacaagtgtcttttaaatgtgggtgacagacggagaaagtcaaagtcagagacttgaagatgggggaaggggccatgggccagggaacacaggcagcttctacaagctgaaaaaggcaaggaaatgattccccctgagagctccaaagccacgcagtcttgccaacaccttggtctcactgaggccagtaaaactcatttcagaattctgacccccagaactgtaagaggagtaaattggtgttgctgtgagccacctagtttttggtgatttgttactgcggcaataagaaactaacacaccaaggctaagccatgaaagattcacttcttttccttccgtgcagtggctcctggcctagccaatcaggaacaaagtacatagagtatccttgttttttccagcaaagcatctgattatgtcttttatggtatcataagctgaagaaacacatgctaaatgcaaagtcaataaagtgagttagaactctgtgaaacggccatccttgaagagtgctgattaatggaataacgcccagcagcctagatttttaccaacacaccgcgagggcctgtccgttcacttgccagcacttccaccctaacttagcgcagggattcttaacttggggcttcaagaggcaactggcctcctaaccttattaaaagttctgtgtatctctacataaatacgtagtcttctggagaaaggtacaccgctttcatcacttatcaaaggggatctataaagcaaaaggctaagaaccactaacctagatgaagatacagaaagctatgttcggccgggcgcctgtaatcccagcactttgggaggccgaggtgggcggatcacgaggtcgggcgatcgagaccatcctggctaacacggtgaaaccccgtctctactaaaaatacaaaaaattagctgggcgaggtagtgggcgcctgtagtcccagctacgcgggaggctgaggcaggagaatggcgtgaaccccgggggggcggagcctgcagtgagccaagattgtcccactgcactccagcctgggcgacagcgagactccgtctcaaaaaaaaaaaaaaaaaaaaaaaaagctatgttcatgcattcactagtgacacaagctgctagaaagagtaaagactgtgggtgacgcatcaggattcagcaagtatcctgaaaggctgaatgaaatggctgatggcttaggagcagcctcggtggaaaacactggaagtttaatcaacagtgggctcaggatggtcttttggaaaaaaccacaacaactgacgtgacttcaggcacatccagaaggatgaagaaagtatagctcgactctctcctgtgctggcaaagctaaccctgcatgcctgtgttcaacgctgggattctctttgtattagtttccagtggcggccgcaagacatcacaaacttggtggcttaaaacaacatagtctcattgtctcacagttctggggccccaaagtctggtgtgagcagggctgattcctactggaggctcaagggaaaaaccacctccagcccctctcccagcgtctgatggctgctagccatcctttgcacccgccggtttgtggcagaatgatgccatctctgtaacctccttcttcctatggccgccttctctgtgtgtcttcctgtatcttttcctcttcttataaggacattagtcgttggatttagggcccacagtaaactgaaatgattttatcctgatcctcaactaattacatctgcagagatcctatttccaaataagggcacattctgaggttctagggggacatgaatttttgtggacactatttaactcatctcttagtcctttcgggctgctgtaacaaaataccttagactgggtaatttataaacagcacaaatttgtttcacatagttctgtaggctgggaagtccaagttcaaggcaccagcagatgtggtgtcagagcccgctgtctgcttcatcaatggagacttctttgtgtcctcacatggcagaaaagggcaaacatgcttccccctcccccagcctcttttttttttttttttttagacggagtctcactctgtgacccaggctggagtgcagtggcacgaccttggctcactgcaacctctgcctcccaggttcaagcaattctcctgcctcagcctcctgagtagctgggactacaggcacgcacagccacgcctagataatttttgttatttatttttttagtagagatggggtttcaccatgttggtcaggatggtctcgatctcctgacctcgtgatccacctgcctctgcctcccaaagtgctgggattacaggtgtgagccactgagcccggtccccccagcctcttttataagggcactaatcccattcatgagagctctgccctcatgacctaatcaccaccaaaggccccacctcttaacactatcacattggaaatggagcttcaacatatgaatttgggtgggacaccaacattgagactacagcacctactacaccctttaagtggaatattaatagacaaatgcattctgaggtttaagataccatattcccaagaatggtcaaaataaatagggatatgaagcctaaaggttagaggacttgaatcagacaaggaaagtgtctataaatacctgaaccatttttttccagatgaaaaagactttctaacattgggtttgccagagatgaatgtggtagacttctgtcacatttgttcaatcttaacctgtacaagtatctgactggaatgctgaagcctcagatgggggacttgacttgttgactactaatggccattacattctaagattctcaatctgtcccgttaactggccattttacagaacccaagaatttttgtaaagttccactaatatagcaaacactgtgggatgccaaccagagggcacacactgtaaagaagacatagaagccctgggaactgaaagaatatcagaatggtttcagaaggtgagtaagggtgaaatgacctgggggtggggaggaggaaggggctggagctagaccaggtagtgaacacctcatactgcacagagacttctgatgtccgttctaaggatgatgacgagccactgcaggggtttaagcaagcagtaacatgactgggtgaacctttaagattattttggctactatagaagaaaagattgaaagaagttaagaaaaaaggcagagagaccaagaaaaagagagtaggaaatgatagttgcctgaactaaggcggcagccgtgaaaatgtcaaacaacagatacgtacgatccattctagaggtaaatcatgaaggatggattagatgtggaatgtgagccaaagaagcaaggatggtcctaatttgtgtaaataacaagggtggatggcgatgtcatttattgagatgggaaagactggagagcagtggtagcagatagggaggtgaaaaaatgaatcaaagctccatctggagcttatcaatttggagatgtctttgtgacactgaagtaaagataccaataggaagccaagcgcatgaacctagagaggcctaggctaaaaatcaagatacgggaggaggtaacaggaggtacgtggagagaaaacaattcctgtctcagtgttgtcttatttcattacaagaaaatatttttggattactggacactgttaagtgcccatttggtttttcttaacatgtctgatctcaaacctaagacttttcccagcaacactcagctgttgagctgtaggaagcatgagaaagaccaacggtacatggttcatccacaatggaaattttgtgtttacaaaagacttctgtaaatacaaaattatttttggaagacagaggaaaaagaggtgatttcatggaattacatcaaaaaagaagagaagtgagaagccaggagggggctgaaagataactcattctacccaatggggacaaaggacacaatcacactgtgcccaattccattaccgctgagagcctgccacagtggactggggaaggagggaagtgccagagaaaatggaaacactatgagctaggcaacgtaggacctattataataaattattttatgtccatggatttaagcctatttatggaataaaatcaatttaacagtagctttccctgatttcagagtctcctgaaatactgtttagtttgtgcacaatctcaaattccacagcatgtcactggagttggagaagatgctgggaaaataatgagcttctcaaatgagaaaaaataaaaatagggagcagattcatttgcagcaagcaaagggaaaagagtgggaatcttaactgcatgcatctatgaaaaaagcaaattcattcaatggcttgcaatgacacacacctgccccagtcaccctacctgcccatagtccccagaggcaaccacttccaacagtttttagttcttctggtggtctattccaccgttccaaacaggtctctagccatcatttcttggtttgccaactttggaaattgtgtgcagatatatgatgtcactaattaggattgtgtgttcacttactcttcatctccccttcttcccaattttattgttatgttcattttcctctgtttttaaacctttctagcttcgcaactagaaactatctcttgaatccccatcctgtgagatgaatacactgactccctcgccctccctaacttttctctcttccatttctccacctttgtcatctgtgtttgtagagtctcaagctttctgctctgtaactagaattaagtcttccatgctttaactacagattagttctaagcagtgaaaaccacaaaaccagtaagagcattaatatcatcagcatataaatattacactaaaagccaagtcctgaactaggattccacttacttctctctaggattcacaaactgctcaaaattatgacatattttagcttgcttcatatttggaccaagttgtcttggtcctagagtgcctcttttcttactagagaaaaaacacgcctttttcaacattttcctagtatcctccagttccttaataatcctaaccaatgcttggaattcattttgttcttggagctacagaatgaatttaaaaaaaaaaaaaatcttgcaaagacctactcgttcctggttgtccccttcagaaggtacaacttttccccctgtcctttcatggaaaattttcccctttcatagtaaaaattaacaataatttttaagagaaatgtcacccattatctaatcgatataacacaaccatttttatgtctgcatcctatctggagtcctcacccactgtaaataaatttaacacaatcgtagttcacaatgttcccgttttatggctgtgtaacactccactgagtggatatatcataatttattaaacccacttgggaagctgtacaaagaagtggttaaagtacaggcactaggccggtcacggtggctcacacttgtaatcccagcactttgggaggccgagacaggcggatcatgaggtcaggagatcgagaccatcctggctaacatggtgaaaccccgtctctactaaaactacaaaaaattagctgggtgtggtggtgggcacctgtaatcccagctactcaggaggctgaagcaggagaattgcttgaacccaggagacagaggttgcagtgtgccaagatcatgccactgcattctagcctgggcgacagagtgagactctgtctcaaaaaaaaaaaaacaactatgtaaagaaagagttcacaaacacagaaaaaaatgtttccttcctttatagtttctctctttttttaattaaactttcattaccttgcttaagcaggtatcttattcacaactgcctcggaataactttcaattattgtccaaattcaaatctatcaagaaaagataaaaattttacatattgcagactttataaaattattcaatcaaaaaggtaatatcacaaacattaaacagtgtcatcctaataatgtttaatgttttcactgctgcataatatgtgcatatatgtgtacacatacacacgccctctgatatggtttggctctgtgtccccacccaaatctcattttgaattgtactcccataatttccacatgctgtgggagggacccagtgggagataactggaatcatggaggcggtttcccccatactattctcgtgatagtgaataagtctcaccagatctgatggtttttatcaggggtttccacttttgcatcttcctaattttctcttgctgccgccatgtaagaagtaccttctgccacccaccatgattctgaggcctcctcagccatgtgaaactgtatatccaattaagcctctttttcttcccagtctcaggtatgtctttatcagcagcatgaaaacagactaatataccttcccaatatgactaatatactccccaacatgagggacaagaacaacactgtccctcatgggtatagtctagcaagtttgtttaaaaagatttgtcttagcctgggcaatacagcgagaccctgtctctataaaaaatctataaaattagccaggtatcgggcagatcacctgaggttgggagttcgagacgagcctgatgaacatggagaaaccccatctctactaaaaatacaaaaaattagccgtgcttggtggcacatgcctgtaatcccagctactagggaggctgaggcaggaaggcggaacccgggaggtggaggttgcggtgagccgagatcgcgccattgcactccgcctgggcaacaagagcgaaactctgtctctaaaaaataaaatacaataaaaataaaaataaaaataaaaaaattagccaggtataatggcatgcacctgcagtctcagctactggggagactgaggcaggaggatcaatcactcaactccccgaggtcaaggctacagtgagctatgaccacaccactgcattccagcccgggcaacagagcaagaccctgtccttaaaataaaataaaagacatgtcttaccaatttacagtcacaccttattcaaggcgggagggatctcagaagttatctagtcttgaggcccaaatgcagcgcaagattagacagggcaaggtggggtgaggtcagtgagagctcacaagctttgtcatctgacaggtagctaagccttagctcccttctgctcccctccatgaaggtgatttttttttaacccaaatctatgtcttcattcctattaatttttttaaagctatatagcccatcattgtacacattaagatctttgcaattctgaccctgctatcaaatatatgttacatatgccacgtcttcatcaaaatcactggcacggcaatagaagaccttcacaaagagaagagcagcaggaggaaaaatcagaggcagtaaatgtagataacgtttagaggttcgctgtaagagagaaatggggtggtagcaggacagggatttggtggagagatcaagtggtttttaaaaaaattcaaatatttataggctaatggaaatcatcattcaaatgtgaaggaaaaacacggtatgtaaaaacatgtcataagctgtaaagttcaacataaatataatttattatatacatccccttttctcttgccagcctatttatgttaaaatttgatttttagagcctccagctctttctgaatgttcagagaccctgctcccatgatcatatatcctttttctctgaatattttgaaatctgtgtccaatagcccctgcctttgctgttatgaattcaaacattacatgacccctttcacccaaatcctgttttcgcatcaatctcctccactgttcatgagaatttctaaaaaccgatttcagattcattaaaggaaccattaaaggcttcgtctaataggattacatttttaaacatgaaaacctaagattcacttttttgagttttattgtatccctaagcaagttagcaaaacaagatttattatttggtaaaattattctctaaggctgtaacatccaatcctgaaaatttctatgcaaagcaagaagtggccgatactaaactcttccccaccagcacatctgcatacataatcacatcatcaacacagggctttctcctctcccaacccccactctggggccaaacaaaaagttagtgtgcacacacataaagcacatttacaatgtctgctccacagcagaccctagctaggctgctccgcaaaggtactaaatattttgctcctagttctaagctcaccatttgagtaagtaataagaaagcaaccgtgatctgtgcataaatacaagacatgttccttcaaaactccgtttctaaacacgaattctttaccagttaaaatataaaatgtgttagccccaggcaaatgattctacacccaccaatgcattcgacttaatgacaaagacatatttttaaagtacacttgtttataagatatctcataaagtatactacgtaaagtatagcacttgccaaaatatacttttaaaataccaaagtgcctaagaaaaaaattgactatttgctctttaaagggataggacaaataaatgttattcagaaattcacacgtgccaaactgatagtagcactgcaaagcgaacaggaaggtttctagtttcataaatcaatccacagcttcaaaatgagccatcaggttcaactctaggaaaactataaagttcttttgtctttatgttcatttctatcaaacaccctcaaaacaaattttcatgaatttcacgtattggccacagctgtttttccaccaggacctgtctgataactttgtgtgtaatctgagcattactttgcttagtgtcaacgtgcagtaagtcctcaataaacatgtcaagaattctcctcaattcaaaattataagagcatcaaggtcataaagatgcactattttttctaaaactaaaaaattgttaaactcattaaatcaagattataatgtaaaatacccaagtattccaattttaaatcattttcttaacacgaataattttaacagatttatatcaccatttctgtttctaaaataaattcctaagttcctactgcaacagcagaagatttagatttcatataaacccataggtttagaaactactgacaggtaggctaacttacaaagatcccagcagaagctatgcttcatagagacggatttttttaaatctgttttgttcactgctgttgcctctccttcaccaatgccttgactgagactgggcacacaggatttcaattaatatttgctggactgaaaaactgcgtatgtgtgaagacccttggtacaaagccagacttaaaccacctgtaggatcccccaccctcacccccaccccgagaaaacctggagcaagcccctgtgggacggacacagaatgacccctagggaatcaaggaaagggaggctaaaactcaaggggactgacttcacacccagtcttcacacactgcccaaatgtgttcattttgttgcagtgtctgaaatctcaccaactgagagattcctctaggttaacaaatctcctcttttcagaattaaggaaccgtttaaacctgtcaacaaccttaagagatgtacatttcatcattccattttacagatgagcaaacaggctaaatggcagagttacttttacagtgtcacacaatggacgtaaagcacaggcctgactcagaacctttaatcctacaatgctgcctccccactgagaggggaacaggactaatcttcatccatacctcaatacacatgagttagtttccaatacccttctacagaaacacctaaaacaagctttctcaaagacggggcttttgtttggggtgacaggcaagcaacaagtagctgaagcacacgaacaccgtggaggaaggatctgaagttcagaccatggatttggggtgcctgatggaaccaagcctcaaagacaaaccacagatttcacaacactgcagaggaccagctcttgctccacaacagcttgcctccccttcctctttctacccttccacgtgaccctcacggttctctccaccagaaaagaggctaccattgttagttgccagtctggcaacactgtgcatctcaaccacagtgactggcacagagcaggaacgcaaatatttactgaatgaacccaagacaaaagttgtttctacggccaagctgggaccctaactgccatttttaacacagtagagatgagatatgcaccttaagcacctgattactggtgtaaaacggacttttcaaagcctagtctgagttgcggacaggctacagtaaaagccttatgtgattatttttccccagccagactgtctcaaagaagaaaacagcttagcactttggcatacaaatacagacctcagaggggcataatatgttagtatcttaagagtgtacaagcaaatcatgactttatttaggttgcctactttaggtcatcctaacatgaacagcagtttagaaaagaaaaatcccctctcagcattctcagggtgacaatgagggtggggataatggcagatatctcccaaaagttcagcgtgggccaaaacccaaaaaatcatattccacgatgtgcaaaaggtttctttcaaaccatgactaataatttaaacaaatacatgtttacaccaaataatcaactaaacaaagtccttgttcataggaaaacatgacattaagccgaatggtttcaaagacaattcttgaaaattttacctatttcccttttggtcggcacccgtgacctgaaaagccttggctagtagttccgattagtgtcagatcctcataatgtgacattttcaggcgtcaaattacagtaaaactactagggcaagaacaagagccaaaagcaacagggaagatgtccattttccatttacaccccccccccaatttaccacttaagaaaaacggcacgtttttatattagaaaagggccgcatccttccagatctagcgcagccttaagtccgtgatttgaggaacctgccgcttccaaaatacaggctgagacgtcctccccatgaagtagttttgcgctcttgcaccacctcctttgtctacgctgtccctgcaaactcctagctcaatgccctccagcaaacgagctgcctgaacgcaaagatgaccgttccaagtcttttttaaaagaagggaaaaacccagtcacgctcctggagcctggttcccacgggagcaggccgggctgtccacgacggaagcctcgaccctggctggggctgtcggccgggcagcgcgggagagccagggccagagccggggccgggaaccctagtcccgccgcctacgcgggatgcagcgaccaccgcccgccgcccccgggccggcactcacctccgtggaggggcagcggcgccagcacctggccgcggacctcggccttgggggagtcaagcccgtagcgcccgcggtcgatgcgaaacgtgagcggggcgccgcggccgggctcctgcaccgtcacgttgatgagcgccgtgtagtactcctggctcgcgttgtctgcccgtgccggccacaggctgcaggtcagcagggcgagcgcggcgagccgggcagggcccgcccgccccgcgcagctcatcgtccctccggcagccgccgctgctcgcggaccgggctccggggccggcgcctagaggcggggcgggcgcggcccgggcggcggcgggagcgcgcgcgcgcggcctgcgcggggccgagcccgagcgcggccctcctggacgccgcggccccgccgctcgccgccctcacgtccactgcccgcctgtggggacgcgcccatgggccctcggcgagggcggcgtctcaggtcgcacgcgggcgtctcttcggggtcccaggagggttgtagaagcgtgccccctccatccccccgggtcggtcccaccgaatgggaggcgcctcgcaaggacgcggcgggggaggggaagggcggcacgggaggaagcgccccgaggagggtcagcggaacacaaagtccctctcgcg

SEQ ID NO: 2346 - DNA, 6488 bp, Homo sapiens
gtgtacttaaacatacccctctactttttgtcgtttatttctatttataacaaactcttgtgttgagggctcttgatggacggcagcaagggagctgctctgctgcatatgaaaccccgacccagagcccctctactcatgcgatgtgtagttgacagccacttcacaaacattttcagctacagaaaatatattcaaggaagaatgttaaaaagtttccttataacctacaaggggttctctctagatgtaaacaaatctggatgaaatattttaatccaagtataccatttcccacgtcgtaaatcttctgggctggtgggagccaatccagttacacactggaaggggagtgagggtcccagggcttccccacacctcacaaggcccacccttgtttccactgaccctctctttgacctgaaacccccaattgcctccacaggcaaaacaaaactcaaatctctctagactcaaagacttaagactatgccaacctatttgtttgtaattacactgctcaaggctcctgtttcctctccttcagccattctccagagcgctcctcaagagattttaagtctctcacagccagactgtatttcccttggtcaagaagcaaccacggaatattctacctgcaggagataacaaatgttgactaatttatgtatgagaccattctatagtacttttgcagcgaattaccccctattctgaaggttaatgtttttccttctgatgatctagacggggtccacacactacagcattcagcccaaatccagcccatgagcagagaatcttttttaaaaacaatcctttaaaaatataaaaacctaagactatgtgacagagatcatatgtggcctgtaaagtctaaaatatttactgtttggctctttatccaaaactgctgatagtgcctctggacaagagcgtaaaagatgagtcatggcgtaagggaataactgagaggtcacgtagaaacctggtcagcctatgaggaaccttgaggcacgatgtttctttatcccagtaattcggcaactcgactccaagcacccaattttgtggatgaaccccaaggagtctgtcaactttcaaaatcacggcagctgtctgccacttgccagacttattttgggtgagtaataataaatagagaaataagtaatagttagaggttgtaataaaaagctatttaatgtttgatagacaaattgaagtccataaatctccttgaataaagatgctaaaaatgttattcttgttttttaaatagtttcgtttttacaaagttctgtacataaaaataaatatacagaaacaaaccccatcaactgtccacatcagtaatcctcactggtgggctcaccattgataaggaagacatcattcaacgcaacctgtcacagagactgtcctagcagcaaggatttctaacctcaaaagaacattactaggcctcttttatcaagattgctaatcatctagaggcctttacctaccaactagcaattaaccatgaaatcaatgaatgcaatcactgtctccaagtagaatgtgaccaatgacctcatgcctagaggcaacatctataccttttgctgactggagccctgacatatgcaggtgtagttaggaacagaaatcaaccccacctccccttggctagtcactgtgaaaagcgtgcgtaaggcaattgaatcgagggttaagggttcatcttgctaatgtcaaaagtgacactaacaagattcttagcctcatccgccagatgacgggcctctgcgtccaggtctccaggagcaagctccgcctccttcaccagacaacgggttataacctgggaggacagaaaagcagcacaacagtattgataaaaatctgaaaatctgggaacattgtatatccacaataaaattatgagagtgacacgcaaagcactgcaaagatacagatcctaagggacatttaaaaaaaccttttagctatgtgaaaaaaaaaaaaacctttatattgtgattgccatttgaactgattgtctggtggggaaaaaagtcattcagcttctttgtcccaacctccgaaacacatgcaaaagggtcaccaaaaaactctctcaagagggcctgatttaagtatatgaatcctcctatcacagtgcttactaaaactcatacattcaaataagggctgttcacgctacagaaaacagattaaaaaaaatcaagagtcaaacttgtcacttctaccagtcagaacggggtcttctgtatccttccctacccccaaccaccccactccctcatgagcttcccaaagtcagtgcacaactggtaacctggttgagtgctaaggttctagggccacccagaacttaaatgttacttttactccttacttatagtggaatctttgggcaattaaacactgtgcctcagtttccttatttgtaaagccaggctagtcaaaagtcccagctcagaaatgctggggatgctgaaagaggccgtgcaggcaagcacaccctgcattccatcttctacgatttccattcctctcctaaatatcacctctatgtgtctaaaaataagcttccggcaggaccatttaaaaatagcattttctttccagatgcatcaccttctctacagcaagccaggtttagtcttctgacacaaaggggattacagctcagcgtttaaggtcagccaagtctgtggccctgctgccttggagcccatgccccagtctttcctcagtcctcaaagacaccatcagggcctctgcggtgcccctctcctcctatggaggatacaaaatcttccgccttggttcctacagtgttctagtgtgtttgttctttccttcctcagcagtaacttgcaactcttagccagaatcaccaaggattgcttattttcgtttgtgagtcccatcttcccagatttgaaattctcagggatgggatgaagacagactgctgtggcatcatccagagtccccggggcagtgctgcacacaggaagcagctttggatgagcatctgtctgctactccttgttatttgcaagaaacaaggtggtcccagccagaaagaccaaaaccactgtgttccagctccttgacactcatctgaagattggcagacaattcctcaccctacttagctctccctctacggggctgcagaaggatcaagttagaatactataagtacaatccttctaagtacttagtgaggacctaggaggtgatttgcatctgtttcctttattgaatcttcacaatcctaaggaattagtcttaatttatggacaaagaaacaaacaatcttgttcctaaaaggtaactatatcctgtaagtgttgaaaatctgttaacatttgacatcagtggtgcttacctcctccccgcaaaggctttctgtccgatttccgtttcaggacagatgaagtggaaggcccaggactgtcttcctcctgtttgaacacacacagtagtgtaagaagcaattaaaacattctacttggcaatcttcatctaccgcatgccagccggccgaggtctccagtcacctggggcttctttgcatttcctttgtaactttttccttcttgcatgctgtcccacatttcaatcttctgtctccttttttcttcttcaagctgagaaacaatcacattttacagaaagaattcagaagctgccatttctctcaaagacaaagctaactctgataattcttaatttaaatgtctttcagaacaaacttcaccctcgttttctttagttaataaaactgttgtgatctggtagtgtgagtttaactcacatagagcagctttggtttttgtacactattaaagaaagcaaaatgtttcatgaaaaagattactgactccattcttctgaaactcactcctgtcaggacatttttggtaatggggaagacacaggcacatgcacacacacactcacatgctccctgctccagcctgtccctccttttgtgctctggacctttcatggtaatatattcacacatctagtgttccctaacaatcgtgtattcttcttgatatcaccaatacttacatggtaggaactgaaatgcttattgaatctaatgggataggacctggtcctagaagcttatagacaacacagacacaggcatcgttagccactaaacctcagacaatttctatgcacacattcaaactgaaaccagttcatacttgtttcagtttttccttatgcttttcaacttgcgcatttagttcttcttgcattttcagtcgagcagctgctaaagcttcttgtcgtttaacaacaacatcaggttctaaaatgtcagaaaaaaatggagataaagcactgtgtacaatataaaatagaaacttttgagtgtccatattattaaaagtataaagaggtatggatatcagacaatgaaacaacatatttttacataagtactcctaacccctctgcatacattttactgcttcagggggcaggggtctgttgctgagccacggattttagcccgaaatatctacatcaccagaaatctgttagaaatgccaatttctgagttcccctgagcaattccgattcataaagcctgggatagtggccacacagagcacatcttggatacctcagtgacacccacagtctctaggctgactagaatcctggaagactaccaaggaaatataaagttttctaaatcattatccatcccttaattagcgcagaagattcttaagtatttgtttctacagaaaagaaaaatccttccaaatagcattatgaatagaaatgaactcatttctattcataacgtctactcatagagtctcgctctttgcaacaaggctagactccatctcatagaaaaaaaaaaaaaaaagaaagaaaagacagtctcactctgttgcccaggctggagtgcagtggcacaatctcagctcactgcaatctccagctcccaggttcaagcgatttctcctgcctcagccaccctaatagctgggattacaggtgcccgtcaccacgccccactaatatttgtatttttagtagagacagggtttcaccatgttggccaggctgttctcgaacccctgacctcaagtcatcctcctgcctcggcttcccaaagtgctgggattacaggtgtgagccaccgcgccccaccgagaaccatatacttcctactttttttttttttttttttttaaagacaaggtctcaatcaattgcccaggctggagtgtagtgtggcccgagcatagcccactgcagctttgactccctggactcaagtgattatcccgcctcagcctcctgagcagctgggactacaggtgcgtgccgccactcccggctattttttttttttttaaatagagacagggtcttcctgtgtggcccctcttacttttactaagagactaactcttaatataaaggaggtgcaaaaccaccgctttcatttcggttatcaggcactaacccacagcagccgcagctcggtccagctgcctctgcctcaaggctcttagccgggcggaaagcttctgaaagaccacgtagagaaggatgcagctgaagacgatgtaccagccataggtggccagcagggagcccactgaaaagaaaaacagttttcaaaaaactaaaaatgacactactagttgacctttccataagactcaacaaacacaaagtgtaactcctgccctcaaagccttcatggtctaggctgaggaaaaagcctcctaagtagatcgttaaaacacgaactcaagaagtgcgacaattcagggatcactgagaagtgagacttcccaaccatctggggagtcgggggcagttagagtgtggagggcacagcaactgggttttgaagaatgaagagcaactaatctgaatcaggaaggcaaaggcctttcagagccacatagaaaggggtgacagcgcggggagtcaggagtgtgtatggggctgtgtgggacgggtcccagaggcaaacgccaacggccgagtgaccccagtaactaccacaggaagggcttggttcgcaaaaaagacttgcgcaaacaagggacagccgagccgcccagggaagtgcggctcccgagaagcctccgcgcaaggtccgggcctgctgcccaaggtccgcgtaagcgccaacgcccgaccgttcccaggcctcccaggctccggcgcccggtgcagcggcggacgacccacccatcatggctgcgcgtcgcaaaagtggcggcgcgcgcccggctgccccgcaacgactcacccgtggtgtgcaggaagcgcagcccctcggtctccagggccggccgcgcggacagagactcctcttggcgttccatgaccgccgccgccgccgccgcccagccctgccgccgcgcctccagccgggcgcttccggtgcgctcctacgcacacgt

SEQ ID NO: 2347 - DNA, 5312 bp, Homo sapiens
atagttagaggttgtaataaaaagctatttaatgtttgatagacaaattgaagtccataaatctccttgaataaagatgctaaaaatgttattcttgttttttaaatagtttcgtttttacaaagttctgtacataaaaataaatatacagaaacaaaccccatcaactgtccacatcagtaatcctcactggtgggctcaccattgataaggaagacatcattcaacgcaacctgtcacagagactgtcctagcagcaaggatttctaacctcaaaagaacattactaggcctcttttatcaagattgctaatcatctagaggcctttacctaccaactagcaattaaccatgaaatcaatgaatgcaatcactgtctccaagtagaatgtgaccaatgacctcatgcctagaggcaacatctataccttttgctgactggagccctgacatatgcaggtgtagttaggaacagaaatcaaccccacctccccttggctagtcactgtgaaaagcgtgcgtaaggcaattgaatcgagggttaagggttcatcttgctaatgtcaaaagtgacactaacaagattcttagcctcatccgccagatgacgggcctctgcgtccaggtctccaggagcaagctccgcctccttcaccagacaacgggttataacctgggaggacagaaaagcagcacaacagtattgataaaaatctgaaaatctgggaacattgtatatccacaataaaattatgagagtgacacgcaaagcactgcaaagatacagatcctaagggacatttaaaaaaaccttttagctatgtgaaaaaaaaaaaaacctttatattgtgattgccatttgaactgattgtctggtggggaaaaaagtcattcagcttctttgtcccaacctccgaaacacatgcaaaagggtcaccaaaaaactctctcaagagggcctgatttaagtatatgaatcctcctatcacagtgcttactaaaactcatacattcaaataagggctgttcacgctacagaaaacagattaaaaaaaatcaagagtcaaacttgtcacttctaccagtcagaacggggtcttctgtatccttccctacccccaaccaccccactccctcatgagcttcccaaagtcagtgcacaactggtaacctggttgagtgctaaggttctagggccacccagaacttaaatgttacttttactccttacttatagtggaatctttgggcaattaaacactgtgcctcagtttccttatttgtaaagccaggctagtcaaaagtcccagctcagaaatgctggggatgctgaaagaggccgtgcaggcaagcacaccctgcattccatcttctacgatttccattcctctcctaaatatcacctctatgtgtctaaaaataagcttccggcaggaccatttaaaaatagcattttctttccagatgcatcaccttctctacagcaagccaggtttagtcttctgacacaaaggggattacagctcagcgtttaaggtcagccaagtctgtggccctgctgccttggagcccatgccccagtctttcctcagtcctcaaagacaccatcagggcctctgcggtgcccctctcctcctatggaggatacaaaatcttccgccttggttcctacagtgttctagtgtgtttgttctttccttcctcagcagtaacttgcaactcttagccagaatcaccaaggattgcttattttcgtttgtgagtcccatcttcccagatttgaaattctcagggatgggatgaagacagactgctgtggcatcatccagagtccccggggcagtgctgcacacaggaagcagctttggatgagcatctgtctgctactccttgttatttgcaagaaacaaggtggtcccagccagaaagaccaaaaccactgtgttccagctccttgacactcatctgaagattggcagacaattcctcaccctacttagctctccctctacggggctgcagaaggatcaagttagaatactataagtacaatccttctaagtacttagtgaggacctaggaggtgatttgcatctgtttcctttattgaatcttcacaatcctaaggaattagtcttaatttatggacaaagaaacaaacaatcttgttcctaaaaggtaactatatcctgtaagtgttgaaaatctgttaacatttgacatcagtggtgcttacctcctccccgcaaaggctttctgtccgatttccgtttcaggacagatgaagtggaaggcccaggactgtcttcctcctgtttgaacacacacagtagtgtaagaagcaattaaaacattctacttggcaatcttcatctaccgcatgccagccggccgaggtctccagtcacctggggcttctttgcatttcctttgtaactttttccttcttgcatgctgtcccacatttcaatcttctgtctccttttttcttcttcaagctgagaaacaatcacattttacagaaagaattcagaagctgccatttctctcaaagacaaagctaactctgataattcttaatttaaatgtctttcagaacaaacttcaccctcgttttctttagttaataaaactgttgtgatctggtagtgtgagtttaactcacatagagcagctttggtttttgtacactattaaagaaagcaaaatgtttcatgaaaaagattactgactccattcttctgaaactcactcctgtcaggacatttttggtaatggggaagacacaggcacatgcacacacacactcacatgctccctgctccagcctgtccctccttttgtgctctggacctttcatggtaatatattcacacatctagtgttccctaacaatcgtgtattcttcttgatatcaccaatacttacatggtaggaactgaaatgcttattgaatctaatgggataggacctggtcctagaagcttatagacaacacagacacaggcatcgttagccactaaacctcagacaatttctatgcacacattcaaactgaaaccagttcatacttgtttcagtttttccttatgcttttcaacttgcgcatttagttcttcttgcattttcagtcgagcagctgctaaagcttcttgtcgtttaacaacaacatcaggttctaaaatgtcagaaaaaaatggagataaagcactgtgtacaatataaaatagaaacttttgagtgtccatattattaaaagtataaagaggtatggatatcagacaatgaaacaacatatttttacataagtactcctaacccctctgcatacattttactgcttcagggggcaggggtctgttgctgagccacggattttagcccgaaatatctacatcaccagaaatctgttagaaatgccaatttctgagttcccctgagcaattccgattcataaagcctgggatagtggccacacagagcacatcttggatacctcagtgacacccacagtctctaggctgactagaatcctggaagactaccaaggaaatataaagttttctaaatcattatccatcccttaattagcgcagaagattcttaagtatttgtttctacagaaaagaaaaatccttccaaatagcattatgaatagaaatgaactcatttctattcataacgtctactcatagagtctcgctctttgcaacaaggctagactccatctcatagaaaaaaaaaaaaaaaagaaagaaaagacagtctcactctgttgcccaggctggagtgcagtggcacaatctcagctcactgcaatctccagctcccaggttcaagcgatttctcctgcctcagccaccctaatagctgggattacaggtgcccgtcaccacgccccactaatatttgtatttttagtagagacagggtttcaccatgttggccaggctgttctcgaacccctgacctcaagtcatcctcctgcctcggcttcccaaagtgctgggattacaggtgtgagccaccgcgccccaccgagaaccatatacttcctactttttttttttttttttttttaaagacaaggtctcaatcaattgcccaggctggagtgtagtgtggcccgagcatagcccactgcagctttgactccctggactcaagtgattatcccgcctcagcctcctgagcagctgggactacaggtgcgtgccgccactcccggctattttttttttttttaaatagagacagggtcttcctgtgtggcccctcttacttttactaagagactaactcttaatataaaggaggtgcaaaaccaccgctttcatttcggttatcaggcactaacccacagcagccgcagctcggtccagctgcctctgcctcaaggctcttagccgggcggaaagcttctgaaagaccacgtagagaaggatgcagctgaagacgatgtaccagccataggtggccagcagggagcccactgaaaagaaaaacagttttcaaaaaactaaaaatgacactactagttgacctttccataagactcaacaaacacaaagtgtaactcctgccctcaaagccttcatggtctaggctgaggaaaaagcctcctaagtagatcgttaaaacacgaactcaagaagtgcgacaattcagggatcactgagaagtgagacttcccaaccatctggggagtcgggggcagttagagtgtggagggcacagcaactgggttttgaagaatgaagagcaactaatctgaatcaggaaggcaaaggcctttcagagccacatagaaaggggtgacagcgcggggagtcaggagtgtgtatggggctgtgtgggacgggtcccagaggcaaacgccaacggccgagtgaccccagtaactaccacaggaagggcttggttcgcaaaaaagacttgcgcaaacaagggacagccgagccgcccagggaagtgcggctcccgagaagcctccgcgcaaggtccgggcctgctgcccaaggtccgcgtaagcgccaacgcccgaccgttcccaggcctcccaggctccggcgcccggtgcagcggcggacgacccacccatcatggctgcgcgtcgcaaaagtggcggcgcgcgcccggctgccccgcaacgactcacccgtggtgtgcaggaagcgcagcccctcggtctccagggccggccgcgcggacagagactcctcttggcgttccatgaccgccgccgccgccgccgcccagccctgccgccgcgcctccagccgggcgcttccggtgcgctcctacgcacacgt

SEQ ID NO: 2348 - DNA, 29779 bp, Homo sapiens
agctggttgggacccgggaaggcctccctcttaaggtctttcccacacctctgcaccttgttacctgactttcggcttcaggatccgcagcgtgcacccgcgttccgtgagtgccctataggcagtcagcatgcccctctgcgtgtccctgtgttacggggacgccggctgggagccgcagagctatctcagaactagggcgctctcctttgggcacctccaggccattttcctttcattcgagcccacagggttagagataaaccctcactccgttgcttggggacaagggcttcactccctgtcccgagcttgcggctgagcttgagggtggctgggtcatcctggccccccactggatgggaattggctgctctggtgatttctgtgacatcccagaccccaactgtggggctctggagcggactgcgcttcacttcgtggggagggtgtttccacctaggccactcttatttctcttcacatccccagatctgtcttctgagactttgcccttctccaggaagagcactcaggagaccaggaaaatggccacagggctcctgagagccaaaaaagaggtgagaattaactgtaattctatcttggctgtcaacagaatgggtcccattaccttttcttgtcctggaggctgccttgttggtattgggcaaagtcattcctagccctagtcattcctagtccatagaacaaggaggattttgatatagtcttgtagagcgtccgattctgtcgctgttcagggcgccacttgtaacctgcacggacctggtggactgaacaaaaggaataaaagacaagaaacaaaaaagtatatttggaagaaggggtcgggggcactttgtctctagtggacaagggccctgagctttacacaaccctcccgtatttattggtaaaacagataacaagttagggggtggtgattgtcaggtaattgtcagttggccgtttggttcgcaattgcaagactgcatccttccaacaataggcgctagatttcctggtagatcacttcaaggagccaggcgccaggcagtgatggctctcagcacatcttttggtggcagtgtgcgtttgctcacatcctgcattcatgataaacagtttaccgtttaatcatataacctccagtggaatgctgagttggtcacaatccctttggtcttttcggctccaaacatagtctgacctgaattttacctttgagttcattcctagtcctggaagagtgcctcgttctaacaggagtcttccctcagcattcctttctgctccatccttaccgcagtcactcatgaagtagttaattgtgaacaacacatatggagcagtttaaataaaagtaaagagacatacatgcgtaattgttcagtgatgtggatgaagggcagggacagcacagatgcctgtgatttcaaatggttagggaggcctcctagaagtagggctgtctcaattgcccctgactggtttgttaagttggagattggggggaaggcattccagtgggaggcggcaaggaagcatagatagtttcagaggctggactctcagtgtggaaggattatggtggccagtggacttgcttaagattgaattttttttttttttttttttgagaccgagtctcactctgtcatccaggctggagtgcagtggcgccatctcggctcgctgcagactctgcctcccaggttcacaccattcttctgcctcagcctcctgagtagctgggactacaggcgcttgccaccatgccaggctaattttttgtatttttagtagagacggggtttcaccgtgtcagccaggatggtctcgatctcctgacctcatgatccacccacctcggcctcccaaagtgctgggattacaagtgagattacaccacacccggctacctatgcatatttaaaaatcaaccttggccaggcgtggtggctcaggcctgtaatcccagcactgtgggaggctgaggcaggcgaatcacgaggtcaggagatggagaccatcctggctgacacggtgaaaccctgtctctactaaaaatacaagaaattagctgggcatggtggcaagcgcctgtagtcccagctactcgggaggctgaggcaggagaatcgcttgaacctgggaagcgggggttgcagtgagctgagatcgcaccactgcactccagcccgggcaacagagtgagactccatctcaaaataaataaataaataaatatacatatgttaagatacagactatctattcacacatagaacaaggagaatttcgatatagtctgacctgaattttacatttgagagcactttcagcttctggcaattgggacatttccaaaattccagattccctgcttctctgaaaataaatctgccctaaatctgcactgttctttggtgtcagacaatttgagctgaacaacgtctttatcatttggacgtgaccttcagagtatcagctgcactttctgcagtgtcctttatactgaggttgaaaccattgactacctaacatttcacccccctctcatttttattacctacctgacccctgaagggtttgccttttccacctctcggtcagggtggggacaaatcagaaaatgctgagtgccaggctgagcagggtagactttgtctttgagtaagctgagttttgaaggatgttaagaagggacttgacataaggaagtcaatggtatgtgggaaatagtgattgactgtgtataaggacttaaggggaagcgttcttcttttttttgaaacggattctcggtctgtcttccgggctggtgcgatctcagctcactgcaccctctgcctcccaggttcaaacgattctcctgtcccagcctcccgagtagctgggattacaggtggcgccaccaggcccagctaatcttttgtatctttagtagagacgggatttcaccatgtttgccaggctggtcttgaactcctgacctggtggtccgcctgcctcggcctcctaaagtgctgggattacaggtgtgagccacagcccccggccgaggggaagcttttctaagccctgagattggtgacgatgatgcccctgacttaattgaatgcaattaacattcattaagcaccaacacagttgccaggctgtttaacagtcatttttgatatgggttaacttggttatttcagatttgccttgactatccttatcaagaaatctgagtggaatttagacaggaaaagagatttcttaattctggactccagtggtggggattatgcattcctggatgttatcagagcaacactgagaattctgtttctcatttctaaaatagttaattcatttgagagtgttaataccaggaatacataagaaatccaattcaggacatttcccaaggtaacattgaatattttttgtgcgtactttctcttttctttgaggcggagtcatgctctgtcacccaggctgcagtgcagtggcacgatcttggcttactgcagtctccgcctcctgggttcaagcgattctcctgcctcagcctcccgagtagctgggattacaggtgcatgccaccacgcccggctaatttttatgtttttagtagagatggggtttcgccatgttggccaggctggtttcaaactcctgacctcaggtgttccacccacctctgcctcccaaagtgctgggattacaggtgtgagccactgcacccagcctttttgtgtgtactttcttcaccactcccagtgttaccagggaagcattctttctgattggctgggaaaagtcagaagtttgtggtagctgacttttcctgtgccacctccttcattctcagtaggtctacccggaactgcctcctgtatataaacaacttgttcttcaatgtagctttttaacatagtatttactcaggaaaaattaaagggcatgagcatttaaatagttgtttaagatgaaacctctgtgtctctcatgcctagcacacatgaaatgtttggtgcatgaaggaatcacaaccttaagtaaacgatttgaaggaactaagtaacaaaggagtttctgttgtttgctttggtttgttattttgggcatgtggttaatcacatgtttcaggagcgttgggtagaatttccagatactcttgatatgcatggcatctgaattatacaaaataatcaaagcaagactatcttaggacattaggtattactgccaaggacctttgcctgagaggataaattaaaatttgtgttaaatttgtaacaatgagatgaactggcaggcacattatgttattttttttcttagcatttttccttttccttggtgccatacaacaaacttgagtgtctgctatgtgcagaacactcagtagattacagttaatgatgggtaaaacacagtctgcacactcaggagtcttccattttattttaggattcctttctcatttggatttaatttaattttatatgcgctcacacccctgcaaacatattttgacaggccctaatggtaaaatcataatggagtaaagttactggcagtgtatctacccagctctatttttaaaggtgtagaaacagccaacacttatcccactgaaaataatttccatagtaatccattgaatggatgaactcatccattgtttcccaatttttggactcctgtttccaatgtttaactgttgcaaataatacttctatgatcagctttgtacatgaaattcttatataggtttttattctcatacaaaatatgacaaggtgaatagacatgactgttttgaagcattgggcacccacagcagttggagatttgaaccctgccagttttttttttttttttttttgagacagagtctcgctctgtcactctgtcccactgcatcaggctgggatgcagtggtgcaatcgatctcgcctcactgcaacctctgcctcccaggttcgagcaattctcttgcctcagcctcttgagtagctgggattacaggtgcccgccaccacaccaggctaatttttgtatttttagtagagacagggtttcaccatattggccaggctggtctcaaactcctgacctcaagtgacccacctgccttggcctcccaaagtgctggaattacaggcatgagcaccgcggctggccctgaaccctgccagttctaaagaatttgaacttccaattacttctttcttttctgagactcccttcttcaccatgtgtttctttatactgtgcaatttttattttattttattcatttattattattattatttttgagatggagtttcattcttgttgcccaggctggagtgcaatggcatgatctcagctcactgcaacctccgcctcccaggttcaagtgattctcctgcctcagcctcccaagtagctggaattacaggcatgtgccaccgtgcccagttcattttgtatttttagtagagatggggtttcaccatgttggtcagattggtcttgaactcctgacctctggtgaactacccgcctcggcctcccaaagtgctgggattacaggtgtgagccaccacgcccagccctactgtacaacttttatttgcttttattttaattattacactgtgcagattttgattaccggggtagacctgccaacttaggtctctttcttctctcacatgaaagctcacatagtatcctgatttgtttccaaatgttgacatggtcctttgccacccactacatgtttctgtaatcctcgttttccccaacattgcagtaacatcacttttcagaaacctttagtgcctcatttcagtgtcttagatatttaggacagtcttcatttcaaatattgtatcctgttgtctgatgtcatgttctgattattcagtctgaaagtgtgtttattgttaccacaggggagtcatcttatgtgtacttttttttttttttttttttttgagacggagtctggccctgtcgcccaggctggagtgcagtgtcacgatctcagctcactgcaagctccgcctcctgggttcacgccattctcctgcctcagcctcccgagtagctgggactacaggtgccgaccaccacgcccggctaattttttgtattgttagtagagacggggtgtcaccttgtcagccaggatggtctcgatctcctgacctcatgatctatccacctcggcctcccaaagtcctgggattacaggcgtgagccaccgcgtctggccttgtgtacttttaacttagatacatttactttttatccactcagctgaaaaaagaggagaaaaataaaagtaggtcaggtcaatctgtttcctttcccatttaatgaattcatgcccaggagtgagtgagaaatgggaggactgaatctgctgttctccaagactagcttaggagtttctgacatcatgggcatcccagcaagccaacggtcacattagtcaccacgtatttttcatatcacgtgatccctctatcagtgtatcagcctttgctgtataatgaacaatcctaaacatcaatggcttaaaacaaaatcacttattagcacataatttggtaggttcatattttgggctggccgcaggtaggttttgcagatttcacctggtcttgtcattttgctgcagtcggctggcattttgaccagggctggaggactatccatgtgtgacaggaagctggttggctggggtgcctagtttcttcttggttctcttccatgtgggcttgggcttggtcaaatggtcttgggtttctctatgcaggaagagaggacagccccaattaacaagtagttttaacgttttggcttttgtcatgttcactgatgtccttttggccaaaggaagtcacatggccaagtccagagtcgtcatagaacgggataacataagggagtagatacagggagacatgatttattggtcccaatgattcatacccttaccatgtgcaagattaactcacccccctcccaagatccccaaaagtttcatcttgattcaaaagtccagtatcttatgtgtaacagtctggatgtagctaaagcttcttcactggatcctttttgagtcagatacctgtatactaaaaaggcaagtcatttgtttccctccaccccaaacattccctacctaacatacagtggtgagagagagatactgcagtagatgctcccattcagaaaggacaggaattaagcatagaggaggcctctccattttgaactgtttcagatcctttggacttccttgaaagctctatgggtttcccatgtaccagatttgggactgctctattaaacaaaagctgaaatcacagtcagacaggcctcacatctttggcaaggtgtcggtgctatgggacaatgcccataagaatctcagaagcctttttgtccagcgtggagactccactaggcatccccttaacacttcagaggttctaaagtttgggtcttttagccaaacttttgattcgaactttactctgagtttatttttttattttgagacatgtgctggctggagagactgaagatgtaaaataattttatttccaagctagcaagtcctgacttgtctatatttcctctgaattacgcttgcaagctgtataattgcttcttcagctcttctgtttctggacattattatatgtcactagaaacatccaactgaattttttttttttttttttttgagatgaagtttcactcttgttgcccaggctggagtgcaatggagcgatatcggctcactgcaacctccacctcccaggttcaagcaattctcctgcctcagcctcccgagtagctgggattacaggcatgcgccaccacacctgggtaattttgtatttttagtagagacggggtttctccatgttggtcaggctggtctcaaactcccaaccttgggtgatgcgcctgcctcggcctcccaaagtgttgggattacaaatgtgagccaccacgcctggcccaagtgaaacttttaacaggctttttggagatctctttagctagatccaaaaattcatcaggtatattttctgttttccaagttcatgcaggcaatagctttgctaatatataatactagttgccttgttcaagctgccatatcagtttcatcactcctttcccagtccccactagcagtttgtttactggttttccagcctgtgctaatagttttcctggatgctttccaagcctctgcccatgtcctgctcccaaagctaatgccacatgttttaggtattttgttatggcagcacttcacttctgtgtaccaacttagtggcctaaagaacatagcggcttaggcctggtacagtggctctcacctgtaatcccaacactttgggaggccgaggcgggcggatcatgaggtcaggagttcgagaccagcctggccaacatagtgaaaccccgtctctactaaaaatacaaaaattagccgggtgtggtggtacacacctgtagtcccagctacttgggaggctgaggcgggagcaggagaatcgcttgaacccaggaggcagaggttgcagtgagccgagaccacgtcattgcactccagcctaggtgtcagagtgagactatctccaaaaaataaagaataaataaaataaaaccaaaaaaaaaaaaaaaccaaacaaacttagcagcttaaaatgaaatcattttttcaaaatcctgtgggtcagcaagtaggcccggcatggctgagctgatcctcttggcatcctcatgtggctgtagttagctggctgctcagctacagctggatggtctcaacctgtctggtggttgacagcttggttggctgggatgcttcaattcctggttcttctccatgtggcctcttcagcaggcaagctcaggttattcacatggtggtctcaaggtttcttgcacagcgagaaggccagccctgaactcagatgcctctcaaacatctgcttgcatcatgtttgctggtgtcccactggataaagcaggtcccatggccaagcccagggttaatttaggaggagactgcatgaagggtagaaacagggaggcatgattcactggggccatcactgtacccatccactggttagatacaatgcttttggccgcaagcaacagtaaacctaatttaggctgttctaaacaataagtaacttagcctatataaaaagaagttcacagagagagtgcactttggggttggtccttcagctccataagcttcccaaggactggggtgctttcatctctgcagtctaccctgttctctacagtgtcagcctcatccaggctggttcccctcaaagccataggatgtctgccaatagcaactttgtttaattctcacaatggccccataaggtaagtactattataatatcgattttataggaaattgagacacagatattaagatatcaacgcaaagtcataggggagggaggagagaggggactgtaatttgaacacagtttgtctccagagtttgtgcttttagccactgagtagttgttaaactttagtgtgcatcagaattacttggaagccttgttcaaacattgctgggctccccccgcaatttctgattcagtagccctaggatggggactgagaatttttatttctaacaagttcccaggggatgctggtgctgcaggttcagggaacacacattgagccagtgcactaagccctgctgcctcttttgggtaatctgtgcccatgtttctgagcatcaggaaaagtgcttaattcctgtgactccatcttacaaatgacgaagtcttttgctagaatcctacggtaaggcttcttgtggcctgttggttaccattcatttttcatatatttatttttcagctggcaagcagatgaattaactcccccaagcttctagctgtgtttctactcagtgggagagatttggagtgaatcatgagggtcaaccacacagtgtctacaatgctccctacatgcatggttcacagacaaaccatgagttgttccggggctggaggaataacggttgtattaaatgtgttaaagtaacactaattgctctgtgatgtagctccttcgtgggagattttcaaggggtgtatgtgtgtatgttctgagaaggggttgtaaaagcaaatcacaacagggactaggcagatacctgaatagcctttttctctccagtgtttaatgatgaacagtttcagacatatggaaaaaaccaggaagccttgtacattgaacactcacatacccatcacctagattctcagtgagtacctccttctcatgaacttttcctgatcctcaatcctacagtgacctctccctcttgagattactctgacccagtgattcacaaccatcacactacttttaggagcctttgaaagtacaaaagccccatcccctggttttacggatttgtggtgggactcaagaatccataatttaaaacaccacccaggtagctctaaaatatagccagagagagatgaggtatgagaaccaaagccctcactcatctgtgctcttctcttgcgattaagtacattgggactggctgggtttggggacagctatcgatataactgagtgtaggtagagtcttaaggccatttcatagtccagccagtgtagaatagtggagctggtaggggacaggaaatgtagggaggattccctgggaagggtacagtgtggaattagttttagagacacaatgtcataccctcaaggagtgatggaggcattctgagaaggggatgcaaaatcaaagagacaaggcatgtacctaaatgaatgacgctggtgaggcagtctccaatagtgtgttgcggctgatagacccccagcatgagtcaccgtcagccaactgtggtcctacagcagtgcaaagcccagggtggtcagatttatggatttttaacataacccatagattgagattttcatatgaaatcttccaacatttaattgatataaacacaagttttaaagcagtatatgggtcaaattaaacccctctatggactgcagattgtacctaaagagaataagtgttgggcagggaagaatcccagtgctagatttccagactcatttggaaatctcaccgaacttccatgccaaggacggttatatattcccatcctccaaagtacagctttctaggtagcagaggttcgtttgaaactttgttgcttgtctaataataataaatcatttttggttatttaaaaatatttgactgctaagtgtttgcagattctgttgtagacaccagggcaatcacagtgatccagccatgcacatggaactgatgtcttagtgggaagtcagaaaatagaaatgaatataatgtattatcttagagttaaggcaacacaataaagcaggagaggggaatgaaacccgcatgagagcatggaattttacatagaacggccagggactgcactgggcattttgtctgagcccttcacagtaatcctaatcctcaccacaagctgtgagataagcactgttatttttagttcgcaggagaaactgacgtgctgagcagctaattcagtgcctgaggttacactagttgtggacagagatgggttccaaatccagatagtatgggttgaatccacgctcttcatcaccacccactttccctccttaggcctgagcaggcacgtggcagcatttggtagaggaaggagtgagccctgctgtaggaactatatatattggtgagttatttgcccccaagccccagaggcaccactgcttcaagtagaacaaatagtgagaccaagtagtctcagaaaattttcaaactcagcaagataattctttactatttagttgtacttgtgtggtgtcttcttctccctgcctagttttgaaacgccctctaggtaagggctttggttttgtttgctcttatcctccctagcagctagcctgggatattgacagtaagtaacaggtgcataaatgatgctggctcggcagagataggagaataatggtctttcactccttggtgccaaggtcacaatccaaagtagggtctagaaatctttcctacttccctcagggaagccttttgacctctcattctttttttttttttttgagacagagttttgctcttgttgcccaggctggagtgcaatggcgcaatctcggcttaccgcaagtaactgggattacaggcatgcgccaccacacctgactaattttgtatttttagtagagacggggtttctccatattggtcaggctgatctcaaactctcgacctcaggtgatccgcccaccttggcctcccaaagtgctgggattacaggcatgaaccaccgggcctggccttgacctctcattctaaagtgtgggagggaaagacaggctcctgggtgagcagaggtgtgttttgtgttaaaggcgttcgtggcattcagggatgtggctgtgtacttcacccaggaggagtggaggttgttgagccctgctcagaggaccctgcacagggaggtgatgctggagacttataaccatctggtctcactgggtaagaatggcctcccttggcacttaaaatctgccctacagagtattttccactcatcgtgaggaagggctacctgcagagcacctttcccttagagttgagcttgaaaacaatttacttttttcctctgggtaaatctggatttagtagaattgaaagcagacagattgatttattcatgttatggatgacactacatttccaggcctgtttcccaaggcttgtgctctctctttattttgcttcaaacccaggaaatttttcatacaccaagtgttcataatatgccatctttctgactggagtcacctttccttagtcaacccttctacttcagagagagaactattcataggtcttttttatcctctgggtttcctcacccatttcagctctgagttctagaatgccctcttgagcccataaccaacaatgtcctcattttcttccctatgaacagaaattccatcttctaaaccaaaactcattgctcagctggagcgaggggaagcgccctggagagaggagagaaaatgtccactggacctctgtccaggtgagtgttgagtgtggggtagacgggataatccacagcttggcagataggaaggaggaggcatctctcagatactgggaagaagctcttcttcaggcctcctaagccaagagaaacgttgcctgacatggtcttctttccggaacataatcttcagttgagggagggacttccctggttcccttgtctcttccctacaccaggaagcctcccttcctcatttgtcttctccgtaatgcttagtctttcctcattcactgtcttctttctcacctgatcttaaaaattgcatctacccatgaatgttaagtctacgacacttctagatactttctagctactcttatgctaagattaattgattaactccacctctccaattcccataacttattacacaatacttaagctatgactaataataaaatacatactcatgtgccaatgtcccagcttaagaaataaaaaatgacctaaacagtcgaaacccctatttccccttccctgatggtatcctctacccatccctccaatggaattgtttttcagtattagggatttgtaattctcatgcatggctttatcatttccttcatatgtatgaatcgctaaatcatctatattgttgtttggcatattttaaaactttatatcaatgtcatcatattatgtatgtattttgttttcttccctgagactaattttgtactatgttggtatatgtagctctgcttcattcatttttgtggctatataatattgtattttatgcataattataatacaattcatttatccattccatttttgttggacagttacagttctaacagtgtattcttttgacccactaaagaatgttgctgtgaaccttctcatagatatgtccttgggcacataagcacccgtttatctaggatatgtacctaggaataggacagctgagtaaaagaatatgcacctggtcagtctgacaaggtaatgccaaactattctccaaagttgttgtattagtgttctagggctgccacaacaaagtaccacaaactgagtggcttaaacaacagaagtttattttctcacagttctggaggctagaagtagagatgaaggtgttggtagggttggttccttttgagggttgtgaggaagaatctgtcccatgcctctcctctagcttctggaggtttgctggcaatccatggcgtggaggagcagagtcccagtctctgccttcatcttcatatagcattctccctgtgtgtgtgtctctgtgtccaaattttccttgtttgtaaggacattattcatactggattaggacccactctaatgacctcatcttaactaattacatctgcaacaaccctgtttccaaataagttcatcttttgagatattaggggtttggactccaatatgtcattttttggggaaacagaactcaacctatagcaattgcttacactcacatagcattttattgtttgaggattctagttgccctacatccttcctaatactttgtgtggtcagactttaggttttgatcatcttttgggtatgaaatggcctctcatagtagttgtaatttgattagttttgagtttgagcatctttttatatgttcattccttgactggccttggtgtttgctcttctgtgaagccttttcaattcttttgcttttcttcttgttgatttgaatttgaatttttaaaaataaatcattgaggtgaactctttatcagatgttccaatctgtggcctacctccttgctttttttatttttttttattgagatggagtcttgctctgtcacccagccaggagtgcagtggcatgatctcagctcacagcaacctctgcctcccaggttcaagcgatcctgctgtctcagcctcctgaatagcggggactacaggcgtgtgccaccatgcctggctggtttttgtatttttagtagagacggggtttcaccatgttggccaggctggtcttgaactgctgacctgaagtgatccacctgccttggtctcccaaaatgctgggattacagacgtgagccaccacgcccggcccccactggcctttttttttttttttttttaatacagagtctcgctttgttgccaggctggagtgcaaaggcgcaatctcggctcactgcaacctccgcctatcaggttcaaggattacagacgtgagccaccacgcccggcccccactggccttttttttttttttttttttttttaatacagagtctcgctctgttgccaggctggagtgcaaaggcgcaatctcggctcactgcaacctccgcctatcaggttcaagcaattctcctgcctcagcctcccgagtagctgggactacatgcatgccaccacgcccggctaacttttttgtatttttagtgttagccaggatggtctccatctcctgacctcatgatccgcccacctcagcctcccaaagtgctgggattacaggcgtgagccactttacctgatgccctgcttgctatttaaacaaactgtgaaataatttgtctcaatttataaaaataatacagagagtttccatttactcttcaccctgctttccccaatgataatatcttatataaccacagtacatttcaaaaccaggtaactgacattggtacagtactattgagtaaactaaagactttattcagattcagatttcatcagtttttgcatgtactcttttttttaattgttgctctatagtagtatgaaatttcattacataaataagatttatgtagccaccatcaccacaataaagatgtagaactcttctatcactacaaagaaaactctcctgtgctatcttccctccaatcttaacccctggcaactactgatctgttccccatcactataattctttttgcttttttttttttttttttttttgagacagaattttgttcttgtcccccaggctggagtgcagtggtgcaatcccagctcactgcaacctcggcctactggactcaagcgattctcctgcctcagcctcctgagtagctgggactacaggcatgtgccaccatgcctggctaattttgtatttttagtagagacggggtttcaccatgttggccaacctagtctcgaactcctgacctcaggtgatccacccacctcggcctcccaaagtgctgggattacaggcgtgaaccacttgtgcccagcctcaaattttatttctactaaaatatataattattcttatgctacatttcttcatgtgtcagtctttttaaatttgtgtattttaattaatttgtccacttaacctcagcagttaaatttgttggcataatgttcataatattcccaaatttctttaaaagtgtgtatatttctctagtggtgcttcctctttcattccccatattgtgatttaaaacattttgggggtattttatctaaaggtttattaattttatggatttttgcaaagagtcaacttttggtttcattgattttctgtagtattaatctatatcccatttaagtgatttttatttgtatctttttctgcattctactttctttgggtttaatttcctcttcttcttacttcctgaggtagaagcttaggtcattggtatagaccttcttttctaatacaatcacatatatatctgtacatttatttctaagccttgctttagctgaatcctacaacttttggtgtgttgtgttttctttatcatttagttcatgatattttctaattttcttattttttaacctattggttgtttagaagtgagctgcttaatttccagatattcaggtattttctaaatgttttatttttattggttttcaatttaattgtattttgttgagagaatgtattctgtatattttcaatctttcaaagtctgttgagattaattttatggcacagcatatgatctatttttgtgaacatcctatgagctcttaaaaggaatgtgtattctgcagttgttgagggtactatcctataaatgtcagataggtcatattggtaatatttttcagatgattgatatccttactgagtttttgatcttatttttctatccattactgcaaaggtgtgttaacatatcattgtggatttgtctatgtctctgtagtgatctctaaggttttgattcatacagttagtaattttgctatgaggcacatgtacattaataattgttacgtcttcttattgacctttttatcattatggaatttcctcctttgttttttagcaataccgcttgtcttcaggtctgttatctgatattaatatagctactccaggcttttttttttttgagacagagttttgcttttgttgcccaggctggagtgcagtggcactttctcgggcgtggcttggagatgccacgaccaaacacctcttaaaggcctcctggcttcaagtgattctcctgcttcagcctcctgagtagctgggattacaggtgcccactaccacgcctggctaatttttttcctatttttagtagagacaggatttcaccatgttggccaggctggtctcgaactcctggcctcaggtgatccacctgcctctgcctcccaaagtgctgggattacagacgtgagccaccatgtctggcccattccagctttttaatatttactctttccgtggcatacctttgtccattctttatatttcaatctttttatttgcgtctttgtatttaaaatgagtctcttatagacagcatatagttgatttttttcttctttatccagtttgccaatctctacgttttgttggagtattgaatgcattagcactcaaatgttattgttgataagtaaggttatttctacttttgccagatttttctttgttttctccaatgtgtttttacttgctctgttttctttagcctacttttgttttaatgttttaataaaatactttttagattcttttttcttttttttttttttttttgagacatagtctcactctgtcaccgagactggagtgcagtggtgagatcttggctcagtcatcctctgcctcctgggttcaagggattctcctgcctcagcttcccgagtagctgggactaggggcgcacgctactacgcccagctaatttttgtattgtcagtagagatgggatttcaccatgttggccaggctggtctcgaactcctgacctcaagtgatctgcctgcctcagcctcccaaagtgttcagattacaggcgtgagccaccgcgcccggctcctttttcgatcttcatgttaatttctctcagctatctagctatgtatctgccttgtgtgtgttcatgacttttccagggcttacaatatgtatttttaacttaaaccaattagagttattatttgtttaaggtaatgtaagaatctcacaagagtatgtttacattcccctcatcttcagtgctgttgtcatatacattatttctgtaaacatcctaaacccaatactacagtgttaaaatttttaagccatcgtatagtaatacgtatttttaaagaaattaaggtaaatgtatgtagaaatatgtgtgtgtgctttatatctgtcacatttcttatgctcttcactccttaatgtagatacaagttgccatctgataccattttccttcatcctgaaagacttcctttaacatttagtacagttacctggcattggattttccattttaatctgaaaagattattttctctccagtttgcgaaaattaactggagatagaatcgctggttaacatatttttctctggcattgcagtgtcttctggctttcatagttttgtaatttttgttgagtaattattatattgttcttttatattttgatcttctctggctgtcttcaagattttctcgttatctttggccttcagcagtttgaccgtgatgtttctatgagccgttttctttgtgtttctactacttaagcattatgaagcttcttggctctctaagttttattttctattcactgtgagaagtacttggctattatttcaatatttttcctgtcccttttactctttcctctcattctaggactcccaatttacctgtatattggactgctggaaatatgtttctgaagattcatattgtctcataagcttctgttcatttttcttcagtcttttttctcttttttgaggggtgggtggatatatgtaatttctattcttttattttcaaattcactaatctttcttctttttctgtttgctattaaacctgtctagtgaatttttaaatttcagttgtttttttctttccccctcccctcctctcccctcctctcccctcccctcccctcccctcccctcccctcccctcctcttgtttctgtgggttttaggagtgctctcaggcaagaaagccacaaacaaaattattacccctttctgttgcaattttttgagcataaactcttccccatcttctggctggttatgtatattttccagtgcctttgagtagttatttgttatattttatccagtcttattattttctgctgcagggttcttgtgaccatttcagtctgctggcattttcgttagtgggcttcctcatacttatttttgaattgatttttggaaattgcttcaaaattacagaatatttgcaaaaataaaaatagtagaataaatatatatggtgcagtgagttgtatgtggtttgtccccaccacaactcatggtgaaatttaattgccagtttaacggtattgaaaggtggtggggcctttaagaggtgtttggttgtggcatctctgccctctcgaatggcttatgcagactgggttagttcttttggactgggttggttctcgtgagatcaagttgttataaaacaaggcttcctctgatgtttggcctctttgcatgcacttgctttcccttcctctttctgctgtgatttgaagcagcatgagaccatcaccaaatgggctaccatccaacctccagaattgtgagccaaataaacttttttgtaaattacccagtctcaggtattctgttatagcaatacaaaacagattaagacatatggcatatatgttattatataaatggcatcataaaatgacctactattttacttagtttgctttatcatttattcatgtgctcttttgcatgcatacccttcctccttccttcccctttctcagtacatatgtatgtatgtgtatatgtatatgtatgttcatatgtgtttgttttgtttttgtctttgtttttgtttttgttttttgagacagagtctcgctctgtcacccaggctggagtgcagtggcacgatctcggctcactgcaacctccgcctcctgggttcaagcgattctcctgcctcagcctcccaagtagctgggattacaggtgcacgccaccatgcctggctaatttttgtgtttttagtagagacagggtttcaccatgttagtcaggctggtcttgaacacctgacctcatgatctgctcacctcggtctcccaaagtgctgggattacaggcgtgagccaccacccccggcctgtaagtgtttgtttctgtgaattttctaagaatgtcgatattgtctcatataaccacagtgtggttatcagcctcagtaaacttaactttgatacagtcattttgcctgttatctaccattcgtattataattttgtcaacatatagaataatatggttttttactttccagaacataatctagtccaaggttagttagttcattttcatgtcatgtctataattattattaagggaagggaattattatttcaataatctttctctgtcttttataacattgacatttcatttgtttatttaattttagattcagagtgtacatgtgcaggtttgttacatgggtatattatgtaatgctggggtttggggcttctattgaacctatcacccaaatagtttacatagtacctgataggtagtttttcagcccttacctccatcctttttcccctgttttggagtccccagtgtctattatttccatctttatgtccgtgtgtacccattgtttagctcctacttgtgagaacataggttatttgattttctgtttctgcattgattcacttaggatgatggcctctagctgcatccatgttgctgcagaggacatgatttcattcttttttatggctgcatagtatttcatggtgtgtgtgtaccacattttatttatccagtccactattgatgggcctatacgaagattccatgactttgctgttgggaatagtgctgcgataagcatacgagtgcaggtgtcttctggtagaacaatttattttcccagtcttgggattgttggattgaatggtagttctatttttagttccttgagaaatttccatactgtttgccatacaggttgaactaatttacatgaccaccaacaatatataagcattccctgttctgtgcatcctcactaacatctgtttttttgtttgtttgtttgtttgtttaactttttaataatagccattctgactggtgtgagatggcctatcttcttgtgggttttcttttcccatccttcactggtaccaagatctctttgtggttgtaatttgtatttctctgatgattagtgattttgagcattttttatgtttgctccctgtttgtgtaccttcttttgagaagtatctgtttatgtcctttgctcactttttaatgaggttatttgggtttttgttgttgatttgtttaagttccttatgtttctgcatattagtcctttgtaagatgcatggttcgcaaatgctttctcccattctgtaggttgtctttttactctgttgattgtttcttttgcagtgcagaagctcttttgcttaattaaatcatatttgtccatttttgtttttgttgcaatcgcttttgaggacttagtcataagttctttgccttggccaatgtccagagaagtttttcctagttttcctttaggaattttatagtttgaggtcttacatttaagtctttcatccatcttgagttgatttgtgtatatgagggggaagggtccagtttcattctcttgcatgtggctggacagttttcccagcatcatttattgaatagggtgtcctttccccattgtttatttctgtcagctttctcgtagatcagttggtagtaggtgtgtggttttatttctgggttctctgttctgttccgtagatctatatgtctatttttgtacttacaccgtgctgtttcagttaatatagccttgtagtatagtcaaagtcaggtaatgtgatatttccagctttgttctttttgtttaggattgctttggctagtcaggctttgttggtcccatatgaattttagaattgttttttctagttctgttagaatgttagaatgacaaatgatgttggtaatttgataggaattgcattgaatctgtagattgctttgggcagtatcatcattttaactatattgattcttaacaatctatgagcatagaatgtttttccctttgtgtcatctgtgatttctttcatcagtgttttgtagttctcctcgcagagacctttcacctctttggtttgatgtattcttaggcattttgtgtgtgtttgcattcgtgtggctattgtaaatgggatcttgttctttatttggctctaagcttgaatgttactggtgtatagaaatgctattgatttttgtacattgattttgtatcctggaactttactgaatttttttttttaatcaggtttaggagtcttttggagggacctttagagttttctaggtataggattattttctaggtataggattttctaggtaaaggattcttggcgaacagagataatttgactccctcttttcctatttggatgccttttatttctctgtcttgcatgattgctttctctaggacttccagtactaagttgaatacgagtggtgagagcagacatccttttcttgttccacttcttagggggaatggtttcagctttcgcccattcagtatgaagttggctgtaggtctgtcacagataactcttcttattttgaggtatgttcctttgatgcctagtttgttaaagatttttatcatgaaggggtgttggattttatccgatgctttttttacatctattaagatgatctttttttttttttttttttttttttgtttgagacggagtcttgctctgtcaccctggctggagtgcagtggcgcgatctcggctcactgcaagctccgtctcccaggttcacactattctcctgcctcagcctctctgagtagctggaactacaggcgcccaccaccaagcctggctatatttttgtatttttttagtagagatggggtttcaccgtggtctcaatctcctgacctcgtgatccgcccgcctcagcctcccaaagtgctaggattacaagcatgagccaccacacctggccggtttttgtttttaatcctgtttatgtgatgaatcacatttattgaacactgacattttagaatacaattcctcagttctcactttttttttttttcttttttgagatgaagtctcactctgttgcctaggctggagtgcagtggcgcgatctcggctcactgcaacctccacctcctggtttcaagcagttctctgcctcagcctcccgattagctgggactacaggtgcgtgccaccatgcctggctaagttttgtatttttagtagagacaggatttcaccatcttggccaggcttgtcttgaactcttgccctcaggtgatccacccaccttggcctcccaaagtgctgggattacaggcgtgagctaccgcgcctggccagttctcactttttaaaatagctttactgaggtataatttacatgccataaaattacttattgtatgtatacagttcaatatatatatattttttttttgagatggagtttcactgttgtagcccatgctggagtgcagtggcacaatctcggctcactgcaacctctgcctcctgggttcaagtgattctcctgcctcagcctcccgagtagctgggattacaggcatgtaccaccaggcctggctaattttgtatttttggtaaagacagggtttctccatgttggtcaggctggtctcaaacttccgacctcaggtgatccgccacctcagccttccaaagtgctgggattacaggcgtgaaccgccgcacctggcctgtgtgtgtacagttcaataatttttagtaaacttatagagttatatgattgtcacctctattcaacatttctgtcacaccagaaagttctcatgtgcccatttgcattcatccgtcctcccatcagaggaaaccattgatttgtttactgtctatagatttgctgtttctagacgtataagaatggcattgtgaaatatatagtcttttcttttttttttttttagatggagccttgctctgttgccaggctggaatacagtggtgttatatcggctcactgcaacctctgcctcctgggttcaagcaattcccctgcctcagcctcctgagtagctgggactacaggtgcacaccaccacacctggctaattttttgtattttagtagagacggggtttcaccatgttggccaggatggtctcaatctcctgaccttgtgatccacccgcctcagcctcccaaagtgctgggattacaggcatgagccaccatgcctggcccttttcattgtttattaaccatttgcatatcttttttagtaaaatgcctattcaattcttttctttattttaaaattagattgtgttcttattgaattgtaagaatttttagtatattctagacacaagtcctatatcaatataggattttcagatatttctccctgtctgtggcttatcttttcattttctcaatggtgtcatttcaggcacaaaagttttaaatgctgattaagtttaacttaccaatttttaaaatgggttgtgcttttggtgttgtaactaagaactttattcttaactcaaggttatgaagattttcttcactggtttcttctagaagttttacagttttagctcttacatttagagctacaatccattttagttaatttttatgtatcaaatgaggtgaaaatctaaattcattttcttgcatatgaatattcagttgtccttacaatctcatataaagagtatccttcctcccattgaattaccttggcacctttatcaaaaatcagctgactgtgaatctaagtgttcatttctagtctcctgattttgttccatgatctccatcttcctcctatgacagtagcacactatcttcattactgtagctttatattaagttttgaagttagaagtatacactccccaactttattttctttttcagaaattgttttgtctattttatgtcctttgaatttcaatgtaagttttaggatcagattgtgaatttccaaaagggaaaaaaaccaaaagcctgctgtggttgtgataccatgattatgttgaatctgcagataaattttggtgagaatcaccatcttaataatagtaagccttccaatctatgactgtctccctatttatttggagctttaacttcattcaacaatgtttgttaattttctttttaaaaatctttcttcttttcctcctttcctttccttttctctttctcttctctttctttcatcccactatgttgcccaaactggcctctaacttctggcctcaagcaatcctcccacctcagcctccttaagtgttgggattacaggcatgagccaccgtgcccagccttaattttcagtttacaaactttgtgctactttgtcacatttattccttagcattttattatttttatgctatcgtgaatagtattgttttctcagtttcatttttagaatagtcattgctagtatatagaaatataattattttttatatatttatcttatatgacctaagtacaattatgacttctagttgcttttttgaaattttatgcttacaaaattatataatctgtgaacaagagattttttttacttcttcctttctagttaagatgcctttcatttattttctcctcattttgtttgtcttctccttttttttttttttttttttgagacagagtctcactgtgtcaccaggctggagtgtggtggcacgatctcagctcactgcaacgtccgcctccggggttcaagcgattctcctgcctcagcctcccaagtagccgagactacatgtgtgtgctaccatagccagctaatttttctatttttagtggagacagggtttcgccatgttggccaggatggtctcaatctcttgacctcgtgatctgcccgcctcggcttcccaaagtgttgggactacaggcgtcataagtttttgagaacacgtgcaatatttgccacttcttctttcttcttctccttttccttctcctcctcctcctccttcttcttccttcctttctctttctcttttctgtgtctccctcttttgaattcaaccccttaaaaaggtaaaaaccatttttagctggcaggccatacagaaacaggtttcaggctggatttggcctgtcaggtgagtttgccaactcctgcaatagaaaatgtaatgcatagggctagacacagtggcttatgcctgtaatcccagcactttgggaggcttaggctgacctgaggtcaggagttcaagaccagcctggcaaacacggtaaaactctgtctctactaaaaatacaaaaattagctgggcgtagtcttggacgcctgtaatcccagctactcgggaggctaaggcaggagaatcgcttgaaccctggaggcggaggttgcagtgagctgagatcgcaccactgcactccagcttgggtgaaagaaagactccgtttaaaaaaaaaaacaaaaaaacaaaagaaagtgtaatgcatgaagtgaaatgaaaaatagatgctgggaaggatgtctaactgggagatagcttgtgatgtaaatatgtaaatatattatgaatgaccagtgggcaaggcaaaattgcctacacagccctacctatggcccctctgaaaatgttctttcttcagcagaatcgaagccagaaattcaacttagtccctcctgccctctgattttctccagtcagcaagctctcagccaacatgtgtggctgagtcatctctctcagctgttttcaagtttatgggcaggaaatcctctccacctgggaaaacactatccagaagatcagaaacaacagcaggatccattctgctttagtggcaaagcagaatggattcaagagggagaagactccagactcctgtttgggagagtaagcaaaaatggcacttcaaaggcactttccagcccacctgaagaacaacagccagcacagtccaaggaagacaacacagtggtggatatagggtccagccctgaacggagggcagatctagaggaaacagacaaagtattgcatggtttagaagtctcaggatttggagaaatcaaatatgaagagtttgggccaggctttatcaaggagtcaaacctccttagcctccagaagacacaaactggggagacaccttacatgtacactgagtggggagacagctttggcagtatgtcagtcctcatcaaaaacccaaggacacactctgggggaaagccttatgtgtgcagggaatgtgggcgaggctttacgtggaagtcaaacctgatcacacatcagaggacacactcaggggagaaaccttatgtgtgcaaggattgtggacgaggctttacttggaagtcgaacctctttacacatcagcggacacactcagggctcaagccttatgtgtgcaaggaatgtgggcagagctttagcctgaagtcaaacctcattacccaccagagggcgcacactggggagaagccttatgtttgcagggaatgtgggcgtggctttcgccagcattcacacctggtcagacacaagaggacacattcaggagagaagccttacatttgcagggagtgtgagcaaggctttagccagaagtcacacctcatcagacacttaaggacacacacaggagagaagccttatgtatgcacagaatgtgggcgtcactttagctggaaatcaaacctcaaaacacaccagaggacacactcaggggttaaaccttatgtctgcctggagtgcgggcagtgctttagcctgaagtcaaaccttaacaaacaccagaggtcacacacgggggagaagccatttgtatgtacggagtgtgggcgaggctttacccggaaatcaaccctgagcacgcaccagaggacacactcaggggagaagccatttgtatgtgctgagtgtggacgaggctttaatgataagtccaccctcatttcacaccagaggacacattcaggggaaaagccttttatgtgcagggagtgtggcagaaggtttcggcagaagcctaacctgtttaggcacaagagggcacactcaggtgcctttgtgtgcagggagtgtgggcaaggcttttgtgctaagttaactctcattaaacaccagagagcacacgcaggggggaagcctcatgtgtgcagggagtgtgggcaaggctttagccggcagtcacacctcattagacaccagaggacacattcaggagagaagccttatatttgcagaaagtgtggacggggctttagtcggaagtccaaccttatcagacatcagaggacacactcaggatagaaactttatgtgtatagggaatgtggtacagcctttagccaggagtcatacttcatcagacaccagaggacacacacagtgctgtggctttttcagccattgctagataccaaagtggagacattctgtgtgtgattatgcatgagactgtactggtaagacttgtatctccatccacctgaaggagaattgctggctcattttcaggagccctgcccttcctcactgtggatggtgggttgtggaaacccggtcaggtaatgatagtggcaggaggcagtcaaatgcccaggcagataggggtgggtacctggtgaaacccaaccttaaagctgaagacagtcccggctaaatcctcatactgaattgagaacctgtcttcccatttggtgtgctttcctccgattgatcccaacccttcacctattttacgtatacctgccctttcctaattggtttttacactgctgtgcccaccttttgagtggtgcctttgcatacttacaaatcagtcaacgtgtattcccctattctgagcccataaaagacccagactcagctgcagtgaggagagaaatcaccctgctgtgggggttggggaccactccctgcatcccctctccactgagagctgttcttttgctcaataaaattcttttctacccatcctcacccttcaa

SEQ ID NO: 2349 - DNA, 69247 bp, Homo sapiens
tggtttgtaactccgctttttattttctacaggatttaaaagacaaatgcataaaatgtaattataaatctgttaggtggtgtacaatgaataaagatacaatttgttacatcaataacctaaaaagagtagacctatatagcagtagaattttggtatgtgattgaagttaagttgaaataaattcaaatcagaatgttataactccaggatgttatatgtaattttcatagtaaccaaaaacgaaatctacatagaatatacacaaaaggaaatgagaatagaaacaaaacttgtcactacaaaaaaaatcaactaaagataaaagaagtaaataattgagaaaatgactggcaaaaatcagtaactgacgtattaaaactttccatgctacataaatctggaaactctatttcacatgaaactggagctgaaagagacaaatatttacttataaagttaaaagttatatggaaaaccaacactaattttttttagaaaaaattatggaaaataaaaatatgccttatagtatcatataatatcatgttttatagctcttggaaaatagaaaataaaatgttctgttagcatgaatccttctgtgccctcaaaaaccctatggattataccattattacctaaaaagtctattctcaaatgcagcacaatgataatttttataaggtagatgttatttttaaatatggaataatattggtgatttcagtttcagttttaataacattggattaagatgaaagaatgagaagataaaggtccctcagcaatataactcacaaacatgttcagaagcagtaagaagttacattaattatcttttgaaagtcaataatctacatttttaatgtatgcatatggcatagctaatgtactattgctgggtccatttattcaatgaataattgctgctatgcgtcagacatttttctaggcctaggaatggatacataagtgaacaaagcaaagattctggttcttgtagagtttccattaaaagatcatttagtaaaatttttcttcccccaaattataaaatctgtaagatgatttaacaatatgtataaaagtcattgtgggtcaggcacagtggcttataccaggtgtggtgactcagcgctctgtcacccaggctggagtgcagtggcgcaatctctgctcactacaacctctgcctcctggctacaagcgattctcctgcctcagctttccgagtagcagggactacaggtgcacaacaccacacccggctaacttttgtattattagtagagatggggtttcgtcatgttggccgggctgttctcaagctcctgaccgcaagtgatccgcccacctcggcctcccaaagtgctgggattacaggtgtgagccaccacacctggccttattttctacaactttgataactttggcatataccccaaatctgtaacacataatattatcattcaaatgcaactctttctctagcttttgaattctttattctaatatcagttttaagtctgacacaaaagcatgggagttcttatcaaattccaaccttttatcataaaaactgtcaagaaattatcagtagtagaacttaaaaaggaaaataggcctattaattagatttgtataacttaacattttatgcctatgagtccccaacaaagcctccagcttctatttggatataaaagttaaaagtcactactggatccaaaagcaggactatggtaaataaatttctccacctaaccagctccttttacatgatgctacgtgtttcttttgttttttcattttggcaaatattgattgaaagtcatatttgtgttagtgtacgtcctaagtgccaagatacagaatctgaaaagagggacacaggatctgccttctgggagttcatacttttttttttttttttttttttgaggcggagttttgctcttgtcacccaggctggagtacaatggtgagatcttggctcactgcaacctccacctccggggttcaagtgattctcctgcctcagcctcccaagtggctgggattacaggtaccggccaccaaacccagctaatttttgtatttttagtagaggcagggtttcatcattttggtcaggctggttttgaactcctgacctcaggtggtccacccgcctcagcctcccaaagtgctgggattacaggcatgagccaccacaccccgctaggagttcacactttagttggggaaaatatacaataagcaagccaatttttaaaatgagaacttcagagttaaatgctacaaagacaatctcacaggaagttgcgatgtagaatgatagggctctcagaatagtaagagaaactattatttcttacgatgtttgtctttctttgtatcggtgctcagctgagtctgcagtgcttcggaggcagctttcattttataaaaatctatgatttctccttccagttgttttttctcttcctcgagcttccttatctcctcctgttgaatcattttaagatgctcgaacttgtcctgcagctgtgaaaccaatgtgcagttgtgacaccaaagcacagtgtggctgaacacccaaaagaatatgcttttttctaaatatcaaacaaacccaaatcatcacagtagagcatgatcttaataacaacctcaaaaactcaggagtaaacactgagatatggaatttttcttttctttcttttttccttttttgagatggagtctcactctgctgcccaggctggagtgcagtggcgcgatctcagctcactgcaacctccatctcctggttcgagtgattctcctgccttagcctcccgagaagctgggactacaggcatgcaccaccatgcccagctaatttttgtatttttagtagagacggggtttcaccatgttggccaggctggtcttgaactcctaacctcaggtgatcctcccgctttggcctcccaaagacttttttttaatatagaagcaaggtctcactatgttgcccaggctggtctcaaactcctgagctcaagtgatcctcccacctcagcttcccaaagtgctgggactgactggatgcagtggctcatgcttgtaaactcagcactctgggaggccaaggcagaaggatcgcttgagtccaggagttcaagaccagcctgggcaatgtaacacaatagtaaacttcaacaggagagagcatctgtaaaattgaatatagatcatctgaaattatccagtgagaggacaaagaaaaaaagaataaaaaagagaaaagaaggctgggcgtggtggctcacacctgtaatcccagcactttggtaggccgaggcaggcagatcacaaggtcaggagttcaagaccagcctggccaacatagtgaaaccccgtctctactaaaaatacaaaaagtagctgggtgtggtggtacatgcctgtagtccaagctatttgggaggctgaggcaggagaatcacttgaacccaggaggcggaggttgcagtaagccgagaccgtgccattgcactctagcctgggcaacagagagagactccatctcaaaaaaagaaaaaaaaagagagagagaaaagaaagccaatgagacaccattaggcaaaccactgtcaggttatgggagtctgagaaggaaagtagagaaaggagaagaaagcttatataaagaaagaatggctgaaaactctctaaatcatgggaaagatttagacatccaaatccatgaagcttaaagattcctaaagaggttcaaaccaaatagatactcaccaagtcacaatataatcaaatagtcaaaagtcaaagattttttaaaatgttgaagaggcaagagaaaagtggcatgacatagacaagagaatcttcattagactatcagcagatttctcagaaggaactttgcaagtcaggagagaatcaaataatacattcaaagtgctgaaagaaaaaactgccagcaactaatactatgtctgacaaagctaaccttcagaaagaaagaagaaataacatgtttcctcgacaaacaaagctgagggaattcaggaccactaggtgtaccttaaaagaaatgcttaagggagtttttcaagtaaaaatgaaagaatgcagctgggcatggtggctcatgcctgtaatcccagcattttgggaggccgaggtgggtggatcacctgaggtcaggaggtcaagaccagcctggccaacatggcgaaaccctatctctactaaaaatacaaaaaattagccaggtgtggtggcagctgctgagattgcaccactgcactccagcctgggtgacaagagccaaactgcatctcaaacaacaacaacaacaaaaaacttgaggcctggcctcctactcccctcccactccccttctccaggcccaagccaccttggctgaggagggggctgaggaagtgtgagcccctgccaggaacccctgcccagaccatgtactcggcccacaggcccctgatgcttgcattcagcaaggcctcccgtggcctcggcatgttcaggtagaggaacgtggaacctcgctctttggctgtgttcccctggtactccatctccttcctgacccctccctgcagccacgcaaagcccagcaacctgccagacactcagtggcctccaactagacaaaagaacctgctgagttggcagctgttgctcatgagcgtccaccaggtgggacagggagtgctgaccctgggcggccccctgaagccacctgccctgaaagcccagggcccagaaccccacacactttgggggtggtggaacctggtaagggcccaccttccaccatggaggaggagccctgggcccctcaggggagcccctgctggacagtgagacagagaatgaccacaatgatgctttcctctccgtcatgtctcctgacacccagttgcctctaccacccaaatgatgtcaggcccagtctctcagtgccctgcccaaggaacagaactcatcttctgagaaggatggacgcagccccaacaaatgggacaaggaccacatccggcagcccgtgagtggcactcatgatcttcagcaagcggcaccaggctctggcagggcccaccagtgtcaccccaaccaggacaactggaccgtcagccagatcctgggcgagtggtggtacactctggggcccaatgagaggcagaagtaccatgacctgacctcccaggtgaaggtggcccacttgcaacaaggaccgaaagaagtccaggcccggagactcacacctgtaatcccagcactttgggaggctggggcgggcggatcacctgaggtcagaagttggcctggccaacatggtgaaatcccgtctctactaaaaatacaaaaattagccgggagtggtgttgggcaacaaatcacaaaggaagacagaaagagaggaacaaagaaactacaaaacagtcagaaaacaattaataaaatgataatagtaagtccttacctataaaaattactttaaaagtaaatagattaagcccactaatcacaagacacaaagtagcagaatgaataaagaaacaattctcaataatatgtggcttacaagagactcacttttgccttaaggacacacttagactaaaagtgaaggaatagaaaaacatggctgggcgcagtggctcatgcctgtaatcccagcactttgggaggccaaggcaaatggatcacttgaggtcaggagttcaagaccagtctggccaacatggtgaaacgccatctctactaaaaatacaaaaaaaaaaaaaaaaattagccacgccttgtagtgggcacctgtagtcccagctactcaggaggctgaggcaggagaatctcttgagtccaggaggtagaggttgcagtgagctgagatcgtgccactgtactccagcctaggtgacagagcaagactcttgtctcaaaaaaaaaaaaaaaaaaaaaaaaggaaaaagaaaaagatattccatgcaaattataggcaaaagaggacagggcaggtatacttattgcagacaattagacttttggtcaaatgttgtcataagagacaatatcactatataataataaagaaatcaatttataaagaggttataacaatcatcaaatatatgacaacattggagcacctaatatataaagcaaatattaacagaaatgaaggaagaaacttacagcaatatgagaacagtaggggactactgtatcccactttcagcaccagatagtccatccaaacagaaagtaagtagggaaagagtagatgtgaataactatagacccaatagaccaaataggcatagatagattatttcactgaacagtagaagaatacattcttctcaagggcacaggaacattctccaacatagatcatatattgggccacaaaatgactcttaacaaattttaaaagtttgaaatcatattatgtatctttttatcataatagtataatattagaaatcaataacagaaagattttattattgaagcactattcataatagccaaaatttggaagcaacctaactgtccacaacagatgagtggatgaaaaaaaatgtcacatatacacagtggactactattcagccataaaaaagaatgagatcctgtcacttgcaacaacatggatggaactggaggacctcacgttaagtgaaataagccaggcacagaatgataaacttcacacgttctcacttacttgtgggagctaaaaattaaaataattgaactcagtcaggcgcagtagctcacacctgtaatcccagcacttcaggaggctgaggcaggtggatcacctgaggtcaggagtttgagaccagcctggccaacatggtaaaactccatctctactaaaaatacaaaaattagctgggtgtggtggcacatgcctgtaatcccaaccacttgggaggctgaggcaggagaatcgcttgaacccaggaggcagaggttgcagtgagctgagatcccacagccgcacaccagcctgggtgacagagcgagactttgtctcaaaaaaaaaaaaaattaaactcatggagatagagaatgaaatgatgattaccagaggctgggaagggtggtaggggtggggggaagtgaggacatttcttggtacaaaaatatagttagaaagaataaataagacgcagtatttgatagcacaacagggtcactatacacaataataatttaattgtaccttttaaaataactgagtatcattggatttcttgtaacacaaaggacaaatgcttgaagggatagatatcccatttaacttgatgtgattattacacattgtatgcctatatcaaaatatctatcgtaccccataaatatgtatacctactaggtacccatagaaattaaaaattaaaaaatatacatctcttgacacaaatgaagataaaaaacaacatatcaatagttatgggatacagcaaaagcagtttaagagtgaagtttattgcaataaatgcctatattaagaaaaaatagattaaataatgtaatttcacacctcaaaagaaaaagaaaaacaaaccaagcgcaaagtcagtaaaagcaagaaaatagtaaaaatcacagcagaaataaataagatatagactagagaaacaatagaagaaaatcaatgaactaagtgttttttaaaaagataaataaatgaacaacccttagaaaaactaagaaaaaaagagagaaaactcaaacaaataaaatcagaaatgaaaggtgacacataaccactgacaccaaagaaatacaaatgatcatgagactactatgaaaaattataagccaacaaaatttgataacctaaaaaagaaattggatatccttggttaataaattcttataaccacacgatctacgaagactggatcatgaagaaactgaaaatctgaaaagactactaataggtaaggagatttaatcagtaacaaaaaatgctaccaaagaaaaggccgtactaggtgactttactggggaaggctacaaaacatttaaaatggaaataataggccaggtgcagtggctcatgcctgcaatcccagcagtttaggaggctgaggtgggcagatcacttgaactcaggagttcgagaccagcctgggcagcatagtgagaccccatctctactaaaagtacaaaaaaatagccaggcacggtggtacatgcctgcggtcccagctactcgagaagctgaggtgggaggatcacttgagcctgggaggtggaagttgcaatgagctgagatcgtgccacttcactccagcctgggtgacacagcgagatcttgtcttaaatagataaataaaatggaaaaatacaaaaatacttcccaaagtcttccaaagaatggaagaggagagtatggtttctttttttttttttttctatgagacggagtcttgctctgtctccaaggctggagtgcagtgcagtggtgcgatctcagctcactgcaaccttcacctcctgggttcaagcgattctcctgcctcagcctcctgagtagccaggattacagccgcacaccaccacgcccggctaatttttatatttttagtagagatggggtttcgccaagttggccaggctggtcttgaactcctgacctgacgtgatctgcctgcctcggcctcccagagtgctgggattacaggcatgagccacctcgcctggccaggagaatacacttctaaatgcattcgaagaagacattattactctgatactacagccagaagaggacactatgagaaaaaaaaattataggccaacatttgtgatgagccaactaggaaatcctcaacaaaatactagcaaactgaattagatcgcacattaaatatcagatggccaagtggaatttattcttggaatgcaaggatgattcaaatacacaaatcaataaatgtgaccacatgcagaaaaaaaaattagatctttatctcaaaacatatgtaaatctcaactcaaaatggatgaaagacttaaccgctataagatctaaagctgtacaactactttaaaaaattagggataagttccttaacttgggtctgacaatgatttttttggatacaaactccaaagcatagacaacataggcaaaaatggacaaataaaattatatcaaactaaaaagctcctgcacagccaaaaaaaaaaatcaacagactaaagaaacaaactatgaaatgtgagaaaatatttgcaaactgtacatctgataaggggttaatgccccaaatatacaagaactcaaataattcaatagtatgaaaacctcattccgaaaatgggcaatgaaactgaactttttttttttttttgagatggagtctcactctgctgcccaggctagagtgcagtggtgcaatctgggctcactgtaacctctacctcccgggttcaagtgattctcctacctcagcctcccgattagctgggactacaggcgtgtgccaccacatctggctaatttttgtatttttaatagagacaaggtttcaccatgttggtcaggctggtctttaactcctcacctcaaatgatccgcccacctccacctcccaaagtgctgggattataggcgagagccactgcacccggctgaacctgaacattttttaaaagaagacataaaaggcaaatagggatatgaaaaaaatattcaacctcattaatcatcagagaaatgccaatttaaaccacaattagatggcacctcatatctgttagaaaaacagaaagataagtgtttacaagaatgattttatagaaagataagtatttacaaaaaaaggtaagtgtttataagaataattttataaaacaatgataaaaaagtaaatcagtacagctattatgaaaaatatgggtattcattaagcaactgaaaatagaataaccatatggttcagcaaccccactaatagttatgtgttcaaaggaaataaaatcagtatgtcaaagagatatctacactttcatgtttattgcagcattaattgacaataatcaagacatgtaatcaaccctaagagaacacatagttgagatatggaaaagaaactaatctccagagagaaagaaaaaagaagcagacgtacaggaataaggttcataactaagggaagtgaggtgggagagaaagagaaaatttaaatggttgcttcggtttctggtcacttcctagttttggtttaagtcttcatgaggccaggcgcgatggctcatgtctgtaatcccagcactttgggaggccgaggcaggcggatcacgaggtcaggagatcgagatcatcctggctaacacggtgaaaccccatctctactaaaaatacaaaaaaaaaaaaaaaaatttagttgggcacggtggtgagcgcctgtagacccagctactcgggaggctggggcaggagaatggcgtgaacccaggaggcggagcttgcggtgagcccagatcgcgccactgcactccaacctgggtaacagagcaagactctgtctaaaaaaaaaaaaaaaaaaaaaaaaagtcttcatgagatccagctatgtctcttgtccttagatgtcatgacgtacccttgtatacatccaaactttttcctttatacctaagctaatggtttggttttttttgttttttttttttgagacggagtctcactctcgcccaggctggaggcagtggcaccatctcggctcactgcaacctccacctactgggttcaagcgattctcctacctcagcctcccgagtagctggaattataggcatgcagcaccatgcccagctaatttttatatttttagttgagacggggtttcaccacgttggccaggctggtcttgaactcctggctttaggggatccgcccgcctccatctcccaaagtgctgggattataggtgtgagccaccgcacccggctggaatttttattacttataattcaactgtctttgaatgagacatctggcctatagcacctaattactactattctgttcttatgaaaaaggaagtttatgttccaatttacctaattaaactaaatgttcttaaactaaagccacctacacttgagagaaagaaattatggtttcaaaaatatgtcttcaccaaaaacgtatttgtggcaaataattaaaacgatattaatagcttttttccccattttattagaaatggcatggaataacataatttaccaacttaaaattttctcattaatcaaggccagcattagtcaacatttgctttttataaaagtgaagacaattttctagtgcattaatagcattagacagtacaagactcttctcagagtaaatagcttgggtttgtcacaaattaaactttatgcatgaaaatttaaattataaataaaacataatttttataaaattatcttcagggttatttaaatgggaaaattaagttctctagaaaaaacactacagactataattttgtaaaggctatattcaagtctacatggtaaaaagctactttttgaaaaatagcaagtatcctccaaaaacatcaagtaaactcttgagattaaaacccccaaattaatagggcacctaaaaattaatacaaattatatcaaactgtcagtactaacctctttttcagcttctttaaatgttgcttctttctccttgactcgctgcataaatctctgtttcaactcttcttcttccctctgacattgatcatagaactcttgtcttttggcttcaaagatttcttgaaaactaaagagaaatgttttcttagtcttatattaaaatgaggtaggaggatcgcttgaacccaggaggcggagtttgcagagaatcaaaatcgtgccactgcacgtcagcctgggagacagagtaagactccatcataaaaaaataaaataaaatgaaaaataaaaacacactagtataaacatgtaaaaaatatatattgtatgttacatcctatataaggaaatttaccaacattctctcatgtttagcagcacaaaatggaaatttccatatcataagatgtaaaaaccaaggcacaatacttaagatcagagtatatagacagtatatgtaaagaatactagaattttccaacacttatatgagtgaattcttatccccaccactttccaggatatcatacattttcatatcttttgacaataacattcagggaaacctctaatgtatgagacgattttcaaaaatcctctaaaataaagcaaaaagtctttcaaaatatcatcattcatttaagatagttaaattttgggtgtctacaaagaacaatgaatgatataactagattatatacactacagtgccatgtttttgcaacacaagtcctattcttcttttttttttgagacagagtctctctttgtcgcccagactggagtgcagtggcacgatctcagctcactgcaatctctgctgcccaggttcaagcgattctcctgcctcagcctcccgagttaactgggattacgggcacccgccaccacgcccagctaattttttttgtatttttagtagggacggagctttaccatgttggccaggctgatcttaaactcctgacctcaggtaatctgcctgtctcggtttcccaaagtgctgggattacaggcgggagccactgcacccggctctattcttcaagttagagcaaacacctgctctcaaacttttctcatttaacttccaggatgctgcactactgcttttcagctggttcctccatcaaactcttcttaatgtcttttgtcaaactttgctaatatttttccatctttttctttatcctttctttttttttctttttttttttaagatggagtcttgctcagtccgccacgctggaagtgcagtgaggtgatctcagctcactgcaacctccgcctccagggttcaagcgattctcctgcctcagcctcccaagtggctgggatacaggcgtgtgccaccatgcccggctactttttgtatttttagtagacacagggttttaccatgttggccaggctgctctcaaatacctgaccttagatgatccgcccgcctcagcctcccaaagtgctgggattacaggcatgagccacagcgcccggcctatcctttctttcacataatacagatacatttcatataaatacaaaaaatggaacaaaatactgggttttttcatcaatatacatttcagcatatatacatattgaatacacatatttcagcataaaaatgagatctcgcattatattgttcctactatctctaccttcgtcaaaagatcataaaaacacctaacattcaggtgttttctttatgatggctcaagatgggagaagtataattattctcatatccaaattatcataccttgtgtttgtagggactcctaaattatccatttggttgtgctagcaatatttttactcacctaactggctggttgtttggacccacatctgtaaagcccattttctgcagtttttggtacctataacattcatagtgctgagtgtgggttttttcttttagattttccatattggtacaaagaagcatatctcggagcttaacgaagtcacagtgattttcattttccactagtaaaaaaataataatgaatcaacaacattcagtatcaatccctgacaatcagtaagtgttcatgaatgaatacatgaataaaaaacacatttaaaataacacacaactgaacaatttgattaatagctataattcttttaagcatgtaagtgtggttgtactatacataccaaccataggcagagattatttataggttagcaaatttgctttaaacttattacctgaagaataagcaggaaatagtgaaataatattttatgtgcatatatgccataggtttttattaacaattgtgtagtatgttataaactacctctgggtattttggagtgctaacagaatatgtaatataacatcactagtgtaaataattttatcagagtaaattctgctagcaaaaaggccttacaattgaaaatactttagttacatatttccatttatatatcatatttaggagacaccgttagtcaatattcaaaatcaatcaacaaattcacatagctgttttaatgatacatacagactgacagtgaagacacggaaagatatttcatgcaattagaaactaaaagagaaggcacggaaagctatactcctatcacagaagatagactttaagtcaaaaactgtaaaatgatataaagaaggtcatcatatcatgatgaagaggtcagttcattaaaaaaataacaattgtaaatatatatgcacccaatatcacaacttctaaatatataaggcaaatattagcagacctgagggggagatagactgtattacaataatagtaagggacttagataccctactttcagcaatggatagattatccagacagaatatcagtaagaaaatatcagatttaaactacactttagaccaaatagacctaatggacatatgtggaatatttcatccaacagcaaagtaatacccatttttctcaaacaaacacaagacattcttcaggatagatcatatgttaggccacaaaataagtcttaacatattttaaaagactgaaataaaaatgtgagtgcacatgtcttttgacagatcaatttcattccactagggtacatacccagtagtggtactgctggatcatacagtaatactatttttagtttttgaggaaccttcatattatttcccaaaatggctgtaccaacttaaattcccaccaatgatgtttaagaattcccttttttcttagaaatatatatacactgctggtgggaatataaattagttcagccattgtgaaaagtagtttgataatttctttttttctttttttgagacagagtttcgcttttgtcacccaggctggagtgcagcagtgcgacctcagctcactgcaacctccgcctcctgggttcaagtgattctccaacctcagcctctcaagtagctgggattacagaagtccaccaccaggcccagctaatttttgtatttttagtaaagatggagtttcaccatgttgaccaagatggtttcgaactcctgacctcaggtgatccactctcctcagcctcccaaagtgctgggattacaggcatgagccaccacgctcggcctgacaatttcttaaagaagttaaaacagaactaccatttgacccagtaatcccattaccaggtttatatccaaaggaatatatattgttctatcataaagacacaggcacgtgtatgttcattgcagcactattcacaataacaaagacatagaatcaatctaaatgcccatcaatggtagactggatagagaaaatgaacatatacactatggaatactacacagccataaaaaaagaacaagatcgtgtcctttgcagcaacatgaatggagctgaagccattatcctaagtgatgtaatgcaggaacagaaaaccaaataccacatactctcatttataagtaggagataaatattgagaacacatagacacaaaggggagaacaacagacactggggcctccttgagggtggagggtgggaggagagtgaggacagaaaagctactatgcttacttttttttttttttttttttttggttagtatatgtgctgctaaagtgagcaattttttttttttgagatggaatctcgctctgttgctgaggctggagtgcaatggcacgatctcggctcactgcaacctgcacttcctgggttcaagtgattctcctgcttcagcctcttaagtagctgggattacaggagcgcgccaccacacctggctaatttttgtattttttagtagagacggggttttgccatgttggtcaggctagtcttgaactcctgaactcaggtgatccacgtgcctcagcctgccaaagtgctgggattacagactcaagccactgctccagccagtactatgctaattatctctgtgatgaaataatcttttacaccaaacccccatgacatgcaatttatctatataacaaatttgcacatgtacccctgaacctaaaataaaaattaaaaaaaaaaaaaaaagaattctctcttctccatatgcttgccagcacttgtaatggcttgtctttttttttttttttttgagacagagtctcactctgttgcccaggctggagtgcagtggcgcaatctcggctcactgcaagctctgcctcctgggttcacgccattctcctgccccagcctcccaagtagctgggactacaggcgcccgtcactacgccaggctgattttgtgtatttttagtagagacagggtttcaccgcgttagccaggatggtctccatctcctgacctcgtgatccacctgcctcagcctcccaaagtgctgggattacaggtgtgagccactgcgcccggcctgtctttttgataatagtcattctaaaagacatgaagtgatacttcatcatgtgtttaattcgcattttcctgatgttttagagatgctatttttttcatatttcttttgccatttgtatttcttcttttgagaaatgcctgttcagatcctttgcccatttttccttgtgttatttgttttcttgctattgagttgttagagtaatatcaaaaatattatatattttggacatttgccccttatcagatgtataagttgcaaatattttttccaatctctaggttgtatctttatgctattaaattgtttcttttggttttgttgctggtgtttttgaagttctttttttttttttttttgaggcagagtcttgctctgtcacccaggctggagttcaatggcacgatcttggctcactgcaacctctgcctcccgggtttaagcaattctcctgcctcagcctccctcccgagtagctgggattactggcacccaccaacatgcccagctaatttttgtatttttagtagagacagggtttcaccatgttggtcaggctggtctgaaactcctgacctcaggtgatcacccgcctcagcctcccaaagtgctgggattacaggtgtgagtcactgcaccctgccagcttttgttataaatccgctctcctgtggcaggagtgcacagaccagggatcatgaagaccctcgagtcaaacctgggtgtcaggcctggagttggcttcactatggacacatccaataagcccaaaactagggtaacagtgatagcacagcttgacctttcccttctgccttttccttgtacagactgagttctgttcttggatgcaggacatcttttgactgttgcaatttgaagattcttatgtttattttcttcttcttcctcttccactatcatttcatctacttgtatcacctttcgtgtttcagcagatgtcaggggtgtttgaatagctcccgcggtgatatccaggtcagctgttgctgcctcttccaagccctgtttgtttcctccaagggagaagtagttgagccattcatgccattcatctttgcgcagtgccttggggagccgcaggatctggatgttgtagagtttatccacctccttgaagaggttctgcctgtcagactcaattggcttgattcgtatttccactttgcagtcgaagtctttaagaaaggaggcgagcttccacctccctaaggagttggtcttggccacccaactactgccctttctaggagccatggtgttgggtggaggctgcagggagcgatggagatggggaaggaaggcaaactcttctccaattttaaatcaagttttacagttctttttttttttttttttttttttgagatggagtcttgctctgttgcccaggctggagtgtagtggtgtgatctcagctcactgcaacctccgcctcccaggttcaagtgattctcctgcctcagccccccaggtagctgagactataggcatgcaccaccacgcctggtttttctgttttttagtagagaaggggtttcaccatgttggccaggctggtcttgaactcctgacttcaggtgatctgcccacctcagcctcctaaagcactgggattacaggtgtgagccaccgcacccagcatttttttttttttgagacagagtctcgctctgtcactcaggctggagtgcagtggtgcaatctcggctcactgccacctccgcctcccaggttcaagtgattctcctgcctcagcctcctgagaagctgggattacaggcgcccgccaccacacatggctaagtttttgcatttttagtagaaatggggttttgccatgtgggccacgctggtctcaagctcctggcctcaagtgatccacccgcctcagcctcccaaagtgctgggattacaggcatgagccaccgtgtctggccaagttttacagttcttagtgtgcaggtattttacttccttgtttagatttattcctaagcattttatttttcagcattattcacaatagctaagatatggaagcaatctaatctaaatgcccatcaacaagatacacaataaaatactatagagcttttaaaaagaatgaaatcctgtcatgtgtaaaacctgaatgaaactgtaggacattatgctaagagaaataaaccaggcacagaaggacaaatactgcataatctcacttatatgtggtaactaaaaatgtcaatctcacagaaatagagagtagacaggtggtgactggaggaaagtggggagactgagggatgaggaaatggaaaatattgatcaaacggtacgaagttttagttagactggaggaataagcttcagtgatctacggcactgtatggtgactacagttaataataagctactgtatatttcaaaattgctaaaatggggagtggggtggagcaaggtagctgaatagaacctctcatcagtcatccccctacataaacaccaaattgaacaaatatccatgcaagaaaacaccttcataaggatgaaaaatcaggtgagcaatcatagtacctgattttaatattatatcaagaaaagaggcactgacgattatagtaaagagagtcttgcatagcctatgccatctgacattcatcccccagcagcaccatactaaacagagagagaatctgtgtgttttggggagggagagtgaagtgattgtgggactttgcattggaactcagtgactgccctgccacagtgctacacaacatagggcagaattctgctagtgcccacgacaggagccttttttttttttttagatggagtctcgctctttcacgcaggctggagtgcagtggcgcaatctcggcttactgcaacctccacttcgcaggttcaagtgattctccggcctcagcctcccaagtagctgggactacagctgcacaccactatgcccagctaatttttgtatttttagtagagacagggtttcaccatattggtcaggctggtcttgaactcctgacctcaggtgatccacccgccttggcctcctaaagtgctgggactataggtgtaagccaccactcctggccaaagggagcatttaacctagctcccactaaagaggaataccccatgccagagatagataggaacttaagttccagctacctccaccactagttaattaaagtgccctggggtcctgaataaatctgaaaggcaatcaggccccaaggtctgcagtccttgggcaagtccagttactgagcttgctcagagccagtggaataggaatgcgtgtgacccagcaagacaccagttttggtggccaaggagtgcttgtatcacacctcccccaactccaggcagtgcagcccgaaaagagactccttccacttgtgggaaagaaaaggaagattagaagagaactttatcttacaacttgagtagcagctcagccacagtaaaacacacaagagagtccttccacttgtgggaaagaaaaggaagattagaagagaactttatcttacaacttgagtagcagctcagccacagtaaaacacaccactaagcccattcctgaagcccccaattccaggccctacttcctggacatttctagacctactctgggacagaagggaacttgctgcactgaagagatggacccagcccagcaggactcaccacctgctgactaaagagcccttgggccttaaacatcagtagtagcaaggcagtagttgccatgggccttgggcaggacccagtaatttgctggtttcatatgtgacccagcacagtaccagctgtgatggccacaggagtgatgatgtcacccttccctcaactccaagcaacctagcacagacagagagactccttctgtttgggagaaagtgagaaaagagtttgagagattctgcctcataatccagggaattctcccagatattatccaagaccactgaggcagtacgagtctgctggcgtcacagtgttactgggcttggggtaccacctaatacattccctttgaatacttagaaaaccttctcaaatagaataggcacaattgagcccagactgcaaagattacaataaatatctaactcttcaatgcccagacatagatgaacattgacaagcatcaagaccatcccagaaaacatgacctcaccaaatgaaccaaatgaggcactaatgacaaatcccaatcacatatctcaggacagatatatgtaacctttcagagatctcaaaatagctgttttaaaagagctcagtgaaattcaagataacacagagaagaaattcagaattctattagcattattatatgccaacagtgaacaatctgaaaaagaaataaaaactaatccaatttatgacagctataaaataaaatacctagaaataaacataaccaaagaaatgaaaaatctctacaatgaaaactataaaatactgatgaaagaaattgaaaagaatgcaaaacaatggaaacacagttcatgttcatggattggaagaatcaataatattgttaaaatgttcatactgctcaaagcaatctaaagattcaatgcgatccctatcaaaataccaatgacattcttcatagaaaaagaaaaagcaattctaagatgtatatggaaccacaaaaatacttaaagcaattctgggcaaaaataacactggaggaatcgcattacctgacttcgaattatactacaaagctatagtaagtgaaacagcatggtaccggcataaaaacagacacaaagaccaatggaacagaatagcgaacccagaaataaatccacacagccacagagaactcattttcaacaaaggtgccaagcacatacattggggaaaggataagcgcttcaataaatggtgttgtgaaaactggatatccatttgcagaagaaagaaactagacttttatctctcaacacatataaaaatcaaatcaaaatggattaaagacttaaatctaagacctcaaattatgaaacgactacaaaaaacattggggaagctctttaggacatttagtgagtaataccccacaagcacaggcaaccaaagcaaaaatagacaaatgggatcacctcaagttaaaaagcttctgcaaaacaaacgaaacaacaaagtgaagaaacaatacacacaatgagaaaatatttgcaaactatttatctgacaaaagattaatagccagaatatatttaagaagctcaaacaactcaataggaaaaaaatctaataatttaatttaaagtgggcaaaagatccgaatagacatttctccaaagaagacatacaaatgtcttcttttgtcttattgataataactgttttaacatgtgtgaagtaactgctcattgtgggtttttttaaatgccaaacaagcaaatgaaaaggtgctcaatatcactgattaccagagaaaggcaaataaaaactacaatgagatataatctcaccccagttaaaaaagcttttatccaaaagacaggcaataacaaatgctggtgaggatgtggagaaaaaggaatccttgtacactgttgataggaatgtcaatcagtacagtatctatggaaaacagtatggagtttcctcaaaaaactaaaaatagaactaccatatgatccagcaatcccactagtaggtgtatacccagaagaaaggaaagtagtatatcaaagagatagctccactcccatgtttgttacagcactattcacaatagtcaagatttggaagcaacctaagtatccatcatcagaggaatgaataaagtaaatgtggtacatatacatgatggagtactattcagccataaaaaataatgagatcctgtcatttgcaacaacatggatggaactgaggacattctgttaagtgaaataagcaagacacaggaagacaaacttcacatattctcactcatttgtggagctaaaaattaaaacaattgaacccatggggataaagagtggaatgttgattaccagaagctaggaaaggattggggagggagagaagtggggatagttgatgggtacgaatatatagttacatagaatgaataagatctagtatttgatagcacaaaagggtgactacagtcaacaataatttattgtacattttagaataactaaaagagtatagttggattgtttgtgacacaaagaaaggataaatgcttgagttgatgggtactctatcctgatgtgattactacacactgaatgccagtatcaaatatctcatgtgccctataaatatacacacctactaggtatccacaaaaattaaaaattaaaaaacacaggcccagtgtggtggctcatgcctgtaatcctagcattttgggaggctgaggcaggcagatcacctgaggtcaggagtttgagactatcctgaccaacaagccaaaaccctgtctctactaaaaatacaaaaaaaaaaaaaaattacccaggcttggtggcgcatgcctgtaatcccagctactgaggaaggagaattgcttgaacccaggaggcaaaggttgcagtgagccaagatcacaccattgcactccagcctgggcaacaagagctaaactccatctcaaaaaaaaaattaaaaacacaacaagctgtaacttcacccatgctaaaatggctattatcaataagacaaacaagtgctggtaaggatgtggaaaaaagggaacccttgtacactgttggtggcaatgtaaattaggataaccattatgaaaaacggtatggagtttcttcaaaaaattaaaaataaaacaactaccatatgatccagccatctcactactggatacattacctcccaaaaatgaagtcagtatgtcagagagatacttacactaccattattcacaagaaccaagatatggaagcaatctaagtgtccatgaatagatgcatgaagaaaaaaagtgtggcatatatacgcaatggaattcagccttaaaaatcaggaaattctatcatttgcagcaacatggatggaactggatgactttacactaagtgaatacgccaaacacagaaagacaaatggtaaatgatctcactaatagatcaaatttttaaaagttaaacttgtagaaacagagagtagaatggtggttacgtgagttaggtagagggtatgtaggagagatgttggtcaaaggatacaaaattttagttaggtaagaacaagttaaagagatctattgtacaacatagtgaccatgttaataacaatattttatatatatatatatattttttttttttgaaaaggagtctcgctctgttgcccagctggagtgcagtggcgtgatctcagctcactgcaagctccacctcccgggttcacatcattctcctgcctcagcctcccaagtagctgggactacaggtgcccgccaccatgcctggctaatttttttgtatttttagtagagattgggtttcactgtgttagccaggctggtctcaatctcctgacctcatgatccgcccgcttcagcctcccaaagtgctgggattacaggcgtgagccactgcgcccggccaatattttatattcttgaaaattgctaagatagatgttaagttttcatcacaaaaataattgagataacacatatgttaattatatcaatttagccatcccacaatgtatatgtatttcaaaacatcatgttgtacataagtacataaaattttatttgtcaattaagattaattaatgaaaaataatttgtatggctctctcctgtgtttgtcatgtccagaagattgaccacaatatatggtttattgtgattaatactgtgaccaaattttatgtatcaacatatagtatagatatatattttataacatatactaacatgtaatacaacataataaatattaaaacattaagttttaagtatgcttaacaaattttaaattttctaatatgtcaattttttaacaacatcatttgaggctggacacggtggctcatgcctgtaatcccagcactttgggaggccgaggcaggtggatcaccggaggtcaggagttcaagatcagcctcactaatatggtgaaaccccatctctactaaaaatacaaaaattagcccggtgtggcggcaagcgcatgtaatcccagctactcggaaggcttaggcaggagaatagctggaacctgggagacagaggttgcagtgagccaagatcatgccactgcactccagcctgggcaacacgagtgaaactctgtctcaaaaaaaaaaaaaaaaaaaaaatcatttggaaaccagtacaagtagaaatcttccattccccaataattatatgaaccacaagtatatgaaccagacaataaattactgcttactacactattctaactcattatgatgctaaataataatataaatgtcaaaggtataatctctagccaaaggtaaattgtactttcttgttttaaaaagtttataactcttttttctagtgaccagtttaaaatggtttctacattaggtagtaatgagtttatgtaacatgtctacacactagtatttttgcttccattttgttgaaagtgctttccagcactctcagtgtcatgatttatacagagagataatatgtacatggcacattgggagcgttgggatagacaaagaggttcttcccagcctctgtagattttggcttaaagcagcgttcagcaaacttctatgagaatgaatcatagtcaaagtaagcattagtttaaataaaacagagtttgtgttccccattagtaactgttaacttacagattagcaagagttaccaatattagttcaagttaaaatgttattttgagactatgagtgatacacatatatttaacttaatcattccaaagcctgccctctgtcatttttaccttgcaaaactccccaagggtagtgacggcctctgaccatcctttttccaactttcacttcatctgtactccctaccacagcaaagggtaacagcccctagaaaacaagaatgacatgaattgaattctctagcaccattagagcttactctattactctcattcctgttataaaaatgacaggccagcgcggtggctcatgcctgtaatcccagcactttgggaggccgaggtgggcggatcatgaggtcaggagatcgagaccatcctggctatcatggcggaaccccatctctactaaatatacaaaaaattagccgggcatggtggcgggcgcctgtagtcccagctactcgggaggctgaggcaggagaatggcgtgaacccggaaggtggagcttgcagtgagccgagatcataccactgcaccccagcctgggcaacagagcaagactccgccacacacacacaaaaatgacagagatgatgatattgtaataaatttaattagacagggatctaccctgcatctcattttaagacttgacagtatgcactaattggtttctgtcagcataagtctcaggctgtgcacacaattggaaactgtctactgagccagagcctaaagcaaggtatcctgctgtgggaaacacatagaaaaaagattttcagtaggcatcatttttctcacactatgtttaccctgaaccatctttaacctgaatgttgaagaaataacatgcaaataacttttaactctggtataaaagttaaaagacaaaaatattaaaaacaactacaactattataataattaatggatacacaatataaaatactttaataagcaatactgtatatgtctcaataaattatgtttgtttttttgagacagagcctggctctgtcacccaggctgtagtgcagtggcatgattttggctcactgcaacctccaccttccaggttcaagcaattctcctgcctcagcctcccgagtagctgggattacaggtgcctgccaccatgcctggctaatttttgtattgtttagtagagacggagtttcaccatgttggccacgctggtcttgaactcctgacctcaggtgttctgtccacctcagcctcccaaagtgctgagattacgggcgtgagccaccacgcccatcccaaataattttttacattttacattacttagcatttcaattcagaaatctattagtgtttgaggtatcttaaaataaaggaggtgtaaattataagaaaagagaaatggaagacatggaattaacagttatcagttacagttacctgttacattctagactctgtgtttcagatccttcacaaagattttggcacttacacctcagaaaaaaagccttaatagaagtgtcattgatcccatagcatagataacagtctcagggaagatgagtgaattgtgcaggatcttttggcttttaagtagagaagctaggatggaaatctaaatctgtatactttcaaaatgtatcatctttcggctgggcatggtggctcatgcctataatcctagcactttgggaggccgaggtgggcggatcacctgaggtcaggagttcgagaccagccttgccaacatggtaaaaccccgtctctactaaaaatacagaaattagcggggcatggtggcaggcacatgtaatcccagctacttgggaggctgaggcaggagaattgcttgaatccaggaggtggaggttgcagtgagctgagatcgcgccattacatctcggtctgagaaacaagagtgagactctgtctcaaaagaaaaaaagaaaagaaaattatcatctttcaaatttaagctaatattttaggtatttactagcctaaaatatttacacagataaagagtttcatcatctttattactgccctgattccagaaccagagacaacacagcattcgcatccaacccccatctacctgtttttgaggctaagtccttggcaagtctatttgagagttggaggctcccttttaccactcaagacctacttgtgaaataggggccctgccttggatgcagcaaacagagaagatgggggccctgaccatccttgcctggttcatgaggcagtggctcattgtgtggggaagtaatccaaagaacctcagactggtgctcctcctcactgagctctcagttaccagtgggtgcctgaagcttcagggcagggtgggtaacctgccattgtttccacccacaattccagaaccctgcctcagagattttaccttggaggagaaacaggccatgaaatggagaaaacccattcaaaaaattatatgtaatcccaagggacctgaatagccaaaaaaatattgaaaagaaagaccaaagttagaggtctcacacttctagaattcaaaacatattacaaagctacagtaatcaaaatagtttggaagtagcataaagacagacatgtagaccaatggaatcaaatacagagtccagggttaatccctccttacctattcttctgttgatggatatttgggttgcttccatctctcagctactgtggataataatgcaatttatatggctttacaaatatctaagtaagaccctgctttcaattctttcagagaaagaggattgttagatcatatggtaattttattttcaactttggagaaaccacctatattagtctgttttaacgctactgataaaagatatacccaagactgggaagaaaaagaggcttaattggacttacagttccacatggcaggggaggccttagaagcatggtgggaagtgaaaggcacttcctacatggcagcggcaagagaaaattaggaagaagcaaaagcagaaacccctgataaacctgtcagatctcgtgagacttattcactatcacaagaatagcacaggaaagaccagcccccataattcaattaccttcccctgggtccctcccgaaacatgtgggaattctgggagatatgattcaagttgagatttgggtggagacacagccaaaccatataaccaccatactgtttttcatagtggttctagatgagaaaaagataaaactctattgaaaaaatcagggactatctaaataaatggagagacattccatgtacatggatagaaagactcaatattgtcaagatgtcaatgttccataacttaacctatgtattcaccacaaccccaatcaaaatttcaccaaattattttgtgaataataacaaattaactccaaaatttatatgaaaaggcaaaagaactagaatagccaatgcaatattgaagaagaacaaaattggaagacatactattcaacctcaggattcactgcaaagccatagtaatcaaaacagcgtggcatgggcaaaataatagacaaacagatcaatagagcagagcagagagcccagaaatatgcctacacaaataaagttaactaatatttgacaaagaagcaatgggaatttaatggagacaagatattcttttcaataaacagtgctggaactgaatactcacatgtaaaaataagaatctacaaacagaccttacatatttcacaaaattaactcaaattggatcataggcctaaatgtaaagcataaaacaataaaattcctagaagataatgtagagtcctaattagagaaagggagtcaggctggtgggagcaggggaaagcaaaaaaaaaaaaaaaaaaaatcagataagctacaagtctgcctttcttcaccatccagaacacacggccctcctgcacaaataactcacaatcttcctgtgcctagctatcagcagaccctcggctgatacaaaaaattgcaagttagctcactgccactgatagtggcaggaggcggacaaatgcctaggcagataggggcaagtccccagggaaaccccacttccaacccaaggatagtttaaagcctgaaagccaagttacaagtcaaatccatggactggattgagaacctgtcttcctgcttggtgcactttcctctggctgatctccacccttcacctgttttacatatacctacacttcctaattgtttttttcacattgttgtgcccacctttgggtggtgcctttgttttaacctttttgcatactcacaaaccaatcagcatgcactcgcctattctgagcccataaaagccctgggcttagccacacaaggagagaaacagcccccaggtcccctctccactgagagctgttccatcactcaataaaattcttctgtcttcctcatccttcaattgtcagggtatcctcattcttcttggttgtgggacaagagctcatgaactgctgatctcagatagaagctttaacacaggcaggctggggcatgctggcccagccacaggctgagccactgtgcaagccagaatgggccaaatggatggggctacctgtgtggcaggtagcgcgcccaagcaaggcccaggtgggggtgtcactggctggaggtccctggctggcaaaatgattgagaggaatcctgcatcacaaccttggcattatcagcactacacaaagccctcttcagcatacagcctaagaactagcctataaaatctgcagcaatcctttgtttgtttgcagtcagcttctttcttgcaagctgcctgttgcctccctagcaatgtattttcctactttctgtaataaatctaccttccttacctacagcaaggtaaattcttttttttttttttttgagagagagagtgtctcactctgtcacccaggctggagtgcagtggtgcaatcctggctcactgcaacctctgcctcaacaaggtaaattcttttatgcctgcaccaccaggccagatagtcatcactcccttgcaacagataacataaaaggaaatgcaggtgactttgaatttagcaatgacttcatcgatataacactgaaaacatcattgatgaatggaaagaatcaatgagttgaacttcattaaaactaaaacttctgctagcaaaagacactgttaaagataacaagataagccaccgactgagagaaaatctttgcaaaacacacacttgataaaggactgatgtccaaaatatacaaagaactcttaaaacccaacaaaaaaatgaacaactcaattaaaaatgggcacaagatccaaatagccacctcaacaaaaaagatattcagataacaaattagcatgtaaaaaagatgatcaacatcatacatcctcagggaattgcaaattaaaagaaaaatacatggtactacacatttattaaatttccacccactgaatctaaaataaaactcagtaattttttttaggccaagcacagtggctcacatctgtaatcccagcactttggaaggctgaggtaggcggatcacctgaggtcaggagttcaagactagcctggccaacatggtgaaaccccatctctactaaaaatacaaaaaaaaaaaatagccaggcgtggtggtgcatgcctgtaatcccagatacttgggaggctgaggcaggagaatcgcttgaacccaggaggtggaggttgcagtgagccaagatcacgccactgcactccagcctgggtgacaagaatgagactccatctcaaaaaaacaaacaaacaatttttttttttaatttccaaaatcccaaacactgacaacaccaaatcctggcaaagatacagagcagcaggaactatcactcattgccagtgggaatgcaaaatggcagtaaccacatcgtaagactggtagtttctttcgaaactaaacgtacttttaccatatgatcaagaagtgcactcatcagtatttatccaaataagttgaaaacttgcgtccatacaaaagcctgcacacaaatgtttatagcaactttactcataattgctaaaacttgaaagcatccaagatgtcctttaatcagtgagtggataaacaaactgtggcatacctaaacatgaaatattatttaataatgagaaatcagctatcaagccacaaaaaaagacacagagaaaccttaaatacatatttctaagtggatgaagccaatccaaaagttctacatgaactataattccaactatgtgatattcccaaaataaaaaattacggagagtaaaaagatcaatagttgccaagggtaaagggaaaagagggagacaaatgaataggtcaagtacaggtgatatttagggcagtgaaactatggtgaatgttactgcagtatgggatagaggtcattagacatttgttgaaacccatacaatgttcaacacaaacaatgaagactgttgtcagatacgaactttagtttataacttaccaatattgcctcatcaagtgtaacaaatgcaccacacttaatgcaggatgttaataatagaagaaaatcaagggagggcattaagatctctgttctttccactcaatttttctacaaccataaaactactaaaaaaacataaaagtattttacatttaaaaagaaggatggggccgggcgtggtgactcacacctgtaatcccagcactttgggaggccgaggcggttggatcatttgaggtcaggagtttgagaccagcttggccaccgtagtgagacccccacctctactaaaaatacaaaaattggccgggcatggtggctcactcctgtaatcccagcactttgggaggccgaggcgggtggatcacgaggtcaggagatcgagaccatcctggctaacacagtgaaaccccatctctaatcaaaatacaaaaaattagctgggcgtggtggcaggcgcctgtagtcccagctactcaggaggctgaggcaggagaatggcgtgaacccgggaggcggagcttgcagtgagccgagatcgagccactgcactccagcctggcgacagagtgagactccgtctcaaaaaaaaaaaaaagtcacaattatttatcatatttattacctcaaataattattattttctttgctttttggggggtgagaacatgtagatctactcttttaccaaatttcaagtatacaatgttgtatattgttaactatattcacactgccatacattagattttcagaacttactgattttgcaaactgaatctttgcataccctgacctatatcacaaagagaattttgaaagcagcaagagaaaaacatcttgtcccatataagggaggctgcgtaagactatcaatggatttctcaaaagaatcttgcagatcaagaaacagtgggatgattcaatgtactggaagaaagagaaagaccaaaaggaatactttaccccagaaaagctgtcctttaagaataaaggatgggctgggccaggtggctcacgcctgtaatcccagcactttgggaggctgaggcaggcagatcacctgaggtcaggagttcaagaccagcctggccaacatggcaaaaccctgtctctactaaaaatacaaaaattagccaatgtgatatagggtgcctgtaatcccagctactcaggaggctgaggcaggagaattgcttgaacccaggaggtagaggttgcagtgagccgaggccatgccattgtactccagcctgggcaacaagagtaaaacactgtcccagaaaaaaaaaaaaaaaagaataaagaacaatgctgccatctgatcttttcagctgtggcctggcacccttctgagagcccggctcccagatacttgcagtctgccctggcactgctgtcactttagcattctgcagttgcctgagcattcttcctgcccctgcctaagttttctgccagctgtgtgggggccagcctgcccctctctatcacagccagcacctgaaccctgggtacctgaggacacatatgccagcctgcttctgatccagtccctccagtacttatgcatgccatccagagcaccatatagggatctgagaatcaagaaaatggctagcccagtacaccattggcacatgatcgctctctctggagactaaggctgtgctgacccagctagccaacactgcaacagctgaaatccaccctcatgtgctgaaaggtgaagctgcttcccctttgtacacaaaggagcagcgttcctgcatgagagaacaggcaagccacagggctgtctgtattggcctgagggaagaggtcctaccctgaggttgctcctgtgaagagccacaagacaggcattttcaatggctcttggctacgttatgacctagagatagatgactgggtctgtatgaactgagagtcatgaactctgggacaggggtaggatagggaaacacatcatgttcctacctacacaggaggtagagctggtacagctcctccctccctacagagacctgtgagcatttcaccaggagctgcaccagccaccctctaaaggctactgttcacgttcatcattgagatgttggtgggtaagctttgtggtccagctctgcccagctgtgtcttcccctctgggctgaacaggcaactcagagtctaggcattacatagaccagcctatcacctgaaacaacagacaggaaatcacagtaaacaaagatcaaacacacaccatctgcttctgccatagctggctcttactcataagtgccacttactggcatggaggttaaactacacaaatcaataaaaagtctactgacagaagggcacagggctaaagaaacaaagccaaagccccctacccaatatatgctgtagttacacccacaaggaggaaaaaccccatctaaattaaagtaaattcaaaaataagaagtgacaactttcccagatgagaagaaaccatcataagaagtttggcatcatgaagaaaaaaaaaaaagcagaatgttttgacactaccaaaggacacactagctctctcgcaatggatcctaaccaaaatgaaaattctgaaatgaaagataatgaattcaaaatatggattataaggaagttcaatgagatccaagacaaagctgaaaatcaacacaaagataccagaacaatgcagaatgtgaatgaagtacagatatcttaaaaaaaaaacaattgaatttctagaaatgaaaaacacactgaagggttgggttacagatgaaagctttttttttttttttttctttttgagacagagtcttgctctgtcgcccaggctgcagtgcagtggcgccatctcagctcactgcaagctccacctcccgggttcacaccattctcctgcctcagcctcctgagtagctgggactacaggcacccactaccacgcccggctaattttttgtatttttagtagaggtggggtttcaccgtgttagccaggatggtctcgatctcctgacctcgtgatccgcccatctcggcctcccaaagtgctgggattacaggcgtgagccactgcacccggccagatgaaagctttaacaataggctagactaagcagaagacagacagaaaataggatcccagtgccttttggcttgtaaactttcttctgagaagtcggctgttagtctaatgtgatttcctttataggtgatttgaaaattgtctcttgcttctttcagagtattttccttcaagttgcctttggatagtctggtgaagttcatcttgcaaaatattttcaggtattttccgagcttctcgtatctggatgtgtacctctctagcaaggccaagacaatttttctgattattccctcaaatatgtttccaatctttttaccttttcctcttctctctcagaaatgcctacaactcataagtttggttgctttacataatttccgatttattgaactcttgattatttatttaaatttacttttttttttgtctgtgttagttcaaaaaacctgttttgttttttgaaaagataagaaaattgatatggtgctaggccgggcacggtggctcacgcctataatcctagcactttgggaggccaagacaggtggattgcctgagctcaggagttccagatcagcctgggcaagatggtgaaaccccgtatctactaaaatacaaaaaatcagctgtgcatggtggcaggtgcttgtaatctcagctactcaggaggctgaggcatgagaattgcttgaacctgggaggcagaggttgcagtgagccaagatcgtgccactgaaccccagcctggacaacaaagcaaaactctgtctcaaaaaaaaaaaagaaagaaagaaaagaaagaaaattgatatggtgctagctagattaaccaagaaaaaagacagaagattcaagtaagcacaagcacaatcagaagtgataaaagtgacattacaactgataccacagaaaacaaaagatcatcagagactaatatgaatatctctatgcatacaaactagaaaacctagataaaatggttaaattcatccctccctgctcggatgtggctggagctggaggtgcagagggccagagatgctgcagaccttccacccagagcagcttggaggcagtgaataacagctcttcaagtctgcaacaaaaaatggcctcttccagagaattgtttgaacctgggaggcagaggttgcagtgagccgagatagcgccactgtgctccagcctgggtgacagaacgagactccatctcaaaaaaaaaaaaaaaaaaaaaaaagcctcttcatagcttaaattacaaaagtaaactaaaagacttacatgcttttggccaggcgcggtggctcacgcctgtaatcccagcactttgggaggccgaggcgggcggatcacgaggtcaggagatcgagactatcctggctaacacggtgaaaccccgtctctactgaaaatacaaaaaattagccgggcgtggtggcgggcgcctatagtcccagctactcaggaggctgaggcaggagaatggcgtgaacccgggaggcggagcttgcagtgagcagagatcgcaccgctgcactccagcctgggcgacagagcgagactctgtctcaaaaaaaaaaaaaggacttgcatgtttttttctttactccaactcattccttacatgtaggctcaatcttttcagtatttgctttactggttcagcaaaagccaggaaatacaactttgtggtaatcagaatgttatccaactgtatatatatatatatatatatatatatatttttttttttttttgagacggagtctcgctctgtctaccaggctggagtgcagtggcgcgatctccgctcactgcaagctccgcctctcgggttcacgccattctgcctcagcctcccgagttgctgggactggaggcgcctgccaccacacctggctaattttttgtatttttagtacagaaggggtttcatggtgttggccaggatagtctcgatttcctgacctcatgatccgcccgccttggcctcccaaagtgctgagattacaggggtgagccaccacgccaggccccaactgtatattgtttaccttattgtaaatattggtgaacagtggtcaataatagttttatattcctttaaaaaaaaagaaaatgggtaaatacctggaaacatacaacctcctaagactaaaccaggaaaaaatagatatcctaaatagaccaataacaagtaatgaaattgactcactaataaaataatttcaaacaaataaaaacaagaacagataggtttacagccaaattttgccacaagtataatgaagagctggtaccagtcttactgaaactattccaaaaatttatggaatttttggattggaagaatcaacatcattacaaagaccacactaactaaagcaatgtacaaattaaatgcaattcctatcaaattaccaatatcattttttcacagaattagaaaaaacgatcctaaatatcatatggaaccaaaaaagcattcaaatagccaaagtactcctaagcaaaaagaactaagtcagaggcatcatgtgtctgacttcaaattatactataatgctatactaaaaaaaacagtatggcattggtacaaaaacagacagattaatggaatggaataaagagtccattgctaggaaggatacagcttaaaaagggagaaaaaaattgtgaaagaaaagagaataaagaaccagtaataaaatcacatgcctacaaccaagtgatgtttgacaaagttggcaaaaataaacagtggggaaagagcattctattcaataaatggtgctgggaaaattggctacccataggcaaaagaatgaaactgaattcccatttctcatcatatacaaactttaactcaagacgtattaatgacttaaatgaaagaccagaagctataaaaatcctagaagaaaatttaggaaaaactcttctagatattggcctaggaaaataattcataacttagacctgaaaaggaaatgcaacaaaaccaaatatacacaaatgagacttaaactaaagagcacagcaaaagaaataatcaacagagtaaacagacaacctacacaataagaacaaaatatttgcaaactttgcatctgacaaagaactaatatccagaatctaaaaagaacacaaacaactcaacaacaacaaagaataaacaacctcattaaaaaagactgcaaaggatatgaacagacatttctcaaaagaagacatacaagtggccaccaaacacatgaaaaattgctcaacatcaccaatcatcagagaaatgcaaattaaaaccacaataaaggcagggcgcagtggctcacacctgtaatcccagcactttgggaggccaaggcgggtggatcacctgaggtcaggagttcaagaccagcctgaccaatatggttaaaccccatctctaccaaaaatacaaaaattagctgggcatggtggcaggcacctgtaatcccagctactcggaggctgaggcaggggaatctcttgaacccaggaggcagaggttgcagtgagatgagatcataccactgaactccagcctgagtgacagggcgagactctgtctcaaacacacacacacacacacacacacacacacacacacacacacaaaataagatataaacacaacagatgttggtgtgaatgcagagaataatgaatgcttattcactgttggtgggaccataacaacctctatgaaaaacagcatagagatttctcgaagcactaaaaatagagctaccatttggcccagtgattatactactaggcatctgaaagaaaagaaataattatataaaaaagtcactttcactcatgtgtattacattcctactcataatagtaaagtcatggaattaacctaaatgtccattaacagtggactggatttattttaatatggtatatatacaccatggaatactatgcagccataaaaatgaaatcatgctctgtgcagtaacatggatggagctgggggccattatcctaagtgaaataactcagaaacagaaaatcaaataccacatgttctcataagcaggagctaaacaatgagtacacaaggacataaaaatggaaacaatagatagtgagactccaaaagggagagactgggaggaggccgatggtcaaaatattatctattggtagtgagatgtgatcacgccactgcacaccagccagggcaacagagtgagatcatgtctcaaaaaaaaaatgatctgttgggtacaatatttactatttcaggatagttacactagaagccaaacctcaccattatgcaatatatctatttgacaaatatgcacttataccctctgaatctaaaataaaaaacaaaggaattctatagtagtaaacacctacatctttttttaaaaaaagatctcgcctgtgtggtggctcacgcctgtaatcccagcactttgtgaggccgaggcaggcagattgcccaaggtcaggagttcgagaaagcctggctaacatggtgaaaccccatcctactaaaaatacaaacaaattagccggatgtggtggcgcacgcctgtagtcccagctactcgggaggctgagggaggagaatcacttgaacctgggaggcagaggttgcagtgagctgagattgcgccactgcactccagcctgggcaacagagagagactccgtctcaaaaaaaaaagatctcaaataaacaacctaactttacacacacacaaacacacacacacaaatagcagaaggaaagaaataacaaagattagagcataaataaatgaaatagagaataaaaaaaattttaatcggccaggcacggtggctcacacctgtaatcccagcagatctcttgaggccaggagtttgagaccagcctggccaacatggtgaaaccctgtctgtactaaaaacacaaaaattagccaagtgtggtggcatgctcctgtaatcccagctacttgggaggctgaggcaggagaatcacttgaagccgggagatagatcttacagtgagccgagattgtgccactgcactccagcttgggcaacagagtgagactctgtctcaaaaaagaaaacaaaacaaaaaattaatcaatgaagctaagagttgatttggggaaaaaaactcaaaatcaaagcccttacttagactaagaacaaaaagagagaatatgttaataaaataagaaatgaaagagaagacattacaacttattacagaagtttatttcttacagaaataaacagaattataagggactactatgaacaattatacaccaaccaacttgacaacttagaagaaatggtgaaattactagaaacatataaactaccaagatggaatgaagaataaatagagagcttaaagagaccaataacaaatagagaaactaaagaagtaatttttcaaaactccaaaatatagcctaggaccagattacttcatgggtaaattctaccaaactttcaaagaaaatttaatataaaacatcctcaaattctttgaaaaaatagaaaaaagaggtaacaccttcagagtcattttatgaggcagcatccccttgatatcaaagcaagaaaacacactttcaagaagaaaattataggccaatatccttgaggaacatgctgtatgaattaaatctaaataaatctgtttacaaagaatcgattctcagcagaagctttacaaaattaaaaaaattaaaaattctcacactggattctggataaacactcatttctagcctctttgtcagatatgttactgaaacttacactaactgaggagttcgcttgagcagcagtttcttcatctgttgggagctgatatatctggatgccattgctaatcaattcactcattatcttattcttaaacgtctgtaaatcatttttagaaatagtgtctgctttggcaatcagtggtataatattcacctatgaagaaagaagacaaacaaaatctcatcattgttcatctcacagtttttttgttttttgttttttgttttgagacggagtctcgctttgtcgcccaggctggagtgcaggggcacgatctcggctcactgcaagctccgcctcctgggttcacgccactctcctgcctcagcctcccgagtagctgggaccacaggcacccgccaccacgcccggctaatttctttttgtgtttttagtaaagacggggtttcaccgtgttagccaggatggtctcaatctcctgacctcgtgatccgcctgccccggcctcccaaagtgctgggattacaggcgtgagccactgcgcccagccatcctatagtttttatagtaaagccttcacaatctctgacaacaaattgcataactaggtaatcactggctgtcatgcttttcttaaaaattattttccaaaattatcaatacttttgaagattgatcttttatccaaattcaggtttagaagtctcaaccttgtttctcttctaaaaatcccttatacctctacacatatggagttagtaaaatgtaaatagtaggacaatgtaaattattttatttatttatttatttatttatttatttttcagacagagtctggctctgttgcccaggctctggagtgcagtagcgcgatcttggctcactgcaagctccgcctcccaggttcatgccattctcctgcctcagcctcccgagtagctgggactacaggcgcccaccaccatgcccggctactttttggtatttttagtagagacggggtttcaccgtgttagccaggatattctcgatctcctgacctcgtgatccgctcgcctcagcctcccaaagtgctgggattacaggcctgagccaccgtgcctggtctatttaatttattttcaattttatttcttattaagctgagtgataaaagacaaattcaaagaactttcctcaaaattgtggaagggattttgtccttctactttttacatcactttttccatcaatcaatcttaattaatgtcccattttcactctcttgccccgcctagatgtgtttgcagatagatttgctattgtttttcaaagaccacctaaaaagaatatagatgtttttgattaccatattctttctttttttgaggcggaatcttgctctgtcgcccaggctggagtgcaatggcgcaatctaggctcagggcaacgtctgcctcccgggttcaagcaagtctcctgcttcagcctcctgagtagctgggattacaggtgcccgccaccatacccggttgatttttgcatttttagtagagacagggtttcaccatgttggccaggctagtctcgaactcctgacctcaggatacaaccacttcagcctcccaaagtgttgggattataggcatgagccaccacacctggcctggttaccatattctaaaggccgtgtgtgtatgtatgtgtgtgtgtgcgcgtgtgtgtgtataagaacaccttgcaaacaaatatgttcatttttcttttgtaaaaagacataatttccacattgaaagttaaatatttgcatatttgaggttgaatttttacccacaaagttttttcctagtgcttcaatatgagcactcctgccttttgcatttgcacttaaataactaaactttttaggaaataacaatatacaaaattatataatgttttattactgttaaaatatcttattaaattatagctccacaaaatcaatatctgtaatatagtagaaatacataaatataaattttaggcagactgcttttgttttagattgctcaaaacacgttttttaaaaaatccatggacagaccgggcgcagtggctcacgcctgtaatcccagcactttgggaggccaagactggcagatcacctggggccaggagttcaagaccagcctgaccaacatgaacaaaccccgtctctactaaaaatgcaaaattagccaggcgtgttggctcatgcctgtaatcccagctactcaggaggctgaggcaggagaatcgcttgaacccaggaggcagaggttgcagtgagccgagattgcgccattgcactccagcctgggcaacaagagcgaaactccgtctcaacaacaacaacaacaacaaaaagagtgtatattcctgactattgaaggtactactaattaagaacttgaagcagctcttaatttaactagaaatctaatttatttcaactacttaatgacatctgagattaagtacaaagtctcttttcagtttgaacaatatatagtaaaagttgagattcctcggataaaaggaacccaacttagaactttttctctcttcaactaaataaagatgtcttcaactaatttaagttgaagacagcatgttttgttagggctgagtgcagaaaagaatctgataatatgacaatttcctttatatgtatattgcttttctatatttaaaaaagaaaatatacttttaaccttttttttttttttgagagagagagagagagggtcttgatctgtggccctgtctgcagtgcggtggcatgatcacagctcactgcagcctcaacctcccgggctgaagcgatcctcccacctcagcctcctgagtagctggaactacaggcacgtgctgccatgcctggctatttttttgtattttttgtagagacagggtctcactatgttgttctagctggtctcaaacttccaggctcaggcaatcctccctcctcagcctcccaaagtgctgggattacaggcgtgagccaccatgtctggcccttctaaattttttatgaaaaatgattttagacttatggaagagttgcatgaatattacagagaaagaaattgaggcatcataattttcccaaagccacacagtgagcaagtaacagggtcaggtttgtgaaagcaggcagcttgaacccactacccatgcttttttatttatttttttttttggagacagagtttcactcttgttgcccaggctgaagtgcaatggcgtgatctcggctcaccgcaacctctgcctgcgggttcaagcaattatcctgcctcagcctcccgagtagctgggattacaggcatgtgccaccacgcccagctaattttgtattttttagtagagacagggtttcaccatgttggtcaggctgttctcaaactcctgacctcaggtgatctacctgtctcggcctcccagagtgccgggattacagggtgagccctggctcccagccctccccatgtttttaatcacagaaagcgctagacatttttcccaaggtcacagacacctagcaagtgataaagcaaatattcaaaagctgcttccactgacaagtcctgtgacctttacatattcaaaaattaaaattccttctgtatggataaatctgagcttcataaacattcaacggactgattttctgtacaataaaaccaaactacaaaaaactgctgaataattagaaaaattaatcaaatgaacagagtctcatatcgattttgagattttgctgaagccatggggcttaagcagcctattgaaaggaagtcctcgtgtgtcccaggtttttgctggaaagaattatgcttttcttagctgtttctatataacaagcagtagctgcctgcaggctcttgtatctgaatcctgtctgatatgatctgtaaccaggatcacaaaagctttctgtttcacaccatcagtggtactagtcaaacatcagtgggattatttcacagtatcatatagtaaattttattttaaaaatacaggcatcccccattttccacagtttctctttcttccttttctttccttcttttttacttccttccctccttctttcttttcttccttccctccctccctccctcccccctcccttcctccctcccttccttcctttctttctttctctctttctctctttcgctctcttttctttcaacggggacttgctctattgcccaggctggaattgcagtgacatgatcttggctcacagcagcctggaactcctgggctcaagcaatcccacaggtgcacaccaccatgcctggctaatttttctatttttttgtagagatggggtctcactacattgcccaggctggtcttgagctcctgagctcaagcgatgctcctgcgttagcctcccaaagtgctgagattacaggcttgagccacagagcccagcccagtttcactttccacaatttcccgtaatcaacagcagtccaaatatattaaatgaaaaattctagaaatacacaatgtagaagttttaaattgcatgcaattctaaatactgtgatgaaatgtcatgttgacccactccttctcaccctggatatgaattatctcactattcacctcattttatctcaacatgtaggcattgtattatctcacatcatcataagaagagtgagtacagtataataagatattttgaggccaggcgtggtggctcacacttgtaatcccagcactttgggaggctgaggcaggcggatcacctgaggttaggagtttgagaacagcctggccaacatggggaaaccccatctctactaaaagtacaaaaaattagccgggcgtggtagcgggcacctgtgatcccagctactcgggaggctgaggcaggagaatcacttgaacccgagaggcagaggttgcagtgagccgagattgtgccactgcactccagcctggacaacaagagcaaaactccgtctcagaaaaaaaaaaaaaaaaaagatattttgagagacgcaggtaactttcacataacttttagtacagtgtattgttataattgttctattttattattagttactattgttagcttcggtctgcatctaagaaactaacaataataactaataataaaagagaactgcatctcatttataaataaatctttatgataggtatgtatgcatagaaaaaaacagtatatatcaggctctgtaccatgcatgctttcaggcgtccactggggatcttgtaacttactcccaagggtgctactctataggcaaatggccatgatctgggaggtaagtcaaggttgaaatctatcaaatgtgagttgtctcccccagcaaccaaaaaatttgtatgttgaagcctcaaccccccagtacctcagaatgtgacctcaactgagataaagccttcaaagaggtgattaaaaagtgagactgggtcaggtgcgatggctcacgcctgtaatcccagcactttgggaggccgaggtgggcagatcacctgagattaggagttcgagaccagcctggccaacatggtgaaaccttgtctctactaaaaatacaaaaattagctgggtgtagtggtgcatgcctgtaatcccagctacccaggaggctgaggcaggagaatcccttgaacctgggagacggaggttgcagtgagccaagatcacaccacggcactccagcctgggcattaaaaaaaaaaaaaaagtgagactgttacagtggggcccaacctaaactgactggcacccttataagaagataaaatgtgaggccgggcacagtgactcacgcctgtaatcccaacactttgggaggccgaggtgggtggatcacctgaggtcaagagttcaagaccagcctggccaacatggtgaaactcatctctactaaaaatacaaaaaattagccgggtgtggtggtgggcgcctgtaatcccagctactcaggaggctaagataggagaactgcttgaacccaggaggcagaggctacagtgagctgagattgcaccactgtactccagcctgggcaacaaaagcgaaactccgtctcgaaaaaaaaagacaaaatgtggacaccccggagacactaggaaaaacaccatgtgagaacacagagataaggtggtcatctgccagacaaggacagagatttcagaagaaagcacatcttctgacaccttgatcttggacttctgtcctccaagactgtaggaaaatacattttcattgtttaaaccacccagtctatggcattttgatatcccagccctaacacactgatgcaaatgcctcaaatattaacagaaaaagataattaggatatatacatatattacaaaatgacaggtacagtcgtgcaccacataatggcatttcagtaaatgatgggccacacatatgatgttgttcccataatattataatactgtacctttgctttttgttgttgttattatttatttattatttatttatttatttactgactcttgctctgtcgcccaggctggagtgcagtggcgcaatctcggctcactgcaacctccgcctccctggttcaagcgattctcctgcctcagtctcatgagcagctgggattacaggcgcctgctacaacgcccagctaatttgctaattttctgtatttttagtagagacagggtttcatgatattggccaggctggtcttgaactcctgatctcaggtgatctgcccacctcagcctcccaaagtgacgggattacaggcgtgagcctccgcacctggctatttagagatctatttattgaatttctggattcaggggatatatgtgcaggtttgttacttacatatattgaatattagtgaggttttggtctctcgtgtgcccatcacccaaatagtgagcattgtacccaataggtaatttttcaaatctcaacctcctcccacccttcccctttataaagggcccagcgtctattatttgtctaatactgaaactttttttatgtttagatacacagacaaggctgggcgcagtggttcacgctttgggaggctgaggcgggcagatcactcgaggtcaggagttcaagaccagcctggccaacatggcaagactccgtctctattaaaaatacaaaaattaggccgagcacagtggctcacgcctgtaatctcagcattttgagaggctgaggtgggtggatcacccgaggtcgggagttcgagaccagcttgaccaacatggagaaaccccatctccactaaaaatacaaaattagccaggcatggtggcacatgcctgtaatctcatctactcagaaggctgaggcaggagaatcgcttgaacccaggaggtggaggttgcagtgagcccagatcacgccattgcactctggcctgggcaacaagaatgaaactccgccaaaaaaaaaaaaaaaaaaaaaaattagccgggcatggtggcacaggcctgtcaggcctatagtcccagctacttgggaggctgaggccagagaatcacttgaacccaggaggcagaggttgcagtgagccaagattgtgccactgcactccagcctgggagacagtaagactccatctcaaaataaaataaaataaaatagatacacagatacttaccattgtgttataattctacagtattccgtacagtaccatgctgtccaggtttgtagcctaggagcaataggccataccataaaaggctatagcctagatgtgtagtaggctatatcatgtaggtatgtgtagatacactctaagatgtttgcataatgatgaaatcacctaaagatatgtaactacacttgcatgcaagtgccttcaagatgtcttattatctcaaaattaatattacatcatgaaaggttgagaccaggaacaatggctcatgcctgtaatcccaacaactctgggagggcaaggtgggtggatcacttgagccagaagttcaagttcagcctgggcaacatagtgacaccctgtctctacaaaaaatacaaaaattagccaatcttggtagcacactcctgtcccagttgctcggatggctaaggtgggaagattgcttgagcccaggaggttgaggctgcagtgagctatgatgacgccactgcactctagcctgggtgacagagcaagaccctgcctcaaatacaaaaaaaaaaaaagaaaaagaaggctgggcacggtggctcacacctgtaatcccagcactctgggaggccaaggcgggaggatcacgaggtcaggagatcgagaccatcctggctaacatggtgaaaccccatctctactaaaaatacaaaaaaattagccgggcgtggtggcaggtgcctgtagtcccagctactcgggaggctgaagctggagaatggcgtgaacctgggaggcggagcttgcggtgagatcgcaccactgcactccagcctgggcgacagagggagactccgtctcaaaaaaaaaaagatggtagatttaccaaacataccttactgtcaaggttcttcattgttaatagatcaagagacttcagggaatgtcctgtaggtgaaatgaagtaaagacacacgtggacgcgagaatcatggtactcaaacaaggaacgtttaatcttcagttcttcttgaagataggcctcaaattgggcatctatgtagtcaactattggttggtagctaaaaaaaaatttatacatttagcataacagactaataaaatctaaagcctgctttttgaccacttaatgagcagttaacatgtatgtaagcagtttgctatagtgatgaagaaaaagttcataacatgtccatacaaagatattaattctaaaccaataataaggctcatgctttactctatggttatgtaaaatgtaaacatagaggaaagctgggtgcatccgacaggggactagtatccagaatatacaaagaatgcaagcaactaaacaacaacaacaagaagaacaaataatcccattaaaaagtgggcaaaggacatgaatagacatttttcagaacaccaaaatacaaggcaaaaccacaatgagatatcatcttatctcagtcagaatggctattgttaaaaagataaaaaatggccgggcgcggtggctcacgcctgtaatcacagcactttgggaggccaaggtgggtggatcacgaggtcaggagttcaagaccatcctggctaacacggtgaaaccctgtctctgctaaaaatacaaaaattatctgggtgtggtggcaggcgcctgtagtcccaggtactcaggaggctgaggtaggagaatagcatgaacccaggagacaaagcttacagtgagccgagatcgcgccactgcgctctagcctgggcaacagagcaagactccatctcaaaaaaagacaaaaaataacaggccaagtagagtggctcatgtctataatcccagcactttggaaggccaaggtaggaggatcacttgaggccaggagtttgacaccagcctgggcaacatagcaagaccccatctatacaaacaatttttaaaattagccaggcatggtggcatgtgcctgtagtctcagttactcaagaggctgaggtggaaggattcacttgagcctgggaggtcgaagctgcagtgagccaagcttgtgccactgcactccagcctgggtgatggaatgaaaaactgtctcaaaaaataataataaaaataattaaataacataatttggcaagggtacacagaaatgggaacccttagacactgttggtgggaatgtaaattagtacaacgtctacggaaaatttgtacaaataaagttaaataaagaaataaggaaataagctaaaactaatagaagctatatttaaaattttttgctataactggctaaataaaaatcttgtaagaaagtcaattatatacaaaagtattaatcttataagaaaagaacattacttaggaaaatattaaaatctggaagaaaaggtattacttacacaaattagtctatggcaaaggaagtcaaattccttgaaataagaaaaccttttttaatttaaataagaaaacactcacctggcttctttgtctatttgatcaccataccctactgtctccacaacagtcaatttcaactgaacattgctttcctgaagttcatatgtctgaatttgaagtccaacatttgagtaaaaatgtgaggatttgttatctttcaagttagtattaaacaatgtgtctatcagtgtcgattttccaattccagtctcccctgtaatagacatagagtcattgtcatagggacataaaggggctaagaaaaagcaacactttgaattcctacggtggtttttaaaatcttagaaagttgaactcatagaagtagagagtagtattctggctaccagaggctgggggagcaggagaaaggaaaggtggagtagttggtcaaaggtacaaagtttctttttttttttttacttttattttaggttgggagtacacgtgcaggtttgttgtatcagtaaactcatgacatgagggtttgttgtacagattatttcatcacccaggtactaagcatggtaaccaatagttattttatctgatcctctccctcctccaaacctccaccctcaagtagacaccagtgtctgttattcccctttttgtgtccatgtgttctcatcatttagctcccacttacaagtgagaacatggcacatgttctcagccataaaaaagaaggagatcatgtcctttgcaggaacatggatggagctggaggccatcatccttagcaaaccatcagagctcattgtagcgctattcacagtagcaaagacatggaatcaacctaaatgttcatcaatggtagactggataaagaaaatatggtacatatacaccatggaatactacacagccatgaaaaagaatgagatcatgtcctttgcaggaacatggatggagctagaggccatcatccttagcaaacagtttcaaacaggagtagaaataagttttgagatctattgcacagcagagtgactatagtcaatgtattgtatatttcaaaataatcaagagagttaatttcaaatgtctcatcataaaaaaatgataagtaaaccgggtaatagatacattaattcacttgattgaatcattccaaattgtaaacatatagcaaaacctcacattgtatccatacatgtaaataactatgatttttcaattaaaaataatattaattttaaaaataaataaagggtctcaaatacttcaaagactgggatggccttgaaaatatacatgctaggccgggtgcggtggctcacgcctgtaatcccagcactttgggaggctgaggcgggcggatcacgaggtcaggagatcgagaccatcctggctaacatggtgaaaccccgtctgtactaaaaatacaaaaaattagccgggtgtattggcgggcgcctgtagtcccagttacttgggaggctgaggcaggagaatggcatgaacctgggaggcggagcttgcagtgaaccgagattgcaccactgcactccagcatgggcaacagagcaagactccgtctcagaaaaaaaaaaaaaagtatatatatatatatatatatatatatgtatacatgctagccctgattctctcagtcattaacataatggaaaaagaaagtatatactaagctacatcagacttttaagagcacaggaatgtgtcaatttttaacaatcactacaggtcgagtgtggtgtctcatgcctgtaatcccagcactttgggaagctgaggtgggcagattgcttgagcccaggcggctgaggctacagtgagccataatcacaccattgcactccagcctgggcaacaaagtgagaacctgtctcaaaaaataaaaggattacataatatggctaagatgagaatcactgtaaacatgaagatatatttgaattaatagcatcaatgttacactgcttaagataagttgaaatgaacattgggaaaaatgaaggaataattcaaatgaggtgtttgacacttacccacacagagaatattaaaagtgaatccttgtcggatagatctgctcaccaactgattgggcaaacattcaaaaccaaaatgtccaatcgtagttaaacaacgaatattattttctttttgcttaaataaaacaaaaatttagagttttgtgttagaataaaaaatgaagtcatttgaaaggaaaatgattatagtacatcaaataaattagaattgattatcatttgcttatcatacctcagacaagatgcaaatatattaagtaaatttgtgaaaatagaagtctgtgttcaaacacatagatttggctattatttttataaataaagtgaatctatctctcagcacactcaaagaggctctgtttctaaattttaaaagagacaggggacaggcacggtggctcatgcctgtaatcccagcactttgggaggctgaggcaggcggatcatgaggtcaggagttcgagaccagcctggccaacattgtgaaaccccatctctactaaaaatacaaaattagccgggcatgcttgtactaaaaatacaaaattggtggtgcatgcttgtaatcccagttactcaggaggctgaggcaggagaatcacttcaacccgggagggggaggttgcagtgaggcaagagcacaccactgcactccagcctgggtgacagagtgaaactctgtctcaaaaaattaattaattaattaaatagggaattaaggaaatactacaagaaactctaatgtattactgtaacataataaattatttcttccataagaaaaaagaaaaaaactttaacatcctttcattctgctgcagcgtattaatatattgagaaaatcccacacatgttaatccagatgcttctcaacttatgatgaggctatgtcccaagaaacccctcctaaattgaacatattgtaagtcaaaactgcatttaacacacataacaaaactgaacattatagctcagctttgcctgccttagacatgctcagaacacttacattagcctacagttgggcaaaatcaactaacacaaagcttatgttataataaagtattaaatatctcatgtaatttatcaaacaaagtgaaaaacagcactattatagagtcaacaatttaagttgaatgattgtaagctggagatcctctacatatgtgaggaaaccaaaatcaatttgaaatttttaaaaaatcaaatgatgtatacttcagatttgttatataccctctgaggacttgtgttatatcgaagaaatctactactaataacaccattctagaaaattagaaatccatcagtattacacacaaagttaccaactgatcatttttaaaaggttaaaagatcattcattttttatttttaagtacttctattttaaaaatgggaattatacaaccccctgcacaactataaacacattaaataccactttgcaatgacagctcagcatacttcacagttcttaacactattttatgaggaatacaaaatacctttttatttaaattaacccgctttaaaaatgttttagtatatgtgagaataaaggaattataaatcagtaggaaagattttaaggtagaagcatcaacaatcagctcagtagatgttgtctacatttattttgtacctttataaaacaagaacatgctaatcggcctgggaggcagaggttgcagtaagctgagatctcgactcactgcaacctccatcacccgggctccagcaattttccagcctcggcctctagaaaagctgggactacatgcatgcgccaccatgcccagccaatttttgtattttttgtagagaaggggtttcaccatgttggccaggctggtctcgaactcctgacctcaggtgatgcgcctgcctcggccttccaaagtgctgggattacaggtgtgatccactgcacctggctaatttttgtatttttgatagagacggggtcgcaccatgttgcttgggctggtcttgaattcctgagctcaaacaatcctcctgccttagcctccaaagggctgggattacaagcttgagtcactgagcccgatctactaacagagatttttttttttttttttttttgagacggagtctcgctctgtcgcccaggctgcagtgcagtggcacgatggctcactgcaagctccgcttcccgggttcacgccattctcctgcctcagcctcccgagtagctgggactacaggcacctgccactacgcccggctaattttttgtatttttagtagagatggggtttcaccgtgttagccaggatggtctcgatctcctgacctcgtgatccgcccgcctcggcctcccaaagtgctgggattacaggcatgagccaccgcgcctggcctactaatagagattttaaaacagctattataaatgtgcagagacataaaggaaagtgtgcatacacaatgagtaaaaagacaaaaatcccaggagaaaaacaaaaattataaaattaagataaaagcagaaagcatggccaggcacgttggctcacgcctgaaatcccagcagtttgagaggctgaggcagaaggatcacttgaggttaggagttcgagaccagcctggccaacatagtgaaaccctgtctctactaaatatacaaaaatgaacccggcatggtggcaggagcctgtaatcccagctactcgggaggctgaggcaggcgaatcccttgagccagggaggcagaggttgcagtgaactgaaatcggaccactgcattccagcctgggcaacagagggagactacatctcaaaaataaataaataaaagcagaaagcaaagaaataggaaataggtcttagaaaaaattaaataagcaaaaatttgctgctttgaaaagattgataagattgataaacacctagctggactaataaaaacacccaaaacagccaggcatggtggctcatgcctgtaatcccagcactttgggaggctgaggcagggagatcacctgaggtcaggagtttgagaccagcctgaccaacatggaaaaaccccgtctctactaaaaatacaaaaattagccgggcatggtggcacacgcctgtaataccagctactcaggaggctgaggtaggagaatcacttgaacctgggaggcagaggttgcggtgagccgagatcgcaccactgcactccagcctgggcaacagagcaagactccatctcaaaaaaacaaaaaacaaacaaacaaaaaacacccaaaacacaaattgctcatagcagaagtgggagaatattactacagaccacacagataacaaaattagactactgtgaacacattgatgaacacattttgccaatgattttgaaataactcttttgccaacaaacttgaaaataaataaatttcattgggaaaaaaaacaaattataaaaatgacacaatgggaaataggaaatctaaatagtcatatatctattgaagaaattatagccaaaaacctttccacaaagaaatcttcaggccctgctgatttcactattgaattctatcaacaagcagttaaaagaaaaattcacacaaactctctacaaaacagaagagggggtagttttttccaatgtattttatgaaaccagatataatggcaatataaacacctgacaggccaggggcggtggctcatgcctgtatcctagcattctgtgaggttgaggtgggttggatcacctgaggtcaggagttcaagacaacctgaccaacatggtgaaactccatctctactaaacacaaaaaattagccgggcatggtggcacgtgcctgtaatcccagctacctgggaggctaatgcaggagaatcccttgaacccaggaggcagaggttgcagtgagctgagattacaccatgcactccagcctgggcaacagagtgagactccatctcaaaaaaacaaacaaacgaacaaaaaacacctggcaaagacatcacaaaaagagaaaattatacattaatttctgtcatgtgcatagctgcaaaaattcttttttactactataattttaattgtacaactagtaagtgtgcaaataaatttttcttaacaactgaaatattgaaatggaagataatattccatttaactattccccacatcctatctccttcctcttttccctatttttatgatttttaggattctagacattaaaaaatacttttatatacacaaatatagaggtattaaattttaaaaacacatacatggccaggtacagtggctcacgcctgtaatcgcagcactttgggaggttgaggtgggcagatcaccagaggtcaggagttcaagaccagtctggccagcgtggtgaaacccggtctctactaaaaatacaaaaaaaaaaattagccagtcatggtggcggaggcctgtaaccccagctactcaggaggctaagagaggagaattgattgaacccgggaggcagaagttgcagtaagccaagatcgcgccattgcacgccagcctgggccacaagagtgaaactcttgtctcacaaaaaaaaagcaaacattctgcaacttgcttttttctactaaaattctatacatgttaatcagctagctttattgaggaataatttatatgtaataaaattcaccaactttatgtgcacaatttgataaattttaacaaatgtgtatagtaatgtaatcaccatcatgatcaccatatagaacatttctgacatccctaaaactttccctattagcccctattcagtcaatttgtaaccctcatccctcagccctggcaacctctcatctgttttcagttgctatagttttactttttctagaatttcatttagaagaaatcatactgcatggagtttttttttttatcttaacaaaacattaccaatcaattcacttgtatataaaaaagattatagattaaaacaattggcatttattctagaaatgcaaggttaattcagcactcaaaaatcaataaatgataaactataaaatactgatgcaagaaattgaaaaggacacaaaaaaatgaaaagatattccacgtgtatggactgaaagaatcaatatcattaaaatgttcataccaccgaaagcaatctacatatttaactcaatccctatcaaaataccaatgacattctccacagaaatagaaaaaataggccgggcgcggtggctcacacctgtaatcccagcactttgggaggccgaggtgggtggatcatgaggtcaggagatcaagaccaacctggctaacacggtgaaaccctgtctctactaaaaatacaaaaaagaggctgggcgcagtggctcacgcctgtaatcccagcactttgggaggctgaggcgggtggatcatgaggtcaggagatcgagaccatcctggctaacacagtgaaaccccgtctctactaaaaatacaaaaaattagccaggtgtggtggtgggtgcctgtagtcccagctactcgggaggctgaggcaggagaatgacgtgaacctgagaggcagaggttgcagtgagccgagattgcgccactgcactccagcctgggcaacagagtgagactctgtcaaaaaaaaaaaaaagaagaagaaaagaaaaaagaaatagaaaaaataatcctaaaatttatacgtacccacaaaagacacagaatattcaaagcaatgctgagtactctgggtacactgaaggaatcacattacttgacttcaaattataatacagaactacaataaccaaaacagcatggtactggcatgaaaacagacatatagaccaatggaacagaatacagaactcagaaataaattcagacatgtacagtgaactcatttttgacgaaggtgctaatagcatacagtggggaaagaagagtctcttcaataaattgtgctgggaaaattggatatccatatgtaaaagaatgaaaacagactcctatctcttatcatatataaaaatcaaataaaaatgaattaaagacataaatctaagctgtgaaactatgaacctactaaaagaaaagattggggaaactttccaggacattgacctgggcaaatatttcttggataatgccccacaagcacaggaaaccaaagcaaaaatggacaaatgggatcatatgaaattaaaaagcttctacacagcaaagaaagtgatcaacaaagtgaggagacaacccactgaatgggagaaaatatttgcaaactatcccccgataagggattaataaccagaatatgtaagaagctcaaataactcaataggaaaaaatctaataatccaatttaaaaagtggcaagtgattggaatacacttgtctcaaaagaagacatacaaatggcaaacaggtatataaaaaggtgctcaacatcattgaccatcagagaaattccaatcaaacctacaatgatatatcatctcacctgagttaaagtggtttttacccaaaagactggcaataacaaatgctggcgaaaatgtggaaaaaaagagaaccctcttacactgttggtgcaaatgtgaattagtatggagaacgtatggaggtacctcaaaaaactaaaaatagaactacctatgatccagcaatcccactgctaggtatatacccaaaagaaagaaattagtacattgaagagatatctacactcccatgcttattgcagcactattcacactaggcaagatttggaagcaacctaagtgtccatcaacagatgaatggaccaagaaaatgtggtacatatacacaatggaaaactattcaatcatcaaaaagaatgagatcttgttatttccaacaacatggatggaacctaacattatgttaagtgaaataagcaagtcatggaaagacaaacttcacatgttctcacttacttgtgggagctaaaaattaaaacaattgaactcatagagatagagagtggaaggatggttaccagaggctaagaagggtagtgggggtggtgaggggatggttaatgggtacaaggatatagttagatagaatgaatagggcccagtatttggtagcacaacagggcgactatagtcaacaataaattgtacattttagaagaatgaagagtacaattgaaatgtttctaacacaaagaaatgaaaaatacttaaggtagtggatactccatttatcctgatatgattattacacattgtgcgcctataacaaaatatctcatatgccccataaatatatagacctgctatgtacccataaaaattaaaaagtaagggctgagcgtggtggctcatgcctgtaatcccagaattttgggaggctgaggctggaagatcgcgtgagctcaggagttcgagaccaatctgggcaacatagtgaaaccctgtctctactgaaaataaaaactaaaaaaatagcagagtatggtggtacatgctcgtcgtcccagctactctggaggctgaggcgggagaatcacttaagcccaggagttagagtttgcagtgagctatgattgtgccactgcgctgcagcctgggtaaccgagtaaaaccctgtctcaaaaaaaaaaaatttaaaaatcaataaacatatttcaccatattaatagtataaagtaaaatcaccatatgactgactcaataagtgaaaaatattatatttgatgaattgaattgaatacccatttgtgatttttaaagtctattagtaaaataagaattaaagagaacttcatcaatctgataaaaactgtattagaaaaaaatttaaatctaacatcatacttaatagtaaacatctgagtgctttcttcacaagattgaaaataaagcagagatgtcagctgttgccattttatacattgtactggaggttctttttttttttgagacggagtctcgctctgtcgcccaggttggagtgcagtagtgcgatctcggctcactgcaagctccgcctcccgggttcacgctattctcctgcctcagcctcctgagcagctgggaccataggcacccgccaccacgcccggctaattttttgtatttttagtagagatgggtttcaccatgttagccaggatggtctcaatctcctgaccttgtgatccgcccacctcggcctcccaaagtgctgggattacaggcgtgagctaccacacccggcctgtactggaggttcttaccagtcaataaggcaaacaaaaagcataaatattcaaaagagtttgtcattttatattgaaaaaaggtagaaaatatacaagaatctacagagcatctaccagaactactaagagaacatatcaaaattacaagatacaaagtcaatatacaaaaatcagttatattcatttctagcttctgctcagagatgtggagagcagaaaaaagacatcactactaatactataggaataaaataatgaactaaggcaagatcacaactttttttttttttttttttgagacagagtctcgctctttcgcccaggccggagtgcagtggcactatctcggctcactgcaagctctgcctcccaggttcacgctattctcctctctcagcctcccaagtagctgggactacaggcgcccgccaccgtgcccagctaattttttgtatttttagtagaggtggggtttcaccgtgttagccaggatggtctcgagctcctgacctcatgatccacccgcttcggcctcccaaagtgctgggattacaggcgtgagccacggcgcccggtcagatcacaactttttaaaaactcatcctagtactgacgtttcaggtcgaccaattgttccagaatcgaaggagagacagaaacccacaggaaaagacaagatgggagcatcaacttttctaggcaagaaagacgcagacatcagtgagaagagttctaaagcaaggagcaaattgctagaacatgccttgcctgacaagtaaaaagtatgagccataaagaggaatcatctgtaggtgcttttttcttttcttttcttttctttttgagacagagtgtcgctctattgaccaggctggagtgcagtggtgcgatctcggctcactgcaacttccgcctccctggttcaagcaattctcctgactcaacgtcctgagtagctggggttatagccgtgccaccacgcccaactaatttttgtatttttagtagagacggagtttcactatgttggccaggttggtcttgaacgcctcacctcgtgatccacccacctcgccctcccaaagtgctgggattacaggcgtgaactaccacgcccaggcctgtagctgcttttttttgtttgttttctggtttggtttttatttgtccttatttggaaatctgtcattctaagtagagaatacaaggtatattaattatattttttaatttattaaggtttgatttaatgtatgtatttaatttttatttgtaatttcaacttttagattcagagagtacatttgcaggtttgttatgaggaaatactgaatgtgctgagttgggggtgtgaatgatcccatcacccaggtactgagcatagtactcaataggtagattttctgccctcaccccctccctccctcaccctctagtagtcctcagtgtccattgttgccatctatggcatgagtctcatactcatatgtctatgagtacccaatgtttacccccacttataaatgagaacatgtggtatttggttttctgttcatgtattaattaacttaggataatggcctccagcagcacccatgttgctgcaaaggacacatttcattttttatagctgcatagtattccatggtgtatatgtaccactttttcgttttttttttgatatggaatcttgctctgtcacccaggctggagtgcagtggtgtgatttcagctcactgcaatctccgcctcccaggttcaagcgattctcctgcctcagcctcccgaatagctgagatcacaggtgcccaccaccacacctggctaattttttgtatttttagtagagacaagatttcaccatgttggccagcctggtctcaaactcctgacctcaggtgatccgcctgtcttggcctccgaaagtgctggggttacaggcatgagccaccgcgcttggccatgtaccacattttttaatccaatctgccactgatggacacctaggttgattccatgtctcagctattgtgaatagcgctgagatgaaaacaagtgcaggccaggtgtggtggctcacacccataatcccaacacttcaggaggctgaggcaggcagatcacttgaggtcaggagtttgagagcagcttggccaacatggtgaaaccccatccctactaaaattacaaacattagctgggcgtggtgcatgcctgtaatctcagctactcaggaggctgaggcacgagaatcggttgaacccgggaagtggaggttccagtaagccaagattgtgccactgcactcccgcctgggtgacagagcgagactctatctcaaatttaaaaaaaagaaaacaggatgggcgtggtggcttacacctgtattcccagcactttgagaggctgaggcaggcggatcacctgaggtcgggagtttgagaccagcctgaccaacatggtgaaaccccgtctctaataaaaatacaaaattagccaggtgtggtggcgcatgcctgtaatcccagctactcaggaggctgaggcaggagaatcacttgaacccaggaggcagaggctgcagtgagccaagattgagccattgaactccagcctgggcaacaagaggaaaactctgtctcgaaaagaaaagaaaaggaaaaaagagaagagaagagaagagaaagaagagagagaagagaagagagaaaaggaaaggaagggaaggggaggggaggggagaggaagggaggggaggggagggaagggaagggaagggaagggaagggaaaggaaaggaaaggaaaggaagagaggaggggaggggaggggaggggaggggagcctgtgtctttttttttttttttttttttttttgagacggagtctcgctgtcgcccaggctggagtgcagtggcacgatctcggctcactgcaagctccgcctcccgggttcacgccattctcctgcctcagcctcccgagcagctgggactacaggcgcccgccaccacgcccggctaattttttgcatttttagtagagacggggtttcaccgtgttagccaggatggtctcgatctcctgacctcgtgatccgcccgcctcggcctcccaaagtgctgggattacaggcgcgagccaccgcgcccggccacctgtgtcttttttgtagaacaaaaaataatctgtagctccttgaaaactttttctccttgaactcaactagacattcagtgaaagattgataggactctgaaaaaaaaatatctctctcaagttacagaactgggacatgcaacagcagcaatgctggcaagaagctccactcacaactttctcctctacagaataaaaaagccttcatctatgggtgaagagccaggaagcactctcttagggcgctggtgaaagcacattgctgctgaaagtagggaacacaaagaaagcttgaagccctagaagatgtgcagaaattcacaatggattcagaaccatgtcagaagaagagaaagagaaggtcaaatccctggggcccagagggagagtgtttgcctaagactggcaatcaaataaaaaagtattctcacgtaccttcatcaccaggctaactgctgtcaagatacatattctttgcaagagatattgcaagagacatactctttctgaggcatagcacaaaaggaagacttaaggttgagggtgaaatcatcatcagaaaaacatcctctggcaaaccaaccccaccctcaacacaaggtatcaccagaggcattcaaagcccatagggtaggccaggcgcagtggctcatgcctgtaatcccagcactttgggaggcagaggcgagcagatcacctgaggttgagagtttgagaccagtctgaccaacatggagaaactccctctccactaaaaatacaaaattagtcgggcgtggtggcgcatgcctataatcccagctactcaggaggctgaggcaggagaatcgcttgaactcaggaggcagaggttgcaatgagcagagattgtgccactgcactccagcctgggcaacaagagtgaaactctatcccccgccaaaaaaagcccatagggtagtaagaatcacactatagcaacatcaaatctcaagcccagctttactcagagaaacacaaacctctgtactaaaggcctggtaaaagaaaaggcatgtcagtttcagacataaaatctacttatctcagtttctatggttctacataagatgtccagttttcagcctccaaaattagctgggcatggtggtgggctcctataatcccagctacttgggaggctgaggcaggagaattgcttgaacctgggaggtggaggttgcagtgagcagagatagcgccattgcactccagcctggttaacaagagcgaaactccatctcaaaaaaaaaaaaaaagtattgtcaagaccaatgtccaggacattttcccctatgttatcttctcagagttttatgatttcaggtcttacttttaggtcttttatctattttgagttggttttttggtatagtataagataatggtccaatatcattcttttgcatatagaaattcagttttcctggaaccatttagtgaagagatgatttttttcctcattatgtcctcttggtgcccttttcaaaaattagctaaccatgaatgtttggatttatttctgggagctctattgtgtttcactggtctatgtttctgtttctatgatggtaccatactatactgattactatagctttgtaatataattttaaatcaggatgtgtgatgctctgtgttcattgcagtatttttttaatagctaagatatggaaacttaagttctattatgatcctagtcactcttttttcaatccctcccttcacttcttttatccctctctcccttcctccctctctttctctcattctttgtttccactataaatggaactaccgtatgatctagcaatcccactactgggtatatacccaaaggaaaaaaaatcagtatatagaagagatctctgcatccctgtgtttattgaacctgtattcaccacagcaaaaatatggaatcaacctaagtgtccatcaacagacatatggattaaaaagttgtatatatacacatttaaatactatttggggccagacgtgatggctcacgcctgtaatcccagcactttgggaggctgaggcgggtggatcaccagaggtcaggagtttgaaaccaacctggccaatatgttgaaaccccatctctactaaaaatacaaaattatccaggcatggtggcgcatgcctgtaatcccagctacttgggaggctgcggcaggagaatcaattgaacctgggaggcagaggttgcagtgagctgagatcatgccattgcactccagcctgggcaacaagagtgaaactccatctcaaaaaaaaaaaaaaatacaatttggccacacaaaaaaatgaaaacctgtcatttgcattaacatggatggaactagaggtcattatgttaagtgaagtaagtcagacacagaaagacaaatatgtcactcatatgcatcagcttaaaaagttgacctcatagaggtagagtagaatgatagctaccagaggctgggaagggtgtgtgagtagtggggggatgaacagaggttggctggtgggttcaaacattcagttaggcagaagaaataagttctgatgttctatagcagagtagggagactatagtttataacaatgtattgtatatttcaaaatagctaaaagaggggatttgaaatgttcccaaaacatagaaataataaatattccaggtaatagatacatgaagcaccctgacttgattattatgtattctatgcatataataaaatatcacatgtaccccatcaatatgtattaatattacatatcatttaaattttttaaaaaacagaggggtccttggagaggtaattaggtcatatggctccacccacatgaataggactagtgcttttataacagaagcttgagggacactgtttgcttctcctgccatgtgaggacacagctagaagccatttttgaagcagagagtaagcccccacctgacaccaaacctgctggtgctttgatcttggacttcccatcctctagaactgtgaacaatgcatttctattgtatataaattaccaagtctgaggtattttgttatagctgcccaaacagactaagacacttgctaaagatttgttgctagcatttgcatatcagcatttgcataatgtttgactaattggcttttgggatcccttctaatcctaaaattttatgttttagagtcatgtgaacaaaggagtattaaccatgatttgttaaacaagaaagcccaaagataaaatggaatgagcataggccaatgtttcagtccctgagaaattcctctgatggttattcatgaaaagcaatgacaggccaggcgcagtggctcatgcctataatcccaatactttgggagactgaggcgggtagatcacctgaggtcaggagttcgagaccagcctggcccacatggtgaaaccctgtttctactaaaaaaaaatccaaaagttagccaggcatgaaggcaggtgcctgtaatcccagctacttgggaggctgaggcaggagaatcacttgaacccaggaggcagaggttgcagtgagctgagatcacgccactgcactccagcctgagcaacagagccagactcagtctcaaaaaaaaaaaaaaaacttgctctaacctcacactcagtaaagcaatcagcaagcagccatccaaccatttgctaaaataacttcattaaaaaattatttattgtcagtgcatacattctgcaaatatatccatcaaaacagcactgttcttctcatttattgggcgattcagaagttttactttgaatttctttggtgttaagtagaaatagtctgttgcactgctaacaaggtcatcggactcaaaaaacatgtaacaattatctaaatcaccattgatacttaaaactccaattagtataaaagctaattcatgcccaaacataacaaacaagactttatcttctatgcctacatcagttttccaagtcaatatttttaggctatataatcttattgaagtacaaaatgcagagttatatttgaaagatatacttaactgtatctccatcagcaggtatttgtgtgggcatagccattgttctttctgccatgctacactaaaagagctggaaatttaaaaaaataaacatttttaaaaatttcttacaaaggctatattcttactatataatttagataattagggggcataatatgggtatttttgcaagctttagtttttagttcacactattcatctgttttaaactgtggctgtcttgctagatgggcttctacatgatgaataatatgtaatattcaacttataatgtagagtaatacatttaaccataagcacacaaaaagcatcttaaagttaaactccctttggaaatcaagaggataagagcattcttcttctttaaatgactccatggtcgtaagaaaggaaagtagaaaattttgctttaaaaaatggttaaaaaaaaaacaaaacaagacactcacaagcacttaactttccagagtagcataccagaggaggcttaggcatttgaatttacccattgaaagagaattgtgaaagcagaccttaaaaaacctaaacaagttctttagacactgaactaaaataatgataattctcatttatgaagcatctattatacagctagcattgtgctaagggtttatgtgctttatttacctctgttagtcctcatagtagatctgagatgtatgtattttcattgccatatgccaggtgaaaaaattcagactcagaaagattaaataacttactttcccagggattcagctgtgcagcagacacaggtccgaactgattccaagctggtgtcctttctactgtccccagttgtggaccaaataaatattcactgt

SEQ ID NO: 2350 - DNA, 122346 bp, Homo sapiens
taacaccggatgatggcgcagcgctgtgcacgcaggcgcagtgtggggcccttgcggtcgaagctcacgcggtaagccgctgcacgtgtgctacggcgggcggagggccgaaagtccagtatgtgggtccagggtcactcttctagagcttccgcaacggaaagtgtgaggtcagtagtagtttttgtggtacgtgcagtggtggccgcttcaaggactattttcgtcgctgcttgcgttttaagtctccaatcctgggacgaggcccatttcagggttttctgtcaccttctagccgcccgccaccccagaggggtgccagatgccccagtttttgagtgcatgcaggcaggcgaaagtggctcgaaaagacctccggcctgaatgatctccatgaagacgcggtcacgcagcctccacactctcttccccttctcgaaaattctgtgccatttaagtttcaaaatcccttataaaataagtgtcagagagctacgtgtacccgtttcttccaaattttcatcacgaagtggagatttggacgtactattttgtgatctctgtttgcagaaagtgggtacggcatcagtgccttcataatcagggcaagtcattttaaaataagatttaaaaactactctagaagtagcttcttggagtgtgtggagagatttccaaagtaattttaacttttactgaatttaagccttaatgctttccgtgggaatatatagtctccctaaaagttattacagcttttcagtcagttgaatttaaaaactgctttttgaccagtagaaaagaacccttgctttggagacattttcatgccacttacgaaaaatttttttaaaaaattaagttgtgacaaagtaatccatttttaaaattttatttttctgtgatgaggagttaatgttttccttttcataatgagagagcatttgaaactttagtatagtggtgttcctagacaacttttaaagctcttaaaaaattgcggtggcttaggcctgtaatcccggcactttgagaggccgaggtgggcaaatcacaaggtcaggagttcaagaccagcctggccaacatggtgaaaccccgtctctactaaaaatacaaaaattagctggacgtggtgtcacgcgccggtaatctcagctacttgggagggtgaggcaggagaattgcttgaacccggggggtggaggttgcagtgagctaagatctccagcctgagcgacagagcaagacttcgtttggggggaaaaaaaaaaaaacccataaaaaatctgtgttttaattttccttcaacacttatgaatggaaagtgcagtattttagtatattacagataaaattacatagtgtacatttattttggaatatttttgcatttgataaagtataatattatgtaattaaaattatttttgaagtaataggcaaaattttaggtatttttgcagtctttaatcccacggaatcttcaaaaatagtaaccaccgtgccttttacataaaatagactaccagtttaaagcatttgttctattacttgtaatgtttctctttgtttacattgtggaagtcctttttatgggaggatattttctaaaaaaagaatatgtacattgtttcaaagtattgatttatgtaagtgatcaaaatgtatatgagttcagtataagtttgtaaaagtttggctagagataattttaaggatagagattatatatgataaaattgcatctactacaaaatactcaaaagaattagttagtgaaggaaatattgagctcatttttaatatagagtttgaattttgataactgcatttaggacaaaacatttgtaagaattgaacatgatgtagtttagtcttcattcattattaatggtggattattgtaatctaatttaaggtattgttctagtttttcaggaattgttcaaatggatgaagatacacattacgataaaggtactgacactaaaaattattttggggtgtaagagctagatgatactgattaatttctaattttccttgtattgtgatttgattttagtggaagatgtggttggaagtcacatagaagatgcagtaacattttgggcccaggtaaatagcaaactggttgatatcccccctcacctcccccaatccagttcctccccaacaaaaacaaaaataaaacccaggaataaatacatttgtcattctcattgcctaatatttattgaattatttatcaccaggcattattaggagacaaatgttgacagctgtgatgttacttgactcattatgagtcaagtgttatgcccataatacaccaagtttgaaaaaagaaaattggcaagattgtgatttcagaattccactcaattctaggctgcttttgctggattctgagagcctgttgtatttgtgaagttatagccccatctaggggtcttttataagattgtttcttgaaggaggataagttaaaaatctcggtcgttttttctaatggcttaaatttgagatgtggtatttttctcattatagaattggaagcatgaatgaaacatttctgattttctgttgggagggtgtcagttaggtaaggttactcagttttaaatacaaagcaagcactgaagggctgtgttccacaatttaagaaggtaaattcctctgatgcacagaacgacctgctaatttttggttttgtaaactatacatgatacggaagggaaagaaattacgtttctctatactccctacagcatgggaactccttttggtggggggtgaggtgaactcgtaatgtgggaaataaggagaatatatgagaagaaagttctagaagaatatgattaacccagagttcttaaatatatagtcatgcatcacttaatgactgggatacatacagagaaatgcatcattaggcaactgcgtcgctgtatgaacatcatagaatgtacttagagaaacctggatgatatagcctaccacatacctaggccatgtggtgtacctgtacctcatgttactgtactgaatgctgcagacaattgtaacacaatattaagtctttatgtatctaaacatgaaggtacagtaaaaacatattataaaagattaaaaagtggtacacctgtatagggcactcaccatgaatggagcttgcaggattagaaattgctttgggtgagtcattgagtgagtagtgaggaatgtgaagtcctgggacattactgtacactactgtatactttataaataccatacacttaggctacactaaatttataaaaatatttttcttcaataaaccttagcttactgtaacttttaataaacttttgactcatttgtagtaacacagcttaaaacaaacattgtagagctgtgcaaaaatattctttacgtccttattctaaagctttcttctctttttaaacttttaatttttttttactttaaaaactttttggttaaaaacgaagacaagatcttcaatatcactgtctttcacttccgcttcttgtcctactagaaggtcttcagggtcagtaatgtgcatggagctgtcatcttctgtaataaaaatgcccttttggaataccttcagaaggacttgaggcggctgtacagttaacttttttaaataagtaggagtacactaaaataagaaaaattatagtaaaaaaaaatatatatatacacacacaccagtgacatagttattttcattaccaagtattatgtactgtacataattgtatgtgctgtgcttttgtgagactggggcacggtaggtttacaccagcatcaccacaaatatgtgagtaatgcattgttctatgatgttacaatggctaggactacactaggcaataggaatttttcagcttcattataatcttacgggactactgtagtgtgtgtggttcattctttgaccacaatgtcactatgtggggcatggctgcatgtaaaaaaaaattgtagaagggtgatgttatagaaaacttggggcaaattcgtgtgtctgcttatgcacatatatttggcaaatttgtttctgcttatgcatattctctaaaggttgctcacacgttctggttccatgcccattgtctctgtattagtgacaactgcatcactctcaacagtgtcccagggtggatgataaattatatttaagcttattatacagaaacatcatttatcagtgtaaaaagattttctagactagtgctgtctagtagaaatatatgagccatgtaagtaattttaaaacatttttggcagccacattgaagaaactaaaaatagcaggtgacattttaataagtacattttatttaactcaatatatccaaaatattgtttcaaaatataattagcataaaaatgtgaacaggatagtttatatttcctttttaatattgtctttgaaatccagtgtgtatattagacttacagcatatctccttagactagccatatttcaagtgggtattggctattgtattcactagtgcagctctagactttgatttcagtttactttatttgtgaatatgttgattgaatttggagcaaattcaagagtcagcagttttttttttgtaaaggatcagatgatgagtattttaccatttttaggccatacagtttgttttgcagctattcaattctgccaacatagtgcaaagcagccatagacataatgtgaatgagtgtgtgtagctgtgatgcagtaaactttatttactaaaacaggcggctgtaatttgccaacctctgagttaaaccatgaagttgaggctcttgtagaagaacgtttaaaacaggaaacatgcgcatgaaaagattaaacattaaaactactaatggtatataaatgaatgtagtggttatttcaataagcaaattggcaaatttggttggggttatggtgggatataggcatagagaagactagagatttggaaatacgcgtaggcagattaggatgaaaatctgctcacgtgtattctccatttttttttgccctgtgggcttctgccttataaaccacttataagcaaacacttcagattggatgagtggcagctgaaggaatctgacgtatttgactccacctgtttctttgaaagaacaagcttctggtcaggcatggtggctcatgcctgtaatcccaacactttgggagacctatgtgagaggatcgcctgagcccaggagtttgagaccagccttggcaacagtaagaccttgtcgctacaaaaaaaaaaaaaaaaattagccaggcatggtggtgcatgcttgtgttcccagctatgtgggaggctgagggtgggaagattgcctgggcccaggagattgagactgcagtgagctgagattgcaccaaacaaacaaacaaacaaagagctcctatttgttttagtctgtatagtgaaaaaatatagttatatggaatattttgattccaggggtttgttcacaaaggctgcttctcttgtttctcagggtcagtttaaattcagttcctgttctatgctgagactttgatattcatcatgatgttctttgaactgctctttcagagttttttttcagtcatcacggataatcatgttctttctagcattattgaatattttgttggtatatttctttagaacatatatatatatttaacattttattttgaagaaactttgacttacaggaatgttgcaaaattagtacagaggctagaatgtggctctgtatactcttcacccagcttcctttaatgctaatgtgttatataaccacagtacagtgatcaaagccagggaattaacattagtacaatgctattaactaaactacagcccttatttaaattttagcagttttttgtctttttgtgttccaggatccaatacagaatcccaaattgtatttagttgtgtatccttggtttcctttaacctctgaatgttcctcagtttttccttgtatttcaagacttttgacacttctgatgaatattagttattttgtagagtatcttttaatttgggtttgtttgatgatttcttatgaatagattagcaagagttccacagaagtgatattgtagtcctctcagtatatcatattggggtttcatgatgtgatataccttcttattgatgataaccttgattcacttgggtaaggtggcaacttccaggttttttcgctgtaaagttactcttttcttttgtaattaattaatgttttaggagacttattgtggctgtctaatccagtttctgttcaacttttcacccacgaattttattgtttattgctctagtgcttgcctaatgatgattttctattcccctcattccttccacatttattaattggaattcttctgtaaggaagagctgtctcttctctgccatttatttattcaattatttatattaatataaactcaaggatatttattccgtgggttataatcctatgctatcataatttattttgttgtttaaattattcagccttggccattgggacaaagttcaccaaagaatacagattggtacttgtccttaaacgtctcctattctttttttgagcacttttttttttttttttttcaagacagggtctccgtcaccaaggctagagtgcagtagtgtgctcatggctcattgcagtctcgaacttctgggctcaagcaatcctcccacctcatcttcctgtgtagttggaactataggtgcacactaccatgcccggctaatcttttgtattatttttgtagagacaggatttcaccacattgccaagctagtctcaaactcctgggctcaaaaatgatcctcccacctcggccctccaaagtgatgggattacaggtgtgagccatcgcaacctgcttttttttttttttttttttttttttttagcatttctttactttctggcaccatcaaatgtcccaggatcatcttttatttcccagtttgagctctgcaatcaaatcaatctttaaggaatcctttccatatgatttaattatatttggtatcttgtttgaattctacctaatttgaacacattgggaagtaaactttttctatggcctagtctcatttcttataaataactcatttaaattatgaaaaaatacaggcataagaagttgatttaatttctaatggcctaaaatcttttaagtttatcatgcttagaaccctcaagcgtgtaacactgtaaaataatattttactgtatcttatactatatctaatctttctagagtatcaatagaaataaggatatcatgaagattggttgctcactgtctgaagtttgcccccaggccagttcagttttggggaatcttgacccaaacaaggtgagccatattcttgaatataattatttcattcctcctgtcagctttcctgtgtcttagatatttagtttttggagttcctggtatatttgaaaagaagaggctgatttttggaatttgtataaactactgttatggtatatttattaattcaaaaatacttatggactgaatattactcagtcttgaaatttgacgtaagctacaacatggatgaatcttcaggacattagctaaataagccagtcacaagaggacaaatactgttatggttctacttgtatgaagtacttagagtagtcaaaatcatagagacagaaaaagtgagtgatggttatcagggactgggggaagattgaggatgaggagttattgattaatgggtgtagagtttcagttttacaacatgaaaagagctatggagatggatgatgaatggtggcgaaggttgcagaacagtatgaatgtacttaatgccactgaactgtatacttaacaatggtcaagatagtcaattttatgttatgtatagtttactacagttaaaaataggaaaagtagaattaaaagctacactattctagccaaaaaaacaaaagtgaagaaaacgtatgtactgtctgccatgtacctggcactgtattaagcattaagtaagtatgcagtggtgaacaaactagattccttgcatttgactttgattcacaaaaaatttgtaagatgcatctttatgcagagcaatttggcttttttcttttttactgagttataacttgtatacagtaaggtatatatctcttaagatcctaagtatatagcttggtgagtttttacgtgtgtatgtatccatgtaaccaccatccagatcaacatatggttctatcatttcagaaaattccttcgggccccttctcagtcaattcttagtcagtagtttctccatcagaggtataaccctcattttgatactatcaccatagattcgtatgtctgttcttaaatcatggagtatgtagtttattgtatgtatctggcttcttttgttcaacataatttctgagattcatttatattgttgtgtgtattagtgtattggtagtctgttcttttttaagctatttaacattcattgtataaatataacacaatttatcgatctgttctcctttgatgggcatttggattttttgcagtttttaactactctgaatgaaactgccgtgaaatccttatataagtcttctgctggatgtattgactcatttcttttgcacatatatctagagtagaattgctaaattgtagggtagacatgtttctgccaaagtagatactgccaaacagctttgcaaaagtgttgaaccaatttacattcttatcagcaatttatgagagttatagttcctcgatatcctcaccagccccctgctttgctagtgtactgaggttgtgttttaatatttttattagccctttggaaggggtcttgtgaagtacctattcacatcttttccccatttttaaattaggttatttgtcttgattgatttgtaggcattctgtatgtttttttcactttaattttcatttttgtttctacctcttaaagtcaatgataaagtcacaactgtaaaatgaatgcatttaaaaaataaaagatatatttcaatgacaaaaagtatgcaatgatcatgaaaatctactgtacactttgccaaggccaaagaatgaaagacaatatgaaaaagccaatcttcaaatatatcctcaacaaaaactccctcctaaatagtaaaattatcatttaagaatatttgtctttacacatctaaacagaagctctaaccaaaaaaaaagtgggggaaagggcagatgataactctccacaagttttccagatataaacatgtggtcaccaggaattcaagattaaacttctaaagcaacatttaactcaaaataaagtgaacatttctgacaggtgacaacagtagtatgaaactgatttttcctttcctaaatagaaatgagatggggcatttcagtaatcatctaagaataactgtagaaatactcccaattctaccaccccacccactggtataaaacagataccttccatgaaagtatctttcacattactgaaatatcctcacttacttgggacaatttcatgcttagatgagtataaacacttgtttttaggtgtgtggaattattggagctgagatttttgaaacaatatctgaatcttagcagagatataataatactttcactatacattgattgggcttccttaaccaaatctgagcaactactgtaataacaatgctggtggtagtccatgatactctcaaattttttccctttaagaaatatataatccatgtaatactagtaaatatgttacattgtacaccttcttaacaaagaatgtctgttttcaggccttactaggaaaacaaacaaacaatggcagttactgcctgtttttatcactgataagctacaataaagctcaaatgatggatggtttacgtgtgtgatattaagtacaaaatgaaagccattataattttaccaaaagaaacacgaaaaatatgggaagaagtgaaatgaacatggcatgggtcccaaagattacgatatgtttcagaacaggattttgaaaacaaacaatttctgtgaatatttcttatactagaaagatccaaagcaaatctaggcaagcttagccctaccttgtcaaagataaatactcagataagttggaagttccgtttgctaaagtgcatctgggatcatatctaccctgctacttagagacagccaggaaggtggccatcactcatgctctttcactctttctgtgtcttatcaagagtcacacgtaacaatttttttttcaaaccaaatgctttatatagtgaactacaggaaaaacaattctaaatacacttttaaaatgctagagagttaagataacctcattaaagaaaaaatactgaaaatgtaaagggtccatacaaactaagagctgtattaagtgtatactttctattttaataattcacttggctgtgctcttaaaatgagagaagcagatattttacccatgtcttctggcaagagattcaaaagcagaagtagcaggactgtaaaatttcataaaatttgtgggattttttaaagctaaattattcaatatcttgtacagttttgtacccatatattaccccggaatatatgtacagcatcccagcaacagtgactgcaacaaaagtaaggtaaataggtctacaaagcatttgatttccttattagagaaagtttttatagaggaaatgcaaacaactgcaattcagatcacattatataagcttgatgattatttaaaccttatataaaattaaatctaacccttaccactacaaatctgtaaggaatcagaaaaggatttatagtacacaagtcttgattactgtttcattccactttgatatcactctgagctaaaacagcattcttccaagatttaaagaaaaatagattttataaaagggattcttttacattattattgttactgacagaaacaagttttgcttttttccactataattcgctctgatgaaagaaataattctctctcttaactcctaacaaacgctacattttcaagactaagggaattactggtggcattctttctccttgatctaaactatttgtctctaaaatatgtcaagtaagcttttaaagattcaggaaggggcagcgttgtgatttttttctcagtaaattttgaggtggctcctctggcttcattgcttcactgtgatctttttcttcctcttctttgttatcttccattttttcatcctcctctctgtccagaggctgaggaataagctgattacccacaaatatgtatgtgttagttctctgtttaactctctttttttttttccttttgggtggagccctttgcggaatccccttggcctgcatctcatcatttatgaaatttctaagtgtgcgtcgaatgtaaatacaagccaagccctgtggattcctgacagcacagggagggagtcccacagaatctggtttaccattatcattcttacttggctgcacaagtggagcaaatgacacaataaggatatttttcctttcccaagtgttttgtccagttctgcgttaactgatcctctacaggcatgatcctctacattcatttgatcttcaatcagtgataccctttcttccacttgatcaaatcagctactgaagcttgtgcatgcgtcacgtagttctcgtgccatggttctcagctccatcaggtcattaaggacttctctacactgtttattctagttagccattcgtctaatttttttcaaggtttttagcttctttgcagtgggtttgaacatcctcctttagcttggagaagtttgttattaccaatcgtctgaagccttcttctctcaactcatcaaagtcattctccatccagctttgttccgttgctggcgaggagctgcgttcttttggagaagaggcgctctgatttttagaattttcggcttttctgctttggtctctccccatctttgtggttttatctactttttgtctttgatgatggtgacgtacagatggggttttggtgtggatgtcctttctgtttgttagttttccttctaacagtcaggaccttcacgtcctcagctgcaggtctgttggagtttgctggaggtccactccagaccctgtttgcctgggtatcaccagcggaggctgcagaacagcaaatattgcggaatggcagatgttgctgcctgatcgttcttctggaagcttcgtctcagaggggcacccggctgtatgaggtgtcagtctgcccctactggggggtgcctcccagttaggctactcgggggtcagggacccacttgaggatacagtctgtctgttctcagatctcaaagtctatgctgggagaaccactactctcttcaaagctgtcagacagggacgtttaagtctgcagaagtttctgctgccttttgttcagctatgccctgcctccagaggtggagtctacagaggcaggcaggcctccttgagctgtggtgggccccacccagttcaagcttcccggtggctttgtttacctactcaagcctcagcagtggcggacgcccctcccccagcctcgccgccgccttgcagttcatctgagactgctgtgctagcagtgagcgaggctccgtgggcatgggaccctcggagccaggcgtgggatataatctcctcgtgtgctgttggctaaggctattggaaaagtgcagtattagggtgagagtgtcccgaatttcccggtaccatctgtcatggcttccctttgctaggaaagggaattctctgaccccttgcacttcctgggtgaggcgatacctgccctgctccgtgggctgcacccactgtctgacaagccccagtgagatgaacccggtacctcagttggaaatgcagaaatcacccgtcttctgcgtcgctcacactgggagcttcagactggagctgttcctattcggccatcttggaacctctctctcctcttttctttataaatcttgattttacttttatttgctgaaacagtctaatgccaattctcctttctatattaatggagaatgagcatgcagataagtgtctctatatgattccttgacagatttctttcagagactatgtctataaaaattagcccatctgagacccatcattggagccaactcattcctcaatttttaaaattttttttatggggggattacaggtgtgagccactgtgcctgacctatgactgtgtttaatattgttataaattaagacatactccttttcttctattgaatataaaattaattaccttatcaaaaatttaaacaagtgtcagtaattaagtgattaatcagctacttctgattgttcataaatggattatactttgtcagttttccttagtgatctaaatggttctctccctctgccaccatgtagaagggtcataggctatgaatagtggagttgtgggaggagaagattgggcccaggcacaatgagagtgaatatatagttttcactatgtcatgagaacagataagtctatctgggatagatttacatgttttggtggttgtattacactaacagagccacgaacttcagattcttcactttgttgagtactgttatacctaggcgagttagagaaacgccacactctgagacgaattaagagtcctttatttaagctggcggccaaagagacggctaatgctcaaaattctctcggcccggaggaaggggcttgattaactttcataccttggtttaggaaggggaggggaactcaaatgcagtaattctacagaagtaaaaacatgcaagaatcaaaagaagcaaatggttacagagagataaacaatttaaaagacaaatggttacaaaaagcaaggtaccaggtgcagggctctaaatccttcattataattagatataaatgctatgccggacaggaactcaaggctttatgttgttatctctttgaaaaaaatcctgggaacttcatacattgtttgtgccagtaccttatcagttaattgggctcctttgaaatgctgaggatctgcttacacaggtcaactccttgcggaaggaggttgggtaaggagcccttagtgtcttgtaaattaaggggtcaattggagtttgtccggctttcccagctagagagagtcttacttgagaagcaaggctaggtgattaaagagacaaacaggacaaaatttaaagtagcgagttagagtaaaaacaaggttaggcattacagtaccagctctattcttggacacaagtgttcccagccctgcctcacctggtttgcaataaaccattgcatatctgtcgcttaccttataccaaattattaatcatattgtgatgttattacaaagccttaattaaagatgatgcagtcttttgcagggattgaaattggttaggactgttgattgtcagctatttttgctacttacccctgtcttcttaccagggttgagagagagtaccgtactattactgctctctcttgccctttagttgtttaatgttagctgaagaaaccggagttaattatgaattgaatacacttatcctttgtagcttttgaattgttatttatttatttgtttgtctgaatttatgtgttctttattgttttggtgaataggtttggtgtttaggtttcataaaataaatctgtggatttgtcctagttcagagtgatacattgaaattaattttataatccataacttaaagcagtattcttcagccatttttctcattattccctcctaaggagcatttttagacctgttttctccctaatggcctaatgggccttctccccttcagatattttaatactacagatatacagtatataataactatgttatcagtagggttgaactttggagggctacagaccattgtagtgtttaagatttccaactctccataaggaccacttttattccccttagggatattgccccagttgagaatgtatgatttaaagctgttaaggccaggcatgggggctcatgcccgtaatcccagcactttgggaggccgaggcaggaggattggttgaggccaggagttcaaaaccagtcttgggcaacatagtgagaccctgtttctacaaaaaaaaaaaaaaaaaaaaaaaaagctaggtatggtatgtgtgcctgtaaccccagatatttgggaggctgaagcgggaggattgtgtgagcccagaagtttgaggctacagtgagctatgatcatgccactgcactccagcctggacaacagagtaaaaccttatctcaaaaaaagtagttatcagcctgcagtgatttttgtatccttcccaatccaatcatggcttacttcatttttgttactgtaaagaaatacctgagactgggtaatttataaagaaaagaggtttatttggctcatggttctgtaggctgtacaaaaagcataactccaacatagtatagttgagagttagacttaagtggcatgtacttcgcatgtttatgttttaaaaaaattataccaattatgtcttcagacattaaaatagtatgattttaagtgtttgatgcctgtgtcttctaaaaaaagtctttttgctttttatacaactctaacaagggactcagggtgcttccacaaatattagaaggtgaagaggagccagtgtctgtagattacatggtgagagaggaagcaaagggaggaagaggtgccaggctcttttcaacaaccagttctcttaggaactatgagtgaaaactcattcacttccacgagaatggcaccaagccgtttttagggatctgcctctactatccaatcacctcctaccaggcccccctccaacattgggaatcagattttaacatgagatttggtggatgatatccaaatgatatccatctaaatcatagacaccttcaggagacatttgacagtgtttggagacgtttttgcttgtcacaactggaagtggtgctactggcatctagtgtctagaggccagaagggatgttggtaaatatcttacaatgcacaggacagaggacagccccactctgccactcaacacagactcatctggtcccaagtgccagtagtgctaaggctactttgaagttcgagaaaatgaaagccagcctgggcaacatggtgagaccttgcctctacaaaaaaaaaaaaaaaaaaaaaaaaaaaatacaaaacttagcccaggcgtggtggtgcgtgcccatgttcccagctaccgtggggactgaggtgggaggatcacttgagcttggagaggttgagtcagcagagagccatgactgctgcactgcactccaggcctggcgacagaatgagaccctgtctcaaaaaaaaaaaaagaaaagaaaatgattgaaagtacataaattttctctttattcttttattaaacatcattcaattgagatataaaataaagtacagtattaaagatattatctaatttagttttatctacttaataggactaatgtccttatacgtaaagtaaaaagtatgaaatctttcttgcttggtaggaaatatgaattccactatagttgagagttagacttacgtggcatgtacttgccatgtttatgttaaaaaaaattgtaccaattatcgcctcagatattataatagtgtgattttaagtgtttgatgcttgtgccttaaaaaatttttttttttgctttttatacccctccctcctcattttggagatgcagaatagcataatgaactctgaagtcagaagtttgaatcttggttctgcagtttactagtttatgtctttggatacatagtggcataaacaaagtacctgcctgataggattgtgagaattaaatgagttatatataaagtacttattgacatataggaagagcttaaatgctaacctttattctgatctgttcaccatgctttaaatgccaagtaattttgctttcttttctctttgtagatttatggtggattattttctgaagatcagtgttggtacagatgcaaagtactgaaaatcatcagcgttgaaaaggcaggaaattaagtgttcagtttttttttgctttaagaaatatttattgtggttcaaaaatttgatgcttatttagcccttcattgcttattcgtagtactgatacctggttcagtgattaaaacacagaagaaattaattgctaaaaaacatgttgttttataatcacctcagattattcaagaatagattatataatatgtaggttatttttggtgactagttatttttacctcagttcttttttttttttttttttttttttgagatggagtctttctgtgtcgcccaggctggagtgcagtggtacgatcttggctcactgcaaactctgcctcctaggttcaagctattctcctgcctcagcctcccaagtagctgggattacaggcgcccaccaacacactggctaatttttgtatttttagtagagacggggtttcaccatgtttgtcaggctggtcgaacttctgacctcaggtgatccgtccgcctcagcctccgaaagtgctgggattacaggagtgagccactgtgcccagcctgcctcagatcttaataattatatttggttcttgagtaacttttaaatgttcattttattaagctttataagtaggagaagaacattttgattgattcttctgaagttaggtatatcttttatttagttgatgtgaatattgttaataataatgattggcttgccactttcttatgcctgggttaaatgtggtgagttttctttgtgttaagcttttttttttttttttttttttttttttgacattgtgaatttgtggaggatttttaagaggatttagggagacagaattctgaatagctgtttggtgacagttgcatattgcaggctgggtgaaagcacctctgtaagatttcctttggtgttttttctacacctcctttctgtacttaaattataatatgtatgtttttactgaaccagggaaagtggttcaggataaaagagaaaaagttaaaaatatgtatgtttcagaaatattttctttggtgtgataagatgctaagatgtgacaatttgattaatattctgaatagcttggtttaaaaaaatttcattttttgctgtcatagaaaatggtttattttagtggaatggaactttctaattgacctttctcccataatttgacaactggagatgatattttacatatgtttttcagttggctttaattttttaaattaaagggcagcatgatgtttgaccttgtaataactatttttcttttttactttttaaacagatgtagagctggaggtaagggtggtgaatctgattagtttacatggtctacctggagtgagtttaattgtgtcaaaggaagtttgataactttgcctttcttttcagattttattctttccaacttgaaattgaattgaatgttgattgattttaacattaggagaaacaggagagggctgtaagcttcataggctgatgtttatttaaaatatcaattgtctaaaaacaaaaagcaccctaatgagaaatggtactgttggaatttaactagtaacaagtaaagaaatcactgtaatttcatggactgtggattttttttttattttgaagatattagaaatctgtttctgaatgtattttgtcattttgaggtaagaatgctattttgatatacaggtcattaacagagagcagcaaattggtggtttctttggaaacatttaatctggggtcagtattcgtatttgtctcttattttttccagtgtctggtgaggtacattgactatggaaatactgaaattctaaatcgatctgatatagttgaaattcctttggagctgcagttttctagtgttgccaaaaagtataaactttggggactacacattccttctgatcaagaagttacccagtttgatcaggcaagtcacgtattttaaatatttttgctaatgaaagtaaaactatgtgcttgaaacaaaatgtaggtatagttaaatcttactttaatataaaagtctgtataaattagtgaaaaataggaattataattagaaagcaattatatatttatgctcatctttgctaggtaaacattgaacagataagaatgacatacacatatataatatatgtaaatagtttccttctgatgtaaatgtttaaaaggatagtctctttttgtttttttttttttttttgagacagagtctgactctgttgcccaggctggagtgcagtagcgtgatctcggctcactgcaacctctgcctcccaggttcaagcaattcttctgcctcagcctcccgaatagctggattacaggcctgtgccaccatgtccagctaatttttgtatttttggtagagttggggttttaccatgttggccaggctggtctcgaactcctgaccccaggtgatccacccaccttggccttccaaagtgctgggattacaagcatgagccactgcgcccagccaaggatagtctcttatatgatggagaaaataatgaatacagttatttctataattgttttgggaaagtatttattaaataaaagtgatctttacctagtcctggccataaataccacaaatttgaaattaatggggttataattaatcagattgtattattttggcagaggctcatactgtttgatgtaataattggcagtggatgttttgcttatgtggattctagtttatattactttccattgaattttgggttggtaacctaattctggaagacgttcgataatttcaggggtagtcttacaggaattctacctcttttaaaatctgttatacaaagatgattcttttggtaaatggtaatgctggtgagagatattacattggaaagtaatcagatttgtaattcttatttataatagcagctcaagtagctcatgtggaaaacagtttaatcattgtaagcattataaagaaattaattaaaattgcctctatttttctttgagaatcttgtaggtgtgttgggtatagttttgtctgctatgtagttacttataaaaaacatttctgtacatgaaactcaggctttcataaacatgaaatatagatattataaaattacaccccaagtttctggtttaaaatctaaagtttgttactttcttctttaatataaatgctttgaccaaggttggggaggcttgttttggatttcttgcatgcataaaactctaaaatcttgtttacggaccttagaatattatctgctctcactttgttttacatatagggaaattgtagtctagaataattaaatgacttcaagtcgtgaagctaactagggaagagctaggcctagaactcaagtctgttgttcttttcatagtaaaatgcacagatttgtgttgattgaaacacacatgaatcaagggggaaaaagacattaaaaaaagttaattttagaactgaattaataaactgcagctgagaatgtttttgtatgtttcaaagattctttatatatggtactgtatataaacatttatatatatatatatatatatattttttttttttttttttggttgggggttgaagtcttgctctgttgcccaggctggagtgcaatggcatgatctcggctcactgcaacctccgcctcttgggttcaagcgattctcctgcctcagtctcctgatagctggaattacaggcacccgccaccacgcatggctaatttttgtatttttagtagaggtggggtttcaccatgttggccaggctggtcttgaactcctgacttcaagagatccccctgtctctgccttccaaagtgctgggattacaggcatgagccacccggctaaacatttgtatttggatgcttagttcagtaaaaagatcattgattagagttaagctaattggcacacaatgttttctggaaaaaaatgagctattcttgaatagctctgcttagaaagtccgtgtttagttattaattctcagcccaaagctcaactctaatcttctatatgaagtctttgctaatacccacttacccggtcctctgtggtgttttagtcactccgtatataaagcctataaagttgtaattttttcctcccctacaagcttagtgagtttggtagagataagtattcacttttctgtgcctaatttccctgccaggtaggtgttagatgagcattagtttatctaacatttgaataaatagatgaacagcagggattcagtaacaacacaaatacctccttccttccccttttccagaaggtgtcctgggcactgaaattccttcacatttttttaactaacactttcacgctatgctgcagcacagtcagaattgatgctcagaatggtagtttgctgaagatcgagagaatattacattactagtcctacatgcctgactttaaaaattatatgtagggtaagggaatgagagctagagcttggaatttgtgtttaacaatttaaaggccttttagcttgttttctaatatatacaggcagaattcagaggaataaagtagaaagcaagtgatcctttcttgtttctgaatgaagcttaccagtttggaaaacagaatgaaatatatttctaaaaagtgacattcatcttttttaatgattgaaagccttatgttctaaaccagtgaccagatttattttaaaaagttaagttttgtccagtgcggtggctcatgcctgtaagcccagcactttcggaggctgaagtgggtggatggcttgagtccaggagtttgagaccagcttgggcaacatgggaaaaccctgtctgtataaaaaatacaaaaaaattagctgggcatggtggcgcatgcctgtagtccccgctactcaggaggctgaggtgggaggattgcttgagcttgaggggtcaaggctgtgagaccctgtctgaaaaaaaaaagataaaagttaagttttataccttttaaatgcctaaatatattttttaagtgcaggtatatatctccagctcataagggttagtggaaaatatatttcttatgataaaaattaaatgtttatatgtattatatataaagagaaaacatacatatttttggtatagtattaaaacacccatgtatcatatactctgtcattctttttgttagttggaactgaggaagactcagattttatttcaagttcagggttctgtgtttatgattatatatgattcagggagaatctgtttgaaccacttcatactaattgtgattggtgactgtaactaaaatgaatttgaattcagagagaaatctaaaattagatttctgcataaaaattctatgcaaggagtaatggacctttagaacattcagctttaggtaattgaaacttttgtagacaataggttatttccatttgaattcacgtattgcccaaagacagggtttcttgaaatattaataattccacatataccagcaataattttcaaagacttcctaggggcagaagttgttcttgaattttagatagacttttgataataagagttgaaagcaagggtttttatgtgaaagaggttaactggaaaactacatctaattgattaaaatcctaacatatatttcagttagttatattttgaggttgttagctttgcctgcttgatcccatttgattggtgataacttctggactgtatttgttatttatactgatataattgatataatatattgatataatatattgaattcttggtgaattcaaacctcttgatataatgtgtgtatttctgaattttatgccttggaaaatttataaaacctgtgtttttgttaacctaaagtattataggaattttatgccttgaaaaatttataaaacctgtgtgtttgttaacctaaagtattttcgtgttttgtggatttaaaaaattattttttcagctaggcacagggtgtgtgcctgtaatcacagctacttaggaggctgaagtgggaggattgcttgggcccaggagttcaagaccagcttgagcaaacatagcaagaccccatctaaaaaattctttttttttttttttttgggtagtgatagttggtgattcttgagcatatgtagtttgagtctccttctctgccccttcagatgcatccttgtaggcccaggtatcctcaacctgttgttaaaataaatgtgtcagctgggtgcggtgtctcacgcctgtaatcccagctctttgggagactgaggtgggcggatcacgaggtcaggagatcgagaccatcctggctaacatggtgaaaccccatctctactacaaaatacaaaaaattagctggtcatggtggtgggtgcctgtagtcccagctacttgggaggctgaggcaggagaatggtgtgaacctgggagatggagcttgcagtgagccgagatagcgccactgcactcccacctgggcgacaaagccagactccattcaaaaaataaaaaaataaaaaaaaaatgtgtcccaatgaaataattttttttgtaatcctatgtatttcatacatttaaaaacattctgagaaaaagtccaaagatttcacctgactgataaaggagccccatggccacaaaaaggttaagaattcctacatcggtctcaattttaccctctatactactgtgtagttgaagagaaaatagttcttaaaaatgttatttagtttcttggaccttgacttccccacaccccctatttcttttaaaaatgtgaccggtttgtattttgtggtttttagtgtgtttttacactcttgtttgtctgattattacgggtatgatgtcctgttcggtttgctttgtttgcataaactatattgttttttgtatttatagagtgggaatgtagctaaaaatacagctccaccttctaagagagatacgtttcatcagatgatgtccctatttcaaggaagttgtgaaccagtaaatttgagctgtacctacccattttgtgttttaagtttatgctttatatattccgaaaaagaatacttacttttaatttcctttatagtacgcacagggtgaaattcaggaaaataacctagagaaatttgggaagagcagttagattgtgtcaaagtaattttagtaattacagttttatggaggagtagataagttcttattaaaattaagtctcaatatgttccaatcccaaatatgttttaggtgtatctttgcttagttctattgatagatattcagtagctcaaagttagcaagcacctaatttctcatatgccagttgtacagttgtagccctcttaagcaaaagtctatttaagagagttttgaatgtagaaggccaggcgaggtggctcacccctgtaatcccagcactttgggaggccgaggtgggcggatcacttgaggttaggagtttgagaccagctcaactgacacggtgaaaccccatctctactaaaaatagaaaaattaggcaggtgtggtggtgtgtgccagtagtcccggttactggggaggctgaggcaggagaatcgcttgaaccggggaggcagaggttgcaatgagccgagattgtgccactgcactccagcctgtgcgacagagtgagattctgtctcaaaaaagaagaaaaacaaagttttgaatatgtatttgtgacacctcacattttataatttcagtttgttgatttttaaagaatttgttcgtattttgtgctttcggtttgtggctttttttgcttctgctcgtcttactttaaaaccagagttcctgactctgcctctaaaactttcaaagttttgtaaaatcgagtaccttttctagatatcagagattcatttttatgcgctattgcttttcaggagaccattatatttagttggggccaaagtaatcaatgtaatctgctgggttaaaaaaaactattctaggatatttacttagtatacatttttagatttataaaggtggctgcctgtacaagtatttagctctacttgattttagcaagtgtgtaattggaatacattcatatacgtggagatgcatatttgcatattatagccaacagcaaagtaatatagagattttagaatgaagaaatatgatgcttggaaaaaatgggtaggaacaaaataagggaagagaaacatgttggtgtagctggtttatgttttcttctttcttagggcacaacctttttggggagcttgatttttgaaaaggaaataaaaatgagaattaaagcaacctctgaagatggaacagttattgctcaggctgagtatggcagtgtggatataggggaagaggtgcttaagaaaggatttgcagagaaatgcagacttgcttccagaactgacatctgtgaggaaaaaaaattggatcctggtcaacttgttctcaggaacctcaaaagccccattcctttgtgggggcatagatcaaaccagtcaaccttcagcaggcccaaggggcacttaagtgagaaaatgactcttgacttgaaggatgaaaatgatgcaggcaatcttataacatttccaaagtaagaatttagtcttcactaatttctaattgatggtagaggtccctgtcatagtagaatagaagttaaggcttatgcttttggaatcctttactgtgtcagtgattttaagggctgatgctgatatttctgtttttctcaaatgtattcctctctgctttagcagggatattttcattaaaagctattttgaaagaaaaataactcctgaattattttaaagtttacataccaacttttcatgccaactatttggaatacacttatcaaaaataaaaatctgctcctaaatctgaattattcaggcaaagtcagaatttcagataagatttgaagttcttcctatggctttaggaatattttaaagagtttcaggaaattgcctttacttttttaataaaagtgaggctctttcttcttcttgtgaaaacttgtgatggagtttgattattccgaatactttactttttagataattttaaattatcaacttgaagcagaaatccagatttgatatttatatgtatcaaaacagtcttctatatcatggtccaagccatgatgctgtatcttggatgacatagctgtttgatgggatctcatcagtgctttaggagctaaactgtcaaatgggggtgggaggcggtggacggggggatcacaggggatcacaggacggggggatcacgggggggggatcacaggagggactggaaaaaaactaatacagaaatgctttttactttgttctctgtagttgatagtgctatgaagaagttggaatatttttttttgagaattagaggcattattgaattacgacttcagttataaaatcttgtttgcattaaattattttttaatattatgaactaggtaaatattttagttttcaaaattaactttcagatatattgtggcataaaaggaccaagataacttagatttgttttctgtgtcagccttatacagtttgtttgtcaaaataaatgaatttgtttttatagggaaagtttggctgttggtgactttaatttagggtctaacgtcagcctggaaaaaattaagcaggaccagaaactgattgaagaaaatgaaaaacttaaaacagagaaggacgctcttcttgaaagttataaggcgttagaattgaaagtagagcagattgcccaggagctgcaggtatgttcagtggcttaaggtgaagagtgtccaactgggaaatctgtgtactcatctgctgctatttatttttctgtcactttcctttccttccccacctcattctctcctttgctaatccctgtatttgtttataggtgaattttttttcatatactccagactaatcatctttggatttcattggatgtttgcaaatttaataatttctcatttacatttccctttatgttctaaaaacttttcaactaaggcaattttcaaacattctaaaaggagagagacttgaataattaattctcatgtgcccatcacccagtttatacaattataacacatggccaatctttttaaaaatttacacttcctggattattttagaagaagtcccattcatattatttcatagtcttcagtatgtatgactaatagaaaaggactttaaaaaaccgtaataataatactattcatacttaaaagtaaacaataattccttaatattatttatatccaggcagtattcaaatttgccatattgtgtcatgaatgccacatgattgtaggcatgttgattgtagttttctccaatcaggatcccagttaggcacatacattgcattttggttgatatttctcttaaattgctttaatgtgtttccttgtgttgcttaactggattcttgatctccacgtgtgtcttcttttatggtaatcacgtctccagatttgctcagattttagttcagaaattttcccccccagggatacagtgtggttgataagtgtgtgtgtgtgtgtgtgtgtgtgtgtgtgtgtatgtgtgtttaacaccaaatctgttgttcctgcactagttcctccaattctctgacaccaactgggtgtctaataattcagctccattctgacactacattacctgtacttagcatataccctacaagttaaggactcagttccataaagctgcctctactttagatgccagccacaaatggggtccccaggctacttgcatatctacccccccactataaattcggggtttcccatgaccctccctcaggttagataattcactagaactactcacagaactcacggaagtgctatacttacagttttattattaaggatataactcagaaacagccaaataaatggaagatatatataaggcaaggtactggggcaggaggtacagagcttccatgccctttctgagtgtgccaccctcccaggtcatggatgtgtttatcaacccagaagctccccaaatctcattcagagtattttggttttgtttgtttgtttgttttgagacagtcttgcaacatcttgctctgttgcttaggctggagtgcagtggtgtaatttctgctcactgcaacttctgcctcccggactcaagcaatccactcacttcagtctcctgcctagctcggactataggtatgtgccccattcctggctaatttttgtgttttcttttctttttttttttaaactcaaacttgccttatttatatccccaatggcatgatctcggctcactgcaacctctgcttcccaggttcaagcgattctcctgcctcagcctcctgatagctggcattacaggcacccgccgccatgtctggctaatttttgtatttttagtagagacggggtttcaccatgttggccaggctggtttcgaactcctcaggtgatccacccacctctgcctcccaaagtgctgggattacaggcatgagccactgtgcccagcccacattttctttatccagtctatcattgatgggcatttgggttggttccaagtctttgccattgtaaatagtgctgcaataaacatatgtgtgcatatgtctttatagtagaatgatttataatcctttgggtatatacccagtaatggtattgctgggtcaaatggtatttcttgttctagatccttgaggaattgccacactgtcttccgcaatggttgaactaattcatactcccaccaacagtgtagaagtgttcctatttctccacatcgtctccagcatctgttgtttcctgactttttaatgatcgccattataactggagtgagatggtatctcattgtggttttgatttgcatttctctaatgaccagtgatgatgggctttttgtcatagttttttggccgcataaatgtcttcttttgagaagtgcctgttcatattctttgcccactttttgatggtgttgtttttttcttataaatttattttaagttccttgtagattctggatattagccctttgtcagatggacagattgcaaaaattttctcccattctgtaggttgcctgtacactctgatggtagtttcttttgctgtgcagaggctctttagtttaattagatcccatttgtctattttggctcttgttcccattgcttttggtgttttagttatgaagtccttgcccatgcctatgtcctgaatggtattgcctaggtgttcttctagggtttttactgtttggggttttacatttaagtctttaatccatcttgagttaatttttgtataaggtgtaaggaaggggtccagtttcagttttcttcatatggctagccagttttcccaacaccgtttataaaatagggaatcctttccccattgcttgtttttgtcaggtttgtcgaagatcagatggttgtagatgtgtggtgttatttctgaggcctttgttctgttccattgatctttatatctgttttggtaccagtagcatgctgttttggttactgtagccttgtagtatagtttgaagtcagatagcgtgatgtctccaggtttgttcattttgcttaggtttgtcttggctatacgggctctttttggttccatatgaaatttaaagtagttttttctagttctgtgaagaaagtcagtggtagtttgatgggaatagaattgaatctatcaattactttgggcagtgtggccattttcatggtattgattcttcctgtccacgagcatggaattgtattttctgtacagtcagggtttgctgtgttgcttaggctggtctcaaacttctgggctcaagcaatccttcctcttttggctccagagttgctgggactacaggcgagccaccatgccttgctaaattaatgaactttaaacacatttgacatgttttaatccactgaagccattttttttctttttgatgcacacattatcccctttgaagtctttttaaattagcttctgtgtccttttgacatcataacagctgatattcataatggataaatcaccattattaagtttttcattaatctgtgacctaatgatttttgcagccatcgatggttgttgtctgcaagcatgttttcatcaggtgctgtatttcttttttttgtttttattattatactttaagttttagggtacatgtgcacaacgtgcaggtttgttacatacgtatacatgtgccatgttggtgtgctgcacccattaactcgtcatttagcattaggtatatctcctaatgctatccttcaccactccccccaccccacaacagtccctgatgtgtgatgttccccttcctgtgtccatgtgttctcattgttcaattcccacctatgagtgagaacatgcggtgtttggttttttgtccttgcgatagtttgctgagaatgatggtttccagcttcatccatgtccctacaaaggacattaactcatcattttttttggccaggtgctgtatttcttagctggaaaatttcaactatttagtcatgctgaagcctagtttgttcagtaaaggcaagataaatactttattcattccctttatatgtacatgttttcagaaaaataagtttattccctaggattgtccagtgttgaccagcaagggttatttgttctccttaagtattattatgaactaatgaattttaaacatatttgagtgttttaattcactgcagccattattctttttgatgcccatcttatactctttggaagtctctttaagttgttgctctgtccttttgatgtgattccagtagtctgatagcttccttgttttctggtgtcacaagatgttccatactcatctgcatttcctaccctaatcctggaaaagttatttctccaagctatagttctttttagtggcaagaggtatttagataccagactttgggtgctagggatatatatagctattgctttagtctttgcttctaggttatagaatgtctaattgatagggttaggaaatattattttctaatgctatattgagatatcatttacatatagtaaaaatgcacaaatactgtgtagaacttgataaattttgacgtatgtatactctcatgtaacctgaatcaccctcatcaagattggctgatgaaactatcattaatcagatatttcacctagtatcaagctctaccaataatttcagggacacaggtaacaaagagactcctttgttccagagcaggtgccccagtctctgaccagagactagaatgtctgctgtggctactgctgccaggcatcaaacaatgtctctaaactctcataagggtgccatctgtagtattgtaactagagagggtggggcccctctcaggtgagcagtgtggatatgaagcagtggggagtgtgttctactcaagtgtaagtctcacagcagcctatagcagagctttgggtgttgtcccaggtgtgcataggagagcctggcttttctgccccttcttggctgggcagcagctgcagtcatgtcagcctaaagtcaggccaaagttgggccacagctcagaattaaactctccaagtgacacttttggcctgtgccctgggatactggggcaccaccctggtgaacagcatgggcaaaaagctgtgggaagtgtagtctgattgtgtctcagtttcacagcagcccattgcagggctgtgggtattctatagatatgtgtggggtagcctggtttccctgttggtcctttgctgggcagtgactggggctgtgtcagcccaaactcaggccaagggcaggactcagcccagcattgaactcagaaaatggtgccttgggcatggggctagagagaatgagtcaccacccagccaagcagcatgagcaagaaggtgtatggagtatgatctacttatgtctcagtctcaacagcagcttgtagcagggtgacaagtatcctcctgggggtgcatgggcatgcttgttctccctctccttttttggagcagtacagtggctgcagccatgtctataggtccctggtatctaaactcttaaagtggctccctgctgaggctgctccagacttgggtgcctgtgggattctgtgtggattccttttctggaacaatgtctttgtgtgatctttaggcagctccatatgtgaggtgtgaggccctagtggatcgagggtttctcctatagccaatgttgtaaatgcttgtttcagagctctggggatttttctcttactgtttccctgcgtacagtagcctttcccagctctcagctggtttctggctaggcatgcttcctcaaaccctctcctttcttacttctggggctttctctctcttctctggtgaatccaaatattcattcttagtctgttcaaaatgtgtctacttaactatttctgattcttccctgtggaaaaggcacacactatctagttggccatcttgattattttctctctcactcattgtttatcattgtggtttggtgtgtttctgtagtgggaacatttgattcctttcttgttttacttgtgtgtttgctttactctgtgggttttatacttttttttttttttttttgagacagagtcttgctctgtcgcccaggctggagtgcaatggcacggtcttggctctctgcaacctccacctcccaagttcaagcagttctcctacttcagccccctgagtagctgggattataaggacctgccaccatgcccagttaatttttgtactttttagtagaaacggggtttcaccatgttggccaggctggtcttgaattcctgacctcaggtgatctgcccacttcggcctcccaaagtgctgggattacaggcgtgagccactgcgtccagctgggtttttaactttcatgtgtttttatgatcacagattgtgtattgccctcccttaagcatctcttgtagggatggtctagtgctgatgaattccctcagcttttgcttgcctgggaaagactactacttcttcattcatgaaagacaactttgctggatatagtattcttgactagcagtttcctttcagcgctttgaatatattgtttcattctctcctgtaaggattttactgagaaatttacagttaatctgatgggggtttccttataattgatgacacgcctttttccttctgtttttagaaatatctttgtctttgacttttgacaggttgactgtaatatgctgtggagaagacctttatgaattttatctgtttaggcatctctgaacttcttttatttgaatgtctaaatctcttgctagacttgggaagttttcagctattttattaaatataagaagtttttgatccctttttttctctttttctgtgacattgaaaattcaaatacttgtttgcagtgtggtgtctcatatgtcttgtaggcttttttcattcttttttgttctttttttaaatttttgattgactgggttagttcaaaagtcttgtcttaagttctgaaattctttcttctgtttgatctagtattttttgttgttgtttgttttgttttgaggcagggttttgttttgttgcccaggatagagtgcagtggcacaatcacagctcactgcagcctccaacttctgtgctcaatcagtgctcctgcctcagcttcctgagtagctgggactacaggtgcatgccaccatgctgagctaatattttaaatttttattagagatgaggtcttgttatgttgaccaggctcttctcaacccctgagctcaagtgatcctcctgcctcagcctcccaaagtgctgggattataggcgtgagccatcatgccaggcctagatctagtatattgttgaagctttggaatgtattttgtatttcattcggtgaatcctttagttctaggatttctttttttttttttaatgatacctatttggtaaatttctcatttataacctgaattgtttttctgatttctttatattatttttcagaattatcttttatctcactgaacttatttaaaatcagtattttggatttttcatctggaatttcagaatttctttttgattatgatctgttggtggagaattactaacttcctttggagttatattttcttgtcttctcatgtttcttttgttacattgatatttgtgcattgggtgtaacagttgcttcttccaattttttggaaataattttgtaggggaggatcttttcctgaagatgtacccatggtgttggttgggtagggccctttggctttaattctgggttcatgcagtagcatagtctttgtatgattcctttggatgtgaatagtcagtggcgtttgtgatttcctcaatggcttagggtgtggttgttagtgggggctgcggagaagttttgctgggtaaaggaatgccatgtttgccagtcctcagaccccaatggtggcaatgccaggccaagtatgcttgtccttggtttccaggacagcacatgctggcactactgttagaaagcccaggttggccagtgcttgggtttccaggagtcttgcttgggtgctagtagcagcagtggtgggccagacaggtgagtgtgttcttgggctcttaggcagtgggcacgatgtgggtgatagtagcaatggcttgacaaccctgtgctttccaagtggtctacactggtgttagtgctggctgtgatgtgctgagtgggtcagtcaggcccacaggtagcatgtgcaagtggatgccagctgtgttggtagtggcaggttgggtaggcctgaccttgggcccttgggaggagtgttgaggtaccaatggtggactgggctgggtgatacccagggccttgggtggtgtgctcagacactggtgagaggggttatggagctgggtagagtggacctgtcctcaggtccaggtggtgagtgcagactctgattgcggtaggcaggtgcaggatgatgcccaggtttccagtggaatgcttgagtgggggtggcagtggttgctttgcagccctgtcactggggagggtgaggttgctttcactggcagcagatgtgtggaggtggctggtgaacatgtactttgctcttacatttgctccagtggaggcagtttgcaagggcagcagctgcaggtgggaaagtttgtcctttgggtgtgtgaaaatgtgcagcagctttgctgcttagggcagcggggtcactgtaaatggctcacactttgacactggtggcagcagcagctagcattgcctcaggttctgggttgggtagccctcccttgggtcatgtgaagatgcatggctacccttctgctggtggggttggggttcctgccagtggcttgcagtttggcctcaggtgtggcagcagctagtgacaatggtggttgtgggatggggtagcctttcctctgggtccgtgaaaatgcatggttgcccttcttgggcgtagagtggctgccagtggcttgtgttttgattctgtggcagcagcagccagtagtggtggtggctgcaagcaggatagcatttcctcagggccatcaagatgtatggctgttcctctgccgtagggaacagggttgctgccagtggctcctacctcttcgcgggtacttgcagccagctgcagtggtggctgtgggcaggagatgtcagctttgctccagggttgtggagttgtaggggatgttgggccctagaccatgatgcagtctacttggggctgggcacacaaaatggcagcatgctgtagttgcttaggattggggggtgggtgtatgggacccaacatgagctccctgtatggagcaatatacttgtgtagtctctgggcagctctctgtgtctcagagcacatgaggatcaaaggtccctttcgtggctagaattgcaggagtttgcagtgagaatatgggccactggggtctctcatttaccccttctatgcattgaggagcctgtccaggctcccagccaagaaggctgcttctcttctttctccttccttcctttatgtgtttcctgtcacttctctgttgaagtcccatttctctcttagatgatctatttgaagtgtgattatctacttgctattttggctcttttctcagagggaggcaaataacagtggcctctagtgagtcatcttgaagcccctgtctgaaataatgtaatctaacaaacacgtttttgtgtgttatatttattgtatactgtatctttacaattaagtaatctagagaagggaaaatattattaagaaaatcataaggaagaagaaatgtatttacgttttattaagtcttaatcctcattgtcttcatgttgagtaggctgaggaggaagagcatgggttggtcttgtctcacaggtgacagagatggaagaggtggagggataaataagttaaataattttaacttaatattatttaattttaaaataagttaaaattatttaacttactaacttatttaaaaataagttaaaattattttaaaataaattaaactttttacttttttttctcaataagttatacaaggtgtaccaggcaggcacaccttgtgtaactttttgagaaaaatctgtttgtaagtggatctgtgcagttcaaacctgtgttgttcaggcatcaactatgtttcttttcatacattgttggattcagttttctaattttttggagggtttttacatatatgttcgtgacatatattggtttgtggctttctttttgtgtaatgttgttttctgatttcagtattagggtgatgctggcctcatggaatgagtttggaagtatttcctctgcttctattcaatgactgagaattggtatagttttttccttaaatgtttggtagaatttaccagtgaacttatataggcctgacattttctgttttggaaggttattaatggttgattcaattttaaaaatagaaataagtctgttcagattatttttttatttttatttttttggagacggagtctcactctgttgcccaggctggagtgcagtggcgcgatgtctgctcactgcaagccccacctcctgggttcacgccattctcctgcctcagcctcccaagcagctgggactacaggcgcccgccaccatgcccggctaatttttgtatttttagtagagacggggtttcactatgttagccaggatggtctcaatctcctgacctcgtgatccacccgcctcggcctcccaaagtgctgggattacaggtgtgagccaccatgcccggcctgttcagattatttttgtgtgagctttggcagattacgtctttcaaagaattagttcatttaatctaggttatcaaatttgtgggacttgagttgttcataatatttttaagttttaatttccattggatctgtactgatgccctctctttcatttctgatactggcaatttgtgtcctctgtctttttttcctttattagcctggttatagtgttaccaattttattcatcttttcaaagtatcaacttttggttttgctggtttttctctcctgatttcctgttttcaaattgattgatttatactttcctatttttgcatattaagatttaatttgctaaaggagatttaatttcctaagaagcaaacttagattattaatattagtttcttttcacttctaatatatacgcatttcaatgctgtaaatttttgtcaatgcactgcctgtgctgcgttctacaaattttggtaagttgtatttttatcttgaaagtatttttaaatttgtcatgagatttcttctttgactcatgtgttattagtaatgttggttaatccttacatgttttgagatttttttcaattatctttctgttattgatttttagcttattctactgtggcctgagagcagacattgtacggtttctattcttttaactctgttaaggtgtgttttatggcccagaatgtggtggcgtattttggtgaatcttccatgtgatcttgacaggaatgtatattctgctgttattggatgaagcatagttcacccttgaacatgagtttgaactacatgggtccacttatatgtggatattttaaataaaagttacatcagttatgcctgcctctccagcctccccttccacttcttccctctctgccatcggtgagataggaataccaacctctcctcttcctccctgtcctcagcctgctcaatgtgaagatgagggaggatgaagaccttaatgatgatccacttccatttaatgaatagtaaatatatcttctctttatgcttttcctaataacattttcttttttttggcttactttactgtgagaatacagtatataatacatataacatacagaatacttgctaactgatggcttgtcttatcaataaagcttctggtcaacagtaggctattagtaattagctttctgtggaatctaaagttatacataaattttcaagactgttgggggttggcacccctaacacttgctttgttcaagagtcagctgtagtctgtagatgttaattatcaactgtacactatagatgttaattatatccaatttattggtgttgagttcaaatgtatctttactgatttttccatgctagatctgtccacctctgatagagggatgttgaagtcatttttgatttccgttacagtgttttgatatctaacatttctttttggttcattcttaggatttccatctctttgcttacattgcccgtctgttgttactacatgctatctactttctccattatgatgcgtagcatattaatcataattgttttaaattcattgtctgataattccaacatcccgtctacatctggttctgaatgttttctttcttcaaactgtagtttttgccctagagtatgccttgtaattttttcttttcttttcttttcttgttttttttttttttttgagacagggtcttgccctgttgtctagtctggaatgcagtggcgtgatcttggctcactgcaacctccacctcccggactcaagtgatcctcccacctcagcctcctgagtaactgggactacaggtgtgcaccaccatgcctggctaatttttgctttttttttttttttgggggtagagaccattttgtcttgttgcccaggctggtcttgaactcctgggctcaagcagttgacccacttcagcctcccaaagtgctggaattataggcattagccactgtgcctagctgtaattttttcttgataactgtatatgatatatcaggtaaaaaagcaattggtttaaatatgtctttaataatgtaattgtaagatgtacgcgggagtgatgtgttgtatagtcctgtgattaggtctcagtctttttgtgagtctatgtctctggcccatgaattcacaagcatttctcaattttttcctccccctttaggtgggataggatggctagagtaggatggaattgggtatttacctcctcccatgtggaaggatagagctggctggagttggatatttccatcccccaggtcagttaggctttgatgaaacctcagcaggttaggctctgcttaactggtttcttttcagggtagatcttattaagaagtacagagtgctctgggatatttcagaatggtttgtttccccccccgccactgctggaaacatgaggggattttactgcgatgatatgtatgatactgtatttactgtgagaacctgatctagctcctggaggtaaaattcacaaaagcatgggggcccccatgactggatgcccctggagctttcaactctcagtcgtgcccacacctagtttccagcagtttgtcagcagtccaggttttcctatctaggcactgcttcctgtagaaatttctgttccagtatgttgtgattctctgtatccctgtctgtctgtttaattttaggagtagcagttttcccagtgaccctacctatctcaccttttcttacagatctgagaaaagttgttgatttccactttgttcagctttttaatatgtgttaggatggcatagtgacttccaggctccttacatgtgaaaccaaaacctgaagtccccatattattgttttaaatcttttgttcttttgtaatatacttttagagataaagatttctttctaagcattgctttatttacaaaccacaaattttgatatgttttgtttattatttagtgaagcatatttacaacatttcctcgtgaatcctagtttgaaccatgagctacttagaagcatgttgcttaatttccacaaatttgaagatttccccaatatacattttatttttttcttggtacatagtatttgtatatgtttactggtgtatgtgtgatattttgtcatatgcctagaatgtgtaatgatcaagtgtaggtatttaggatatcgatcacctcaaggatttatcatttctgtgtgttgggaacatttcaagacctctcttctagctattttgaaatatacaatacatcattaactgtagtcatctgctatcaaacattagaacttatcccttctatctaactgcgtgtttgtacttattaaccaaactttctttattcttctatccctaccacatccttcctagcctctggtatctatcattccactctctacctccatgagatcaactttttttagctcctacatattaacaagaatgtaaaatattttctttctgtgcctggcttatttcacttaatagaatgacatccagttccatccatgttgctgcaaatgacaggatttcattctttttttatggctgaatagtatcccattgtatatactgcattttcttgatccactgatggacacttaggttgattccatgtctttgatgttgtgatagtgctgcagtaaacttaggagtgcatgttaattcctttcttttggataaatactcagtggttcctgcaatatattttgttactgatttctaatttaattttattggtatcagagagcatactctgaatggtttcagtccttttaagttgattgacatttgtttcattacccagcatatggtctgcctggaaatgtttcatgcatttttaaaagttatgtgtatcctatagctgttgggtgaagtgttttataaatattaggctgaattggttgatagtggacttcaagtcttttagaccctgacagattctttctctacttattcaatcaactactgagagagaagtactgaaatctaaatattattgtagttttgtctgttttattcccttttgttctattagattttgtgatttttttaaaaaaagttctattattatgcaaatatacatttagaattgttggatctttttgatgaattgacccatttatctttatgaaatgtctctctttattgcttagaaaatactccctgtgccaaagggagttgttgcttgacattaatacaggcatatttgcatatagtatttttattcgaagttcctagagcagtcaaatctgtagggacccaaagttgaatggtggtttctgggggcttgggggagggggaggggagatagggagtagtgtttgagagatagagttttaattaggaaagatgaaaaagttctggagatggatggtgctgatgattgcacaacaatatgaatgtacctaatgcaacagaactatacattttaaaatggttaaaatgataaattttatgttatgtatattttaccacaatttaaaaaaagacatagcaccaaaaaaagatgatgaatgaataaattccaaaaagctgtgccaggagtgataatgtatagtttgtttagaatcattgaagccttcattctttatttaattgaagcagttaaaaataaatattaatttgaaataaaaatcagcagctagattctattatattttattcaaatttggaatttttttttttttttttgagacagagtctggctttgttgcccaggctggagtgctgtggcacaatctcgcctcgctgcaacctctgcctccctaactcaagccatcctctcaccttagcctcctaagtagctaagctacaggcatgcaccaccacacccatgtattttttcgtagagacggggttttgccacattgtccaggctggtctcaaacttctgagctcaaaccatctgtcctccttggcctcccaaagtgttggaattacaggcatgagccactgtgcccagccaaaaattatttaaattatagcagaaatacagtttcctatttgggtctcacgagaatgtgtttattctttgtttcagcaagagaaggcagctgctgtggatttgactaaccacttagaatacactctgaagacctatatagataccagaatgaaaaatctggcagctaagatggaaatactgaaagaaatgaggtaggtaaaagcatatttttcagaaggatattttaaactaatttttaatcaattggtgctttgtttaaattgtgtgcttgccatttttgctttaaaatttaacctttgtatttttatgacttcaaagagagaaagatagttatttctgagatgaattttatactgtttttgtcaggtttctactgtcactgcttggagctagagtgttctaaggttataactgagactgaaattgaaaaaacagcaacatagcttttaagtgatagtttgatgggaaactaccatatccagttattttgcttggggttattttcaggagtacagcatgtccttgaataacgtgttttcattcaacattatttcattataacattgaagaagaaaatcaattcctagctggagccccactgtctgtgtggagtttgcacattctctccatatttgggtggttttcttggaatactgtggtttcctctcacatcccacttaggtgaattggtgtgtctgtattgtcccagtatgagtgagtgtgtggatgagggtgagtgtgccctgcaatgcaagggtgtcatgtccaggattggttcctaccttaatgctctgagctgctgagatagatgtggccacctgcaacccctggattggaataagcgggttggaaaatgaatgagtgaatgagtatatacagattatcataaaataaaaatttgtgaagtatgcaagaatcatacagatgcctttgcaataagcgatgtgacatgaaagcattcagcaagcccactacgtttgttattgtttgtttttgaacctgtggtggtagggggcgcttcttagaattttcgcttgcaaacatttattccttgatttaaccctactgtcacccactcattcaccaaagtttgggtaaataattatctttgttgtttttattgctttttcttaaatgtgtgtataggacacgtatattttagtgtttaatattagaaatgttttgggtctttatttggaagtgctgtttttgtgactaaaaatatgccataggaacttaactcttgtttagatcaattagcctatgatactatgggtttcttatatgtcttttctcttagacattgtaaattatctgtagaccaaaaattgaaggttcatttgataccatttcaaattctgcagactttcgaagttgccttttttatagtttaaaaaatttttaattttttcatattttttatgtcatgaaattagtatatccacagttgttttttaattaaaagtttatattaaattatgcatgtctgcataaaaatatgtggactgaaaaaaataagttatacatgattttatataaagttttaaaaggtaccccttcaaagccagtgctgtaaacactaacttttagaccattactattaaagtgtaactttttctcacaccagctttctaatttattgatcttcttctttttgatgtttttaaaaataggcatgtcgacatcagtgtccgtttcggaaaagacctttcagatgctatacaagtgttggatgaagggtgctttactactccagcttctttgaatggattagagataatatgggcagaatacagtctggctcaggagaatattaaaacttgtgaatatgtggtgagttgggaatttttctctattgtggtttttatctgttgaacataaggaagtgtttttttaatttcttctaaaaaaaataacaggatacatgtgcagaatgtgcagatttgttacataggtatacatgcgccgtggtagtttgctgcacctgtcctctaaattccctccctcacccccccatttcctaacgagccctggtgtgtattgtttccctccctgtgtccatgtgttctcaatgttcaactcccacttacgagtgagaacatgtagtgtttggttttctattcttgtgttagtttgccgaagatgatggcttccagcttcatccatgtcgttgcaaaggacataaactcgttcctttttatggctgcatagtattccatggtgtatatgtaccacattttctttatccagtctatcgttgatgggcatttgggttggttccaagtctttgccattgtgaacagtgctgcagtaaacatacgtgtgcatgtgtctttatagtagaatgatctatattcctttgggtatatacccagtaatgatattgctgggtcaaatggtatttctggttctagatccttgaggaatcgccatatcgtcttccacaatggttgaactaatttacgttcccaccaacactgtgaaagtgttcctgtttctccacatcctctccagcatctattgtttcctgactttaatgatcgtcattctaactggtatgagatggtatcttcttgtggttttgatttgcatttctctgatgattagtgatgttgagctttttttcatatgtttgttggccacataaatgtcttcttttgagaagtgcctcttcatatcctttgcccactttttgatggggttgtctttttcctgtaaatatgtttaagttctttgtagattctggatattagatctttgtcagatgggtagattgcaaaaattttcttctgttcaggagaacaggttgcctgttcactgtgatgatagtttcttttgctgtgcagaagctctttagtttaattagatcccatttgtcaattttgacttttgttgcatttgcttttgttgtttttgtcaagaagtctttgcccatgcctatgtcctgaacgctattgcctgggttttcttctagggtttttatagttttaggttttacatttaagtctttaatccatctagagttaatttttgtgtaaagtgtaaggaaggggttcagtttcagttttctgcatatgtctagttttcccagcaccatttactgaataggagatgctttcccaattgcttgtttttgtcaggtttgtcgaagatcagatggttttagatgtgtgatgttatttctgaggtttctgttctgctccattggtctatatgtctgttttggtaccagtagcatgctgttttggttactgtagccttgtagtatagtttgaagtcaggtagcatcatgcctccagcattgttccttttgcttaggattatcttggctatatggggtcttctttgaatccatatgaaatttaaaatagttttttctaattctgtgaagaatgtcaatggtagcttgatgggaatagcattggttctataaaattttttggccagtatagccattttcatgatattgagtcttcctatccatgaggatggaatatttttccatttgtttgtgtcctctcttatttccttgagcagtggtttgtagttcttcttgaagaggtccttcacatcccttattagctgtattcctaggtattttattctgtttgtagcaattgtgaatgggagttcattcatgatttggctctttgcttgcctcttgttggtgtgtaggaatgcttgtgatttttgcacatttattttgtatcctgagactttgctgcagttgcctatcagttcaagacgtttttggggtgagacgatggggatttctaaatataaaatcatgtcgtctgcaaacagacaacttgtcttcctctcttcctatttgaataccctttatttctttctcttgcctgattgccctgtcgagaacttccaatactgtggtgaataggagtggtgagagagggaatcgttgtcttgtaccagttttcaaagggaatgcttccagcatttgcccattcaatttgaggctgtgggtttgtcataaataactgttactattttgagatatgttccgtcaatacttagtttactgagagtttttaacatgaaggcatgttgaattttatcgaagccctttctgcatctattgagatagtcacgtggtttttgtcattggttctgtttatgtgatggattacgtttattgatttgcgtatgttgaaccagccttgcgtcccagggatgaagtggacttgatcgtggtgggtaagttttttgatgtgctgcgggattcggtttgtcagtattttattgaggattttcgcatcgatgttcatcagggatattggcctgaagttttctttttttgttgtgtcttttcccggtttgggtatcaggataatgctggcttcataaaatgagttagggaggagtccgtccttttcagttgttgggaatagtttcaaaaggaatggtatcagctgttctttgtatttctggtagaattcggctgtgaatctgtctggtcctgggctttttttggtcggtaggctgttaattactacctcaatttcagagtttttgttattggtctattcagggattcagcttcttccagaaggggtggccagcccctgcacacctgtgggcgtttctcgtcaggtggaacgagagacttgagaaaagaaagagacacagagacaaagtatagagaaagaaaagtgggcccaagggaccggcgctcagcatgtggaggacccgcgcccgccggcaaaggtctctgagttccctcagtatttattgatcattatctctaccatctcggagagggggatgtggcaggacaatagggtaatagtggggagagagtcagcaggaaaacatgtgaacaaatgtctctgtgtcataaacaaggttagaaaatgtgctgtgctttgatgtgcacatacataaacatatctggtgcattaaagagtagtattgccgtcagcatgtctcacctccagccttaaggtggttttctcctgtctcagtagatagaacatacaatcgggttttacaccgagacattccattgcccagggatgagcaggagacagatgccttcctcttatctcaactgcaaagaggccttcctcttttactaatcctcctcagcacagaccctttatgggtgtcgggctgggggacggtcaggtctttcccttcccacgaagccgtatttcagactgtcacatggggagaaaccttggacaagacctggctttcctaggcagaggtccctgcggccttctgcagtgttttgtgtccgtgggtacttgagattagggagtggtgatgatttttaacaagcatactgccttcaagcatttgtttaacaaagcacatcctgcatagccctaaatccatgaaaccttgagtcgacacagcacatgtcgtagggagcacagggttgggggtagggttgcagattaacagcatctcaaggcagaataatttttcttaatacagaacaaaatggagtctcttacgtctacttctttctgcattgacacagtaacagtctgatctgcctttcttttccccacactacctggtttagtcttggtagggtgtaggcatccaagagtttattcatttcttctagattttctagtttatttgtgtagaggtgtttatagtattctgtgatggtagttggtatttttgtggggtcagtggtgatacccctttaacattttttgttgagtctatttgattcttctctctcttcttcttagtctagctagtggtctgttttgttactttttttaaaaaacagaccctagattcattgatttttttttggagtgttttttttgtgtgtgtgtgtctctgtctccttcaattcttctctgatcttatttcttgtcttctgctagcttttgggttcatttgctcttgcctttctagttcttttaattgtgatgttaaggtgttgatatgagatctttctagctttctgatgtgggtatttagtgctataaattcctctcttaacactactttatctgtgtcctggagattctggtacattgtctctttgttctcattggtttcaaagcacttcttgatttctgccttaatttcattatttaccctggagccattcaggagcaagttgttcagtttccatgacattgtgtggttttgagtgagcaatactaaccttaaatgtaaatgggccaaatgccccaattaaaagacacagactggcaaattagctaagtggtcaagactcatctgtgtgctgtattcaggagacccatcttccgcacaaaaacacatacaggctcaaaagaaagggatggagggaaatttaccaaacaaatagaaagcaaaagaaagcagaggttgcagtcctagtctctgataaaacagactttaaatcaacaaagataaaaaaagacaaaggcattacgtaatggtaaaggaaacagttcaacaagaagaggtgactattctgaatatatatgcacccaaggagcacccagattcataaaacaagttcttagagacctacaaagagacttagattcccacacaataataatgggagactttaacaccccactgtcagtattagatcaacgagacagaaaattaacaaggatattcaggacttgaacttagctctctatcaagtggacctgatagacgtctgcagaactctctaccccaaatcaactgaatatacattcttctcagtgccacatggcacttattctaaaattgaccacataattggaagtaaaacactcttcagcaaatgcaaaagaactgaaatcataacaaacagtctctcagatcacagtgtaatcaaattagaactcaggaaatgttatctttctagaaagacaaggaactggagatattgtaatgatagtttgtgtaaaacctttaacttttacagtatcttcatattaataatttccttcatttattgccttataagaaaggtgtaatagacaactggtgattgtggataaggggtagcaaaatcttttccctttttgcatgaaaactttacctttggttaactccctctctttgttcccttggtaatgtgataaaatatttcaactgtgttactaggcaacattatttatggtaagtataacttatgattgtcaaactgcatctgtactgggagaaactacaaactacaaatacttgatgtggactcttgtaactaaacatgccccttgagggaccctggaagctatacctatggagttgttacaagagatactggcttttgagggacattaggcttgtaaaccagagtggctttcatacatgctaatgtggaacttttctggtctgagtggtgtgttttatgcatgtaagactctgccttactattaattagtgtctgagtcacctattgttgggaggtagttgtttgtgtgtgtgagtaggggtgtgaaaatgaaatattttacataaattctttattagcttaggtacaagtatatttatttcctgttgcagttttctttaatttattgtattgggctgaacagaacttcctgtttttcttgtaaaccattccctacaaccaccataactttccctagcacctgtgagctctatacttgttgtgtttggacttgttccatcttaaatatttgtggtttctgcctctgtggattataccctgtaaatcttactccctagtcatacctaggttgatcagttggcagcctgactgcctctgaatgagaagtatgagcaggataactaggcttttgaaaatgccaggaatgtttagtttggagaagggatttgattttggttattttacgtattagattctaactgatcacttctgattatgggagaaagaagatgacagcagaatgattaattttttaatttctatgaaacacaggcagtgtgtttataaacattttcttacattaacttttaaaatgggcatatttgctcccattttataagtgaggaaacaggcttacaagggtaaggaaattgttcaagattacctagttgtaattttttaaaattaaaaaattactcttttttttgaggtatggtctcactctgtcacccaggctggagtgcagtggcacgatcacagctcactgcagcctcaacctccagggcacaagagattctccacttcagcttcccaagtagctaggactacaggcggtgtactaccaaccatgcctggctaatttttttgtactttttatagtgacggggttttaccatgttgtccagacaggttttgaactccttggctcaagtaatcctcctgccttggcctcccaaagtcctgggattgcaagtgttagctaccatgcccgtaccctagttctaaatgttaatatggaacttgaacccagacatgtctgacagcaaagcctattgtttttccattgaaaccacactattgatattaaaatacttcttaatgtattttcatgtaagatgaaaagatgtaaaaaaacctgccttatttgtttttgtggtttgagcatagtgaaagtattcaggatggagctttagcacttactatcctatgagtacagatgtgactttttttgaaagcagaattttttttttctactactgcttgtgtttccggacttaaagtttacttgatagatggaagtgtagattattggctaaatatataatcataatagccactcaaatgaaatcgtcattttatttcccttattgtacttattttggtttagaattgataacttttattcaagtattttgcatagttctttaacttgattgccatgtggccatatgctttttttttttttttgagacggagtctcgctctgtcgcccaggccggagtgcagtggtgtgatctcggctcactgcaagttctgccttccgggttcgtgccattctgctgcctcagcctcccgagttgctgggactacaggcgcctgccactctgcccagctaattttttgtatttttagtagagatggggtttcaccatggtctcgatctcctgacctcatgatccgcctgcctcggcctcccaaagtgctgggattacaggcgtgggccaccgtgcccagatgttttttttttttaatgatgaaaacagtaggctttacttgaggtcttttcttttttatttatagttttaaaataatctggttgagcttatgcaagaaaaaatatcctaaaattcaggcttttatagttttatagttttataatgtattttatagttttatttatagttttaaaataatctggttgagcttatgcaagaaaaaatatcctaaaattcaggcttttatagttttatagttttataatacattttatagttttatttatagttttaaaataatctggttgagcttatgcaagaaaaaatatcctaaaattcaggcttttaagtgtatgtgccagacactgttataggtaatagagattaaaacttttttattttatttcattttattattattttacttttagggtacatgtgcacaatgtgcaggttagttacatatgtatacatgtgccatgctgctgtgctgcacccattaactcgtcatttagcattaggtatatctcctaatgctatccctcccccctccctccaccccgagataaaaatttttaaaagacatatcctttctttctttcttgggtacaggatggatatattaatatatagttttaatacagtatggtaagtgctataataaagaaaatgcatagagttcttggatatctttcacatatgtatttccaaacacagcctgttggacaaattggagggtttatcctggtgtttaagtgtatcttgaaggatgagtagctgaaggagttgagaatgggatgggaatagaaaagaggccatatgtaattagtaggaacttatataattttctgtaagaaaaacaaaaatttcattgttgcagaaataatgggaaaaataaaaattagatcagagttgttgaacttaaatgttttatttttaattaagagaaaggaagtttttttgtcattttgttgatctaaggagagaaatgtcctaagtgctataatgtttggagaatataaagttaattttggagatcactttttttcatataggtcatatgcggaaaagacctgatgtattaatgatggttattctttttttcttcctccagagtgaagggaatattttgattgcccaaagaaatgaaatgcagcagaagctgtacatgtcagtagaagattttattctggaagttgatgagtcatctcttaataaacgcttaaaaacattgcaggttggaattaaaaatatattaaatatacgttaaattgtaagtttatttaagaagtgaaattagcatttaccttaagactttagattgttctgtgatggttgcaaaagtttttcctgtttcctgaattctgatttctttttaatgggattaaaagtttatattaatatattttgtggctatgtttatatgcatatctatcttgcaaacaaggtaaaatggctagggactccagtattcactggggaaattaatggagacaggagcagtagcaggtatgtgggtccctatcgtccattgcattctagcagaaaatgtagtaggaccacatgttacagggagaagggatcaactctgatccataaattatagggtttttaggctccatgaccagggaagtttctccctgatgtgatcagaggctagagtactgtagtacatatagctatatgatatggtggaatcttgtcttcagctctgtcttgccagctcaggaatgactttaattcggggtgaatgaacatgacagtgttaagtaatttcacctaataatagtgtttctctctacttattcagatctttttttgtcctttaatattgtttaaaatttttctctataagtcctcatgcttttttcttcatttaacttttatttatttatgcttttgattgcttttatgaatattatcttgtcatttcctagttttgattgaatagaggaatactgttcatttttatgtactggtgtttctctgataactctgctgatctctcttttagttctcatttgtctgttgatactctgctttctgtgttttcaaatgttttcatttgaaatgttttcattttctaatgttttcatttgaaatgttttcattttcaaatgttttcatttcattttcaagtgttttcatttgaaaacaataactctttaatcttttctcttctagtccttttaccttttatgtatctttgaatttttactgctttggtcagttaccctagtactaagctgaccagtagctaatatcgatcttgttgtggactgcagggagtaagcttgctagaaatttggagaagaagatattcagggacatctgggcattgtttctttctgtcctgctggatgaagatgtagttttgatgatgcaccacatggcttaagaaccattggagccctggtttgaaacattttcttaattggaattgcataaatagtataagttcttccagaatgttgaagtaagccttgcatataaaagggcagtaatatagtaagaatttagctttccacaatgcagcttctactttgtcccttaaaggtttatttcttctcactgttagtaaatgtaggttaaggttctgtaattaagatcatctttaaacctcttttcttttaaaagttcaatgctagaagactttttgccttaactggcttgtctccacttctagtattccctcaggtcaccaaaatattctttaaacttctctttattttgctgagaaatagtttatatttttcaagtatccaagaaagatatttctataatgaaggtcaaataaatgaaagttcttgatttctgatttcctcagcattttatttagacttcttttgtggcatacaatacatgtttgattttttgtgactggtcttcttaagttcaaaaagaaattgtattctcggttttcttggtgtacagttttagatatatctaaaacttgcttaggttttggttggttcagtatatcagtctttgagatatttttgttacatatatctgaaatagataggtttgtccctatttgtccctattgttcttttggttcttgttcaaagtatttcagcgccacattgttgggtgttaaggtattcatgattgtaatgtatttaaaaatgtgtatcccccccatgacacatgtttacctatgtaacagaccttcacatgtacctccaaacctaaactaaaagtcaaaaataataataaaaatgttttctttttaactactatgtaatcttattttttcacttagattttaaaaaataaaaatttttttgtttgccttttaagttcgtatcccacctttctttttggttaacactgcaacatcttttctttttttctatttttattttatttatttttatttttcttgagatggagtctcgctctgtcgcctaggctggagtgcagtggccgatctccgctcactgcaacctctgcctcccgggttcaagcgattctcctgcctcagcctacctagtagctgggattacaggcacacaccaccatgcctgtctaattttttgtattttagtagagatgggtttcacgatgttgcccagggtgggctcgaactcctgagctcaggcagtctacccaccttggcctccaaagtgctagatttacaggtgtgagccaccgcacctggcttctccctttatttttaaccttttgtattcacgttttgaaataacctcttgataacacactaatggatttaatttttgaaagcacccaacgtatatcttttttgttggtaacttaatttacatatttataattactgttttattaaaacttatttctgtttatcatcgtttctttttctctctttttctaacttacacctcttatacttttttttttttttttgagatggagtctcactctgttacccaggttggagtgcagtggcacagtcttggctcactgcaacttctgcctcctgggttcaagtgattctccttcctcagcctcatgagtggctaggattacaggcaggcctggctaatttttgtgtttttaatagagatggggtttcatcatgttggccaggctagtcttgaactcctggcctcaagtcatccacccgcctcagcctcccaaagtgttgggattacaggcgtgagccactgtgcccggccactcttctaatactttagaacattcttatctgcctttggtgtctttcctctctttctctacctccttccccaaaccaaccagtgaacctaccacaattgtctaggattttagtcacgggttattatagatattgtgtgtgatagctcagttaaatagactttagagttatttttccattcttatttcataagtcgtttatctcttggctttctctgtatattggaatattttctctaagagtgctttcaaagaaatctttgtgtatttgattttgcgagttatttgatatttcaggatatctcatttcaatctcaaatacaaatagttgtttagctgactataaaatagcaagttcaaaggccatgtttcctttacacctttgacaataataatctattgtttcatttctatcattttatttctttatttatttgagacagagtcttgctctttcacccaggctggagtgcagtggtgccatctcagctcactgcaacctctggctcctgggttcaagcaattctcatgcctcaacctcccgagtagctgggactacaggcatgcaccactgtgcccggctaattttagtagagatggggtttcacgatgttggccgggctggtctcgaacttctgacctcgagtgatccgcctctcttggcctcctaaagtgctgggattacaggtgtgagccaaagtgcccagccttcttatttccataattgttatcagtctaatctttgttcttctgtgatcttttttccctctggaagttttaaaattttctcttgactttgttcttaagttgcatcagaacatgtttatgttttgactgaatctgagccagttcagtctgaggttttatatatttctttaattgtaggtaatacttgataattatttattgagatacttctctcccccattaattttttctcttattctgagacttctgatagatatttcagcttctatttctgttatctacatattttaatggctaatctattgtttaaaatctttttatcttatgtaggaggtgggttaaactaaataaataaatacaatctttttatcttgttggtgtctttttggagggatccttgacttaaccatgtagctaatgaattaatcctctagctgtgtcccttctgccatttagccaatccattgcattttgtatgtcaaagattatttcttttatatttaatatcttcagttggttattttttatttataagtacttggcttttgtgtttccaatattctttcttttgttgagaatatttattatgcttatttttgagttcttactgttatctgggccattgacactgattttgcttcctttttataaagtggcttagttttttatacttctttcagagtgcttgtgctgttcacaccattttatcctcttcttatctctcctcaagatctcatattcccttggaactataagctaccttagttctttgctgttgtgtagttatatgaagggcctagggaagagtgaaagtctggaccacaacttttaagactttggataggtttagggaatagaatggggttatttttatttttaagggtctagcttctgatgttgccatctgggattatctacttcctctttgcttctctcctgggtggtctgtcctactcttcagcaaacctctattccctctgcctcagctactgctcctttccaggcactaccacccttagatgtaaatgctgccagatattcaggggagaagtgaaggaaagagaatggtcaggggctggccagctcttctgtattggttatcagtttttgcctcatctgtgttcttgtgctgtacttgcataaacctgttgcctcttgatggtgctgctgtttttctttctgatgtgagggagagagaagagcctatgaaaaaagttttcttttcccacaggtaattctgtgctgtgacacagtccttctttcacttgtagggactttgttaattcaatgctaaacaccaaccatcctctgcctaagatttctcagagttttgtgattaaaaacttctgagatctcttaagctttttttcttatctctgtaaaatttctagggtttgatttctggagagagctagcaggctgtgcctatcttgtcttttccaattctttattacattaaaaaattttattgttactgttattttttttttgtgcacctgccccgacaaacccagccaggccaattcattaaaaaaatgcctttaagtacagtcaagggctgcatggtttggtcagtgatggactgcatatatggtggtggtgccataaaattatagtacttaactgtaccttttctgtgtttacataggcaatcattgttacaattgcttacattattcagcacagtaacatgctatatctaggagcagtaggctatagcatgtagtttggttgtgtagtaaatttataccatctaggtttgcatcagtacactccatgatgtttgcataatgatgaaattgcctcacgatgcatttcttagaagatatccgtgttgttaagtgatgcatgattgtccatatatatgtttaatgtctttacttaattagaattatttgtatattttagcgtgtagtttatttttatttggcaatcggtcttagaaactttcatgccaggacaaacagtagtgattcttatgatagacaaaggagactcagaagggtgattaggggtggagagtggtggatgttgagaaattacttaatgggttcaatgtacatttggatgatagatacactaaagcccagactttaccactacacaatatatccatgtagcaaaattactcttgtacttaataaatttatacaaaaagttagggaaaacagggtaatgtctacttaattaaaaaccataaggatataaagctttctatttgtaactaattcacttaataaactttactgttatggtccaaataaaccaccttctaggtagttttgtgttttcatctctatctgatgattctaagttgtatttatgaaattctcaagaatggggattcagcatactgcttttctaccccttagatcctaacacagtgctcgaatcctgaattagttaataaactttaataaacagaagtatatctctctgcaggatttgtcagtctctttagaagcagtgtatggacaagccaaagaaggagcaaattctgatgaaatacttaaaaaattttatgactggaagtgtgataaaagagaggagttcaccagtgttagaagtgaaacagacgcttctctgcaccgtcttgtagcatggttccaaagaaccttaaaggtaataaaagctcctgcccggttgtgtttgtagcataaaccagggaatatatattttaaaaatcacgcgctttgttcaagagctgacatcatctacctactatgtatcagatttaaaattgccaccttaccagtcaaggttctttattagcttttagtcagattgctccttttattagtctcaaaaaaatcatatcggtcttgttcctcctttttctcagcttttcctaaggattgtcctctttcctcttttaaccatttatttattttcttacagtatgctatgtgtatgtaccttttcctttcagtgcataaattttatgagggtaggcacttttttttcctgcattcctagttcttttacattgcccagggtatagcttaatactctgcttcaggtattaaggcacgatgaatgctgattgaattaaatgagatatttcatgtgtttatttttgcaaatgaggtttttgacctatctgtggaaggatcactgatttcagaagacgcaatggataatattgatgaaatcctagagaagactgagtcaagtgtctgcaaagagctggagatagctctggttgtgagtatcgatattctttattattgcctcctttgaagcagtgtggtttcctttcatggttagaaagtattaaccaataatagagtttttcttgctagttagaaagtattaagactgatcttagctttcttctaataggcttgttgaaagagtaacaatgtctagttctaatccagacaccatgcaaagtcttattcttaggtgacatttttgttttaataggacatttcacataaaaaatctgtttaattctaagaaaactgctcttaatttgagtggacaatcttgtctatattttgattcttgaatgcgtcataccaaatgactataagaagagactccttagagtttgtgaaaacttaaaatctgagagagctctgaaagttgacacacaagatggagtggtcatcctctttctttctccattgtgtatattctttgttacagtgtcaaggtaaaaattagtgtagctactccaaagggtgttttgtaattttaattattgctcattgggactcttcccagttattcaggctgctttccaatgtttcagtggttaggcttctcattttacttgttttttcttttttttactttttataattttactcatattggcattaaaaatacattaagaagttttatattgttaaatagtcctgatgtagatagttttgtcagacttgattttagtagtagttgttaacaggtgatttctaaaagtaaagtgttgaaggtctatatattgtttatagttcttatatttagcatattagtatccctgatttccattaatgctcttattctacacagctttgggaataatggtgtaatacgggtaaagtttcccatatgaatggctttgctttttttagagagacagtgtcttgctctgtcgcccaggctggagtgcattgatgtgatcctagctcactgcagccttgaactccttaatctccctgcctcagcctcccttgtagctaggactacaggtgtataccactgtgctcagctaattaaaaatttttttttagggactggtctcactatgttgcctggctgccatatgaacatctttgatatctatctatcttctgactaggaaaacatttgtgtttaagaactgttttgaaatcactgcggaaatctgttaaaggcataattttgaagtttatctattgttattggaggccttagctgttttggatattcctttgtgtataattctatgtgtgtgatttcatttaggatcaaggtgatgcagacaaggagataatttcaaatacatatagtcaagtactgcaaaagattcattcagaggaaaggctcattgccacagtacaagctaagtacaaggacagtattgaggtttgattgtgctttctcttattgatcttataaattgatgatttgaatttttcagtacttaaatttttctattgttgtttaatactcagtgtcagtaaattgttattactagaattcactgtcaactggaaatggtgatttttgatgatataaatatatcaaattttttattgttttaaatattttattatgtccatgagaaccacaatttttaacatcattttctttttgcctgtatgagtctactgtagataatttgctatatacagaaagataagaaataaaacattgcttataattcccttagcctaagagatagttttagagtatttactcactggatgtgcatctgtatgtttgtgagcatatatatatgcattgcattgttttttaagttacttcaaacatactttcttcatttaatggtatattatgaacatttttctatatgatttttctatactgtcatcttgagtgactaaatcctcatccctatgtagatgtacaacaacattaacctttcatgtgtgttggacattaaggttacttccaatttttcctaccataaataacactgtacatatgtttgtgcataattttttgtttttatttctcagatttctaaattctataattactgagttaaaaggaatggacattattaattaaaacttgatacatattttcaaaccacttttgggaaagatgatttcagtttacatcctcactagaaattcctttttcatccatactaacaatgtgtgttttattgtatgtctcagtttgaaatattacttttgtctttgttactttgagtgctggaactgatattcttctaaatagaaacatggattaaaaaggaaatctattgaattgtcttgttgaaaattatagattttcttggtatttcagtctgaactcagtaaatactagttgaatcttaacagagaaataataaatgatcactgttcaataaatacttttcttatgtgtttgaaaatacgtaacttttgtttacttagtttaaaaagcagcttattgaatatttaaataagagtcccagtgtggatcacttgctatccattaagaagacattgaaaagcttaaaagctctactcagatggaaattggttgaaaagagtaatttggaagaggtaaggaaacagttgtttcttactgatctttatgtgcatctcattttacttggtctctgcttcataaaaataatgcataaatacactctttacaataagagagccattacattcacattttgttttatatactttatcttgttttctgtgtatataaataaaattgagattacagtaatagtgtaaaaattttcctatatcattaaatattctttaaaaacattttcctaggctgccttggttcttagtaacatgaacattttagaataattttaaaagctcttttagtttggactgttagaatgtttattgtaataccaacttgctacatgcaggtgacagggtaccccctcgaaggtagcgttttgtcataaagtatttttaagatcatggtatcttttgttaactccctttttatggatagatgtaatatttcttgcaagtattttaagttgcttttatatgataatagaactggagaggattaggatgccctaatctggactaacttcttcctttaggcttgaaactttgtgaataagatagtaaactttgtgttcctttgaggatttgatttatgtacaaggatctgtattatgccttaatccaatttgaattatctgtcttctacttctgagcactgaattgggggtggagcggaggactattctagaactaatatcatagttgaagaactttctagttttattctattctgggctttggggaagttgatttttttagtctgatttttcaacttttggagaaatctgacttttgttatactttaagttctgggatacatgtgcagaatgtgcaggtttgttacataggtatacacgtgccatggtggtttgctgcacccatcaacccgtcacctacattaggtatttctcctaatgctattcctcccctagacccccaccccctgacaggcccagtgtgtgatgttcccctccctgtgtccatattttctcattgttcacctcatcttatgagtgagaacatgcggtgtttggttttctgttcctgtgttagtttgctgagactgatggtttccagtttcatccttgtccctgcaaagaacacgaactcgtccttttttatagctgcataatattccatggtgtatatgtgccacattttctttatccactcaatcattggtgggcatttgggttggttcgaagtctttgctattgtgaacagtactgcagtaaacctacatgtgcatgtgtctttatagtagaatgatttataatcctttgggtatatacccagtaatggtattgctgggtcaaatggtatttctggttctagatccttcaggaattgccacactgtcttccacaatggttgaactaatttacactcccaccaacagtgtaaaagtattcctatttctccacatcctctccagcatctgtggtttcctgacttgtgtgtgtgtgtgtgagtgtgtgtgtgtgtgtgtgtgtatttgtatgttgcctatgttgttttttttttcattattatactttaagttctacagtacatgtgcacaacgtgcaggtttattacataggtatacatgtgccatgttggtttgctgcacccattaactagtcatttacattaggtatttctcctaatgctgtctctctccctgccaccccccaccccacaacagaccccggggtgtgatggtccccttcctgtgttcaagtgttcccattgttcagttcccacctatgagtgagaacatgtggtgtttggttttctgtccttgtgatagtttgctgagaatgatggcttccagttgcatccatgtccctgcaaaggacatgaaatcatccttttttatggctgcatagtattccatggtgtatatgtgccacatattcttaatccagtctattattgatgggcaactgggtttgttccaagtctttgctattgtgaatagtgccacactaaacatacgtgtgcatgtgtctttatagtagcatgatttataatcctttgggtatatacccagtaatgggatggctgggtcaaatggtatttctagttctagatccttgaggaattgccacactgtcttccacaatggttgaactagtttacagtcccaccaacagtgtaaaagtgttcctatttctccacatcctccccactgtctgttgtttcctgactttttaatgatcaccattctaactggtatgagatcgtatctcactgtggttttgatttgcatttctctgatgaccagtgatgatgagcattttttcatgtgtctgttggctgcataaatgtcttcttttgagaagtgtctgttcatatcctttgcccactttttgatgggattgtttttttcttgtaaatttgtttaagtcgtggtagattctggatattaaacctttgtcagatgggtagattgcaaaaattttctccattttgtaggttgcctgttcactctgatagtagtttcttttgctgtgcagaagctctttagtttaattagatcccatttgtcaattttgtcttttgttgccattgcttttggtgttttggacatgaagtccttgcccatgcctatgtcctgaatggtattgcctaggttttcttctagagttgttatggttttaggtctaatatttaagtctttaatccaccttgaattaatttttgtataaggtgtaaggaaggtatccagtttcagctttctacatatggctagcccgttttcccaacaccatttattaagtagggaatcctttccccattgctttcccagttttcccaataacatttattaaatagggaatcctttccccattgcttgcttctgtcaggtttgtcaaagatcagatggttgtagatgtgtgacattatttctgaggcctctttgtgttccattggtctgtatatctgttttggcaccagtaccatgctgttttggttactgtagccttgtagtatagttaaagtcaggtagcatgatgcctccagctttgttctttttgcttaggattgtcttggctatctgggctcttttttagttccatatgaaatttaaagtagttttaaaaaaattctgtgcagaaattcagtggtggcttgatgggaatagcattgaatttataaattactttgggcagtatggccattttcatgatgttcattcttcctatccatgagcatgaaaattttttccatttgtttgtgtcctctcttatttcgttgagcagtggtttgtagttctccttgaagaggtccttcacataccttgttagctgtattcctagataccttattccctttgtagcaattgtgaatgggagttcactcatgatttggctctctgtttgcctattattggtgtataggaatgcttgtgatttttgcacattgattttgtatcctgagactttgctgaagttgcttatcagcttaaggagattttgggctgagacgatggggttttctaaatatacaatcatgtcatctgcaaacagagacaatttgacttcctgtcttcttatgtgaataccttttatttctttctcttgcttgattgccctgtccagaacttccaatactgtgttaaataggagtggtgagagtgggcatgcttgtcctggtgacagttgtcaaagggatgcttccagattttcccattcagtatgatattggctgtgggtttgtcataaatggctcttaatattttgagatgcattccatcagtacctagttagttgagaatttttagcaagaagtgtgtcaaattttatcaaaggctttttctgcatctgttgagatagtcgtgtggtttttgtcattggttctgtttatgtgatgcattctgtttacttatttgcatattttgaaccagcgttgcatcccagggatgaagctgacttgattttggtggataagctttttgatgtgctgctgaattcagtttgccagtattttattgaggatttttgcatcaatgttcgtcagggatattggcctgaaattttctttttttttgttgtgtctctgccaggtttttgtacgaggatgatgctggcctcataaaatgagttagggaggattccctctttttctgttgtttggaattgtttcagaaagaatggtactagctcttctttgtacctctggtggaattcacctgtgtatctgtctggtcctggactttttttggttggtaggctattaataactgcctcaatttcagaacttattgttggtctattcagggattcgacttcttcctgatttagtcttgggagggtgtatgtgtccaggaatttttccatttcttctagattttctagtcgatttgcatagaggtgtttattgtattctgtgatagtagcttggatttctgtgggatcagtggtgatatcccctttatcattttttattgtgtctatttgattcttctttattagtctggctagtggtctatctattttgttgatcttttcaaaaaaccaactcctggattcattgatttttttttgaagggtttttcatgtctctatctcctccagttctgccctgatcttagttatttcttgtcttctactagcttttgaattagtttgttcttgcttctgtagctcttctaattgtgatgttagggtgtcgattttagatcttttccgctttcacctgtgggcatttagtgctataaatttccctctaaacactgctttagctgtgtcccagagattctggtacattgtgtctttgttctcattggtttcaaagaacttatttatttctgccttaattttgttaattacccagtagtcattcaggagcaggttgttcaatttccatgtagttgtgtggttttcagagagtttctcaatcttaagttctactttgattgcactgtgatctgagagacttgtttgttatgatttctgttcttttccatttgccaggaagtgttttacttccaactgtgtggtcagttttagaataagtgtgatgtggtgctgaaaagaatgtatattctgttgatttggggtggagagttctgtaggtgtttattaggtccacttggtccagagttgagttcaagtcctgaatatccttgttaattttccatctcattgatctgtctagtctaatactgacagtagggtgttaaagtctcccactattattgtgtgggagtctaattctctttgtaggtctctaagatcttgctttatgaatctgggtgctcctgtattgggtgcatatatatttaagacagttaactcttcttgttgcactgatccctttaccattatgtaatgcccttctttatttttatttttttttatcttcgttggtttaaagtctgttttatcagataccaggattgcaatccctgcttttttttgctttccatctgcttggtaaatcttcctccatccctttattttgagcctatggtgtgtctttgcacgtcagatgggtctcctgaatatagcacaccaatgggtcttgactctttatccaatttgccagtccttgtcttttaattggggcatttcacctgtttacatttcaggtcaatattgttatttgtgaatttgatcctgtcattatgatactaactggttattttgcccattagttgatgtagtttcttcatagtgtcgacggtctttacaatttggtatgtttttgcattggctggaaccagttgttcctttccatatttagtgcttcctttaggagctcttataaggcaggtctgattgtgacaaagtctctcagcatttgcttgtctataaaggattttagttctcctttgcttgtgaagcttagtttggctggatatgaaattctggtctgaaaattcttttctttaagaatgttgaatattggcccccactctcttctggcattgtacagtttctgcagagaaattgctgttagtttgatgggcttccctttgtgagtaacccaacctttctctctggcttcccttaacattttttccttcatttcaaccttggtgaatctgacaattatgtgtcttggggttgctgtttttgaggagtaggtttttggtgttctctgtatttcctgaatttgaatgttgacctgtcctgctaggttggggaagttctcctggataatatgcttaagtgtgttttccaacttggttcccttttccctgtcactttcaggtacaccagtcaaacgtaggtttggtcttttcacatagtcgaatatttcttcaaggctttgttctttttcattttttttctttaatcttgtcttcatgctttatttcattaagttgatcttcaatgtctgatatcctttcttctgcttgattgatttggctattgatacttgtgtatgcttcatgaagttctcatactttgtttttcagctccatgaagtcatttatgttcttctctaaacaggttattctagttagcaattcgtctaaccttttttcaaggttcttagcttccttccattgggttagaacatgctcctttagctcggaggagtttgttattacccaccttctgaagcctacttctgtcaattcatcaaactcattctccatccagttttgttccgttgctggcgaggacttgtgatcctttggaggagaaaagatgttctggtttttgaaattttcaccctttttgtgctggttttttctcatcttcttggatttatctacctttggtctttgatgttggtgacctttggatgtgtttttttttgtgtggacgtcctttttgtttatgctgatgctattcctttctgtttgttagttttccttctaacagtcagtcccctctgctgcaggtttgctggagtttgctggaagtccattgcagaccctgtttgcctgggtatcaccagtggagactgcagaacagcaaagattgctacatgtcccttcctctggaagcttcatcccagaggggcacctgccagatgctagccagagctatcctgtatgaggtgtctgtcgtcccctgctgggaggtgtcttccagtcaggaggatgggggtcagggacccacttgaggaggcagtctgtcccttagcagagctcgagcactgtgctgggagatccgctgctctcttcagagctggcaggcagaaacattaaagtctgctgaagctatgcccacagccgccccttcccccaggtgctctgtcccaggaggatgggagttttatctataagcccctgactggggcttctatctttcattcagagatgccctgcccagaaaggaatctagagaggcggtctggctacagaggctttgctgggctgcggtgagctccgtggagtctgaacttcctggtggctttgtttacactgtgaggggaaaactgcctactcaagcctcagtaatgacagaggcccctcccccaaccaagctggagtgacccaggttgacttcagactgccatgctggcagtgagaatttcaagctagtggatcttagcttgctgggccccatgggggtgggatctgctgagcaggaccacttggctccctggcttcaaccctcttttcaggggagtcaacggttctgtcttgctggcattccaggtgcaaggggggtatgaataaatattccagcagctagctcggtgtctgcccaaacgtctgcccagttttgtgcttgaaacccagggcactggtgatgtatgcatctgagggaatctcctgctctgtgggttgtgaagactgttggaaaagcatagtatctgggccagaatgaaccgttcctgatggcacagtccctcatggcttcccttggctaggagagcgagttccccagccccttgcacttcctgggtgaggtgactccccaccctgcttttgcttgccctctgtaggctgcacccactgtctaactagtcccagtgagataagccgggtacctcagtttgaaatgcagaaatcactcaccttgtctgttgatctcgctgggagctgcagaccggagctgttactatttggccatcttagtatctggatccttgaaatctgacttttaaagtgtaaaccaaactatctgaggcaggtatcaatcaatttagaaagtttgttttgccaaggttaaggatgcatgcctgggaggcaggtctgtgcctttctcagagatgattttgagggcttaaatatttaaaagggaaaggatggatactggggaaagaggaagaaattttaaaaagatgtgagtagataagagacagatggtttgaattctttaatccttgatcacctttcagcaaatacactatttacatttgagagaggggtagaggaatagtcactagctcagtgaatctgcatttttacatcagaggaaggaatcagatatgcatttgtctcagttgagcaaagggatgatgacttagagttctgtcctttgtcctgcacctgagaaaataagccatcaatttaccttgtcagggtaaaattcaacagaactgttttagggtgaagatcctgagacccataaggaatttcctactgagcaaattgtgagagaggtgtgcagggtttttatggttgtagctatcttatttaggaataaaatgagaagctggtttgcctgacacagttcccagcttgactttttcctttggcttagtgatttaaagttcacaagatttattttcctttcacaaaagcatacatactttttaaggtggcttatgtattatcattggagacagttcacacatttactcatccttttgttttgtttttaactaaatatcatgtagaagacaattctagggaattcaggtgtattctggttgctattattaacatttcttttgttcgaatggcagttggccatctttatcttagagaaaatctacagcagatgaagagacaagaaaaatctgtataattgattttatgtctttactttttgtaattcctttttctaggtttcagaaaagtcattgttagaataaattgacctaagttaattcagcaagtattagaagggtcttttatgtgctaggtactgaaggatacatagaaaccacacagagtaatttactatagaacttgaattcttaaaagaagacttgttttctctatgttaataaaaaacactttttctttctgattcaagtcagatgatcctgatggctctcaaattgagaaaataaaagaagaaataactcagctgcgcaataatgtctttcaggaaatttatcatgagagagaggaatatgtaagtatttggttctttgaagttttacattaggttttactctagaaattgaatttaaatacccgttttatgaagtggactgtaatcacaaggctagaggtattatatagaaagtttatatatatattgacctggtaagatttttgtaaatttagaaataaatttcacatgacaaaatattctgaccattgtaccagtgtggaaataactgaaaattgtaaagaaggaaaaacatcacttgtaatatttccactcagtgataatagtagtaatcactgttaacttttgactttcttttagtatttttttgtttgtttttagaattgagattatagcacagacacacttttgcatattgccttttttctgtttaacataaaacctaaagaccttttccttacatcaacgtcattttcccataatgttgcagtgaaaacattaatggagcacataatttagttgaagaatgtaacaaaataagtctacctggttttgggggcaggagaagttacatcttttaagtctctatttttaccactgatttttgtgagcttgggaaaataagtcattgtattttttctttaaaatggaagaatattgtattttatatctgggagatgttaccaggaagaagttagttaagaaacagtgctttgaaagtaaaaatactgaccgggcatggcggctcacacctgtagtcccagcactttgggaggccgaggcgggcggatcacttgagcccgggagtttgagaccagcttgggcacatggtgagaccccatctctacaaaaaatacaacaattagctggtcatggtgtcatgtacctgtagtcccagctgctttggaggctgaggcaggaggattgcttgaacccaggaggttgaggctgcattgagctatgatcatgcctctgcattccagcctgggcaacagagcaagaccctgtctcaaaaaaaaaaaaaaaaaaaaagaaaagaaaagaaagtaataatattaatactgtgaaaacaataggtaagtgtcatgctttctttagcaaattcatctgcgtatatgtaaataccttatggaccttgggttaaaatagcgatcttgcaatgatttgacaagtgtttagaagttttgcttaataaatatgtgataagtggcttttctttcgtgagggtactcaattttcacatttatttcaaagttacttatgtagagctatgtgttttttctcttaggctttaaaaatttttcttaacgaaacagctgttattttaaaatgtcactgtgttcttaatattttgagaaataatgacagttttatgcctcaaattgaaatattatcagacattttcattttagtttggaagtgggtgaggactttgaccttgcaagatttgtgcttatgtatgtatccaaagcttaaaattggtaattaaatttttcttcaattagtaagatggtagtttagatgggttaaaaaaaaaaacttcagccaacttaaatttaaaggagcaatgaacaattcgcaaattgggcagctgaatcacagcatattcggagagactctggggatgctttgtggtcagaacaaattaatagacgaaaaaaggaaagtggctttcagaaattggcagcgaggtacagaaacagctatattggttacagattggtgtttgccttatttgaacacagtttgaacacttagcagtctgtaagtggttgaagtatggcggctgggattggccaagactcagctattgttataggtccacactgctaagttacattttcagtctcgtctgcctgttaagctaggttgcagttcatccacaaggactcaaatatagaagtacggagtccttctcaggccatgtttaatttgctttagcagatgcaaggtgagtcgtggttttcacttgttatttcttgaagtagaaggcaaaatcagtgattatgtatcttactggatatgttataaggtagatgctgatatattttcctgaagagcaacatgtcaaaattgaatatatattgatctacagttaaaaactttttttttttaactttaggagatgctaactagtttggcacagaaatggttccctgagctgcctctgcttcatcctgaaataggattactcaaatacatggtaaactttgtttcccttgcgaattactactcttcagagggtgttgaaaagtgataatattaaatttgtgtcagtgttaaacttatagtatcttttaaataaaaatactcctgatgaatattttatgggtattagaactttttcttatgaccctttaatagttgcatggtatatatttgtatttttatgtaaatttgcattatccgtttttctgctttcctcatcctcattcagtacattgcatgacacttatttgaattataggtgtttactttttgaaatgacaaaataaaattttaactgctatttcaagagttaggataaaaacaagatattgctagccctgagggatttgagcacaatgggttttttaagttaaagcagtctgggaaaaaattctagagaggttggttaaggtagagatgttgaggtgggtatggttttctaggtaggcaggattcaaaagctggagatcagcatattaaataggggccatagggagcaggattagtaaacactggtttactaatctgttagtcctgaatctgttagtcctgcgatttatattgccttctacagtgagggcctagatgaggtatttattcattaagattgtcacgaagtccattataatggcttaaatatggtacagagagggatatttgtgtagacatgtgagtttattctaaaaaatatttaagattaaagttccctaacttaaataattactctaaactctttctagactagactttaaaatgatgtgagttttttcttgcaactatttagcttagtgattaccttatgcagtgtgggcaaataagtatgtactgccacatgggacttgaaaattaatatttaaaaatatgctaatctactttattatggaagattataaaaggtttgactcatggtttattgaagtctttaatggctttctgatgtttaactgtaatgtatgcttaggaattttttgtaggttgattatgtattgtagaatacttaaatgtaccgacaagacttaaaaaaaaaacccagaaaacaattctacaatgcctcttactgaaactgcaccacagtaaaacttagctttgtttaaaatgttgatgatcatattttagtgtgaaaaattattccttttaaaaagtagcagaaatatctagtaaaattagttattgaaagccattttcacttttgaggactccaaacaggggcagaggtgttagaattacttcatggtagtcataatttttggactaatctttcccatttgatacctacatttttgtcattattttaccttatttattttttgtttttttacaaatgtttatttcagtagtttttggggtacaggtgttttgtggttacatggataagttctttagtggtgatttctgagattttagtgcacccatcacctgagtggtgtacactaacccaatatgtagtccctcattcctcacccccgtcccaatcagttgttactttagtattttttaggaaacataagtggtttttcaagtaaacattagggatcctaggatgcatgtctggttgattctagtcatttcctgaatctgttctaaaattatagcagtaattaaatgtatggtgattacactttgggtaggaggagtttaagagccaggaactggagaaagtacacagttttaaagattttaattttgttggtttttccagtacagttgatggtgtccaagtcatttaatatcgtgtaactaattattttgatgatttttaagtgctgggattgtttggattctttaactgtgataaaaacttgtgcctagaactctggtggtctccttacaatgagcttggaacgagatcttcttgatgctgagcccatgaaggaacttagcagcaagcgtcctttggtacgttctgaggttaatgggcagataattctgttaaaggtaagtctaacttcttcttacttgtgggagattcagcagcataaaggatagtggtgctgttacatttcaagaaagaaaaaacctcactgttagttttctaaagtgtataagttgactggcatgataattgtgcttgtagtttggttgccagaactaattttcacttttaaagtttccctcaattgaacaatgagaacacttggacacagggcggggaacatcacccgtgggggcctgtcatggggtggggggcagggggagggatagcattaggagaaatacctaatgtaaatgatgagttaatgggtgcagcaaaccaacatggcacatgtatacatatgtaacaaacctgcacgttgtgcacatgtaccctagaacttaaagtataataataaaaataagtatataaaagtcattaaataaagctttgtctcacaagaaaaaaaaataaagtttccctcatttccctaaatagaatatgtccttaataggatatactttcctttttttttgggtgaacttattatagtcatccaatatctttttaaaattcttgattttcttacatttctccttgaaatctcagctgtgttatcagtacaatcttctactctttaatttcttcttctcattgatctgggaaactgttaatcatgataataagataattaatttggccttagttgctacacattctagaatgtgtagcaggctacaggtagaattgcactttccttttccaaattatagcattcaaagaagatagaaaagtacttataaaattaaaaaataaaattagatttgatttaacttaaaataatgaattatgtttaaattggaatgatgtataattataatgagattttcatcttggaattacgagtgcctctttctttggtacaagggctattctgtggatgttgacacagaagccaaggtgattgagagagcagccacctaccatagagcttggagagaagctgaaggagactcagggttactgccattgatattcctgtttttatgtaaggtaaagttcttatgctaatctcttgcagaaaccattttatcttgcagaaactattttatttaaaataaattttagctccaggttttagagcagcagttcattccccttaacataaaagaaaaattatcccatagaatcaatgtatgctaaaaatatgttgaagaagtttttacttggagtcacattctctgttttgcttcttagtctgatcctatggcttatctgatggtcccatactaccctagggcaaacctgaatgctgttcaagccaacatgcctttaaattcagaagtaagtaaaaagcactatttatttccatggatgtattaaatgagaaaataacacctgatatttattcaggcatactacatgctatgtattttgtaaaattttgactcatggtattctatttgtcacctcaagcctgtgatagaagttatcgtgttatatagatgagaaaaagcgttaaagggattagattaagtgacttgcacagggtccgttagccagaggtagagctgggactcgaaattaagtctttctggttccaaagcccaaacttacaactgctaagctgtgctgtatgtgaactgcctaatatagcacttggtactgtaagtgcttaagtggcagctttaatttttgtcattgtaagtttaggattagtaataacagtaaaggaggccctgattcttcttatggagtaacactgtttcagtctcttatagctactttacatggttggtatttgtaatccaagtcttctttgagatgatagaacaggtgtcctcagaccccaggtcgcagactggtaccagtctgtggcctgttaagaacagggcggcacagcaggaggtgagtggcaggtgagcaagcattactgcctgagctccacttcctgtaagatcagtagaggcattagattctcataggagcataaactctattgtgaactgtgcatgtgagggatctaggttgcgcactccttgtaagaatctaatgcctgtgatctgaggtggaacagtttgatcctgaaaccaaccccctgcatccatggaaaaattgtctttcatgaaaccggtccctggtgcccaaaaggtatgattgtacacacacacacacacacacacacacacacacacacacacaaacacacacaggcacacatggtatcaccattacaaaatcaagccttcatctggtctttctctatgctgtattcttattaatggttcatttcgaggaaactttactcacttctagagcagtcttttaattagagaacagtttcaagattaaaatgatttgcctacttcctcacttcttttatgtgtacttatctataggaaactttaaaggtcatgaaaggtgttgcccagggtctgcatacattgcataaggctgacataattcatggatcacttcatcagaacaatgtatttgctttaaaccgtgaacaaggaattgttggagattttgacttcaccaaatctgtggtaagatatcatggttttacaaataggttctagactttatttaatattattaagcagtagttcagcacttatatataatataatactttattataggatctttgtcttcagttaaactgtgtcatgtagtataagcaactatttgccctcagctagatgctagaacagcaggagtattgtgtattttaaccataagtcttaggagctacctgacattatatactcaatggcattgacaacattaataattttgtcatcattaggaaacatttaattgctaggaaacatgtaaggaaactaggtggccatctcctaaacctctctccactggtgtccctccgtctatagatacaatttacatatacgtactttgctgttttttgattaataatgtgcatttttagaaaccggggaaccttggactttttagtttaaatcctgattcacctctaatggctgttaattcagtgtcatattacctcagaataggcagtttgtagagatagcaaaatcacacaatttaagagcatgttgtgatttttttgtcgttataatggaaacaattctctattttaattgagaaataaaaattgtatatatttatcatatacaacatgatgttttgaagtatgtatacaatgtggagtggccaaatcagtaattatttttctaaacattacagctttattgagatacaattcacataatgtatacaattcattaatagtttgtagtacattcacaaagtcgtgcagtgataaccagtattgaattccagaacattattaacattcccaaaaagaaaatccatactgattagcagtcactcaaatttcccacttcttctcaagcctggaaactacgaatacactttctgtctctatggatttgcctatttggacatctcatgtaaatggaatgatacaatatgtggccttttatgctaatttcacttagcatagtgttttcagagttcatccacgttattgactgtatcaaaatgtcattcctttttattgccaaattatatttcattgtatggatgcaccacattttgtttatatattcatcagttgctggacatttggttgtttatacttattggttatatgaataatgctgctatgagctttagcatacaatattttttgtgtggacatgttttcatttctcttgggagtggaattactgggttacattgttttactttttgaggagccaaactgttttccaaagtggctacatcattttatattcttcccagtaatgtatagggattttgttttctctacatccttgccaatattttttattatctgagcaattccctttgactagtatatgttataatgcttttatactttggtcatctgcaagtcatagtgtaatgctactggagtatatatagtcttaatggttttgatatggtagctcaaaaagatgagaaaatgaaactgcaactgtaatcaaaagctggattgtacaggatttatacagattgattttctgaaatatttactttattacattagtttaacaaaattaagatatcctaagaaatataactaaattatgaattttgaaagatctcaaccttcaggggttctggttagtttaccttttgagcatactatttgcataattatagatatgactacaataattactctttagtcattcgtcatctgttattattccccaaaacattgtttttaattttcagttaaaaatatttattctgaaatattgatcaaactcaccttttgctacattttccatgcaattttcagattgaagtggttatcaggaagataaatttgaaaagtagtctgaggtcaagatcattgcttttcaggccttatagtgcatacaactcacctggggttcatgttaaaatgcaaattaatattcagcatttctgcagtggatcatctgcatttctaacaagctaccagttaatgctgtagctcctggcccttggaccatactttgagaagcaaggatcaaaatcgtagctagaaaaaagatagcacttagtgacacatgctaggcattgtatctctgtaaggtagacattatttccattttacaaattaattcaggctcaaagaggtttacacctactatgtacccataaaaattaaaaataaattttaaaaatggacaaaaaagaggttaaagccctcggtcccacagcaaataaataggagagtggggaattgtaaccaagatctgcctgaatataggattcatgctattgtcactgatcatctttgacatgttagaaatggtatatttagagaatgatcagtaaggaaggaaagtgctttgtaggatttcagttcttaaatgaattatttagaattttcagaattagaacatggcactgctgctcactcttgtgaaatttattttttaaaaagagtatcaaatgtttaatcacagaataagtggttgttagtattaaatctgttcaagtctacaaagtgaatgtaaaaaaaagtcccatagttaatttattagactgattttaagagcaatttataatagcagaaattggtaaaaatatttgaaagcaagggaatgaaatatttaaaatgaatttgttttttgtattgattaaatgcagagtacttcacagaaagtcacctcaactgtgttgtatctgaaatatgtaaaatattgtttttgcagagtcagcgagcctcggtgaacatgatggttggtgacttgagtttgatgtcacctgagttgaaaatgggaaaacctgcttctccaggttcagacttatatgcttatggctgcctcttattatgggtatgttatttttttgttgaaatagatcatatatatatatatttcagtatataaagtgatgattttatagtgattctccttaaaaataaaaagcagcagacttttagtagaactttaagttttaacaaaaactattgatatgcttcctattacctattgtgtactttctacaaattggcttgatgtatattttaggtatcatgctattgtcttggttctgttgaagtcaagattaacagtgaagatgattttgtcctacattaatctgaaagcagttcatgcatatatggaaaataaatgttaaataagccttgggtatattcctgcttccagtgtagaccaaatagctgtttctcatccatagtttaagaattaagaagttggatggagctggagaccattatcctaagcgaatttactgtggatcagaaagccaaatactgcatgttctcacttataagtgggagctaaacactgagtacatatggacacaaagaagggacactggggtctacttgagggtggaggttgggagaaaggtaaggattgaaaaactacctgttaggtattaggctgattacctgggtgacaaaattatctgtacaccaaactcccatgacacactgtttacccatgtaacaaacctgcacatgtaccccttgaacctaaaataaaagttggaagacaaaaaaataaaaagcttgtttcatgttgtactgctattttacgtagagaatgcctctttttccaaagtcttgagtgtgacaaaaccttatctttgttgatcacataaataaaaataatctccttgttagaaaaacaagagttaagagggattaagtattaagagaaggaagactattcttatcagcccaggggccagcaagcattttctgtaaaggaccagatggtctctgttgcaagtactgagttctgctgctatagcatgaaagcagccatagacagtatgtaaacaaatcagtgtggctcttttccagtagtactttatttatggatattgaaatttgaatttcatgtagtatgcatgtgcatgaaatagtattccttcagtttgctattaaacatttaaaaatgtgaaaactacccttggcttgcagctgtacaaaaacaagtagtggaatcagtttggtgcagaggccatatagtttgctgatctctgttccaatcagtgtaataaggtcaaaaaaagaaataaaagtcatagagtttgaaaatgaagaaataaagctgtctttatttgcagatgacatgcttaattatgtagaaaatctttgagaatgtacataaaagctactagaacaaatgagtttagaaagatagcagttttaatttcaatataattgtgtttttatataagcaacaaataataggaaattaaaatttaaaaatcatttacaaaagtattaaaatatggaatttgtaggggtaaatttagtaaaagatgtgcaagagttgcacactattaaaactacaaagcattgttcagagaaactcaagaagacataaataaatggagcgatacaccatgctcatggactagaagacattgtatggatatcagttgttcttggcttatagattcgatgcaatttcaacaaaattgctggtagattttgcttattttttcagaaattgacaattagattttacaattaatataaaaatggagaggatctgagatagccaaaacaagtttgaaaaagaacaaaattgaaggacccaaactacctgattttatgacttaatagattctaggaaattaagacaatgtaggcctagagtggtggttcaaaactgtaatcccagcacttagggaggctgatgcaggaggattgcttaatgccaggagttgaagactagcctaggcaacacaagtgagcaccccctgtctctacaaaaaatagaaattagctgggtgtaatggcgtgtctgtggttctagctccttggtaggctgagacagaaagattgttggagtccaggagtttaaggctacagtaagctatgactgctccactgcactccagcctaggctacagagcaggaccctgtttctaaaaacacaagtgatactgctgtgaagttagatgtccagatgaatggagcagaatagagacaatataaatagactgcacatgtatgataactggcttttgacaaagatgccaaggcagttctctgggtaaaaggagaatcttcaacaaaaatgatacaggccaactcataccatatgtagagaataaattttgattcatttcttataccatgcacaaaaattagctcaaaatgtgtatcagacctaaatgtaaaacgtgagtctaaaacttatagaagaaaacataggatgaaatatttgactttcgatttggcaaagatttcttaagtaggacacagaaaacatcaactctaaaagaaaaaaatcatttggatttcatcaaaatggaaaaccttgctcttctaaagacattgtcacaaaaatgaaaggcaagctacagactaggagaaaatatttgcaaaacatatatctgacaaaaatattatatccagattatcaagagctcctacaatcaatactaagaagactgcccagttaagaaatgggcaaaatatttgaacaggtactttaccaaagaaggtgtccacatggcatgtaagcatgtgaaagatgctctgaacaccatttgtcattagggaactacagattaaaaccaaaatgagataccactatactactcactataatgtataaaattaaaaagatcgtaccaacggttgcttagatctgttgtacctagaactcatatatattgcccaggggaatgtaaagggaacaaccactttgaaaaacatttggcagtttgttaaaaggttgaacatattcctaccctatgacccagcaattccacttctagatatttagccaagagaaatgaaagcatatgtccacacaaagatttgtatgtaaatattgaaagaatttatgtgtaatagatgaaaactagaaacaactcaaagtccatcaacagatgaatggaaaaacagtctgctatgtatgtgtctatccattggaatactactcaggaataaaacgattgaactataaatataactcagtaagataggtgagtcttaaaataattctgccaagagaaagaagccagatgataaggtttggctgtgtctccacccaaatctcacattgaattgtaatccccatgtttcaagggtggggtcaggtggagataattgaatcatgggggtagtttcccccatgcagttcttgtggaagtaagtctcacaagatctgatgatttcataaggggcattttcccttttgcttggcacttcttgctgcccccatgtgaagaagaatgtgtttacttccccttctgccatgattgtaagtttcctgaggaatccccagtcatgctgaactgtgagtcaattaaacctctttcctttataaattacccagtcttggggatgtcttttattagtggtgtgagaagggaccagtacagtaaattggtacagagagtggaatgctgctgtaaagatacccgaaaatgtggaagcagctttggaactgcgtcatgggcagaggttggagggctcagaagaggacaggaagatgtgggaaagtttggaacttcctagagacttgttgaatggctttgagcaaaatgctgatagtgatatggccagtgaagtccaggttgaggtggtctcacctggagatgagggacttgttggaactagaataaacgcgactcttgatgttttagcaaagagattggtggcattttgcccctgtcctagagattggtgaaactttgagcttgagagagatgatttagagcatctggtggaagaaatttctaagcagcaaagtgttcaagaggtgacttgggtgcttttaaaagcattgttttgtgtaatcacaaagatatggtttggaattggaacttatgtttaaaagggaagcagagcataaaagttaggaaaatttggagcctgatgatgtggtagaaaagaaaacccgtttcctgggagaaactcaagccagctgcaggaatttgcataagtaacaagtagctgaatgttaatcgctaggacaatggggaaagtatctccagggcatgtcagaaagcttcgcagcagcccttcccatcacaggcacagaggcctaggaggaaaaaatggtttcatgggctgggcccacggtccccctgctgtgtgcagccttcagacatggtgccctgtgtcccacctgctccagtcatggctaaaaggggccaaggtacagctcaggccatggctttagagggtgcaagccccaagccttgttagcttccatgtggtttgagcctgaaggtgcacagaagtcaagaatggtggtttgggaacttccacctagatttcagaggatgtatggaaatgcctggatgtccaggcagaagttttctgcaggggtggagcccttatgaagatactctgctaagacagtgcaaaacggaaatgaggggttggggctcccacacagagccccaactggtgtactgcctagtagagctgtgagaagagggccacagtcctccagaccccagaatggtagatccactgacagatcacactgtgtgcctggagaggcaacagacactcaatgccagcccatgaaagcagccagaagcggggctgtagcctgcaaagccactggggcagagctgcccaaggctgtgggagcccactcttgcatcagtgtgacctggatgtgagacatggagtcaaaggagatcattttggagctttaagatttgactgccctgctggattttgaatttgcatgaggcctgtagcccctttgttttggccaatttctcccatttggaacaggtgtatttacccaatgcctgtaccccattgtatcaaggaagtaactaacttgctgttgattttacaggctcataggcagaaggaacttgccttatttcagatgagactttggactgtggacttttgacttaatgcttaaatgagttaaaactttgggggactgttgagaaggcatgattgtttttgaaatgtgaagacatgagatttggaaggggcctggggtggaatgataatggtttagctgtgtccccacccaaatctcaccttgaattttaataattcctgtgtgtcaagggcaggcccaggtggagatatttgaattacggggtggttcccccatactgttctcatgactttagccctatgcctgcatgtatatttaaagttgtctggtttcattgaaccagcaccctcatggaaataaactagcatgattttcatcaatgcttcagtaatctattctttatatcagaagggtgaaagtaaacatatcaagtttttttttttgtttctgggaggactcataagatatcccataagtgtggtaatagcagtttttattccacctatttcctttaaatgatagtaaaaagctccatgagtaaatatattgtctgattttctactcttatgtattgttgattaagtcctttaaaaactttatttttagattaacttgtacaatggacttttttttgtatacattctatgaattttaacacacctatagattagtgtaataaccactgccacagccaggatgcagaacagttccataaccctgaaaattcctgtgtgccatccctttgtagtcacagcctcctcccaacccttaaacgctggcaaccactgaccttttatcactgtgttttgtgcttttaagaatgtctcacacatagcaatatgaaccttaaatgtaaatgggctaaatgccccaattaaaagacacagactggcaaattggataaagaatcaagacccatcagtgtgctgtattcaggagactcatctcacatacaaagacacacataggctcaaaataaagggatggaggaatatttaccaagataatggaaagcaaaaaaaaaagcagggattgcaatcctagtctctgataaaacagaattttaaccaacaaagatcaagaaagtgtaagaagggcattacataatggaaaagggatcaacgcaacaagaagagctaactatcctaaatattatatgcacccaatacaagagcaccaagattcataaagcaagatcttagagacctacaaagagacttagactcccacacaataatagtgggagactttaacaccccaccgtcaatattagacagatcaacgagacagaaaattaacaaggatattcaggacttgaacttagctctggaccaagtggacctaatagacacctacagaactctccaccccaaatcaacagcgtatacattcttttcagcaccacataacacttattcagaaattgaccacattattggaagtaaaacactcctcagcaaatgcaaaagaatggaaatcttaatggtctctcagaccacagtgcaatcaaattagaactcaggattaagaaactaactcaaaactgcacaactacatggaaactgaacaacctgctcctgaatgactactgggtaattaacaaaattaaggcagaaataaataagttctttgaaaccaatgagaacaaagacacaatgtaccagaatctctgggacacagctaaagcagtgtttagagggaaatttatagcactaaatgcccacaggagaaagcgggaaagatctaaaatcgacaccctaacatcacaattaaaagatctacagaagcaagaacaaacaaattcaaaagctagtagaagacaagaaataattaagatcagggcagaactgcaggagctggagacatgaaaaacccttcaaaaaatcaatgaatccaggagctggtttcttgaaaagattaacaaaatagatagaccactagccagactaataaagaagaatcaaatagacacaataaaaaatgataaagcagaaatcaccactgatcccacagaaatccaagctaccgtcacagaatgcaataaacacctctatgcaaatcaactagaaaatctagaagaaatggaaaaattcctggacacatacaccctcccaagactaaatcagcaagaagtcgaatccctgaatagaccaacaataagttctgaaattgaggcagttattaatagcctaccaaccaaaaaaagtccaggaccagacagatacacagtcgaattccaccagaggtacaaagaggagctagtaccattctttctgaaactgttccaaacagtagaaaaagagggaatcctccctaactcattttatgaggccggcatcatcctggtaccaaaacgtgccagagacacaacaaaaaaagaaaatttcaggccaatatccctgatgaacattgatgcaaaaatcctcaataaaatactggcaaactgaattcagcagcacatcaaaaagcttatccacaacaatcaagtcagcttcatccctgggatgcaaggctggttcaacatatgcaaatcagtaaacataatgcatcacataaacagaaccaaaaacaaaaaccacatgattacctcaatagatgcaagaaaaagcctttgataaaattcaacacccttcatgctaaaaactctcaataaactaggtattgatggaatgtatttcaaaataataaaaggtattcatgacacacccacagctaatatcttactgaatgggcaaaaactggaagcattcccttgaaaactggcacaagacagggatgccctctctcaccactcctatttaacatactattgcaagttctgatcagggcaatcaggcaagagaaagaaagggtattcaaataggaagagagacagtcaaagtctgtctgtgtgcagatgacatgattgtatatttagaaaatcccatcatctcagcccaaaatctccttaagctgataagcaacttcagcaaagtctcaggatacaaaatcagtgtgcaaaactcacaaacattcttatacacccgtaacagacaaagagccaaatcatgagtgaactcccattcacaattgctacaaagagagtaagatacttaggaatacagctagcaagggatgtgaaggacctcttcaagaagaattacaaaccactgctcaaggaaataagagaggacacaaaaaaatggaaaacaaattccatgctcatggatagggagaatcagtatcatgaaaagggccatactactcaaagtaatatgtagattcagtgctatccccatcaagccaccattaactttcttcacagaattagaaaaaactactttaaatttcatgtggaaccaaaaagcccgtatagccaagacaatcctaagcagaaagaacaaagctggaggcatcatgctacctgacttcaaactatagtacaaggctacagtaaccaaaatagcatggtaccggtaccaaaatagatatatagaccaatggaacaaaacagaggccacagaagtaatgcctcagaagtatctacaaccatctgatctttgacaaacctgacagaagcaagcaatggggaaaggattccctatttaataaatggtgttgggaaaactggctagccatatgcagaaaactgaaactggaccccttccttacaccgtatacaaaagttaactcaagatgcattaaagacttaagacctaaaaccataaaagccctagaagaaaacctaggtaataccatttaggacataggcatgggcaaagacttcatgactaaaacaccaaaagcactggcaacaaatgccaaaattgacaaatgggatctaattaaactaaagagcttctgcacagcagaagtgaacacatcagagtgaacaggtaacctacagaatgggagaaaatttttgcaatctacccatctgacaaaggtctagtatccataatctacaaagaactgaaacacatttacaaaaagaaaacaaccccatcaaaaagtgggcaaaggatataaaccgacacttctcaaaagaagacatttatgtggccaacaagcatatgaaaaaagctcatcatcactggtcattagagaaatgtaaatcaaaaccacgatgagataccatctcatgccacttagaatggcactctttgaaaagtcaggaaacaacagatgctggagaggatgtggagaaataggaacgctttacattgttggtgggagtgtaaattagttcggccattatggaaaatagtgtagcgattcctcaggcatctagaaccagaaataccatttgacccagcaatcgcattactgggtatatacccaaaggattataaatcattgtactataaagacatgcacacttaagtttattgcagcattgttcacaatagcaaagacttggaaccaacccaaatacccatcagtgatagactggataaagaaaatgtggcacatatacaccatgcaatactgtgcacccttaaaaaaatgatgagttcatatcctttgcagggacatgggtgaaggtggaagccatcattctcagcaaactaacacaggaacagaaaaccaaatacctcatgttctcactcataagtgaacatgttctcactcataagttgaacaatgagaacatatggacacagggaggggaacatcacacagtggggcctgttggggagtgggggtctaggggagggatagcattaggagaaatacctaatgtagattatggtttgatgggtgcagcaaaccaccatggcacatgtatacctatgtagcaagcctgcacgttcttcacgtgtatcccagaacttaaagtatataaaaaaaagaaaaaatagaaaaaaatataaataaaaataatatcatattagtggtatcatacagtatataattttgtgagtctagcttctttcattcagcatgtgaatcatcttttgtgattcattcaagttgtctaatgtagtttttcccttttttgtttctgaatagtgctctgttgtatgtacataccaaatttgtttgttcacctgttgcagaacatttgcattgtttccagtgtctgactattgcagataaagctactgtgaacatgtgtgtataggtttttatgtgaacgtaagtttttgtttctctatggtaattacccaggagtgaaatttctgggtcagattgtaatcgtatgtattattctttaaggacctgccaaactgttttccagagtggctgtactgtttttgattttcacctgcaatttatgaaagtttcagttcagcatcattgtcggcacctcgtattgttattatcttctattttagccattctcataggtgtgtggtagtgtttcattgtggttttaatttctctaatagataatgatgttgagcatcttttagtttgtttattattggctttctgtattttctttggtgaagtgtctgtcttttgcctgttttttaattggatttttgttttattgctgtagagttttgggcattcataaatacattctagatagaagtcctttatcagatgtcatttgcaatgatttttttctggcctgtagcttttctttttattttcttttcagtgtcttttgcagagaaaagggttttaattttgaagtttaatttattattgttttctttttatgtatcatgcttttagtgttgtgtataagaactcttcgcataacccaaagacttgaatattttttcttatattttcttctaaaagctctatagttgtatggtttacatttagagctgagatctctttggatgtaatttttgtgtaaggtgggaggtttatgtcagggttcatgtttttgcatatggatgtccaattttacaacaccatttttttaagagagtgttattctctgttgaattgtctttgtatctttgtcagaaataaatcggccatttttgtgtgagtctgtttgtggactctttctgctgttgatctgtgtgtctatccgtttaccaacatcatactgtcttggttactgtatctttatagtatgtcttaaaattgggtagtatgattctttttcagattttagctattcagctatctttccttttttgtatatattttattttatattttacatcttaccttattttattttattgagacgtgtaaggtcagccgagagaaaggaaaaatagacctaaagtcaggcgcgtaagtttattgaacctgaggggctgcttcacctcactcagaggaggcagccctgagtttacaaaatgaggggtttatattggagaagggagtttgagggagttctttggtgtggccgcattccagggttgtttgctggttaattttgtcacatatcaccttgtgacatttgtggtagcagaactttcaggaaggtgtaggtaaagtttgtttattcttccaacgacctcccgctgtgcggtccagatggttcgtaattggggtttgtttatccagcaaggtctgataagtgaagtctgctggcttcactgtggtgcctagataagggcttagaaatgtaaagaggcttgggggaagggtggacagcacggagacgtttgaggggagcgccaagaagctttatggggcagtttgtctttaagacgcagtctcactctgtcacccaggctggagtgtactggcacaatcttggctcactgcaacctctgcctcccgggttcaaatgattcttgtgcctcagcctcccgaggagctgggattataggcacccgccaccacactcggctaatttttgtatttttagtagagatgaggtttcactatgttgaccaggctggtctcgaactcctgacctcaagtgatccacctgccttggcctctcaaagtgctgggattacaggagtgagccactgcgcctggctgcttttccatgtatattttacaaacagcttgtctgtgtgcacaaaagccctgctgtgattttgattggaattgcattaaatctgtagatcaatatggggagaattgacatctttactacattgagcctttaatttgtgaactccatttatttaaattttctctggtttcttttatcaacgttttgttattttgggcttacagattctatacatgtgttgttagatttatacctaagaatttcatgtttggaagctattgtgttttttaaaaatttttgttttctagttggtcaagttcttttttacaacagtatttttttgatagtaaagttagtttggtacgaaaggctgtgtatactttgaccttcctcctcaaagaattgggcaatttattatgaaagcacatagtgtaaaatatataaaagggcaaaaagtcaagatccaagggctgtgcttaaaaaggtaatattcagagttaaactggaagcattatcaaaagattttatttacaaggccatgaagggattactgtcactttgtctttaaaaaaattttagaaatagcaataataaaaaagtaatagtttgatagcaaagctctagaatactaactagatattttgggcatatcaaagatactgtggttttagatcatttttcttatgagatccagattaaatgaagtgttctgaagactgcctacagaaaattcaaaacaatggacaattcaagtgttgtgggttattaccttcagtaataaaccatatctttttttaaacgtttaaattaggtttgggggtacatatgcaggtttgttatatagataaactcgtgccacaggggcttgttgtacagattattttgtcacccagatactaagcctagtacccaatagttattttttctgcccctctccttcctcctaccctctgcccttaagtaggccccgtgtctgttgttcccttctttgtgttcatgagttctcaacatttagtgagaacacagagtatttggttttctatatcttttaactgaaatacatggactatagttttatcatgacaccatttgtattaaggttcttcactatatttttaggttattatggaaatcttaaaggtgttttctagaagccagtttttaaaaagtataacagttctgtctgatgttacattgaaaaagaattgtgtttctgtgtgtgttgaggagtactgctgtgaagaagttgaatataaagaagagaatggccccctttctttgtttatttttatttatttatttatttttaagagatggggtctcactatattgctcaggctggtctcaaactcctgagctcaagcgatcttcccacctcgatctcccaaagtgctgggattacaggcatgaactaccacgtctgtcccccttttatttattcagagacacattttcagtgttgctttccctaaaatgcattttttcctgctttatttttctgttaccatattatacacttatttatctttattattgtctgcttctaccactcgagtggaagctttttgggagtagcttatctatcttgtttgccactatatcctcaaatgcctagaactgtgcctggtgcaaagtgggcactcaaatattagttgaatgaatgtttaaattttagccacagttatatgctgaagtattaggctttaaaaaatagttccatgtttttttcctgagttcatttacttacctctcatttatggccccatgtacatcattttattctttaaaaccttgcatgaagattttattccgactcttaatatatttctaggagatgttagtggtcatactgatcacccagtgaacctaactttgcatttctggaccttcttaataacgtgagacccaaacctttatgtaatttcagtcacttccccaaaccaggattttgtgaatctctacaattgttatttttcaaaagtaatagagtccaatccattatatttttctcctaacaggatttcctgtcctctcatttactgtgtctgctaatcttaaatctccagtgggtttatttactgtctctcttttcttccagtttatcagcagccttctagcttttttctttatttactcattcttggaccctatcatacaattcccagactatgccttatattcccatttactcctgttcttctgtttagtctttttggaaaaaactcaattttagataagctatggcctgccatttgtgagtaaaacattctttctcatttctctctctctcttttttttttttgagacggagtcttgctctgtcgcccaggctagggtgcagtggtgtgatctcggctcactgcaacctctgcctcctaggttcaagcgattctcctgtctcagcctcctgagtagctgggattacaggcgcacgctgccatgcctggctaattttttgtgttttagtagagatggggtttcaccatcttgctcaggctggtctcgaactcctgagcacaggcagtccacctgcctcggcctcccaaagtgttaggattacaggcgtgagccaccacgcccagccccatttctcctttttaaaaagttttatttctatgcgtcaataacttttttaaaggcattacattttatttctttaacagagtgtgaccaaacatatttgtttttattttttatttttttattttttggagatggagttttgctctgtcacctgggctggagtgcagtggcactatacagctcattgcagcctcaatctgttgggctcaagtgatcctcctgccttagccccctgagtagctgggactacaggttgtatcaccactcttgactcatttttgaattttttttgtaaagatggggtttcaccatgttgcccagcttggtctcaaactcctgggctcaagcaatttgtccacctttgtctgccaacatggtgggactacaggcatgagccactgtgcccagcccatatttgttaatttaaggacattattatgtctctttataacatggtggtaacatcctcccttggtgagagcacatagaacatgtttggaactaactgctttagaaagttttatctcattacaccctcctaacaagcatgtgagggagtatgttattatccaaagtatagatatgagaattttgtgtgtcagagaggaagtacctgagtgatgccccatttcagaattttagtgtctcgaggctccatgcaagaccaccttctgccttcacatcacatattattaagcctggaaggcagtcttcactgaagccaatgatgaacaactgatgaagggaacccagggctgggaaataagttaccagtaaatgtcatggcattgaccactatgaagtcccttgtatcatattattccccttttaggcatctttaggcttgtctcctatgtgctgtttttttaagaagttctctgcttacaaagtcttgcgtggatgtatttaatacttttgtttggaatacaggtacacttttcacacgtgatacctggttttcatgtgtaatccaaaaataagagacaatgggaaagttatgttccatatgctgtcctttcttgaggaccagctcacgtgacttgtgataagctctcccaccttctctgaaccttagcagtgcctctcaggaatatgctaactaagataaatggagagaaaggaacatgggtagcagccccttaaaatctagaggttttatgattctaacatcataatgaagcagactggggaatagaactcattattgtagaattgaatgtaggaggattaagagatacaggttgggccgggcgcggtggctcacgccagtaatcccagcattttgggaggccgaggcgggtggatcacgaggtcaggagatagagaccatcctggttaacatggtgaaaccccgtctctactaaaagtacaaaaaatcagccgggcgtgttggctggcacctgtagtcccagctactggggaggctgaggcaggagaatggtgtgaacccgggaggcggagcttgcagtgagcagagatcacgccactgcactccagcctgggtgacagagcaagactccgtctcagaaaaaaaaaaaaaaaaaaaaagagagatacaggatggacggactcactaatctctttagtacccttccctgtacaggaatttcgtgtattaatatttctgaaactgctttgagagccaatcaagaaccttagactggtcattcctgtcttatcagatccaaatgcagagaacttggaggaggttcacctttcaaggtttttgtttttgttttttaagatagtctatttacccatatttttattcttattctttttaaaatttctaatgtttcagcatttctccttttatcatttttatcctaataacttcttttggccattctttcaaggtaagtctactggtgacaaatttttagtgtcctttatctgagagcatcttgatgtcacctttatttctgaagaatattttcactgggaatagaattctggattggtagttctttttcttttagcatttggaaaagattgtgctactttctttaggtgtccatggtttctgatgagaaattcactgtcatttgaatcatttcctttataggtaatattacatttctctctaaccagtttcaagatttttgttttctttagttttaagtttattatggtatgtagtggcatgtgtttctttaagtttattctgtttgaggttttctcagcttcttcagcctgtgggcttatgtttttcaacaaatgtgggaagttcagcaattatttactcaaatgcattttagccccccaccctttctcctctttttctaggactctgattatacaaattttctgtcttttattgtctcacaggttcttggggctctgtttatcagggtgtttttttttgtaatgatggttgttcaaatgggttattttctattttttcatcttcagattcattagtgctttcctgtcatatttattctatcattcagtccacctaatgagttttaacatttttgattactgtttttctgttataaaatttccaattgattcttttttatatcttctgtcttctgtttctttgctttctattttaaaaatttaagtgtgtttgtaattgctctatgcagcatttttatgatggccgttttaaaatccttctcagataatcacaacatctgttctatttggtgtccggtggttgtctttttctcagtcaagttgagattattctggttcttgatataaagtgattttttattgtaccctaaacatttgggttattatgttgtgagactatgaatcctttttaatatatatatatatatatattttttgtaggcagccaccctgtttaggtatagtatgcagttccagatggggttagatatgtagttccccactgggctctgctgacatcaccccagcaaaagtggaatgcccagttgtactgccttacttctccttgctgctgacagatgggagtgtaaattcagcactttattgagttcttttgacaccgggagaccaggaggagcaaagtgttagctataactgtttcaccaccaccttattccaccttcttgtgccttgttgctacctggtgagagtggaagttttactccccagtgggtcctgccaacaccgtggggagtgggcaatgaaaaactgaatgctgactcgtactacttcacactgctttgtttcactttttttggctgctgggtgggagtggaagtaagccctgttctgagtcccactgacagtatcccagactgtagagtgacagctagtgctgtttctcactgctgtcttctgcctctgttgatgggtggaagtagaagttcagttccctgtttggcttcatggataccatgctagtggaggaagcaaagggatgacttcccatgacttgttgctgctgggtagggctgaaagtccagctcctcactcagcactactaatactacggatgggatagggggcagtttttcgtttggtgtgtgactggaatagggtatattacctattacagttttctgttctgctaggccaccctcttcccagtcctgtggctacaggaagcaggcttttcttggagcttttgtgtgtgtgtgtgtgtgtgtgtgtgtgcctgtgtctgttggcatttctgggtggcagacttctcaaggaccccatcagagatataggggggcaaaaagaaagcccagggaactcaccattatattgttcctcaagtggcaaggtcctagctacttcaccttcttctttccatcttttagggttttcctgtgttgtattatagctagagttgtttgttttttttaagaggaaaggttgatgtgaaatgtgactactccttggctggaaccccttgcatgctcttgtaccttgggagctgaatgctgttgcactgcattactttaattgagcccttggtgctttcttttggttctttgacctcctcacagccacctcattctcacattcctctcaacaattattttaaaccttttcatcaattctccacttaaatcctatcctcattcttctcagatgatcttacttcttattttactgaaaaacttgagatcatgttatgtgcttttcatcaaatttgagcacttacaaattacagtcatccctcagtatacacagggaattggtttcgggacccccacatatgccaaaatctgcgcaaagtcccactgtgagtattgtggaacctgctaatacgaaaagtggaccttttatatatgcaggctttatgtcttattaatagtgtatttttccatccatgtttggttgaaaaaaatctgcatgttagtgggccaacacagttcaaatctacattgttcaagggactacattatctgtttacccagtcttctatctttgcctcctatttcagagaattaaagtgctccttccccagtgcaagtaattcagtaccgtaacatacaatatggggttgtaaccttggagcggtaggctacatgtatagcctaggtgtgtggtaggatatatcatctaggtttgtgtaagtacatttgttatgatgttcacacaaggatgaaattgcctcatgatgcatttctgagaatatattcctgttatgtattcctgctgttaaacagcacgactgttgttttgtcagttactgagagttgaagtccctggctataattgtagacttgcctatttctcctttcaactctatcttgtggtttaaggtcatcttgtataatatgtacatatttaggattgttatgtcctcttagtagattgatacttttatcattatgtaatatccttctttttctgtagtaattttctttgctctaatgtctactttgtctgatattacagccattcttgtgtttcaacattaatgtttgcatggtatatcttctgccatccgtttactccaaaggtacctacattgttgaatttggagtaagtttcttgtaaataacatatagttgcattgttttttatttactcttgctgatctctgtcttttaattggggtttttaggccatttacatttagggtaattattgatattttagggcttaaatctaccattgtattactggttttgtttgtttcttgtttctttttctttttttcccttcctgtgcattacttgaaaaaattttctaccattgtattactggttttgtttgtttcttgtttctttttctttttttcccttcctgtgcattacttgaaaaaattttaagagtccatctttttatatatatatatatataatatatataatagatataaaatatataaattatatatataaaaatatataatatatataaaatagatattatatataaaatagatatatataaaatagatatatataaaatagatatatataaaatagatatatataatatataatatataaatatatattatatataaatatataaatatgtatatatatttgtatataaatatgtataaatatatatttgtatataaatatgtataaatatatattatatataaatatgtataatatatatttatatataaatatacataaaatatatgtatatatgtgtgtgtgtatatacacacacacacacacacacacctacatgatgtcttattttttttaaacaacacctgtactccagataaatatggtcaaaataaatgaaaaactcaagatgacattattcccatttgtctaaaggccgggtgttgtgtagatgataagcacctgccatttatgatgacaggtgatagatccaaagtaattgccagatttgttaatttttttccatttctaaatcatccataaagaaaatcacatatagggtcacatcatccttacagtagtttagcagagcaactgtgccatctagattgatgttttcaccagtaaaggactggtagtttttgaaattagcaagtatgtgcttgatttgttctgcagcttctgccataaaaggttttactctttctggtcttcattcttcaagtttgcctttgattgatttaatgtaatctttcatatacatcttgtaggcttcttttatgaagccagcttgctgcaagtgatggttcatgacaatatcaataccagtgattactgtgctttcagtaccttcacccttgggtccttcagtagaggcatttccaccaatgagcaagtcatcaatattaccctatgtcttactgaccatcttcctctccccctccaggcacagcctgtttgcagtatctcagatcttgtaattgtcagagataatcatgatggtggctggaggtagatgatagcagtgctcgcttatagcagaagcctggagcttggagcaagtatggtgcagttggaaaggcactccagggaataggaagcatccagaaaagtatattgtgtttttgagtgtattgcctcttacagttttcctagtggttggtttgggtattacaatatacatatgtggcttattacattctagtgatgtcagcatttcaccattttgagtgaagtatagaaacctcacttcctttgaggttcctttattctccccacttttaaatatcattgtcttgagtatcagatggtggtgtaattttggtttggatcatcatatatgattagaaaactcatgatgagaaggatagtctgtggtattagtcatatttctgtttttttccattgttatttcttccttcctgatgctccaagactcctttaaaaaattattttctttttgtttgaagtacttcctttagccactctttaagattgtgtctagtgacaaattcctttcgttttcccttatttgagaacatcttgatttcactttcattactgatggatagttttactggacatagaatttgtggtggttgagagttattttcttttaaaagttgaaaaatgtgctacttccttcggtctccataatttcatatgataaacgtttatcatacaaggtagtatttcttataggtagtgttttatttctctgtggttgctttcaagattttttctttgtctttagttttcccaaacatcttttttcattcctttcctttttttttttttttttaagatttttttctatttggggtttgcacatcttctttaatcttcttcaaaatttgggaacttttcaaccattattttcttaaacttttttttattaaatttctctagatttagggagaacaagtgcagttttgttacacaggtatattgtttaatggtgaagtctgggcttttagtgtaattttgaacagtgtacattgtactcattaagtaatttctcataccccacccctttcccaccctcccaccttttcgaatcttcagtgacttttattcgacattctgtgtccatatgcacattttatttagctcctacttataagtgagaaaatgcagtattgggctttctgattttgagttgtttcacttaagataatggcttccgattccatccatgttgctgcaaaagatatgattttattcttttttattgctgaatattctgttgtatgcatgtgtgtgtacatatgtatgtatgtgtatatgtgtactcacacacatacatacacaccaccgtttctttactcactcatctgtagtcactattttaaaatactcctttagccccattatttttttccttttcttctgagactctgaaagttggatcttttgttattgtctcacaggtccttgaggctctctgttcttttttttttttttttttttgtctgttttctctctgatcaggctgagcagattgtattgatctgttctgaagttcactgattttgtcttctgtcatttctgtcatttcaatttatcccatccagttttaagatttcggttattgtactttgtagttctgtaactttcatgtgattctttttaataacttttttctttgctgaaatttctttttatttaccttagagaaattataattgtttgttgaagcattttatgaccattgcttgaaagttcttgtcagataattatgtgattcattgtggtgttgattgcagtttctcgttgaagttgtggttttcctggtactttgtatgacaagtgatttttaattttatcttggacattttggatactattttaatagattctgggtcctactgaaaattttattttagcaggcagtcaccttgtttaggtttaaacagaggtcctggactactttttgaactgtggttttaacgacaatctaattttcagaaacttttcagttatattttgatctgcttgagttgttgcgtgctgctgggcctccagtggtccctgctgatggtgtttgagggaatgaaaggaacttttcaaggctgaactgcctggtgcttctaagtatgggaatggagaccctggtctatgggatgaagcttcttgagctgggtgctagttgtggcaggatctctcctttcctatgaccgatgcagaatacctccagaaccatcccttgttatggtgggatccccctacttatgggtgtcagagtgtatttactggaccagctgcttgtggtgtggttttcctttgttggtgcctgtggcctcgttggtgtctcaggtggtgctgctgctgaggatggtgaatgcttcccctggctgcttattgacagggaggtttccagttgaaccttcttgctgtttcttctggcctcacatggtggtgttgatggcaatcctattaaattcaagagaagaatgaatctacctgggctgctttctgttgcaggcttaggagttgggaaacatcagatctggctcacttatttttttttttttttcagttgggagggttataagacaacctgttactatgttgttcctctagtcctggggtcttcaactagtttttcttccttttttaaacctttcagtgttttcctttggttatattttatggtattttcaggttttataattgtacttaatggagaggaacaggaagagaccaaaagcccttttgctcattttttaattgcaatgggtggaacttatttggatctggatttaaataaactaaaaaagtaaactaatttgatatgagattactcaaattttgaaagctaggtattttgtataaaagtatttttcctataatgatatgattgtgtaaaaataaaagactgtctcttagagatatgtactaagatatttataggtgaaattatgaaatacataggatttgcctcaaagataatatatatgcgtttgttcatagggtaagagtggtcattggctgatggttgttagggctaggggatgaatatgtgggactcagaatacctttgtgtatgtaaaaaattctccatgtttttaaattaaatttaattaatttattttttgcatccccctgatttctgaagtttttttttaagtttagcttatatttcttgaacaaagtttagatattatggtagaaagaaacttgcctgatttattttctttgtacctaatttttgagtattggtgaggctaacataatataggctaccaagttctaacacgttttcttataaggtgaggaaatattaaagtgtttatagtgtgtacatcccctctgatcggtactttaggagccccaggaaccatttggttgcttgtaattagaatgaaagtgcttttaccctgtaagagagttaatgtgctttctttaagtaagctcttttctagtcaccaggatctgaagttccagagttgactcttctatagattggcgtattaatacattggacatttattcattcttactttctttcacagctttctgttcaaaatcaggagtttgagataaataaagatggaatccccaaagtggatcagtttcatctggtatgtgacctttttgacatttactggtttgaaacacatgcagtaatataaacttagatatctgactgaaagttgtcctccagtttttctaagaatccaaattaacatttgcaataaatgaagtattgaaaaaaattcaggtgccctacttaacaccacttaattaatacaccagggttactctgctgggttgtttgtcacacagattatataaataatctaacaattagggaagaatattgtttactatgtgtttcaagatcatattatagtaaaataatgttttattataacttagttttttgtaagtacctaactatatctttgtcattcacatatgtattcagccaacatattttgagtagctatttctgtgataggaattgaaccaggtgctaggattacaaggattgtggcattgagaatgaaatgaataatttagaaatgtgaacaagtaagtgattaacatctataagttgagtaattagcaagtactttgggggtactccatttaccctgatttgattattacacatcatatgcttgtattaaaatatctcatgtacttcataagtatgcccataaagatttaaaaataatgaagcccctaaaaaaagtacttggggggaagctgatttttagttctgcaaagaaagggggaattcagtatgactagatataaagaggataaatatggcagtaaatgagtctataagagtataatgatcagactctggaagttcttagctattttgagttaagattacaatgaaagagtacatataattttgttaaactcagtagttccttatttgaccacacaaatattgtataataccttctaatgtcccacgaaatcattttaaaaaaacataccttagaaatgatattaaggagctttgccacacttcttgggtagcagtaaaaagcatttcagacaacttttgtgagattataaaactttgtgttacacttcctgattatctctgtggaaggggataacaaagaaggttgactatggtttacagttttgaaaaggctatgataaaaatttattgctattagatagaaaaataccagaaattctgtattagaggttacaacttcaccaaaagtgcacatccagaacccttgctttcaggtttgatagaaaaattaccttgtaccaagttatcctgaaatttagtttaaacttaaaacttatattacagtttcgtgagtcaggaatctggacacagcttatttgggatttctgcttcagttaatttaaggttgcagttaagatgttggctgggctacagtcatcttaaagctcgattggagatgaatatgcctctaacctcacatgtttgttcataggattctgtttctttcagtttattagaatgaggacctcagttgttctctagttgttggccagaggttgccctcaatcctttgccctgtttccatcatggcagcgtgtttcattgaaatgtatacgcagagaaggcagtagactctgttcactaagacagaagtcacagtttttcatagcaaaatcatataagtgatatcccatagtttttgatagtattctctctaaagcaattctctaggtccaagaggaaagaattatgtaaagttatgaataacagaaggttggggtcttggggcaatcttagaagtctgcttactctaaaatgtaatctggccaggcatggtggctcacgcctgtaatcccagcactttgggaggccgaggtgggcagatcaactgaggtcagaagttcaggaccagcctgcccaacatggtgaaaccctgtctgtactaaaaatacaaaaaaattagctggatgtgctggcgggtgcctgtagtcccagctacttgggaatctgaggcaggagaatcacttgaacctgggaggcagaggttgcagtgagccgagattgtgccattgcactccagcctgggcgacagaacaagactttgtctcaaaaaaaaaaaaataataataataatctgcctgtaatctgcaagtaatcatgccttgctaggcatgcagctaggtatatgtataatgaaagtaaatgtaaatacacagtccccgtttaatgtgggtagctactcatggattcaaggattgtggcattgaaaatgagattaataatttagaaatttgaacaagtaagcaagatttataaattgagtaataagcaagttcaaattataaaaatcttggcttgtatagtatttgcttctgtgatctgagtcagttattagtgctgggaatggaattacctttacctacattttgtgttcacacatagctgcaaaacaagtcaaggctctgtagtcagcaccttacagataccataccacaaatggagaagaatataaatgtatggaaccatgtagttgagagagttattagaggataattaatacacccttctcatccttcagaatccctccaataatatccccaagagatggccttcagcctctgcttaagtagagtaatgctgattttggtagtttgtgtctaaaagttggtccattccatttaagttatctagcttgttggcatacagttgtacatattttctttataattatttttatttctctaagttcagtagtgtcccctttttcatttcagattctggcagtttcagtcttctctcttttttttcttcgttagtccaaataagtttaaatacctagcttttggttttattaatttttctgtattgtttttctgttgtctattttcttactttctaatctttattatttctatccttctgcttgctttagatttagtttacaacatatattacacagttatcacaccttataaaattaacaaattgtaatattatatttaaatttccctaattgtcttaaatatatttttaaatggttgcttttttgaaattagcatatcaacaagatctacctgtattgggttaatatatctcttaatctctgttgagctataaagttcccccacaactctttttctccatgccatgtattatgtgaaaaaaatgatttcattttccatactttggagttggctgattgcatccttatggtattatttcatagttctcttttccccagttgaaaaaagtggtagatacagaggttaattaaatttacattcagtttttacaggcagtatattttatattattgtgtcatatgagggggatcatttggtgtttgattgtcacagtaagattgatcagtgtgttcaggcagaaaattttgtatgtacaggggtatatttttagtttttctatcccattggtttgtttattcatatcccagtgcctcactcatttaactaaaatagactttatagtagctttttaatacttatagggctagttccttcttcactgcttttttgttttgttaaaaaaaaaaacaacaaaaagcaacaaaaaaataaagtccgaagtcccaggttggagtgcagtggcacgatctcagctcactgcagcctctgcctcccaggttcaagtgattctcgtgcctcagcctcccgagtagctggtactacagtcacatgccaccacacctggctaatttttgtatttttagtagagatggggttttgccattttggccaggttggtcttgaactcttgacctcaagtgatccacctgcctcagcctcccaaagttctgggattacaggtgtgagccactgctggccctcattgctatttttaaaatcagctttcatggctattcttggttgtcattcttctaagacatctttataattaacttgtttggtctcaaggaaaaaaattatatttttattggattaatataaactttttaagtcaacttagggaaaattgtcccatttgttatgagagtcatttttgttgaagaccataataagacttttgttcctgatctacttttgtggttttcaggagcatgtgttattttttctcatttggattttgtaatatttaattgtttgcacctagggaaggtaactatctttaaatgttcttaaaaacatattctgtagagtacagacattggcattcattcatttatcaaatatttactgaatgtctgctatattcagatactgttttttgctactttctggagatgaagtgacaaactaaaatttcaaatcttaaggatcttagagtgtaatgcagacactagcagtaaacagatgatttctttcctttttttttttttttgagacagtcttgcttggttgccaaggctgaagtgcaggggcacgatctcagccactgcaacctctgcctcccaggttcaagcgattctcctgcctcagcagcttgagtagctgggattactggcatgcgccaccatgcccagctaatttttgtatttttggttgagacagagttttgccatgttggccaggctgatcttaaactcctggcctcaatgatccacttgccttggcctcccaaagtgcctgcctgaccagcagttaaacagattatttttattcagtctgatatgtgctttggttggagtaatcataagaggcaaataaaaggtatactaaggtgtcaaataatggaatagcaacattacaggatcatttacatgttctaatacaaataatgtcctttgaaatggagggatataataaattctagctcccataatgatggtgataatgatagcagcagtagaggtgatcctagagagtgatcacttaaaaaccaaaaccagaaatagttgactagatgaagaaatttacccttccagacagagaagcttcagtgtgacattttaatagtgtcaaattctgaccagtaccttgttaaaagagggagaaggaagtaataaaatttatttgttcgtatttcacttgtttttgagagatttcagctatgatttttttccttttacactttttccccataattcaattccattgtttcagtattggaggcattccatttcaccaaaaagtacagtcgtccctctgtatacacaggggattggtacagataaaatctacgcatacccaagtcctacagttggcccagtggaacctatgcatatgaaaaatcagccctttgtatctgtgggtgttgagtcctgagaatactgtgtttttgatctgtttggttgcagatgtggaaactgcagatagggagtgctgactgtacttacttatttcatattgatacataatatttgtacatatttatggggtatatgtgatattttgtaacttgtatggaatgtgttaatgacagtcggtatttagggtatccattatcttatttattatttctatgttttgggaacatatcaagtcctctcttctggctattttgaaatatttaatacattgttaactggagtcatcctactctgctatcaatcactagtacttatttcttctgtcaacctggttgtttgtacccattaaacaactctcttcacccccttccacctcacccacattctcttagtctctggtatctgtcattcaactctacctctatgagatcaactgttatagctccgacatatgagtgagaacatttgatatttgtctttctgtgcctggcttatttcactttacagaatgactgttccatccttgttgctgaaaatgacagaatttaattccttttttatggttgaacagtattccacattttctttatatttctttaatagtgttccacattgtctttttccatttgtccattgatggacgcttaggttggagtccttacctttgtaattgtgaatagtgctgcagtaaacatgggggtgcaggtttcatatactgatttcctttttattttgatgaatatcaaatattttgacacttaggttgagtccttacctttgtaattgtgaatagtgctgcaataaacatggggatgcaggtttcatatactgatttcctttttattttgataactatcaagtagtgggattactggattgtatgatagttccatttttagttttttggaaaatatttgtactattttccatagtggctatactaatttacatttccactaacaatgtataacagtttcctgttctccacatctttgtggagatttttcaaaatagtatttggctattttttgtcattttttaaaatagtggcattctagctgatgtaaaatgatacttcattgtggttttgatttgcatttctctgatgattagtgatgttgagcatttttcatatacttattggtcatttgtatgccttcttttgagaaatgtctatttatgtcctttgcccactttttaatggaattgttttccctgtcgagtttcttgtatattctggatattagtcctgtgttggatgaatagtttgcaaatttttccttcaattcaacaaattgtctcttacactctgttgattatttcctttgctgtgcagaagcattttagttaagtatagtcccatttgtctctttttgtttttgttgcctgtgcttttgaggtcttagccataaaaatctttgcctaggccaatgtcatgaagtgtttcccttatgttttcttctagtatttttatagtcttgggttttacatttaagtctttaatcaatcttgaattgatttttatatatggtgagaggtgagggtctactcttactcttttgcgtatggctatccagttttcccagcaccatttattgaagtgggtgtcttttccccagtatatgttcttggtgcctttgtgggaaattggttggctgtttatttctggggtttcaattctattctataggtgcatatatctatttctatactaataaaacgctgtgttggttactatagccttgtaagatattttgaagtcagtgtgatgcctccacctttgttctttttgctgataactgttttgactatttgtgctcttttttagttctacatgaaatttaggatttttttctatttatgtgaaaaattacattgctattttgatagggattgctttgaatctgtagatttctttgggtagtatgggcattttaacaatactaatcttctgatccaggagcatggagtgtctttccatttgttagtgtccttttcagtttctttcatcagtgttttgtagctttctttgtagatatcttccacctctctgtttaaatttcttcctaggtaatatatttattttgtagctgttgtaaatgggattactttcttgatgtctttcttagctagttcattattggtttatagaaatgctactgatttttacatgttgattctatatcctgcgatttactatattaatcagatctaaaagctttttggtggagtctttaggtttttctagatagaagattatgtcatctgcaaagagggacagtttgactttttctttttctttttttattattattatactttaagttttaggatacatgtgcacaacgtgcaggtttgttacatatgtacacatgtgccatgttggtgtgctgcacccattaactcgtcatttagcattaggtgtatctcctaatgctgtccctcccaccaccccacaacagtccccggtatgtgatgttccccttcctgtgtccatgtgttctcattgttcagttcccacctgtgagtgagaatatgtggtgttcggttttttgtccttgcgatagtttgctgagaatgatggtttccagcttcatccatgtccctacaaaggacatgaactcatccttttttatggctgcatagtattccatggtgtatatgtgccacattttcttaatccagcctatcattgttggacatttgggttggtttcaagtctttgctattgtgaatagtgccgcaataaacgtatgtgtgcatgtgtctttatagcagcatgatttataatcatttgggtatatacccagtaatgggatggctgggtcaaatggtatttctagttctagatccctgaggaattgccacaccgacttccacaatggttgaactagtttacagtcccaccaacagtgtaaaagtgttcctgtttctccacatcatctccagcacctgttgtttcctgactttttaatgatcaccattctaactggtgtgagatggtatctcattgtggttttgatttgcatttctctgatggccagtgatgatgagcattttttcatgtgttttttggctgcataaatgtcttcttttgagaagtgtctgttcatatccttcatccactttttgatggggttgtttgtttttttcttgtaaatttgtttgagttcattgtagattctggatattagccctttgtcagatgagtaggttgcaaaaattttctcccattttgtaggttgcttgttcactctgatggtggtttcttttgctgtgcagaagctctttagtttaattagatcccatttgtcaattttgacttttgttgccattgcttttggtgttttagacatgaagtccttgtccatgcctatgtcctgaatggtattgcctagttattcttctagggtttttatagttttaggtctaacatgtaagtctttaatccatcttgaattaatttttgtataaggtgtaaggaagggatccagtttcagctttctatatacggctagccagtggtcccagcaccatttattaaatagggaatcctttccccattgcttgtttttgtcaggtttgtcaaagatcaggtagttgtaggtgtgtggtattatttctgaggcctctgttctgttccattggtctatgtctctgttttggtaccagtatcatgctattttggttactgtagccttgtagtatagtttgaagtcaggtagcgtgatgcctccagctttgttcttttggcttaggattgacttggcaatgcgggctctttgttggttccatatgaactttaaagtagttttttccaattctgtgaagaaagtcattggtagctcgatggggatggcattgaatctataaattaccttgggcagtatggccattttctcgatattgattcttcctacccatgagcatggaatgttcttccatttctttgtatcctcttttacttcattgagcagtggtttgtagttctccttggagaggtccttcacatcccttgtaagttggattcttaggtattttattctctttgaagcaattgtgaatgggagttcactgatgatttgactctctgtttgtttgttattggtgtataagaatgcttgtgatttttgcacattgattttgtatcctgagactttgctgaagttgcttatcagcttaaggagattttgggctgagatgatggggttttctagatatacaatcatgtcatctgcaaacagggacaattggacttcctcttttcctaattgaatgccctttcttccttctcctgcctgattgccctggccagaacttccaacactatgttgaataggagtggtgagagagggcatccctgtcttgtgccagttttcaaagggaatgcttccagtttttgtacattcagtatgatattggctgtgggtttgtcatagatacctcttattattttaagatacatcccatcaatacctaatttattgagagtctttagcatgaagcgttgttgaattttgtcaaaggccttttctgcatctattgagataatcatgtggtttttgtctttggttctgtttatatgctggattacgtttattgattttcatatgttgaaccagccttgcatcccagggatgaagcccacttgatcatggtgggtaagctttttgatgtgttgctggattcggtttgccagtattttattgaggatttttgcatcaatgttcatcaagaatattggtctaaaattgtcttttttggttgtgtctctgcccggctttggtatcaggatgatgctggcctcataaaatgagttagggaggattccctctttttctattgattggaatagtttcagaaggaatggtaccagctcctccttttacctctggtagaatttagctgtgaatccatctggtcctggactttttttggttggtaagctgttaattattgcctcaatttcagagcctgttattggtctattcagagattcaacttcttcctggcttagtcttgggagtgtgtatgtgtcgaggaattcaaccatttcttctagattttctagtttatttgcgtagaggtgtttatagtattctctgatggtagtttgtatttctgtgggatcactggtgatatcccctttgtcattttttattgcatctatttgattcttctctcttttcttctttattagtcttgctagcagtttatcaattttgttgatcttttcaaaaaaccagctcctggattcattgattttttgaagggttttttgtgtctatatgtacttcagttctgctctaatcttagttatttcttgccttctgctagcttttgaaggtgtttgctcttgctcctctagttcttttaattgtgatgttagggtgtcaattttagatctttcctgctttctcttatgggcatttagtgctatacatttccctctacacactgctttgaatgtgtcccagagattctggtatgttgtgtctttgttctcgttggtttcaaagaacatctttatttctgccttcatttcgttatgtgctcagtagtcattcaggagcaggttgttcagtttccatgtagttgagtggttttgagtgagtttcttaatcctgagttctagttcattgcactgtggtctgagagacagtttgttataatttatgttcttttacatttgctgaggagagctttacttccaagtatgtggtcaattttggaataggtgtggtgtggtgctgaaaagaatgtatattctgttgatttggggtggagagttctgtagatgtctattaggtcctcttggtgcagagctgagttcaattcctggatatccttgttaactttctgtcttgttggtctgcctaatgttgacagtggggtgttaaagtctcccattattattgtgtgggagcctaagtctctttgtaggtcactcaggacttgctttatgaatctgggtcctcctgtattgggtgcatatatatttaggatagttagttcttcttgttgaattgatccctttaacattatgtaatggccttctttgtctcttttgatctttgttggtttaaagtctgttttatctgagactaggattgcaacccctgcctttttttgttttccatttgcttggcagatcttcctccatccctttattttgagcctatgtgtgtctctgcacgtgagatgggtttcctgaatacagcacactgatgggtcttgactctttatccagtttgccagtctgtgccttttaattgaagcatttagcccatttacatttaagattaatattgttatgtgtgaatttgatcctgtcattatgatgttagctggttattttgcttgttagttgatgcagtttcttcctagccttgatggtctttacaatttggcatgtttttgcagtggctggtacctgttgttccatgtttagtgcttccttcacgagctcttttagggcaggtctggtggtgacaaaatctctcagcatttgcttgtctgtaaagtattttatttctccttcatttatgaagcttagtttggctggatatgaaattctgggttgaaaattcttttctttaagaatgttgaatattggcccccactctcttctggcttgtagagtttctgctgagagattcactgttagtctgatgggcttccctttgtgggttacccgacctttctaaactctggctgccgttaacattttttccttcatttcaactttggtgaatctgacaattatgtgtcttggagttgctcttcttgaggagtatctttgtggcattctctgtatttcctgaatttgaatgttggcctgccttgctaggttggggaagttctcctggataatatgctgaagagtgttttccaacttggttccattctcttcgtcactttgaggtacaccaattagacgtagatttggtcttttcacgtagtcccatatttcttggaggctttgttcatttctttttattcttttttctctaaacttctcttcacacttcatttcattcatttcatcttccgtcactgataccctttcttccagttgatcgcgtcggttactgagtcttgtgcattcgtcatgtatttctcgtgccatggttttcagctccatgaggtcctttaaggacttctctgcattggttattctagttatccatttgtcttatttttttcaaagtttttaacttctttgccattggttcgaacttcctcctttagcttggagtagtttgatcttctgaagccttcctctctcaactcgtcaaagtcattctctgtccagctttgttcagttgctggtgaggagctgcgttcctttgtcggaggagaggctctgatttttagagtttccggtttttctgctctgttttttccccatctttgtggttttatctacctttggtctttgatgatggtgacgtacagatgggtttttggtgtggatgtcctttctgtttgttagttttccttctaacagtcaggaccctctgctgcaggtctgttgtagtttactggaggtccactccagaccctgtttgtctaggtatcagcagtggtggctgcagaacagtggatactggtgaaccacaaatgctgctgcctgatcgttcctctgggagttttgtctcagaggagtacccggctgtgtgaggtgtcagtccacccgtactggggggtgcctcccagttaggctactcgggagtcagggacccacttgaggaggcagtctgcctgttctcagatctccagctgtgtgctgggagaaccactactctcttcaaagctgtcagacagggacacttaagtctgcagaggttattgctgtcttttgtttgtctgtgccctgcccccagaggtggagcctacagaggcagggaggcctctttgagctgtggtgggctccacccagtttgagcttcccagccactttgtttacctactcaagcctgagcaatggcaggcacccctcccccagcctcgctgccgccttgcagtttgatctgagattgctgtgctagcaatgagcgaggctccttgggcgtaggaccttccgagccatgtgccggatataatctcctggtgtgccgtttgttaagcccattggaaaagcgcagtattagggtgggagtgacccgattttccaggtgccatctgtcgcccctttctttgactaggaaagggaattccctgaccccttgcgcttcccgggtgaggcgatgcctcgccctgcttcagctcacgcatggtgcgctgcacccactgtcctgcacccactgtccggcactccccagtgagatgaacccgttacctcagttggaaatgcagaaatcacccgtcttctgcgtcgctcacgctgggagctgtagactggagctgttcctattcggccatcttggctccaccccctgacttgttctttttcaatttggattccttttatttttcttgcctgattgttctgactaggacttccaggactgtgttgaagagaagtggtgaaagtggagatccttgtcttgttccagttctttagaggaatgtttttctttttctttctttttttttgtttttctttttttttgagatggagtttcgttcgtgttgcccagctggagtgcagtggcgtgatctcagcgcgctgcaacctccacctcctgggttcaagcagttctcttgcctcagccttgccaagtagctgggattacaggcgcccgccatgatgcccagcaaattttttttttttttgtattttttagtagagacgaggtttcactgtgttggtcaggctgatcttgaactcctgacctcacgtgatgtgcccacctcggcctcccaaagtgatgggattacaggcgtgagccactgtgtctcactagaggattgcttttcttttccccatttagtaatgatgttagctgtggctttgttacagataggctttattttgttgaggtgtgttacttatatacctagtttgttgagagcttttatcataaagggatgttttaatctatgaaatactttttctgtgtctattgagatcgtttgccatatggtttttgctctttgttcagttgatgtgatggatcatgtcgctgatttgggtgtgttgaaccatcctagcatccctgggataaatgctaattaatcatggtgtattatgtttttgatgtgctgttggattcggattggtagtattttgttgaaaaattttgcatctgtgttcatcagggatactggtctatagttttttgttgttgttgtgtccttgtctggttttggtatcaaggtaatggtgggctgggccttgtagaacaagttagggagaattctcgcctcttgaacctttgcagtagtttgaggataattgatgttagttctttgaaagttcagtagaattcagcagtgaagctctgtggtcctggacttttctatgttgggagactttctcttactgaccaaatcccgttacttgttactggtctgttcatgttttctatttcttactgattcaaacctggtaggttgtatgtgtccaggaatttatatatttcctctaggttttccagttgttcatgtatagttattcataatagtctttatgttttgtatttttttgtttgtttgttttgagacagagtctccctctgttgcccaggctggagtacagtggtgcaatcttggctcactgcaagctccgcctcccgggttcatgccattctcctgcctcagccttccacgtagctgggactacaggcgcccgccacaacgcctagctaattttatgttttgtatttttgtgatatcaggcatagtgtcttctttttcatttctgattgtgtttattgcagcttttttaaagttttagtacagctagcagtttattgattttgtttatcttttaaaaaaattttttttgtggatcctttgtattttttttagtgtatttcacttagttctgctcccatcgttattcttcgttttctactaatatgtatcaggttgtttatttgtaatcttactccttttttgatagaagaatttattgctataaacttctcttttctcactgcttttgctatatctcatcagttttgttatgttgctttgattttcaattgttctaagacattttcttattccctctttaacttcttccttgaaccagtgattgctcgaagacattttctaattccctctttaatttcttccttgacccagtggtcattcagcagcacgttgtttaatttccatgttgtgtgtgtgtgtgtgtgtgtgtgtgtgtgtgtgtgttgtttttgagctgggggtctcactctgttgcccaggctggagtgcagtggtgtgatctcatctcactgcaacttctgcctcatgggtacaagcaattctcctgcctcagcctcttgagtagctgagattataggtgtctgccaccacactcatctaatgtttgtatttttagtagagacgaggtttcaccatgtcagccaggctggtctcaaactcctgaccttaagtgatccacctgcctccacctcccaaagagctgggattataggcatgagccaccgtgcctggccaatttccatgcgtttgtatagttttcagtttctcttgttgatttttagttttccattgtggtctgagatgatactggatatgattttaattttaaaacattttttgagctttgttttgtggcttaagatatggtcgtttcctatagaatgttccatatgcttatgagaagtatgtgtattctgttgctgttgggtaaagtgttctgtaaatatctgttaggttaatttggtttttaagtgcagtgtaaaatcagtttttttaaaattaattttctctctagattatctgtctagtggtgagagttgggtggagtctgtttctccctttagatctaataatatttgatttatatatctgggtgctctgttgttggatccatgtatatgtttagaattgttacattctcttgctgaattgatccctttattattatataatgaccttctttgtcactttttgctctttttgacttaaagtctgtcttacctgatacaagtatagttacacctgcttgcttttggtttccttttgtatggaacatcttttcccatctttttgcagcatacaattgggtcatttaaaaaaaagaaaaactcctttcaaccagtctatatcttttaggtggaaagtttaactggtttacattcaaggctgtcattgatacatgcatgagggttaatttctgtcattgtattaattgattctggttgttttgtgtatcttttgtttcttattttctctcttattcattgtggtttggtggttttctgtcgtggtaacacttgaattatttcttttatttgtgtgtttgttttaccagtggagtttatatgtgttttgtaatggtagatattgttctttcacttccaagtatacaactctcttagtagagacggggtttcactgtgttggccaggctagtcttgaactcctgaccgcaggtgacctcaggtgattccccccaccacggcctcccaaagtgctgggattacaggcataagccactgtgcccagccagatgatctatttgcagtgtgattatcggctcattattttggtgtttttttttgttgaggggagtaccagatacctcgtcagtcatcttgaaacccctccttcctgactgtatttattgaaaaaataagtccacttccttcttcattacagatttgtccttttgttcctttgttttgtaacacctgtttttccttgcaggatgataaagtcaaatccctcctctgtagcttgatatgttatagaagttcaatgactgctgaacaagttttaaatgctgaatgtttcttgatgccaaaggagcaatcagttccaaacccagaaaaagatactgaatacaccctatataaaaaggaagaagaaataaagacggagaacttggataaatgtatggagaagacaagaaatggtgaagccaactttgattgttaaattattattgttgttgttgcagaggttctttttaaaaactttggtttggttaatacacagaaatatctagaaatgttctgggactagttgagttgtatctttagtattcaggttgtgaaaaataaagatgtttggctatgcacaa

SEQ ID NO: 2351 - DNA, 122346 bp, Homo sapiens; identical to SEQ ID NO: 2350

SEQ ID NO: 2352 - DNA, 122187 bp, Homo sapiens
gaaagtgtgaggtcagtagtagtttttgtggtacgtgcagtggtggccgcttcaaggactattttcgtcgctgcttgcgttttaagtctccaatcctgggacgaggcccatttcagggttttctgtcaccttctagccgcccgccaccccagaggggtgccagatgccccagtttttgagtgcatgcaggcaggcgaaagtggctcgaaaagacctccggcctgaatgatctccatgaagacgcggtcacgcagcctccacactctcttccccttctcgaaaattctgtgccatttaagtttcaaaatcccttataaaataagtgtcagagagctacgtgtacccgtttcttccaaattttcatcacgaagtggagatttggacgtactattttgtgatctctgtttgcagaaagtgggtacggcatcagtgccttcataatcagggcaagtcattttaaaataagatttaaaaactactctagaagtagcttcttggagtgtgtggagagatttccaaagtaattttaacttttactgaatttaagccttaatgctttccgtgggaatatatagtctccctaaaagttattacagcttttcagtcagttgaatttaaaaactgctttttgaccagtagaaaagaacccttgctttggagacattttcatgccacttacgaaaaatttttttaaaaaattaagttgtgacaaagtaatccatttttaaaattttatttttctgtgatgaggagttaatgttttccttttcataatgagagagcatttgaaactttagtatagtggtgttcctagacaacttttaaagctcttaaaaaattgcggtggcttaggcctgtaatcccggcactttgagaggccgaggtgggcaaatcacaaggtcaggagttcaagaccagcctggccaacatggtgaaaccccgtctctactaaaaatacaaaaattagctggacgtggtgtcacgcgccggtaatctcagctacttgggagggtgaggcaggagaattgcttgaacccggggggtggaggttgcagtgagctaagatctccagcctgagcgacagagcaagacttcgtttggggggaaaaaaaaaaaaacccataaaaaatctgtgttttaattttccttcaacacttatgaatggaaagtgcagtattttagtatattacagataaaattacatagtgtacatttattttggaatatttttgcatttgataaagtataatattatgtaattaaaattatttttgaagtaataggcaaaattttaggtatttttgcagtctttaatcccacggaatcttcaaaaatagtaaccaccgtgccttttacataaaatagactaccagtttaaagcatttgttctattacttgtaatgtttctctttgtttacattgtggaagtcctttttatgggaggatattttctaaaaaaagaatatgtacattgtttcaaagtattgatttatgtaagtgatcaaaatgtatatgagttcagtataagtttgtaaaagtttggctagagataattttaaggatagagattatatatgataaaattgcatctactacaaaatactcaaaagaattagttagtgaaggaaatattgagctcatttttaatatagagtttgaattttgataactgcatttaggacaaaacatttgtaagaattgaacatgatgtagtttagtcttcattcattattaatggtggattattgtaatctaatttaaggtattgttctagtttttcaggaattgttcaaatggatgaagatacacattacgataaaggtactgacactaaaaattattttggggtgtaagagctagatgatactgattaatttctaattttccttgtattgtgatttgattttagtggaagatgtggttggaagtcacatagaagatgcagtaacattttgggcccaggtaaatagcaaactggttgatatcccccctcacctcccccaatccagttcctccccaacaaaaacaaaaataaaacccaggaataaatacatttgtcattctcattgcctaatatttattgaattatttatcaccaggcattattaggagacaaatgttgacagctgtgatgttacttgactcattatgagtcaagtgttatgcccataatacaccaagtttgaaaaaagaaaattggcaagattgtgatttcagaattccactcaattctaggctgcttttgctggattctgagagcctgttgtatttgtgaagttatagccccatctaggggtcttttataagattgtttcttgaaggaggataagttaaaaatctcggtcgttttttctaatggcttaaatttgagatgtggtatttttctcattatagaattggaagcatgaatgaaacatttctgattttctgttgggagggtgtcagttaggtaaggttactcagttttaaatacaaagcaagcactgaagggctgtgttccacaatttaagaaggtaaattcctctgatgcacagaacgacctgctaatttttggttttgtaaactatacatgatacggaagggaaagaaattacgtttctctatactccctacagcatgggaactccttttggtggggggtgaggtgaactcgtaatgtgggaaataaggagaatatatgagaagaaagttctagaagaatatgattaacccagagttcttaaatatatagtcatgcatcacttaatgactgggatacatacagagaaatgcatcattaggcaactgcgtcgctgtatgaacatcatagaatgtacttagagaaacctggatgatatagcctaccacatacctaggccatgtggtgtacctgtacctcatgttactgtactgaatgctgcagacaattgtaacacaatattaagtctttatgtatctaaacatgaaggtacagtaaaaacatattataaaagattaaaaagtggtacacctgtatagggcactcaccatgaatggagcttgcaggattagaaattgctttgggtgagtcattgagtgagtagtgaggaatgtgaagtcctgggacattactgtacactactgtatactttataaataccatacacttaggctacactaaatttataaaaatatttttcttcaataaaccttagcttactgtaacttttaataaacttttgactcatttgtagtaacacagcttaaaacaaacattgtagagctgtgcaaaaatattctttacgtccttattctaaagctttcttctctttttaaacttttaatttttttttactttaaaaactttttggttaaaaacgaagacaagatcttcaatatcactgtctttcacttccgcttcttgtcctactagaaggtcttcagggtcagtaatgtgcatggagctgtcatcttctgtaataaaaatgcccttttggaataccttcagaaggacttgaggcggctgtacagttaacttttttaaataagtaggagtacactaaaataagaaaaattatagtaaaaaaaaatatatatatacacacacaccagtgacatagttattttcattaccaagtattatgtactgtacataattgtatgtgctgtgcttttgtgagactggggcacggtaggtttacaccagcatcaccacaaatatgtgagtaatgcattgttctatgatgttacaatggctaggactacactaggcaataggaatttttcagcttcattataatcttacgggactactgtagtgtgtgtggttcattctttgaccacaatgtcactatgtggggcatggctgcatgtaaaaaaaaattgtagaagggtgatgttatagaaaacttggggcaaattcgtgtgtctgcttatgcacatatatttggcaaatttgtttctgcttatgcatattctctaaaggttgctcacacgttctggttccatgcccattgtctctgtattagtgacaactgcatcactctcaacagtgtcccagggtggatgataaattatatttaagcttattatacagaaacatcatttatcagtgtaaaaagattttctagactagtgctgtctagtagaaatatatgagccatgtaagtaattttaaaacatttttggcagccacattgaagaaactaaaaatagcaggtgacattttaataagtacattttatttaactcaatatatccaaaatattgtttcaaaatataattagcataaaaatgtgaacaggatagtttatatttcctttttaatattgtctttgaaatccagtgtgtatattagacttacagcatatctccttagactagccatatttcaagtgggtattggctattgtattcactagtgcagctctagactttgatttcagtttactttatttgtgaatatgttgattgaatttggagcaaattcaagagtcagcagttttttttttgtaaaggatcagatgatgagtattttaccatttttaggccatacagtttgttttgcagctattcaattctgccaacatagtgcaaagcagccatagacataatgtgaatgagtgtgtgtagctgtgatgcagtaaactttatttactaaaacaggcggctgtaatttgccaacctctgagttaaaccatgaagttgaggctcttgtagaagaacgtttaaaacaggaaacatgcgcatgaaaagattaaacattaaaactactaatggtatataaatgaatgtagtggttatttcaataagcaaattggcaaatttggttggggttatggtgggatataggcatagagaagactagagatttggaaatacgcgtaggcagattaggatgaaaatctgctcacgtgtattctccatttttttttgccctgtgggcttctgccttataaaccacttataagcaaacacttcagattggatgagtggcagctgaaggaatctgacgtatttgactccacctgtttctttgaaagaacaagcttctggtcaggcatggtggctcatgcctgtaatcccaacactttgggagacctatgtgagaggatcgcctgagcccaggagtttgagaccagccttggcaacagtaagaccttgtcgctacaaaaaaaaaaaaaaaaattagccaggcatggtggtgcatgcttgtgttcccagctatgtgggaggctgagggtgggaagattgcctgggcccaggagattgagactgcagtgagctgagattgcaccaaacaaacaaacaaacaaagagctcctatttgttttagtctgtatagtgaaaaaatatagttatatggaatattttgattccaggggtttgttcacaaaggctgcttctcttgtttctcagggtcagtttaaattcagttcctgttctatgctgagactttgatattcatcatgatgttctttgaactgctctttcagagttttttttcagtcatcacggataatcatgttctttctagcattattgaatattttgttggtatatttctttagaacatatatatatatttaacattttattttgaagaaactttgacttacaggaatgttgcaaaattagtacagaggctagaatgtggctctgtatactcttcacccagcttcctttaatgctaatgtgttatataaccacagtacagtgatcaaagccagggaattaacattagtacaatgctattaactaaactacagcccttatttaaattttagcagttttttgtctttttgtgttccaggatccaatacagaatcccaaattgtatttagttgtgtatccttggtttcctttaacctctgaatgttcctcagtttttccttgtatttcaagacttttgacacttctgatgaatattagttattttgtagagtatcttttaatttgggtttgtttgatgatttcttatgaatagattagcaagagttccacagaagtgatattgtagtcctctcagtatatcatattggggtttcatgatgtgatataccttcttattgatgataaccttgattcacttgggtaaggtggcaacttccaggttttttcgctgtaaagttactcttttcttttgtaattaattaatgttttaggagacttattgtggctgtctaatccagtttctgttcaacttttcacccacgaattttattgtttattgctctagtgcttgcctaatgatgattttctattcccctcattccttccacatttattaattggaattcttctgtaaggaagagctgtctcttctctgccatttatttattcaattatttatattaatataaactcaaggatatttattccgtgggttataatcctatgctatcataatttattttgttgtttaaattattcagccttggccattgggacaaagttcaccaaagaatacagattggtacttgtccttaaacgtctcctattctttttttgagcacttttttttttttttttttcaagacagggtctccgtcaccaaggctagagtgcagtagtgtgctcatggctcattgcagtctcgaacttctgggctcaagcaatcctcccacctcatcttcctgtgtagttggaactataggtgcacactaccatgcccggctaatcttttgtattatttttgtagagacaggatttcaccacattgccaagctagtctcaaactcctgggctcaaaaatgatcctcccacctcggccctccaaagtgatgggattacaggtgtgagccatcgcaacctgcttttttttttttttttttttttttttttagcatttctttactttctggcaccatcaaatgtcccaggatcatcttttatttcccagtttgagctctgcaatcaaatcaatctttaaggaatcctttccatatgatttaattatatttggtatcttgtttgaattctacctaatttgaacacattgggaagtaaactttttctatggcctagtctcatttcttataaataactcatttaaattatgaaaaaatacaggcataagaagttgatttaatttctaatggcctaaaatcttttaagtttatcatgcttagaaccctcaagcgtgtaacactgtaaaataatattttactgtatcttatactatatctaatctttctagagtatcaatagaaataaggatatcatgaagattggttgctcactgtctgaagtttgcccccaggccagttcagttttggggaatcttgacccaaacaaggtgagccatattcttgaatataattatttcattcctcctgtcagctttcctgtgtcttagatatttagtttttggagttcctggtatatttgaaaagaagaggctgatttttggaatttgtataaactactgttatggtatatttattaattcaaaaatacttatggactgaatattactcagtcttgaaatttgacgtaagctacaacatggatgaatcttcaggacattagctaaataagccagtcacaagaggacaaatactgttatggttctacttgtatgaagtacttagagtagtcaaaatcatagagacagaaaaagtgagtgatggttatcagggactgggggaagattgaggatgaggagttattgattaatgggtgtagagtttcagttttacaacatgaaaagagctatggagatggatgatgaatggtggcgaaggttgcagaacagtatgaatgtacttaatgccactgaactgtatacttaacaatggtcaagatagtcaattttatgttatgtatagtttactacagttaaaaataggaaaagtagaattaaaagctacactattctagccaaaaaaacaaaagtgaagaaaacgtatgtactgtctgccatgtacctggcactgtattaagcattaagtaagtatgcagtggtgaacaaactagattccttgcatttgactttgattcacaaaaaatttgtaagatgcatctttatgcagagcaatttggcttttttcttttttactgagttataacttgtatacagtaaggtatatatctcttaagatcctaagtatatagcttggtgagtttttacgtgtgtatgtatccatgtaaccaccatccagatcaacatatggttctatcatttcagaaaattccttcgggccccttctcagtcaattcttagtcagtagtttctccatcagaggtataaccctcattttgatactatcaccatagattcgtatgtctgttcttaaatcatggagtatgtagtttattgtatgtatctggcttcttttgttcaacataatttctgagattcatttatattgttgtgtgtattagtgtattggtagtctgttcttttttaagctatttaacattcattgtataaatataacacaatttatcgatctgttctcctttgatgggcatttggattttttgcagtttttaactactctgaatgaaactgccgtgaaatccttatataagtcttctgctggatgtattgactcatttcttttgcacatatatctagagtagaattgctaaattgtagggtagacatgtttctgccaaagtagatactgccaaacagctttgcaaaagtgttgaaccaatttacattcttatcagcaatttatgagagttatagttcctcgatatcctcaccagccccctgctttgctagtgtactgaggttgtgttttaatatttttattagccctttggaaggggtcttgtgaagtacctattcacatcttttccccatttttaaattaggttatttgtcttgattgatttgtaggcattctgtatgtttttttcactttaattttcatttttgtttctacctcttaaagtcaatgataaagtcacaactgtaaaatgaatgcatttaaaaaataaaagatatatttcaatgacaaaaagtatgcaatgatcatgaaaatctactgtacactttgccaaggccaaagaatgaaagacaatatgaaaaagccaatcttcaaatatatcctcaacaaaaactccctcctaaatagtaaaattatcatttaagaatatttgtctttacacatctaaacagaagctctaaccaaaaaaaaagtgggggaaagggcagatgataactctccacaagttttccagatataaacatgtggtcaccaggaattcaagattaaacttctaaagcaacatttaactcaaaataaagtgaacatttctgacaggtgacaacagtagtatgaaactgatttttcctttcctaaatagaaatgagatggggcatttcagtaatcatctaagaataactgtagaaatactcccaattctaccaccccacccactggtataaaacagataccttccatgaaagtatctttcacattactgaaatatcctcacttacttgggacaatttcatgcttagatgagtataaacacttgtttttaggtgtgtggaattattggagctgagatttttgaaacaatatctgaatcttagcagagatataataatactttcactatacattgattgggcttccttaaccaaatctgagcaactactgtaataacaatgctggtggtagtccatgatactctcaaattttttccctttaagaaatatataatccatgtaatactagtaaatatgttacattgtacaccttcttaacaaagaatgtctgttttcaggccttactaggaaaacaaacaaacaatggcagttactgcctgtttttatcactgataagctacaataaagctcaaatgatggatggtttacgtgtgtgatattaagtacaaaatgaaagccattataattttaccaaaagaaacacgaaaaatatgggaagaagtgaaatgaacatggcatgggtcccaaagattacgatatgtttcagaacaggattttgaaaacaaacaatttctgtgaatatttcttatactagaaagatccaaagcaaatctaggcaagcttagccctaccttgtcaaagataaatactcagataagttggaagttccgtttgctaaagtgcatctgggatcatatctaccctgctacttagagacagccaggaaggtggccatcactcatgctctttcactctttctgtgtcttatcaagagtcacacgtaacaatttttttttcaaaccaaatgctttatatagtgaactacaggaaaaacaattctaaatacacttttaaaatgctagagagttaagataacctcattaaagaaaaaatactgaaaatgtaaagggtccatacaaactaagagctgtattaagtgtatactttctattttaataattcacttggctgtgctcttaaaatgagagaagcagatattttacccatgtcttctggcaagagattcaaaagcagaagtagcaggactgtaaaatttcataaaatttgtgggattttttaaagctaaattattcaatatcttgtacagttttgtacccatatattaccccggaatatatgtacagcatcccagcaacagtgactgcaacaaaagtaaggtaaataggtctacaaagcatttgatttccttattagagaaagtttttatagaggaaatgcaaacaactgcaattcagatcacattatataagcttgatgattatttaaaccttatataaaattaaatctaacccttaccactacaaatctgtaaggaatcagaaaaggatttatagtacacaagtcttgattactgtttcattccactttgatatcactctgagctaaaacagcattcttccaagatttaaagaaaaatagattttataaaagggattcttttacattattattgttactgacagaaacaagttttgcttttttccactataattcgctctgatgaaagaaataattctctctcttaactcctaacaaacgctacattttcaagactaagggaattactggtggcattctttctccttgatctaaactatttgtctctaaaatatgtcaagtaagcttttaaagattcaggaaggggcagcgttgtgatttttttctcagtaaattttgaggtggctcctctggcttcattgcttcactgtgatctttttcttcctcttctttgttatcttccattttttcatcctcctctctgtccagaggctgaggaataagctgattacccacaaatatgtatgtgttagttctctgtttaactctctttttttttttccttttgggtggagccctttgcggaatccccttggcctgcatctcatcatttatgaaatttctaagtgtgcgtcgaatgtaaatacaagccaagccctgtggattcctgacagcacagggagggagtcccacagaatctggtttaccattatcattcttacttggctgcacaagtggagcaaatgacacaataaggatatttttcctttcccaagtgttttgtccagttctgcgttaactgatcctctacaggcatgatcctctacattcatttgatcttcaatcagtgataccctttcttccacttgatcaaatcagctactgaagcttgtgcatgcgtcacgtagttctcgtgccatggttctcagctccatcaggtcattaaggacttctctacactgtttattctagttagccattcgtctaatttttttcaaggtttttagcttctttgcagtgggtttgaacatcctcctttagcttggagaagtttgttattaccaatcgtctgaagccttcttctctcaactcatcaaagtcattctccatccagctttgttccgttgctggcgaggagctgcgttcttttggagaagaggcgctctgatttttagaattttcggcttttctgctttggtctctccccatctttgtggttttatctactttttgtctttgatgatggtgacgtacagatggggttttggtgtggatgtcctttctgtttgttagttttccttctaacagtcaggaccttcacgtcctcagctgcaggtctgttggagtttgctggaggtccactccagaccctgtttgcctgggtatcaccagcggaggctgcagaacagcaaatattgcggaatggcagatgttgctgcctgatcgttcttctggaagcttcgtctcagaggggcacccggctgtatgaggtgtcagtctgcccctactggggggtgcctcccagttaggctactcgggggtcagggacccacttgaggatacagtctgtctgttctcagatctcaaagtctatgctgggagaaccactactctcttcaaagctgtcagacagggacgtttaagtctgcagaagtttctgctgccttttgttcagctatgccctgcctccagaggtggagtctacagaggcaggcaggcctccttgagctgtggtgggccccacccagttcaagcttcccggtggctttgtttacctactcaagcctcagcagtggcggacgcccctcccccagcctcgccgccgccttgcagttcatctgagactgctgtgctagcagtgagcgaggctccgtgggcatgggaccctcggagccaggcgtgggatataatctcctcgtgtgctgttggctaaggctattggaaaagtgcagtattagggtgagagtgtcccgaatttcccggtaccatctgtcatggcttccctttgctaggaaagggaattctctgaccccttgcacttcctgggtgaggcgatacctgccctgctccgtgggctgcacccactgtctgacaagccccagtgagatgaacccggtacctcagttggaaatgcagaaatcacccgtcttctgcgtcgctcacactgggagcttcagactggagctgttcctattcggccatcttggaacctctctctcctcttttctttataaatcttgattttacttttatttgctgaaacagtctaatgccaattctcctttctatattaatggagaatgagcatgcagataagtgtctctatatgattccttgacagatttctttcagagactatgtctataaaaattagcccatctgagacccatcattggagccaactcattcctcaatttttaaaattttttttatggggggattacaggtgtgagccactgtgcctgacctatgactgtgtttaatattgttataaattaagacatactccttttcttctattgaatataaaattaattaccttatcaaaaatttaaacaagtgtcagtaattaagtgattaatcagctacttctgattgttcataaatggattatactttgtcagttttccttagtgatctaaatggttctctccctctgccaccatgtagaagggtcataggctatgaatagtggagttgtgggaggagaagattgggcccaggcacaatgagagtgaatatatagttttcactatgtcatgagaacagataagtctatctgggatagatttacatgttttggtggttgtattacactaacagagccacgaacttcagattcttcactttgttgagtactgttatacctaggcgagttagagaaacgccacactctgagacgaattaagagtcctttatttaagctggcggccaaagagacggctaatgctcaaaattctctcggcccggaggaaggggcttgattaactttcataccttggtttaggaaggggaggggaactcaaatgcagtaattctacagaagtaaaaacatgcaagaatcaaaagaagcaaatggttacagagagataaacaatttaaaagacaaatggttacaaaaagcaaggtaccaggtgcagggctctaaatccttcattataattagatataaatgctatgccggacaggaactcaaggctttatgttgttatctctttgaaaaaaatcctgggaacttcatacattgtttgtgccagtaccttatcagttaattgggctcctttgaaatgctgaggatctgcttacacaggtcaactccttgcggaaggaggttgggtaaggagcccttagtgtcttgtaaattaaggggtcaattggagtttgtccggctttcccagctagagagagtcttacttgagaagcaaggctaggtgattaaagagacaaacaggacaaaatttaaagtagcgagttagagtaaaaacaaggttaggcattacagtaccagctctattcttggacacaagtgttcccagccctgcctcacctggtttgcaataaaccattgcatatctgtcgcttaccttataccaaattattaatcatattgtgatgttattacaaagccttaattaaagatgatgcagtcttttgcagggattgaaattggttaggactgttgattgtcagctatttttgctacttacccctgtcttcttaccagggttgagagagagtaccgtactattactgctctctcttgccctttagttgtttaatgttagctgaagaaaccggagttaattatgaattgaatacacttatcctttgtagcttttgaattgttatttatttatttgtttgtctgaatttatgtgttctttattgttttggtgaataggtttggtgtttaggtttcataaaataaatctgtggatttgtcctagttcagagtgatacattgaaattaattttataatccataacttaaagcagtattcttcagccatttttctcattattccctcctaaggagcatttttagacctgttttctccctaatggcctaatgggccttctccccttcagatattttaatactacagatatacagtatataataactatgttatcagtagggttgaactttggagggctacagaccattgtagtgtttaagatttccaactctccataaggaccacttttattccccttagggatattgccccagttgagaatgtatgatttaaagctgttaaggccaggcatgggggctcatgcccgtaatcccagcactttgggaggccgaggcaggaggattggttgaggccaggagttcaaaaccagtcttgggcaacatagtgagaccctgtttctacaaaaaaaaaaaaaaaaaaaaaaaaagctaggtatggtatgtgtgcctgtaaccccagatatttgggaggctgaagcgggaggattgtgtgagcccagaagtttgaggctacagtgagctatgatcatgccactgcactccagcctggacaacagagtaaaaccttatctcaaaaaaagtagttatcagcctgcagtgatttttgtatccttcccaatccaatcatggcttacttcatttttgttactgtaaagaaatacctgagactgggtaatttataaagaaaagaggtttatttggctcatggttctgtaggctgtacaaaaagcataactccaacatagtatagttgagagttagacttaagtggcatgtacttcgcatgtttatgttttaaaaaaattataccaattatgtcttcagacattaaaatagtatgattttaagtgtttgatgcctgtgtcttctaaaaaaagtctttttgctttttatacaactctaacaagggactcagggtgcttccacaaatattagaaggtgaagaggagccagtgtctgtagattacatggtgagagaggaagcaaagggaggaagaggtgccaggctcttttcaacaaccagttctcttaggaactatgagtgaaaactcattcacttccacgagaatggcaccaagccgtttttagggatctgcctctactatccaatcacctcctaccaggcccccctccaacattgggaatcagattttaacatgagatttggtggatgatatccaaatgatatccatctaaatcatagacaccttcaggagacatttgacagtgtttggagacgtttttgcttgtcacaactggaagtggtgctactggcatctagtgtctagaggccagaagggatgttggtaaatatcttacaatgcacaggacagaggacagccccactctgccactcaacacagactcatctggtcccaagtgccagtagtgctaaggctactttgaagttcgagaaaatgaaagccagcctgggcaacatggtgagaccttgcctctacaaaaaaaaaaaaaaaaaaaaaaaaaaaatacaaaacttagcccaggcgtggtggtgcgtgcccatgttcccagctaccgtggggactgaggtgggaggatcacttgagcttggagaggttgagtcagcagagagccatgactgctgcactgcactccaggcctggcgacagaatgagaccctgtctcaaaaaaaaaaaaagaaaagaaaatgattgaaagtacataaattttctctttattcttttattaaacatcattcaattgagatataaaataaagtacagtattaaagatattatctaatttagttttatctacttaataggactaatgtccttatacgtaaagtaaaaagtatgaaatctttcttgcttggtaggaaatatgaattccactatagttgagagttagacttacgtggcatgtacttgccatgtttatgttaaaaaaaattgtaccaattatcgcctcagatattataatagtgtgattttaagtgtttgatgcttgtgccttaaaaaatttttttttttgctttttatacccctccctcctcattttggagatgcagaatagcataatgaactctgaagtcagaagtttgaatcttggttctgcagtttactagtttatgtctttggatacatagtggcataaacaaagtacctgcctgataggattgtgagaattaaatgagttatatataaagtacttattgacatataggaagagcttaaatgctaacctttattctgatctgttcaccatgctttaaatgccaagtaattttgctttcttttctctttgtagatttatggtggattattttctgaagatcagtgttggtacagatgcaaagtactgaaaatcatcagcgttgaaaaggcaggaaattaagtgttcagtttttttttgctttaagaaatatttattgtggttcaaaaatttgatgcttatttagcccttcattgcttattcgtagtactgatacctggttcagtgattaaaacacagaagaaattaattgctaaaaaacatgttgttttataatcacctcagattattcaagaatagattatataatatgtaggttatttttggtgactagttatttttacctcagttcttttttttttttttttttttttttgagatggagtctttctgtgtcgcccaggctggagtgcagtggtacgatcttggctcactgcaaactctgcctcctaggttcaagctattctcctgcctcagcctcccaagtagctgggattacaggcgcccaccaacacactggctaatttttgtatttttagtagagacggggtttcaccatgtttgtcaggctggtcgaacttctgacctcaggtgatccgtccgcctcagcctccgaaagtgctgggattacaggagtgagccactgtgcccagcctgcctcagatcttaataattatatttggttcttgagtaacttttaaatgttcattttattaagctttataagtaggagaagaacattttgattgattcttctgaagttaggtatatcttttatttagttgatgtgaatattgttaataataatgattggcttgccactttcttatgcctgggttaaatgtggtgagttttctttgtgttaagcttttttttttttttttttttttttttttgacattgtgaatttgtggaggatttttaagaggatttagggagacagaattctgaatagctgtttggtgacagttgcatattgcaggctgggtgaaagcacctctgtaagatttcctttggtgttttttctacacctcctttctgtacttaaattataatatgtatgtttttactgaaccagggaaagtggttcaggataaaagagaaaaagttaaaaatatgtatgtttcagaaatattttctttggtgtgataagatgctaagatgtgacaatttgattaatattctgaatagcttggtttaaaaaaatttcattttttgctgtcatagaaaatggtttattttagtggaatggaactttctaattgacctttctcccataatttgacaactggagatgatattttacatatgtttttcagttggctttaattttttaaattaaagggcagcatgatgtttgaccttgtaataactatttttcttttttactttttaaacagatgtagagctggaggtaagggtggtgaatctgattagtttacatggtctacctggagtgagtttaattgtgtcaaaggaagtttgataactttgcctttcttttcagattttattctttccaacttgaaattgaattgaatgttgattgattttaacattaggagaaacaggagagggctgtaagcttcataggctgatgtttatttaaaatatcaattgtctaaaaacaaaaagcaccctaatgagaaatggtactgttggaatttaactagtaacaagtaaagaaatcactgtaatttcatggactgtggattttttttttattttgaagatattagaaatctgtttctgaatgtattttgtcattttgaggtaagaatgctattttgatatacaggtcattaacagagagcagcaaattggtggtttctttggaaacatttaatctggggtcagtattcgtatttgtctcttattttttccagtgtctggtgaggtacattgactatggaaatactgaaattctaaatcgatctgatatagttgaaattcctttggagctgcagttttctagtgttgccaaaaagtataaactttggggactacacattccttctgatcaagaagttacccagtttgatcaggcaagtcacgtattttaaatatttttgctaatgaaagtaaaactatgtgcttgaaacaaaatgtaggtatagttaaatcttactttaatataaaagtctgtataaattagtgaaaaataggaattataattagaaagcaattatatatttatgctcatctttgctaggtaaacattgaacagataagaatgacatacacatatataatatatgtaaatagtttccttctgatgtaaatgtttaaaaggatagtctctttttgtttttttttttttttttgagacagagtctgactctgttgcccaggctggagtgcagtagcgtgatctcggctcactgcaacctctgcctcccaggttcaagcaattcttctgcctcagcctcccgaatagctggattacaggcctgtgccaccatgtccagctaatttttgtatttttggtagagttggggttttaccatgttggccaggctggtctcgaactcctgaccccaggtgatccacccaccttggccttccaaagtgctgggattacaagcatgagccactgcgcccagccaaggatagtctcttatatgatggagaaaataatgaatacagttatttctataattgttttgggaaagtatttattaaataaaagtgatctttacctagtcctggccataaataccacaaatttgaaattaatggggttataattaatcagattgtattattttggcagaggctcatactgtttgatgtaataattggcagtggatgttttgcttatgtggattctagtttatattactttccattgaattttgggttggtaacctaattctggaagacgttcgataatttcaggggtagtcttacaggaattctacctcttttaaaatctgttatacaaagatgattcttttggtaaatggtaatgctggtgagagatattacattggaaagtaatcagatttgtaattcttatttataatagcagctcaagtagctcatgtggaaaacagtttaatcattgtaagcattataaagaaattaattaaaattgcctctatttttctttgagaatcttgtaggtgtgttgggtatagttttgtctgctatgtagttacttataaaaaacatttctgtacatgaaactcaggctttcataaacatgaaatatagatattataaaattacaccccaagtttctggtttaaaatctaaagtttgttactttcttctttaatataaatgctttgaccaaggttggggaggcttgttttggatttcttgcatgcataaaactctaaaatcttgtttacggaccttagaatattatctgctctcactttgttttacatatagggaaattgtagtctagaataattaaatgacttcaagtcgtgaagctaactagggaagagctaggcctagaactcaagtctgttgttcttttcatagtaaaatgcacagatttgtgttgattgaaacacacatgaatcaagggggaaaaagacattaaaaaaagttaattttagaactgaattaataaactgcagctgagaatgtttttgtatgtttcaaagattctttatatatggtactgtatataaacatttatatatatatatatatatatattttttttttttttttttggttgggggttgaagtcttgctctgttgcccaggctggagtgcaatggcatgatctcggctcactgcaacctccgcctcttgggttcaagcgattctcctgcctcagtctcctgatagctggaattacaggcacccgccaccacgcatggctaatttttgtatttttagtagaggtggggtttcaccatgttggccaggctggtcttgaactcctgacttcaagagatccccctgtctctgccttccaaagtgctgggattacaggcatgagccacccggctaaacatttgtatttggatgcttagttcagtaaaaagatcattgattagagttaagctaattggcacacaatgttttctggaaaaaaatgagctattcttgaatagctctgcttagaaagtccgtgtttagttattaattctcagcccaaagctcaactctaatcttctatatgaagtctttgctaatacccacttacccggtcctctgtggtgttttagtcactccgtatataaagcctataaagttgtaattttttcctcccctacaagcttagtgagtttggtagagataagtattcacttttctgtgcctaatttccctgccaggtaggtgttagatgagcattagtttatctaacatttgaataaatagatgaacagcagggattcagtaacaacacaaatacctccttccttccccttttccagaaggtgtcctgggcactgaaattccttcacatttttttaactaacactttcacgctatgctgcagcacagtcagaattgatgctcagaatggtagtttgctgaagatcgagagaatattacattactagtcctacatgcctgactttaaaaattatatgtagggtaagggaatgagagctagagcttggaatttgtgtttaacaatttaaaggccttttagcttgttttctaatatatacaggcagaattcagaggaataaagtagaaagcaagtgatcctttcttgtttctgaatgaagcttaccagtttggaaaacagaatgaaatatatttctaaaaagtgacattcatcttttttaatgattgaaagccttatgttctaaaccagtgaccagatttattttaaaaagttaagttttgtccagtgcggtggctcatgcctgtaagcccagcactttcggaggctgaagtgggtggatggcttgagtccaggagtttgagaccagcttgggcaacatgggaaaaccctgtctgtataaaaaatacaaaaaaattagctgggcatggtggcgcatgcctgtagtccccgctactcaggaggctgaggtgggaggattgcttgagcttgaggggtcaaggctgtgagaccctgtctgaaaaaaaaaagataaaagttaagttttataccttttaaatgcctaaatatattttttaagtgcaggtatatatctccagctcataagggttagtggaaaatatatttcttatgataaaaattaaatgtttatatgtattatatataaagagaaaacatacatatttttggtatagtattaaaacacccatgtatcatatactctgtcattctttttgttagttggaactgaggaagactcagattttatttcaagttcagggttctgtgtttatgattatatatgattcagggagaatctgtttgaaccacttcatactaattgtgattggtgactgtaactaaaatgaatttgaattcagagagaaatctaaaattagatttctgcataaaaattctatgcaaggagtaatggacctttagaacattcagctttaggtaattgaaacttttgtagacaataggttatttccatttgaattcacgtattgcccaaagacagggtttcttgaaatattaataattccacatataccagcaataattttcaaagacttcctaggggcagaagttgttcttgaattttagatagacttttgataataagagttgaaagcaagggtttttatgtgaaagaggttaactggaaaactacatctaattgattaaaatcctaacatatatttcagttagttatattttgaggttgttagctttgcctgcttgatcccatttgattggtgataacttctggactgtatttgttatttatactgatataattgatataatatattgatataatatattgaattcttggtgaattcaaacctcttgatataatgtgtgtatttctgaattttatgccttggaaaatttataaaacctgtgtttttgttaacctaaagtattataggaattttatgccttgaaaaatttataaaacctgtgtgtttgttaacctaaagtattttcgtgttttgtggatttaaaaaattattttttcagctaggcacagggtgtgtgcctgtaatcacagctacttaggaggctgaagtgggaggattgcttgggcccaggagttcaagaccagcttgagcaaacatagcaagaccccatctaaaaaattctttttttttttttttttgggtagtgatagttggtgattcttgagcatatgtagtttgagtctccttctctgccccttcagatgcatccttgtaggcccaggtatcctcaacctgttgttaaaataaatgtgtcagctgggtgcggtgtctcacgcctgtaatcccagctctttgggagactgaggtgggcggatcacgaggtcaggagatcgagaccatcctggctaacatggtgaaaccccatctctactacaaaatacaaaaaattagctggtcatggtggtgggtgcctgtagtcccagctacttgggaggctgaggcaggagaatggtgtgaacctgggagatggagcttgcagtgagccgagatagcgccactgcactcccacctgggcgacaaagccagactccattcaaaaaataaaaaaataaaaaaaaaatgtgtcccaatgaaataattttttttgtaatcctatgtatttcatacatttaaaaacattctgagaaaaagtccaaagatttcacctgactgataaaggagccccatggccacaaaaaggttaagaattcctacatcggtctcaattttaccctctatactactgtgtagttgaagagaaaatagttcttaaaaatgttatttagtttcttggaccttgacttccccacaccccctatttcttttaaaaatgtgaccggtttgtattttgtggtttttagtgtgtttttacactcttgtttgtctgattattacgggtatgatgtcctgttcggtttgctttgtttgcataaactatattgttttttgtatttatagagtgggaatgtagctaaaaatacagctccaccttctaagagagatacgtttcatcagatgatgtccctatttcaaggaagttgtgaaccagtaaatttgagctgtacctacccattttgtgttttaagtttatgctttatatattccgaaaaagaatacttacttttaatttcctttatagtacgcacagggtgaaattcaggaaaataacctagagaaatttgggaagagcagttagattgtgtcaaagtaattttagtaattacagttttatggaggagtagataagttcttattaaaattaagtctcaatatgttccaatcccaaatatgttttaggtgtatctttgcttagttctattgatagatattcagtagctcaaagttagcaagcacctaatttctcatatgccagttgtacagttgtagccctcttaagcaaaagtctatttaagagagttttgaatgtagaaggccaggcgaggtggctcacccctgtaatcccagcactttgggaggccgaggtgggcggatcacttgaggttaggagtttgagaccagctcaactgacacggtgaaaccccatctctactaaaaatagaaaaattaggcaggtgtggtggtgtgtgccagtagtcccggttactggggaggctgaggcaggagaatcgcttgaaccggggaggcagaggttgcaatgagccgagattgtgccactgcactccagcctgtgcgacagagtgagattctgtctcaaaaaagaagaaaaacaaagttttgaatatgtatttgtgacacctcacattttataatttcagtttgttgatttttaaagaatttgttcgtattttgtgctttcggtttgtggctttttttgcttctgctcgtcttactttaaaaccagagttcctgactctgcctctaaaactttcaaagttttgtaaaatcgagtaccttttctagatatcagagattcatttttatgcgctattgcttttcaggagaccattatatttagttggggccaaagtaatcaatgtaatctgctgggttaaaaaaaactattctaggatatttacttagtatacatttttagatttataaaggtggctgcctgtacaagtatttagctctacttgattttagcaagtgtgtaattggaatacattcatatacgtggagatgcatatttgcatattatagccaacagcaaagtaatatagagattttagaatgaagaaatatgatgcttggaaaaaatgggtaggaacaaaataagggaagagaaacatgttggtgtagctggtttatgttttcttctttcttagggcacaacctttttggggagcttgatttttgaaaaggaaataaaaatgagaattaaagcaacctctgaagatggaacagttattgctcaggctgagtatggcagtgtggatataggggaagaggtgcttaagaaaggatttgcagagaaatgcagacttgcttccagaactgacatctgtgaggaaaaaaaattggatcctggtcaacttgttctcaggaacctcaaaagccccattcctttgtgggggcatagatcaaaccagtcaaccttcagcaggcccaaggggcacttaagtgagaaaatgactcttgacttgaaggatgaaaatgatgcaggcaatcttataacatttccaaagtaagaatttagtcttcactaatttctaattgatggtagaggtccctgtcatagtagaatagaagttaaggcttatgcttttggaatcctttactgtgtcagtgattttaagggctgatgctgatatttctgtttttctcaaatgtattcctctctgctttagcagggatattttcattaaaagctattttgaaagaaaaataactcctgaattattttaaagtttacataccaacttttcatgccaactatttggaatacacttatcaaaaataaaaatctgctcctaaatctgaattattcaggcaaagtcagaatttcagataagatttgaagttcttcctatggctttaggaatattttaaagagtttcaggaaattgcctttacttttttaataaaagtgaggctctttcttcttcttgtgaaaacttgtgatggagtttgattattccgaatactttactttttagataattttaaattatcaacttgaagcagaaatccagatttgatatttatatgtatcaaaacagtcttctatatcatggtccaagccatgatgctgtatcttggatgacatagctgtttgatgggatctcatcagtgctttaggagctaaactgtcaaatgggggtgggaggcggtggacggggggatcacaggggatcacaggacggggggatcacgggggggggatcacaggagggactggaaaaaaactaatacagaaatgctttttactttgttctctgtagttgatagtgctatgaagaagttggaatatttttttttgagaattagaggcattattgaattacgacttcagttataaaatcttgtttgcattaaattattttttaatattatgaactaggtaaatattttagttttcaaaattaactttcagatatattgtggcataaaaggaccaagataacttagatttgttttctgtgtcagccttatacagtttgtttgtcaaaataaatgaatttgtttttatagggaaagtttggctgttggtgactttaatttagggtctaacgtcagcctggaaaaaattaagcaggaccagaaactgattgaagaaaatgaaaaacttaaaacagagaaggacgctcttcttgaaagttataaggcgttagaattgaaagtagagcagattgcccaggagctgcaggtatgttcagtggcttaaggtgaagagtgtccaactgggaaatctgtgtactcatctgctgctatttatttttctgtcactttcctttccttccccacctcattctctcctttgctaatccctgtatttgtttataggtgaattttttttcatatactccagactaatcatctttggatttcattggatgtttgcaaatttaataatttctcatttacatttccctttatgttctaaaaacttttcaactaaggcaattttcaaacattctaaaaggagagagacttgaataattaattctcatgtgcccatcacccagtttatacaattataacacatggccaatctttttaaaaatttacacttcctggattattttagaagaagtcccattcatattatttcatagtcttcagtatgtatgactaatagaaaaggactttaaaaaaccgtaataataatactattcatacttaaaagtaaacaataattccttaatattatttatatccaggcagtattcaaatttgccatattgtgtcatgaatgccacatgattgtaggcatgttgattgtagttttctccaatcaggatcccagttaggcacatacattgcattttggttgatatttctcttaaattgctttaatgtgtttccttgtgttgcttaactggattcttgatctccacgtgtgtcttcttttatggtaatcacgtctccagatttgctcagattttagttcagaaattttcccccccagggatacagtgtggttgataagtgtgtgtgtgtgtgtgtgtgtgtgtgtgtgtgtatgtgtgtttaacaccaaatctgttgttcctgcactagttcctccaattctctgacaccaactgggtgtctaataattcagctccattctgacactacattacctgtacttagcatataccctacaagttaaggactcagttccataaagctgcctctactttagatgccagccacaaatggggtccccaggctacttgcatatctacccccccactataaattcggggtttcccatgaccctccctcaggttagataattcactagaactactcacagaactcacggaagtgctatacttacagttttattattaaggatataactcagaaacagccaaataaatggaagatatatataaggcaaggtactggggcaggaggtacagagcttccatgccctttctgagtgtgccaccctcccaggtcatggatgtgtttatcaacccagaagctccccaaatctcattcagagtattttggttttgtttgtttgtttgttttgagacagtcttgcaacatcttgctctgttgcttaggctggagtgcagtggtgtaatttctgctcactgcaacttctgcctcccggactcaagcaatccactcacttcagtctcctgcctagctcggactataggtatgtgccccattcctggctaatttttgtgttttcttttctttttttttttaaactcaaacttgccttatttatatccccaatggcatgatctcggctcactgcaacctctgcttcccaggttcaagcgattctcctgcctcagcctcctgatagctggcattacaggcacccgccgccatgtctggctaatttttgtatttttagtagagacggggtttcaccatgttggccaggctggtttcgaactcctcaggtgatccacccacctctgcctcccaaagtgctgggattacaggcatgagccactgtgcccagcccacattttctttatccagtctatcattgatgggcatttgggttggttccaagtctttgccattgtaaatagtgctgcaataaacatatgtgtgcatatgtctttatagtagaatgatttataatcctttgggtatatacccagtaatggtattgctgggtcaaatggtatttcttgttctagatccttgaggaattgccacactgtcttccgcaatggttgaactaattcatactcccaccaacagtgtagaagtgttcctatttctccacatcgtctccagcatctgttgtttcctgactttttaatgatcgccattataactggagtgagatggtatctcattgtggttttgatttgcatttctctaatgaccagtgatgatgggctttttgtcatagttttttggccgcataaatgtcttcttttgagaagtgcctgttcatattctttgcccactttttgatggtgttgtttttttcttataaatttattttaagttccttgtagattctggatattagccctttgtcagatggacagattgcaaaaattttctcccattctgtaggttgcctgtacactctgatggtagtttcttttgctgtgcagaggctctttagtttaattagatcccatttgtctattttggctcttgttcccattgcttttggtgttttagttatgaagtccttgcccatgcctatgtcctgaatggtattgcctaggtgttcttctagggtttttactgtttggggttttacatttaagtctttaatccatcttgagttaatttttgtataaggtgtaaggaaggggtccagtttcagttttcttcatatggctagccagttttcccaacaccgtttataaaatagggaatcctttccccattgcttgtttttgtcaggtttgtcgaagatcagatggttgtagatgtgtggtgttatttctgaggcctttgttctgttccattgatctttatatctgttttggtaccagtagcatgctgttttggttactgtagccttgtagtatagtttgaagtcagatagcgtgatgtctccaggtttgttcattttgcttaggtttgtcttggctatacgggctctttttggttccatatgaaatttaaagtagttttttctagttctgtgaagaaagtcagtggtagtttgatgggaatagaattgaatctatcaattactttgggcagtgtggccattttcatggtattgattcttcctgtccacgagcatggaattgtattttctgtacagtcagggtttgctgtgttgcttaggctggtctcaaacttctgggctcaagcaatccttcctcttttggctccagagttgctgggactacaggcgagccaccatgccttgctaaattaatgaactttaaacacatttgacatgttttaatccactgaagccattttttttctttttgatgcacacattatcccctttgaagtctttttaaattagcttctgtgtccttttgacatcataacagctgatattcataatggataaatcaccattattaagtttttcattaatctgtgacctaatgatttttgcagccatcgatggttgttgtctgcaagcatgttttcatcaggtgctgtatttcttttttttgtttttattattatactttaagttttagggtacatgtgcacaacgtgcaggtttgttacatacgtatacatgtgccatgttggtgtgctgcacccattaactcgtcatttagcattaggtatatctcctaatgctatccttcaccactccccccaccccacaacagtccctgatgtgtgatgttccccttcctgtgtccatgtgttctcattgttcaattcccacctatgagtgagaacatgcggtgtttggttttttgtccttgcgatagtttgctgagaatgatggtttccagcttcatccatgtccctacaaaggacattaactcatcattttttttggccaggtgctgtatttcttagctggaaaatttcaactatttagtcatgctgaagcctagtttgttcagtaaaggcaagataaatactttattcattccctttatatgtacatgttttcagaaaaataagtttattccctaggattgtccagtgttgaccagcaagggttatttgttctccttaagtattattatgaactaatgaattttaaacatatttgagtgttttaattcactgcagccattattctttttgatgcccatcttatactctttggaagtctctttaagttgttgctctgtccttttgatgtgattccagtagtctgatagcttccttgttttctggtgtcacaagatgttccatactcatctgcatttcctaccctaatcctggaaaagttatttctccaagctatagttctttttagtggcaagaggtatttagataccagactttgggtgctagggatatatatagctattgctttagtctttgcttctaggttatagaatgtctaattgatagggttaggaaatattattttctaatgctatattgagatatcatttacatatagtaaaaatgcacaaatactgtgtagaacttgataaattttgacgtatgtatactctcatgtaacctgaatcaccctcatcaagattggctgatgaaactatcattaatcagatatttcacctagtatcaagctctaccaataatttcagggacacaggtaacaaagagactcctttgttccagagcaggtgccccagtctctgaccagagactagaatgtctgctgtggctactgctgccaggcatcaaacaatgtctctaaactctcataagggtgccatctgtagtattgtaactagagagggtggggcccctctcaggtgagcagtgtggatatgaagcagtggggagtgtgttctactcaagtgtaagtctcacagcagcctatagcagagctttgggtgttgtcccaggtgtgcataggagagcctggcttttctgccccttcttggctgggcagcagctgcagtcatgtcagcctaaagtcaggccaaagttgggccacagctcagaattaaactctccaagtgacacttttggcctgtgccctgggatactggggcaccaccctggtgaacagcatgggcaaaaagctgtgggaagtgtagtctgattgtgtctcagtttcacagcagcccattgcagggctgtgggtattctatagatatgtgtggggtagcctggtttccctgttggtcctttgctgggcagtgactggggctgtgtcagcccaaactcaggccaagggcaggactcagcccagcattgaactcagaaaatggtgccttgggcatggggctagagagaatgagtcaccacccagccaagcagcatgagcaagaaggtgtatggagtatgatctacttatgtctcagtctcaacagcagcttgtagcagggtgacaagtatcctcctgggggtgcatgggcatgcttgttctccctctccttttttggagcagtacagtggctgcagccatgtctataggtccctggtatctaaactcttaaagtggctccctgctgaggctgctccagacttgggtgcctgtgggattctgtgtggattccttttctggaacaatgtctttgtgtgatctttaggcagctccatatgtgaggtgtgaggccctagtggatcgagggtttctcctatagccaatgttgtaaatgcttgtttcagagctctggggatttttctcttactgtttccctgcgtacagtagcctttcccagctctcagctggtttctggctaggcatgcttcctcaaaccctctcctttcttacttctggggctttctctctcttctctggtgaatccaaatattcattcttagtctgttcaaaatgtgtctacttaactatttctgattcttccctgtggaaaaggcacacactatctagttggccatcttgattattttctctctcactcattgtttatcattgtggtttggtgtgtttctgtagtgggaacatttgattcctttcttgttttacttgtgtgtttgctttactctgtgggttttatacttttttttttttttttttgagacagagtcttgctctgtcgcccaggctggagtgcaatggcacggtcttggctctctgcaacctccacctcccaagttcaagcagttctcctacttcagccccctgagtagctgggattataaggacctgccaccatgcccagttaatttttgtactttttagtagaaacggggtttcaccatgttggccaggctggtcttgaattcctgacctcaggtgatctgcccacttcggcctcccaaagtgctgggattacaggcgtgagccactgcgtccagctgggtttttaactttcatgtgtttttatgatcacagattgtgtattgccctcccttaagcatctcttgtagggatggtctagtgctgatgaattccctcagcttttgcttgcctgggaaagactactacttcttcattcatgaaagacaactttgctggatatagtattcttgactagcagtttcctttcagcgctttgaatatattgtttcattctctcctgtaaggattttactgagaaatttacagttaatctgatgggggtttccttataattgatgacacgcctttttccttctgtttttagaaatatctttgtctttgacttttgacaggttgactgtaatatgctgtggagaagacctttatgaattttatctgtttaggcatctctgaacttcttttatttgaatgtctaaatctcttgctagacttgggaagttttcagctattttattaaatataagaagtttttgatccctttttttctctttttctgtgacattgaaaattcaaatacttgtttgcagtgtggtgtctcatatgtcttgtaggcttttttcattcttttttgttctttttttaaatttttgattgactgggttagttcaaaagtcttgtcttaagttctgaaattctttcttctgtttgatctagtattttttgttgttgtttgttttgttttgaggcagggttttgttttgttgcccaggatagagtgcagtggcacaatcacagctcactgcagcctccaacttctgtgctcaatcagtgctcctgcctcagcttcctgagtagctgggactacaggtgcatgccaccatgctgagctaatattttaaatttttattagagatgaggtcttgttatgttgaccaggctcttctcaacccctgagctcaagtgatcctcctgcctcagcctcccaaagtgctgggattataggcgtgagccatcatgccaggcctagatctagtatattgttgaagctttggaatgtattttgtatttcattcggtgaatcctttagttctaggatttctttttttttttttaatgatacctatttggtaaatttctcatttataacctgaattgtttttctgatttctttatattatttttcagaattatcttttatctcactgaacttatttaaaatcagtattttggatttttcatctggaatttcagaatttctttttgattatgatctgttggtggagaattactaacttcctttggagttatattttcttgtcttctcatgtttcttttgttacattgatatttgtgcattgggtgtaacagttgcttcttccaattttttggaaataattttgtaggggaggatcttttcctgaagatgtacccatggtgttggttgggtagggccctttggctttaattctgggttcatgcagtagcatagtctttgtatgattcctttggatgtgaatagtcagtggcgtttgtgatttcctcaatggcttagggtgtggttgttagtgggggctgcggagaagttttgctgggtaaaggaatgccatgtttgccagtcctcagaccccaatggtggcaatgccaggccaagtatgcttgtccttggtttccaggacagcacatgctggcactactgttagaaagcccaggttggccagtgcttgggtttccaggagtcttgcttgggtgctagtagcagcagtggtgggccagacaggtgagtgtgttcttgggctcttaggcagtgggcacgatgtgggtgatagtagcaatggcttgacaaccctgtgctttccaagtggtctacactggtgttagtgctggctgtgatgtgctgagtgggtcagtcaggcccacaggtagcatgtgcaagtggatgccagctgtgttggtagtggcaggttgggtaggcctgaccttgggcccttgggaggagtgttgaggtaccaatggtggactgggctgggtgatacccagggccttgggtggtgtgctcagacactggtgagaggggttatggagctgggtagagtggacctgtcctcaggtccaggtggtgagtgcagactctgattgcggtaggcaggtgcaggatgatgcccaggtttccagtggaatgcttgagtgggggtggcagtggttgctttgcagccctgtcactggggagggtgaggttgctttcactggcagcagatgtgtggaggtggctggtgaacatgtactttgctcttacatttgctccagtggaggcagtttgcaagggcagcagctgcaggtgggaaagtttgtcctttgggtgtgtgaaaatgtgcagcagctttgctgcttagggcagcggggtcactgtaaatggctcacactttgacactggtggcagcagcagctagcattgcctcaggttctgggttgggtagccctcccttgggtcatgtgaagatgcatggctacccttctgctggtggggttggggttcctgccagtggcttgcagtttggcctcaggtgtggcagcagctagtgacaatggtggttgtgggatggggtagcctttcctctgggtccgtgaaaatgcatggttgcccttcttgggcgtagagtggctgccagtggcttgtgttttgattctgtggcagcagcagccagtagtggtggtggctgcaagcaggatagcatttcctcagggccatcaagatgtatggctgttcctctgccgtagggaacagggttgctgccagtggctcctacctcttcgcgggtacttgcagccagctgcagtggtggctgtgggcaggagatgtcagctttgctccagggttgtggagttgtaggggatgttgggccctagaccatgatgcagtctacttggggctgggcacacaaaatggcagcatgctgtagttgcttaggattggggggtgggtgtatgggacccaacatgagctccctgtatggagcaatatacttgtgtagtctctgggcagctctctgtgtctcagagcacatgaggatcaaaggtccctttcgtggctagaattgcaggagtttgcagtgagaatatgggccactggggtctctcatttaccccttctatgcattgaggagcctgtccaggctcccagccaagaaggctgcttctcttctttctccttccttcctttatgtgtttcctgtcacttctctgttgaagtcccatttctctcttagatgatctatttgaagtgtgattatctacttgctattttggctcttttctcagagggaggcaaataacagtggcctctagtgagtcatcttgaagcccctgtctgaaataatgtaatctaacaaacacgtttttgtgtgttatatttattgtatactgtatctttacaattaagtaatctagagaagggaaaatattattaagaaaatcataaggaagaagaaatgtatttacgttttattaagtcttaatcctcattgtcttcatgttgagtaggctgaggaggaagagcatgggttggtcttgtctcacaggtgacagagatggaagaggtggagggataaataagttaaataattttaacttaatattatttaattttaaaataagttaaaattatttaacttactaacttatttaaaaataagttaaaattattttaaaataaattaaactttttacttttttttctcaataagttatacaaggtgtaccaggcaggcacaccttgtgtaactttttgagaaaaatctgtttgtaagtggatctgtgcagttcaaacctgtgttgttcaggcatcaactatgtttcttttcatacattgttggattcagttttctaattttttggagggtttttacatatatgttcgtgacatatattggtttgtggctttctttttgtgtaatgttgttttctgatttcagtattagggtgatgctggcctcatggaatgagtttggaagtatttcctctgcttctattcaatgactgagaattggtatagttttttccttaaatgtttggtagaatttaccagtgaacttatataggcctgacattttctgttttggaaggttattaatggttgattcaattttaaaaatagaaataagtctgttcagattatttttttatttttatttttttggagacggagtctcactctgttgcccaggctggagtgcagtggcgcgatgtctgctcactgcaagccccacctcctgggttcacgccattctcctgcctcagcctcccaagcagctgggactacaggcgcccgccaccatgcccggctaatttttgtatttttagtagagacggggtttcactatgttagccaggatggtctcaatctcctgacctcgtgatccacccgcctcggcctcccaaagtgctgggattacaggtgtgagccaccatgcccggcctgttcagattatttttgtgtgagctttggcagattacgtctttcaaagaattagttcatttaatctaggttatcaaatttgtgggacttgagttgttcataatatttttaagttttaatttccattggatctgtactgatgccctctctttcatttctgatactggcaatttgtgtcctctgtctttttttcctttattagcctggttatagtgttaccaattttattcatcttttcaaagtatcaacttttggttttgctggtttttctctcctgatttcctgttttcaaattgattgatttatactttcctatttttgcatattaagatttaatttgctaaaggagatttaatttcctaagaagcaaacttagattattaatattagtttcttttcacttctaatatatacgcatttcaatgctgtaaatttttgtcaatgcactgcctgtgctgcgttctacaaattttggtaagttgtatttttatcttgaaagtatttttaaatttgtcatgagatttcttctttgactcatgtgttattagtaatgttggttaatccttacatgttttgagatttttttcaattatctttctgttattgatttttagcttattctactgtggcctgagagcagacattgtacggtttctattcttttaactctgttaaggtgtgttttatggcccagaatgtggtggcgtattttggtgaatcttccatgtgatcttgacaggaatgtatattctgctgttattggatgaagcatagttcacccttgaacatgagtttgaactacatgggtccacttatatgtggatattttaaataaaagttacatcagttatgcctgcctctccagcctccccttccacttcttccctctctgccatcggtgagataggaataccaacctctcctcttcctccctgtcctcagcctgctcaatgtgaagatgagggaggatgaagaccttaatgatgatccacttccatttaatgaatagtaaatatatcttctctttatgcttttcctaataacattttcttttttttggcttactttactgtgagaatacagtatataatacatataacatacagaatacttgctaactgatggcttgtcttatcaataaagcttctggtcaacagtaggctattagtaattagctttctgtggaatctaaagttatacataaattttcaagactgttgggggttggcacccctaacacttgctttgttcaagagtcagctgtagtctgtagatgttaattatcaactgtacactatagatgttaattatatccaatttattggtgttgagttcaaatgtatctttactgatttttccatgctagatctgtccacctctgatagagggatgttgaagtcatttttgatttccgttacagtgttttgatatctaacatttctttttggttcattcttaggatttccatctctttgcttacattgcccgtctgttgttactacatgctatctactttctccattatgatgcgtagcatattaatcataattgttttaaattcattgtctgataattccaacatcccgtctacatctggttctgaatgttttctttcttcaaactgtagtttttgccctagagtatgccttgtaattttttcttttcttttcttttcttgttttttttttttttttgagacagggtcttgccctgttgtctagtctggaatgcagtggcgtgatcttggctcactgcaacctccacctcccggactcaagtgatcctcccacctcagcctcctgagtaactgggactacaggtgtgcaccaccatgcctggctaatttttgctttttttttttttttgggggtagagaccattttgtcttgttgcccaggctggtcttgaactcctgggctcaagcagttgacccacttcagcctcccaaagtgctggaattataggcattagccactgtgcctagctgtaattttttcttgataactgtatatgatatatcaggtaaaaaagcaattggtttaaatatgtctttaataatgtaattgtaagatgtacgcgggagtgatgtgttgtatagtcctgtgattaggtctcagtctttttgtgagtctatgtctctggcccatgaattcacaagcatttctcaattttttcctccccctttaggtgggataggatggctagagtaggatggaattgggtatttacctcctcccatgtggaaggatagagctggctggagttggatatttccatcccccaggtcagttaggctttgatgaaacctcagcaggttaggctctgcttaactggtttcttttcagggtagatcttattaagaagtacagagtgctctgggatatttcagaatggtttgtttccccccccgccactgctggaaacatgaggggattttactgcgatgatatgtatgatactgtatttactgtgagaacctgatctagctcctggaggtaaaattcacaaaagcatgggggcccccatgactggatgcccctggagctttcaactctcagtcgtgcccacacctagtttccagcagtttgtcagcagtccaggttttcctatctaggcactgcttcctgtagaaatttctgttccagtatgttgtgattctctgtatccctgtctgtctgtttaattttaggagtagcagttttcccagtgaccctacctatctcaccttttcttacagatctgagaaaagttgttgatttccactttgttcagctttttaatatgtgttaggatggcatagtgacttccaggctccttacatgtgaaaccaaaacctgaagtccccatattattgttttaaatcttttgttcttttgtaatatacttttagagataaagatttctttctaagcattgctttatttacaaaccacaaattttgatatgttttgtttattatttagtgaagcatatttacaacatttcctcgtgaatcctagtttgaaccatgagctacttagaagcatgttgcttaatttccacaaatttgaagatttccccaatatacattttatttttttcttggtacatagtatttgtatatgtttactggtgtatgtgtgatattttgtcatatgcctagaatgtgtaatgatcaagtgtaggtatttaggatatcgatcacctcaaggatttatcatttctgtgtgttgggaacatttcaagacctctcttctagctattttgaaatatacaatacatcattaactgtagtcatctgctatcaaacattagaacttatcccttctatctaactgcgtgtttgtacttattaaccaaactttctttattcttctatccctaccacatccttcctagcctctggtatctatcattccactctctacctccatgagatcaactttttttagctcctacatattaacaagaatgtaaaatattttctttctgtgcctggcttatttcacttaatagaatgacatccagttccatccatgttgctgcaaatgacaggatttcattctttttttatggctgaatagtatcccattgtatatactgcattttcttgatccactgatggacacttaggttgattccatgtctttgatgttgtgatagtgctgcagtaaacttaggagtgcatgttaattcctttcttttggataaatactcagtggttcctgcaatatattttgttactgatttctaatttaattttattggtatcagagagcatactctgaatggtttcagtccttttaagttgattgacatttgtttcattacccagcatatggtctgcctggaaatgtttcatgcatttttaaaagttatgtgtatcctatagctgttgggtgaagtgttttataaatattaggctgaattggttgatagtggacttcaagtcttttagaccctgacagattctttctctacttattcaatcaactactgagagagaagtactgaaatctaaatattattgtagttttgtctgttttattcccttttgttctattagattttgtgatttttttaaaaaaagttctattattatgcaaatatacatttagaattgttggatctttttgatgaattgacccatttatctttatgaaatgtctctctttattgcttagaaaatactccctgtgccaaagggagttgttgcttgacattaatacaggcatatttgcatatagtatttttattcgaagttcctagagcagtcaaatctgtagggacccaaagttgaatggtggtttctgggggcttgggggagggggaggggagatagggagtagtgtttgagagatagagttttaattaggaaagatgaaaaagttctggagatggatggtgctgatgattgcacaacaatatgaatgtacctaatgcaacagaactatacattttaaaatggttaaaatgataaattttatgttatgtatattttaccacaatttaaaaaaagacatagcaccaaaaaaagatgatgaatgaataaattccaaaaagctgtgccaggagtgataatgtatagtttgtttagaatcattgaagccttcattctttatttaattgaagcagttaaaaataaatattaatttgaaataaaaatcagcagctagattctattatattttattcaaatttggaatttttttttttttttttgagacagagtctggctttgttgcccaggctggagtgctgtggcacaatctcgcctcgctgcaacctctgcctccctaactcaagccatcctctcaccttagcctcctaagtagctaagctacaggcatgcaccaccacacccatgtattttttcgtagagacggggttttgccacattgtccaggctggtctcaaacttctgagctcaaaccatctgtcctccttggcctcccaaagtgttggaattacaggcatgagccactgtgcccagccaaaaattatttaaattatagcagaaatacagtttcctatttgggtctcacgagaatgtgtttattctttgtttcagcaagagaaggcagctgctgtggatttgactaaccacttagaatacactctgaagacctatatagataccagaatgaaaaatctggcagctaagatggaaatactgaaagaaatgaggtaggtaaaagcatatttttcagaaggatattttaaactaatttttaatcaattggtgctttgtttaaattgtgtgcttgccatttttgctttaaaatttaacctttgtatttttatgacttcaaagagagaaagatagttatttctgagatgaattttatactgtttttgtcaggtttctactgtcactgcttggagctagagtgttctaaggttataactgagactgaaattgaaaaaacagcaacatagcttttaagtgatagtttgatgggaaactaccatatccagttattttgcttggggttattttcaggagtacagcatgtccttgaataacgtgttttcattcaacattatttcattataacattgaagaagaaaatcaattcctagctggagccccactgtctgtgtggagtttgcacattctctccatatttgggtggttttcttggaatactgtggtttcctctcacatcccacttaggtgaattggtgtgtctgtattgtcccagtatgagtgagtgtgtggatgagggtgagtgtgccctgcaatgcaagggtgtcatgtccaggattggttcctaccttaatgctctgagctgctgagatagatgtggccacctgcaacccctggattggaataagcgggttggaaaatgaatgagtgaatgagtatatacagattatcataaaataaaaatttgtgaagtatgcaagaatcatacagatgcctttgcaataagcgatgtgacatgaaagcattcagcaagcccactacgtttgttattgtttgtttttgaacctgtggtggtagggggcgcttcttagaattttcgcttgcaaacatttattccttgatttaaccctactgtcacccactcattcaccaaagtttgggtaaataattatctttgttgtttttattgctttttcttaaatgtgtgtataggacacgtatattttagtgtttaatattagaaatgttttgggtctttatttggaagtgctgtttttgtgactaaaaatatgccataggaacttaactcttgtttagatcaattagcctatgatactatgggtttcttatatgtcttttctcttagacattgtaaattatctgtagaccaaaaattgaaggttcatttgataccatttcaaattctgcagactttcgaagttgccttttttatagtttaaaaaatttttaattttttcatattttttatgtcatgaaattagtatatccacagttgttttttaattaaaagtttatattaaattatgcatgtctgcataaaaatatgtggactgaaaaaaataagttatacatgattttatataaagttttaaaaggtaccccttcaaagccagtgctgtaaacactaacttttagaccattactattaaagtgtaactttttctcacaccagctttctaatttattgatcttcttctttttgatgtttttaaaaataggcatgtcgacatcagtgtccgtttcggaaaagacctttcagatgctatacaagtgttggatgaagggtgctttactactccagcttctttgaatggattagagataatatgggcagaatacagtctggctcaggagaatattaaaacttgtgaatatgtggtgagttgggaatttttctctattgtggtttttatctgttgaacataaggaagtgtttttttaatttcttctaaaaaaaataacaggatacatgtgcagaatgtgcagatttgttacataggtatacatgcgccgtggtagtttgctgcacctgtcctctaaattccctccctcacccccccatttcctaacgagccctggtgtgtattgtttccctccctgtgtccatgtgttctcaatgttcaactcccacttacgagtgagaacatgtagtgtttggttttctattcttgtgttagtttgccgaagatgatggcttccagcttcatccatgtcgttgcaaaggacataaactcgttcctttttatggctgcatagtattccatggtgtatatgtaccacattttctttatccagtctatcgttgatgggcatttgggttggttccaagtctttgccattgtgaacagtgctgcagtaaacatacgtgtgcatgtgtctttatagtagaatgatctatattcctttgggtatatacccagtaatgatattgctgggtcaaatggtatttctggttctagatccttgaggaatcgccatatcgtcttccacaatggttgaactaatttacgttcccaccaacactgtgaaagtgttcctgtttctccacatcctctccagcatctattgtttcctgactttaatgatcgtcattctaactggtatgagatggtatcttcttgtggttttgatttgcatttctctgatgattagtgatgttgagctttttttcatatgtttgttggccacataaatgtcttcttttgagaagtgcctcttcatatcctttgcccactttttgatggggttgtctttttcctgtaaatatgtttaagttctttgtagattctggatattagatctttgtcagatgggtagattgcaaaaattttcttctgttcaggagaacaggttgcctgttcactgtgatgatagtttcttttgctgtgcagaagctctttagtttaattagatcccatttgtcaattttgacttttgttgcatttgcttttgttgtttttgtcaagaagtctttgcccatgcctatgtcctgaacgctattgcctgggttttcttctagggtttttatagttttaggttttacatttaagtctttaatccatctagagttaatttttgtgtaaagtgtaaggaaggggttcagtttcagttttctgcatatgtctagttttcccagcaccatttactgaataggagatgctttcccaattgcttgtttttgtcaggtttgtcgaagatcagatggttttagatgtgtgatgttatttctgaggtttctgttctgctccattggtctatatgtctgttttggtaccagtagcatgctgttttggttactgtagccttgtagtatagtttgaagtcaggtagcatcatgcctccagcattgttccttttgcttaggattatcttggctatatggggtcttctttgaatccatatgaaatttaaaatagttttttctaattctgtgaagaatgtcaatggtagcttgatgggaatagcattggttctataaaattttttggccagtatagccattttcatgatattgagtcttcctatccatgaggatggaatatttttccatttgtttgtgtcctctcttatttccttgagcagtggtttgtagttcttcttgaagaggtccttcacatcccttattagctgtattcctaggtattttattctgtttgtagcaattgtgaatgggagttcattcatgatttggctctttgcttgcctcttgttggtgtgtaggaatgcttgtgatttttgcacatttattttgtatcctgagactttgctgcagttgcctatcagttcaagacgtttttggggtgagacgatggggatttctaaatataaaatcatgtcgtctgcaaacagacaacttgtcttcctctcttcctatttgaataccctttatttctttctcttgcctgattgccctgtcgagaacttccaatactgtggtgaataggagtggtgagagagggaatcgttgtcttgtaccagttttcaaagggaatgcttccagcatttgcccattcaatttgaggctgtgggtttgtcataaataactgttactattttgagatatgttccgtcaatacttagtttactgagagtttttaacatgaaggcatgttgaattttatcgaagccctttctgcatctattgagatagtcacgtggtttttgtcattggttctgtttatgtgatggattacgtttattgatttgcgtatgttgaaccagccttgcgtcccagggatgaagtggacttgatcgtggtgggtaagttttttgatgtgctgcgggattcggtttgtcagtattttattgaggattttcgcatcgatgttcatcagggatattggcctgaagttttctttttttgttgtgtcttttcccggtttgggtatcaggataatgctggcttcataaaatgagttagggaggagtccgtccttttcagttgttgggaatagtttcaaaaggaatggtatcagctgttctttgtatttctggtagaattcggctgtgaatctgtctggtcctgggctttttttggtcggtaggctgttaattactacctcaatttcagagtttttgttattggtctattcagggattcagcttcttccagaaggggtggccagcccctgcacacctgtgggcgtttctcgtcaggtggaacgagagacttgagaaaagaaagagacacagagacaaagtatagagaaagaaaagtgggcccaagggaccggcgctcagcatgtggaggacccgcgcccgccggcaaaggtctctgagttccctcagtatttattgatcattatctctaccatctcggagagggggatgtggcaggacaatagggtaatagtggggagagagtcagcaggaaaacatgtgaacaaatgtctctgtgtcataaacaaggttagaaaatgtgctgtgctttgatgtgcacatacataaacatatctggtgcattaaagagtagtattgccgtcagcatgtctcacctccagccttaaggtggttttctcctgtctcagtagatagaacatacaatcgggttttacaccgagacattccattgcccagggatgagcaggagacagatgccttcctcttatctcaactgcaaagaggccttcctcttttactaatcctcctcagcacagaccctttatgggtgtcgggctgggggacggtcaggtctttcccttcccacgaagccgtatttcagactgtcacatggggagaaaccttggacaagacctggctttcctaggcagaggtccctgcggccttctgcagtgttttgtgtccgtgggtacttgagattagggagtggtgatgatttttaacaagcatactgccttcaagcatttgtttaacaaagcacatcctgcatagccctaaatccatgaaaccttgagtcgacacagcacatgtcgtagggagcacagggttgggggtagggttgcagattaacagcatctcaaggcagaataatttttcttaatacagaacaaaatggagtctcttacgtctacttctttctgcattgacacagtaacagtctgatctgcctttcttttccccacactacctggtttagtcttggtagggtgtaggcatccaagagtttattcatttcttctagattttctagtttatttgtgtagaggtgtttatagtattctgtgatggtagttggtatttttgtggggtcagtggtgatacccctttaacattttttgttgagtctatttgattcttctctctcttcttcttagtctagctagtggtctgttttgttactttttttaaaaaacagaccctagattcattgatttttttttggagtgttttttttgtgtgtgtgtgtctctgtctccttcaattcttctctgatcttatttcttgtcttctgctagcttttgggttcatttgctcttgcctttctagttcttttaattgtgatgttaaggtgttgatatgagatctttctagctttctgatgtgggtatttagtgctataaattcctctcttaacactactttatctgtgtcctggagattctggtacattgtctctttgttctcattggtttcaaagcacttcttgatttctgccttaatttcattatttaccctggagccattcaggagcaagttgttcagtttccatgacattgtgtggttttgagtgagcaatactaaccttaaatgtaaatgggccaaatgccccaattaaaagacacagactggcaaattagctaagtggtcaagactcatctgtgtgctgtattcaggagacccatcttccgcacaaaaacacatacaggctcaaaagaaagggatggagggaaatttaccaaacaaatagaaagcaaaagaaagcagaggttgcagtcctagtctctgataaaacagactttaaatcaacaaagataaaaaaagacaaaggcattacgtaatggtaaaggaaacagttcaacaagaagaggtgactattctgaatatatatgcacccaaggagcacccagattcataaaacaagttcttagagacctacaaagagacttagattcccacacaataataatgggagactttaacaccccactgtcagtattagatcaacgagacagaaaattaacaaggatattcaggacttgaacttagctctctatcaagtggacctgatagacgtctgcagaactctctaccccaaatcaactgaatatacattcttctcagtgccacatggcacttattctaaaattgaccacataattggaagtaaaacactcttcagcaaatgcaaaagaactgaaatcataacaaacagtctctcagatcacagtgtaatcaaattagaactcaggaaatgttatctttctagaaagacaaggaactggagatattgtaatgatagtttgtgtaaaacctttaacttttacagtatcttcatattaataatttccttcatttattgccttataagaaaggtgtaatagacaactggtgattgtggataaggggtagcaaaatcttttccctttttgcatgaaaactttacctttggttaactccctctctttgttcccttggtaatgtgataaaatatttcaactgtgttactaggcaacattatttatggtaagtataacttatgattgtcaaactgcatctgtactgggagaaactacaaactacaaatacttgatgtggactcttgtaactaaacatgccccttgagggaccctggaagctatacctatggagttgttacaagagatactggcttttgagggacattaggcttgtaaaccagagtggctttcatacatgctaatgtggaacttttctggtctgagtggtgtgttttatgcatgtaagactctgccttactattaattagtgtctgagtcacctattgttgggaggtagttgtttgtgtgtgtgagtaggggtgtgaaaatgaaatattttacataaattctttattagcttaggtacaagtatatttatttcctgttgcagttttctttaatttattgtattgggctgaacagaacttcctgtttttcttgtaaaccattccctacaaccaccataactttccctagcacctgtgagctctatacttgttgtgtttggacttgttccatcttaaatatttgtggtttctgcctctgtggattataccctgtaaatcttactccctagtcatacctaggttgatcagttggcagcctgactgcctctgaatgagaagtatgagcaggataactaggcttttgaaaatgccaggaatgtttagtttggagaagggatttgattttggttattttacgtattagattctaactgatcacttctgattatgggagaaagaagatgacagcagaatgattaattttttaatttctatgaaacacaggcagtgtgtttataaacattttcttacattaacttttaaaatgggcatatttgctcccattttataagtgaggaaacaggcttacaagggtaaggaaattgttcaagattacctagttgtaattttttaaaattaaaaaattactcttttttttgaggtatggtctcactctgtcacccaggctggagtgcagtggcacgatcacagctcactgcagcctcaacctccagggcacaagagattctccacttcagcttcccaagtagctaggactacaggcggtgtactaccaaccatgcctggctaatttttttgtactttttatagtgacggggttttaccatgttgtccagacaggttttgaactccttggctcaagtaatcctcctgccttggcctcccaaagtcctgggattgcaagtgttagctaccatgcccgtaccctagttctaaatgttaatatggaacttgaacccagacatgtctgacagcaaagcctattgtttttccattgaaaccacactattgatattaaaatacttcttaatgtattttcatgtaagatgaaaagatgtaaaaaaacctgccttatttgtttttgtggtttgagcatagtgaaagtattcaggatggagctttagcacttactatcctatgagtacagatgtgactttttttgaaagcagaattttttttttctactactgcttgtgtttccggacttaaagtttacttgatagatggaagtgtagattattggctaaatatataatcataatagccactcaaatgaaatcgtcattttatttcccttattgtacttattttggtttagaattgataacttttattcaagtattttgcatagttctttaacttgattgccatgtggccatatgctttttttttttttttgagacggagtctcgctctgtcgcccaggccggagtgcagtggtgtgatctcggctcactgcaagttctgccttccgggttcgtgccattctgctgcctcagcctcccgagttgctgggactacaggcgcctgccactctgcccagctaattttttgtatttttagtagagatggggtttcaccatggtctcgatctcctgacctcatgatccgcctgcctcggcctcccaaagtgctgggattacaggcgtgggccaccgtgcccagatgttttttttttttaatgatgaaaacagtaggctttacttgaggtcttttcttttttatttatagttttaaaataatctggttgagcttatgcaagaaaaaatatcctaaaattcaggcttttatagttttatagttttataatgtattttatagttttatttatagttttaaaataatctggttgagcttatgcaagaaaaaatatcctaaaattcaggcttttatagttttatagttttataatacattttatagttttatttatagttttaaaataatctggttgagcttatgcaagaaaaaatatcctaaaattcaggcttttaagtgtatgtgccagacactgttataggtaatagagattaaaacttttttattttatttcattttattattattttacttttagggtacatgtgcacaatgtgcaggttagttacatatgtatacatgtgccatgctgctgtgctgcacccattaactcgtcatttagcattaggtatatctcctaatgctatccctcccccctccctccaccccgagataaaaatttttaaaagacatatcctttctttctttcttgggtacaggatggatatattaatatatagttttaatacagtatggtaagtgctataataaagaaaatgcatagagttcttggatatctttcacatatgtatttccaaacacagcctgttggacaaattggagggtttatcctggtgtttaagtgtatcttgaaggatgagtagctgaaggagttgagaatgggatgggaatagaaaagaggccatatgtaattagtaggaacttatataattttctgtaagaaaaacaaaaatttcattgttgcagaaataatgggaaaaataaaaattagatcagagttgttgaacttaaatgttttatttttaattaagagaaaggaagtttttttgtcattttgttgatctaaggagagaaatgtcctaagtgctataatgtttggagaatataaagttaattttggagatcactttttttcatataggtcatatgcggaaaagacctgatgtattaatgatggttattctttttttcttcctccagagtgaagggaatattttgattgcccaaagaaatgaaatgcagcagaagctgtacatgtcagtagaagattttattctggaagttgatgagtcatctcttaataaacgcttaaaaacattgcaggttggaattaaaaatatattaaatatacgttaaattgtaagtttatttaagaagtgaaattagcatttaccttaagactttagattgttctgtgatggttgcaaaagtttttcctgtttcctgaattctgatttctttttaatgggattaaaagtttatattaatatattttgtggctatgtttatatgcatatctatcttgcaaacaaggtaaaatggctagggactccagtattcactggggaaattaatggagacaggagcagtagcaggtatgtgggtccctatcgtccattgcattctagcagaaaatgtagtaggaccacatgttacagggagaagggatcaactctgatccataaattatagggtttttaggctccatgaccagggaagtttctccctgatgtgatcagaggctagagtactgtagtacatatagctatatgatatggtggaatcttgtcttcagctctgtcttgccagctcaggaatgactttaattcggggtgaatgaacatgacagtgttaagtaatttcacctaataatagtgtttctctctacttattcagatctttttttgtcctttaatattgtttaaaatttttctctataagtcctcatgcttttttcttcatttaacttttatttatttatgcttttgattgcttttatgaatattatcttgtcatttcctagttttgattgaatagaggaatactgttcatttttatgtactggtgtttctctgataactctgctgatctctcttttagttctcatttgtctgttgatactctgctttctgtgttttcaaatgttttcatttgaaatgttttcattttctaatgttttcatttgaaatgttttcattttcaaatgttttcatttcattttcaagtgttttcatttgaaaacaataactctttaatcttttctcttctagtccttttaccttttatgtatctttgaatttttactgctttggtcagttaccctagtactaagctgaccagtagctaatatcgatcttgttgtggactgcagggagtaagcttgctagaaatttggagaagaagatattcagggacatctgggcattgtttctttctgtcctgctggatgaagatgtagttttgatgatgcaccacatggcttaagaaccattggagccctggtttgaaacattttcttaattggaattgcataaatagtataagttcttccagaatgttgaagtaagccttgcatataaaagggcagtaatatagtaagaatttagctttccacaatgcagcttctactttgtcccttaaaggtttatttcttctcactgttagtaaatgtaggttaaggttctgtaattaagatcatctttaaacctcttttcttttaaaagttcaatgctagaagactttttgccttaactggcttgtctccacttctagtattccctcaggtcaccaaaatattctttaaacttctctttattttgctgagaaatagtttatatttttcaagtatccaagaaagatatttctataatgaaggtcaaataaatgaaagttcttgatttctgatttcctcagcattttatttagacttcttttgtggcatacaatacatgtttgattttttgtgactggtcttcttaagttcaaaaagaaattgtattctcggttttcttggtgtacagttttagatatatctaaaacttgcttaggttttggttggttcagtatatcagtctttgagatatttttgttacatatatctgaaatagataggtttgtccctatttgtccctattgttcttttggttcttgttcaaagtatttcagcgccacattgttgggtgttaaggtattcatgattgtaatgtatttaaaaatgtgtatcccccccatgacacatgtttacctatgtaacagaccttcacatgtacctccaaacctaaactaaaagtcaaaaataataataaaaatgttttctttttaactactatgtaatcttattttttcacttagattttaaaaaataaaaatttttttgtttgccttttaagttcgtatcccacctttctttttggttaacactgcaacatcttttctttttttctatttttattttatttatttttatttttcttgagatggagtctcgctctgtcgcctaggctggagtgcagtggccgatctccgctcactgcaacctctgcctcccgggttcaagcgattctcctgcctcagcctacctagtagctgggattacaggcacacaccaccatgcctgtctaattttttgtattttagtagagatgggtttcacgatgttgcccagggtgggctcgaactcctgagctcaggcagtctacccaccttggcctccaaagtgctagatttacaggtgtgagccaccgcacctggcttctccctttatttttaaccttttgtattcacgttttgaaataacctcttgataacacactaatggatttaatttttgaaagcacccaacgtatatcttttttgttggtaacttaatttacatatttataattactgttttattaaaacttatttctgtttatcatcgtttctttttctctctttttctaacttacacctcttatacttttttttttttttttgagatggagtctcactctgttacccaggttggagtgcagtggcacagtcttggctcactgcaacttctgcctcctgggttcaagtgattctccttcctcagcctcatgagtggctaggattacaggcaggcctggctaatttttgtgtttttaatagagatggggtttcatcatgttggccaggctagtcttgaactcctggcctcaagtcatccacccgcctcagcctcccaaagtgttgggattacaggcgtgagccactgtgcccggccactcttctaatactttagaacattcttatctgcctttggtgtctttcctctctttctctacctccttccccaaaccaaccagtgaacctaccacaattgtctaggattttagtcacgggttattatagatattgtgtgtgatagctcagttaaatagactttagagttatttttccattcttatttcataagtcgtttatctcttggctttctctgtatattggaatattttctctaagagtgctttcaaagaaatctttgtgtatttgattttgcgagttatttgatatttcaggatatctcatttcaatctcaaatacaaatagttgtttagctgactataaaatagcaagttcaaaggccatgtttcctttacacctttgacaataataatctattgtttcatttctatcattttatttctttatttatttgagacagagtcttgctctttcacccaggctggagtgcagtggtgccatctcagctcactgcaacctctggctcctgggttcaagcaattctcatgcctcaacctcccgagtagctgggactacaggcatgcaccactgtgcccggctaattttagtagagatggggtttcacgatgttggccgggctggtctcgaacttctgacctcgagtgatccgcctctcttggcctcctaaagtgctgggattacaggtgtgagccaaagtgcccagccttcttatttccataattgttatcagtctaatctttgttcttctgtgatcttttttccctctggaagttttaaaattttctcttgactttgttcttaagttgcatcagaacatgtttatgttttgactgaatctgagccagttcagtctgaggttttatatatttctttaattgtaggtaatacttgataattatttattgagatacttctctcccccattaattttttctcttattctgagacttctgatagatatttcagcttctatttctgttatctacatattttaatggctaatctattgtttaaaatctttttatcttatgtaggaggtgggttaaactaaataaataaatacaatctttttatcttgttggtgtctttttggagggatccttgacttaaccatgtagctaatgaattaatcctctagctgtgtcccttctgccatttagccaatccattgcattttgtatgtcaaagattatttcttttatatttaatatcttcagttggttattttttatttataagtacttggcttttgtgtttccaatattctttcttttgttgagaatatttattatgcttatttttgagttcttactgttatctgggccattgacactgattttgcttcctttttataaagtggcttagttttttatacttctttcagagtgcttgtgctgttcacaccattttatcctcttcttatctctcctcaagatctcatattcccttggaactataagctaccttagttctttgctgttgtgtagttatatgaagggcctagggaagagtgaaagtctggaccacaacttttaagactttggataggtttagggaatagaatggggttatttttatttttaagggtctagcttctgatgttgccatctgggattatctacttcctctttgcttctctcctgggtggtctgtcctactcttcagcaaacctctattccctctgcctcagctactgctcctttccaggcactaccacccttagatgtaaatgctgccagatattcaggggagaagtgaaggaaagagaatggtcaggggctggccagctcttctgtattggttatcagtttttgcctcatctgtgttcttgtgctgtacttgcataaacctgttgcctcttgatggtgctgctgtttttctttctgatgtgagggagagagaagagcctatgaaaaaagttttcttttcccacaggtaattctgtgctgtgacacagtccttctttcacttgtagggactttgttaattcaatgctaaacaccaaccatcctctgcctaagatttctcagagttttgtgattaaaaacttctgagatctcttaagctttttttcttatctctgtaaaatttctagggtttgatttctggagagagctagcaggctgtgcctatcttgtcttttccaattctttattacattaaaaaattttattgttactgttattttttttttgtgcacctgccccgacaaacccagccaggccaattcattaaaaaaatgcctttaagtacagtcaagggctgcatggtttggtcagtgatggactgcatatatggtggtggtgccataaaattatagtacttaactgtaccttttctgtgtttacataggcaatcattgttacaattgcttacattattcagcacagtaacatgctatatctaggagcagtaggctatagcatgtagtttggttgtgtagtaaatttataccatctaggtttgcatcagtacactccatgatgtttgcataatgatgaaattgcctcacgatgcatttcttagaagatatccgtgttgttaagtgatgcatgattgtccatatatatgtttaatgtctttacttaattagaattatttgtatattttagcgtgtagtttatttttatttggcaatcggtcttagaaactttcatgccaggacaaacagtagtgattcttatgatagacaaaggagactcagaagggtgattaggggtggagagtggtggatgttgagaaattacttaatgggttcaatgtacatttggatgatagatacactaaagcccagactttaccactacacaatatatccatgtagcaaaattactcttgtacttaataaatttatacaaaaagttagggaaaacagggtaatgtctacttaattaaaaaccataaggatataaagctttctatttgtaactaattcacttaataaactttactgttatggtccaaataaaccaccttctaggtagttttgtgttttcatctctatctgatgattctaagttgtatttatgaaattctcaagaatggggattcagcatactgcttttctaccccttagatcctaacacagtgctcgaatcctgaattagttaataaactttaataaacagaagtatatctctctgcaggatttgtcagtctctttagaagcagtgtatggacaagccaaagaaggagcaaattctgatgaaatacttaaaaaattttatgactggaagtgtgataaaagagaggagttcaccagtgttagaagtgaaacagacgcttctctgcaccgtcttgtagcatggttccaaagaaccttaaaggtaataaaagctcctgcccggttgtgtttgtagcataaaccagggaatatatattttaaaaatcacgcgctttgttcaagagctgacatcatctacctactatgtatcagatttaaaattgccaccttaccagtcaaggttctttattagcttttagtcagattgctccttttattagtctcaaaaaaatcatatcggtcttgttcctcctttttctcagcttttcctaaggattgtcctctttcctcttttaaccatttatttattttcttacagtatgctatgtgtatgtaccttttcctttcagtgcataaattttatgagggtaggcacttttttttcctgcattcctagttcttttacattgcccagggtatagcttaatactctgcttcaggtattaaggcacgatgaatgctgattgaattaaatgagatatttcatgtgtttatttttgcaaatgaggtttttgacctatctgtggaaggatcactgatttcagaagacgcaatggataatattgatgaaatcctagagaagactgagtcaagtgtctgcaaagagctggagatagctctggttgtgagtatcgatattctttattattgcctcctttgaagcagtgtggtttcctttcatggttagaaagtattaaccaataatagagtttttcttgctagttagaaagtattaagactgatcttagctttcttctaataggcttgttgaaagagtaacaatgtctagttctaatccagacaccatgcaaagtcttattcttaggtgacatttttgttttaataggacatttcacataaaaaatctgtttaattctaagaaaactgctcttaatttgagtggacaatcttgtctatattttgattcttgaatgcgtcataccaaatgactataagaagagactccttagagtttgtgaaaacttaaaatctgagagagctctgaaagttgacacacaagatggagtggtcatcctctttctttctccattgtgtatattctttgttacagtgtcaaggtaaaaattagtgtagctactccaaagggtgttttgtaattttaattattgctcattgggactcttcccagttattcaggctgctttccaatgtttcagtggttaggcttctcattttacttgttttttcttttttttactttttataattttactcatattggcattaaaaatacattaagaagttttatattgttaaatagtcctgatgtagatagttttgtcagacttgattttagtagtagttgttaacaggtgatttctaaaagtaaagtgttgaaggtctatatattgtttatagttcttatatttagcatattagtatccctgatttccattaatgctcttattctacacagctttgggaataatggtgtaatacgggtaaagtttcccatatgaatggctttgctttttttagagagacagtgtcttgctctgtcgcccaggctggagtgcattgatgtgatcctagctcactgcagccttgaactccttaatctccctgcctcagcctcccttgtagctaggactacaggtgtataccactgtgctcagctaattaaaaatttttttttagggactggtctcactatgttgcctggctgccatatgaacatctttgatatctatctatcttctgactaggaaaacatttgtgtttaagaactgttttgaaatcactgcggaaatctgttaaaggcataattttgaagtttatctattgttattggaggccttagctgttttggatattcctttgtgtataattctatgtgtgtgatttcatttaggatcaaggtgatgcagacaaggagataatttcaaatacatatagtcaagtactgcaaaagattcattcagaggaaaggctcattgccacagtacaagctaagtacaaggacagtattgaggtttgattgtgctttctcttattgatcttataaattgatgatttgaatttttcagtacttaaatttttctattgttgtttaatactcagtgtcagtaaattgttattactagaattcactgtcaactggaaatggtgatttttgatgatataaatatatcaaattttttattgttttaaatattttattatgtccatgagaaccacaatttttaacatcattttctttttgcctgtatgagtctactgtagataatttgctatatacagaaagataagaaataaaacattgcttataattcccttagcctaagagatagttttagagtatttactcactggatgtgcatctgtatgtttgtgagcatatatatatgcattgcattgttttttaagttacttcaaacatactttcttcatttaatggtatattatgaacatttttctatatgatttttctatactgtcatcttgagtgactaaatcctcatccctatgtagatgtacaacaacattaacctttcatgtgtgttggacattaaggttacttccaatttttcctaccataaataacactgtacatatgtttgtgcataattttttgtttttatttctcagatttctaaattctataattactgagttaaaaggaatggacattattaattaaaacttgatacatattttcaaaccacttttgggaaagatgatttcagtttacatcctcactagaaattcctttttcatccatactaacaatgtgtgttttattgtatgtctcagtttgaaatattacttttgtctttgttactttgagtgctggaactgatattcttctaaatagaaacatggattaaaaaggaaatctattgaattgtcttgttgaaaattatagattttcttggtatttcagtctgaactcagtaaatactagttgaatcttaacagagaaataataaatgatcactgttcaataaatacttttcttatgtgtttgaaaatacgtaacttttgtttacttagtttaaaaagcagcttattgaatatttaaataagagtcccagtgtggatcacttgctatccattaagaagacattgaaaagcttaaaagctctactcagatggaaattggttgaaaagagtaatttggaagaggtaaggaaacagttgtttcttactgatctttatgtgcatctcattttacttggtctctgcttcataaaaataatgcataaatacactctttacaataagagagccattacattcacattttgttttatatactttatcttgttttctgtgtatataaataaaattgagattacagtaatagtgtaaaaattttcctatatcattaaatattctttaaaaacattttcctaggctgccttggttcttagtaacatgaacattttagaataattttaaaagctcttttagtttggactgttagaatgtttattgtaataccaacttgctacatgcaggtgacagggtaccccctcgaaggtagcgttttgtcataaagtatttttaagatcatggtatcttttgttaactccctttttatggatagatgtaatatttcttgcaagtattttaagttgcttttatatgataatagaactggagaggattaggatgccctaatctggactaacttcttcctttaggcttgaaactttgtgaataagatagtaaactttgtgttcctttgaggatttgatttatgtacaaggatctgtattatgccttaatccaatttgaattatctgtcttctacttctgagcactgaattgggggtggagcggaggactattctagaactaatatcatagttgaagaactttctagttttattctattctgggctttggggaagttgatttttttagtctgatttttcaacttttggagaaatctgacttttgttatactttaagttctgggatacatgtgcagaatgtgcaggtttgttacataggtatacacgtgccatggtggtttgctgcacccatcaacccgtcacctacattaggtatttctcctaatgctattcctcccctagacccccaccccctgacaggcccagtgtgtgatgttcccctccctgtgtccatattttctcattgttcacctcatcttatgagtgagaacatgcggtgtttggttttctgttcctgtgttagtttgctgagactgatggtttccagtttcatccttgtccctgcaaagaacacgaactcgtccttttttatagctgcataatattccatggtgtatatgtgccacattttctttatccactcaatcattggtgggcatttgggttggttcgaagtctttgctattgtgaacagtactgcagtaaacctacatgtgcatgtgtctttatagtagaatgatttataatcctttgggtatatacccagtaatggtattgctgggtcaaatggtatttctggttctagatccttcaggaattgccacactgtcttccacaatggttgaactaatttacactcccaccaacagtgtaaaagtattcctatttctccacatcctctccagcatctgtggtttcctgacttgtgtgtgtgtgtgtgagtgtgtgtgtgtgtgtgtgtgtatttgtatgttgcctatgttgttttttttttcattattatactttaagttctacagtacatgtgcacaacgtgcaggtttattacataggtatacatgtgccatgttggtttgctgcacccattaactagtcatttacattaggtatttctcctaatgctgtctctctccctgccaccccccaccccacaacagaccccggggtgtgatggtccccttcctgtgttcaagtgttcccattgttcagttcccacctatgagtgagaacatgtggtgtttggttttctgtccttgtgatagtttgctgagaatgatggcttccagttgcatccatgtccctgcaaaggacatgaaatcatccttttttatggctgcatagtattccatggtgtatatgtgccacatattcttaatccagtctattattgatgggcaactgggtttgttccaagtctttgctattgtgaatagtgccacactaaacatacgtgtgcatgtgtctttatagtagcatgatttataatcctttgggtatatacccagtaatgggatggctgggtcaaatggtatttctagttctagatccttgaggaattgccacactgtcttccacaatggttgaactagtttacagtcccaccaacagtgtaaaagtgttcctatttctccacatcctccccactgtctgttgtttcctgactttttaatgatcaccattctaactggtatgagatcgtatctcactgtggttttgatttgcatttctctgatgaccagtgatgatgagcattttttcatgtgtctgttggctgcataaatgtcttcttttgagaagtgtctgttcatatcctttgcccactttttgatgggattgtttttttcttgtaaatttgtttaagtcgtggtagattctggatattaaacctttgtcagatgggtagattgcaaaaattttctccattttgtaggttgcctgttcactctgatagtagtttcttttgctgtgcagaagctctttagtttaattagatcccatttgtcaattttgtcttttgttgccattgcttttggtgttttggacatgaagtccttgcccatgcctatgtcctgaatggtattgcctaggttttcttctagagttgttatggttttaggtctaatatttaagtctttaatccaccttgaattaatttttgtataaggtgtaaggaaggtatccagtttcagctttctacatatggctagcccgttttcccaacaccatttattaagtagggaatcctttccccattgctttcccagttttcccaataacatttattaaatagggaatcctttccccattgcttgcttctgtcaggtttgtcaaagatcagatggttgtagatgtgtgacattatttctgaggcctctttgtgttccattggtctgtatatctgttttggcaccagtaccatgctgttttggttactgtagccttgtagtatagttaaagtcaggtagcatgatgcctccagctttgttctttttgcttaggattgtcttggctatctgggctcttttttagttccatatgaaatttaaagtagttttaaaaaaattctgtgcagaaattcagtggtggcttgatgggaatagcattgaatttataaattactttgggcagtatggccattttcatgatgttcattcttcctatccatgagcatgaaaattttttccatttgtttgtgtcctctcttatttcgttgagcagtggtttgtagttctccttgaagaggtccttcacataccttgttagctgtattcctagataccttattccctttgtagcaattgtgaatgggagttcactcatgatttggctctctgtttgcctattattggtgtataggaatgcttgtgatttttgcacattgattttgtatcctgagactttgctgaagttgcttatcagcttaaggagattttgggctgagacgatggggttttctaaatatacaatcatgtcatctgcaaacagagacaatttgacttcctgtcttcttatgtgaataccttttatttctttctcttgcttgattgccctgtccagaacttccaatactgtgttaaataggagtggtgagagtgggcatgcttgtcctggtgacagttgtcaaagggatgcttccagattttcccattcagtatgatattggctgtgggtttgtcataaatggctcttaatattttgagatgcattccatcagtacctagttagttgagaatttttagcaagaagtgtgtcaaattttatcaaaggctttttctgcatctgttgagatagtcgtgtggtttttgtcattggttctgtttatgtgatgcattctgtttacttatttgcatattttgaaccagcgttgcatcccagggatgaagctgacttgattttggtggataagctttttgatgtgctgctgaattcagtttgccagtattttattgaggatttttgcatcaatgttcgtcagggatattggcctgaaattttctttttttttgttgtgtctctgccaggtttttgtacgaggatgatgctggcctcataaaatgagttagggaggattccctctttttctgttgtttggaattgtttcagaaagaatggtactagctcttctttgtacctctggtggaattcacctgtgtatctgtctggtcctggactttttttggttggtaggctattaataactgcctcaatttcagaacttattgttggtctattcagggattcgacttcttcctgatttagtcttgggagggtgtatgtgtccaggaatttttccatttcttctagattttctagtcgatttgcatagaggtgtttattgtattctgtgatagtagcttggatttctgtgggatcagtggtgatatcccctttatcattttttattgtgtctatttgattcttctttattagtctggctagtggtctatctattttgttgatcttttcaaaaaaccaactcctggattcattgatttttttttgaagggtttttcatgtctctatctcctccagttctgccctgatcttagttatttcttgtcttctactagcttttgaattagtttgttcttgcttctgtagctcttctaattgtgatgttagggtgtcgattttagatcttttccgctttcacctgtgggcatttagtgctataaatttccctctaaacactgctttagctgtgtcccagagattctggtacattgtgtctttgttctcattggtttcaaagaacttatttatttctgccttaattttgttaattacccagtagtcattcaggagcaggttgttcaatttccatgtagttgtgtggttttcagagagtttctcaatcttaagttctactttgattgcactgtgatctgagagacttgtttgttatgatttctgttcttttccatttgccaggaagtgttttacttccaactgtgtggtcagttttagaataagtgtgatgtggtgctgaaaagaatgtatattctgttgatttggggtggagagttctgtaggtgtttattaggtccacttggtccagagttgagttcaagtcctgaatatccttgttaattttccatctcattgatctgtctagtctaatactgacagtagggtgttaaagtctcccactattattgtgtgggagtctaattctctttgtaggtctctaagatcttgctttatgaatctgggtgctcctgtattgggtgcatatatatttaagacagttaactcttcttgttgcactgatccctttaccattatgtaatgcccttctttatttttatttttttttatcttcgttggtttaaagtctgttttatcagataccaggattgcaatccctgcttttttttgctttccatctgcttggtaaatcttcctccatccctttattttgagcctatggtgtgtctttgcacgtcagatgggtctcctgaatatagcacaccaatgggtcttgactctttatccaatttgccagtccttgtcttttaattggggcatttcacctgtttacatttcaggtcaatattgttatttgtgaatttgatcctgtcattatgatactaactggttattttgcccattagttgatgtagtttcttcatagtgtcgacggtctttacaatttggtatgtttttgcattggctggaaccagttgttcctttccatatttagtgcttcctttaggagctcttataaggcaggtctgattgtgacaaagtctctcagcatttgcttgtctataaaggattttagttctcctttgcttgtgaagcttagtttggctggatatgaaattctggtctgaaaattcttttctttaagaatgttgaatattggcccccactctcttctggcattgtacagtttctgcagagaaattgctgttagtttgatgggcttccctttgtgagtaacccaacctttctctctggcttcccttaacattttttccttcatttcaaccttggtgaatctgacaattatgtgtcttggggttgctgtttttgaggagtaggtttttggtgttctctgtatttcctgaatttgaatgttgacctgtcctgctaggttggggaagttctcctggataatatgcttaagtgtgttttccaacttggttcccttttccctgtcactttcaggtacaccagtcaaacgtaggtttggtcttttcacatagtcgaatatttcttcaaggctttgttctttttcattttttttctttaatcttgtcttcatgctttatttcattaagttgatcttcaatgtctgatatcctttcttctgcttgattgatttggctattgatacttgtgtatgcttcatgaagttctcatactttgtttttcagctccatgaagtcatttatgttcttctctaaacaggttattctagttagcaattcgtctaaccttttttcaaggttcttagcttccttccattgggttagaacatgctcctttagctcggaggagtttgttattacccaccttctgaagcctacttctgtcaattcatcaaactcattctccatccagttttgttccgttgctggcgaggacttgtgatcctttggaggagaaaagatgttctggtttttgaaattttcaccctttttgtgctggttttttctcatcttcttggatttatctacctttggtctttgatgttggtgacctttggatgtgtttttttttgtgtggacgtcctttttgtttatgctgatgctattcctttctgtttgttagttttccttctaacagtcagtcccctctgctgcaggtttgctggagtttgctggaagtccattgcagaccctgtttgcctgggtatcaccagtggagactgcagaacagcaaagattgctacatgtcccttcctctggaagcttcatcccagaggggcacctgccagatgctagccagagctatcctgtatgaggtgtctgtcgtcccctgctgggaggtgtcttccagtcaggaggatgggggtcagggacccacttgaggaggcagtctgtcccttagcagagctcgagcactgtgctgggagatccgctgctctcttcagagctggcaggcagaaacattaaagtctgctgaagctatgcccacagccgccccttcccccaggtgctctgtcccaggaggatgggagttttatctataagcccctgactggggcttctatctttcattcagagatgccctgcccagaaaggaatctagagaggcggtctggctacagaggctttgctgggctgcggtgagctccgtggagtctgaacttcctggtggctttgtttacactgtgaggggaaaactgcctactcaagcctcagtaatgacagaggcccctcccccaaccaagctggagtgacccaggttgacttcagactgccatgctggcagtgagaatttcaagctagtggatcttagcttgctgggccccatgggggtgggatctgctgagcaggaccacttggctccctggcttcaaccctcttttcaggggagtcaacggttctgtcttgctggcattccaggtgcaaggggggtatgaataaatattccagcagctagctcggtgtctgcccaaacgtctgcccagttttgtgcttgaaacccagggcactggtgatgtatgcatctgagggaatctcctgctctgtgggttgtgaagactgttggaaaagcatagtatctgggccagaatgaaccgttcctgatggcacagtccctcatggcttcccttggctaggagagcgagttccccagccccttgcacttcctgggtgaggtgactccccaccctgcttttgcttgccctctgtaggctgcacccactgtctaactagtcccagtgagataagccgggtacctcagtttgaaatgcagaaatcactcaccttgtctgttgatctcgctgggagctgcagaccggagctgttactatttggccatcttagtatctggatccttgaaatctgacttttaaagtgtaaaccaaactatctgaggcaggtatcaatcaatttagaaagtttgttttgccaaggttaaggatgcatgcctgggaggcaggtctgtgcctttctcagagatgattttgagggcttaaatatttaaaagggaaaggatggatactggggaaagaggaagaaattttaaaaagatgtgagtagataagagacagatggtttgaattctttaatccttgatcacctttcagcaaatacactatttacatttgagagaggggtagaggaatagtcactagctcagtgaatctgcatttttacatcagaggaaggaatcagatatgcatttgtctcagttgagcaaagggatgatgacttagagttctgtcctttgtcctgcacctgagaaaataagccatcaatttaccttgtcagggtaaaattcaacagaactgttttagggtgaagatcctgagacccataaggaatttcctactgagcaaattgtgagagaggtgtgcagggtttttatggttgtagctatcttatttaggaataaaatgagaagctggtttgcctgacacagttcccagcttgactttttcctttggcttagtgatttaaagttcacaagatttattttcctttcacaaaagcatacatactttttaaggtggcttatgtattatcattggagacagttcacacatttactcatccttttgttttgtttttaactaaatatcatgtagaagacaattctagggaattcaggtgtattctggttgctattattaacatttcttttgttcgaatggcagttggccatctttatcttagagaaaatctacagcagatgaagagacaagaaaaatctgtataattgattttatgtctttactttttgtaattcctttttctaggtttcagaaaagtcattgttagaataaattgacctaagttaattcagcaagtattagaagggtcttttatgtgctaggtactgaaggatacatagaaaccacacagagtaatttactatagaacttgaattcttaaaagaagacttgttttctctatgttaataaaaaacactttttctttctgattcaagtcagatgatcctgatggctctcaaattgagaaaataaaagaagaaataactcagctgcgcaataatgtctttcaggaaatttatcatgagagagaggaatatgtaagtatttggttctttgaagttttacattaggttttactctagaaattgaatttaaatacccgttttatgaagtggactgtaatcacaaggctagaggtattatatagaaagtttatatatatattgacctggtaagatttttgtaaatttagaaataaatttcacatgacaaaatattctgaccattgtaccagtgtggaaataactgaaaattgtaaagaaggaaaaacatcacttgtaatatttccactcagtgataatagtagtaatcactgttaacttttgactttcttttagtatttttttgtttgtttttagaattgagattatagcacagacacacttttgcatattgccttttttctgtttaacataaaacctaaagaccttttccttacatcaacgtcattttcccataatgttgcagtgaaaacattaatggagcacataatttagttgaagaatgtaacaaaataagtctacctggttttgggggcaggagaagttacatcttttaagtctctatttttaccactgatttttgtgagcttgggaaaataagtcattgtattttttctttaaaatggaagaatattgtattttatatctgggagatgttaccaggaagaagttagttaagaaacagtgctttgaaagtaaaaatactgaccgggcatggcggctcacacctgtagtcccagcactttgggaggccgaggcgggcggatcacttgagcccgggagtttgagaccagcttgggcacatggtgagaccccatctctacaaaaaatacaacaattagctggtcatggtgtcatgtacctgtagtcccagctgctttggaggctgaggcaggaggattgcttgaacccaggaggttgaggctgcattgagctatgatcatgcctctgcattccagcctgggcaacagagcaagaccctgtctcaaaaaaaaaaaaaaaaaaaaagaaaagaaaagaaagtaataatattaatactgtgaaaacaataggtaagtgtcatgctttctttagcaaattcatctgcgtatatgtaaataccttatggaccttgggttaaaatagcgatcttgcaatgatttgacaagtgtttagaagttttgcttaataaatatgtgataagtggcttttctttcgtgagggtactcaattttcacatttatttcaaagttacttatgtagagctatgtgttttttctcttaggctttaaaaatttttcttaacgaaacagctgttattttaaaatgtcactgtgttcttaatattttgagaaataatgacagttttatgcctcaaattgaaatattatcagacattttcattttagtttggaagtgggtgaggactttgaccttgcaagatttgtgcttatgtatgtatccaaagcttaaaattggtaattaaatttttcttcaattagtaagatggtagtttagatgggttaaaaaaaaaaacttcagccaacttaaatttaaaggagcaatgaacaattcgcaaattgggcagctgaatcacagcatattcggagagactctggggatgctttgtggtcagaacaaattaatagacgaaaaaaggaaagtggctttcagaaattggcagcgaggtacagaaacagctatattggttacagattggtgtttgccttatttgaacacagtttgaacacttagcagtctgtaagtggttgaagtatggcggctgggattggccaagactcagctattgttataggtccacactgctaagttacattttcagtctcgtctgcctgttaagctaggttgcagttcatccacaaggactcaaatatagaagtacggagtccttctcaggccatgtttaatttgctttagcagatgcaaggtgagtcgtggttttcacttgttatttcttgaagtagaaggcaaaatcagtgattatgtatcttactggatatgttataaggtagatgctgatatattttcctgaagagcaacatgtcaaaattgaatatatattgatctacagttaaaaactttttttttttaactttaggagatgctaactagtttggcacagaaatggttccctgagctgcctctgcttcatcctgaaataggattactcaaatacatggtaaactttgtttcccttgcgaattactactcttcagagggtgttgaaaagtgataatattaaatttgtgtcagtgttaaacttatagtatcttttaaataaaaatactcctgatgaatattttatgggtattagaactttttcttatgaccctttaatagttgcatggtatatatttgtatttttatgtaaatttgcattatccgtttttctgctttcctcatcctcattcagtacattgcatgacacttatttgaattataggtgtttactttttgaaatgacaaaataaaattttaactgctatttcaagagttaggataaaaacaagatattgctagccctgagggatttgagcacaatgggttttttaagttaaagcagtctgggaaaaaattctagagaggttggttaaggtagagatgttgaggtgggtatggttttctaggtaggcaggattcaaaagctggagatcagcatattaaataggggccatagggagcaggattagtaaacactggtttactaatctgttagtcctgaatctgttagtcctgcgatttatattgccttctacagtgagggcctagatgaggtatttattcattaagattgtcacgaagtccattataatggcttaaatatggtacagagagggatatttgtgtagacatgtgagtttattctaaaaaatatttaagattaaagttccctaacttaaataattactctaaactctttctagactagactttaaaatgatgtgagttttttcttgcaactatttagcttagtgattaccttatgcagtgtgggcaaataagtatgtactgccacatgggacttgaaaattaatatttaaaaatatgctaatctactttattatggaagattataaaaggtttgactcatggtttattgaagtctttaatggctttctgatgtttaactgtaatgtatgcttaggaattttttgtaggttgattatgtattgtagaatacttaaatgtaccgacaagacttaaaaaaaaaacccagaaaacaattctacaatgcctcttactgaaactgcaccacagtaaaacttagctttgtttaaaatgttgatgatcatattttagtgtgaaaaattattccttttaaaaagtagcagaaatatctagtaaaattagttattgaaagccattttcacttttgaggactccaaacaggggcagaggtgttagaattacttcatggtagtcataatttttggactaatctttcccatttgatacctacatttttgtcattattttaccttatttattttttgtttttttacaaatgtttatttcagtagtttttggggtacaggtgttttgtggttacatggataagttctttagtggtgatttctgagattttagtgcacccatcacctgagtggtgtacactaacccaatatgtagtccctcattcctcacccccgtcccaatcagttgttactttagtattttttaggaaacataagtggtttttcaagtaaacattagggatcctaggatgcatgtctggttgattctagtcatttcctgaatctgttctaaaattatagcagtaattaaatgtatggtgattacactttgggtaggaggagtttaagagccaggaactggagaaagtacacagttttaaagattttaattttgttggtttttccagtacagttgatggtgtccaagtcatttaatatcgtgtaactaattattttgatgatttttaagtgctgggattgtttggattctttaactgtgataaaaacttgtgcctagaactctggtggtctccttacaatgagcttggaacgagatcttcttgatgctgagcccatgaaggaacttagcagcaagcgtcctttggtacgttctgaggttaatgggcagataattctgttaaaggtaagtctaacttcttcttacttgtgggagattcagcagcataaaggatagtggtgctgttacatttcaagaaagaaaaaacctcactgttagttttctaaagtgtataagttgactggcatgataattgtgcttgtagtttggttgccagaactaattttcacttttaaagtttccctcaattgaacaatgagaacacttggacacagggcggggaacatcacccgtgggggcctgtcatggggtggggggcagggggagggatagcattaggagaaatacctaatgtaaatgatgagttaatgggtgcagcaaaccaacatggcacatgtatacatatgtaacaaacctgcacgttgtgcacatgtaccctagaacttaaagtataataataaaaataagtatataaaagtcattaaataaagctttgtctcacaagaaaaaaaaataaagtttccctcatttccctaaatagaatatgtccttaataggatatactttcctttttttttgggtgaacttattatagtcatccaatatctttttaaaattcttgattttcttacatttctccttgaaatctcagctgtgttatcagtacaatcttctactctttaatttcttcttctcattgatctgggaaactgttaatcatgataataagataattaatttggccttagttgctacacattctagaatgtgtagcaggctacaggtagaattgcactttccttttccaaattatagcattcaaagaagatagaaaagtacttataaaattaaaaaataaaattagatttgatttaacttaaaataatgaattatgtttaaattggaatgatgtataattataatgagattttcatcttggaattacgagtgcctctttctttggtacaagggctattctgtggatgttgacacagaagccaaggtgattgagagagcagccacctaccatagagcttggagagaagctgaaggagactcagggttactgccattgatattcctgtttttatgtaaggtaaagttcttatgctaatctcttgcagaaaccattttatcttgcagaaactattttatttaaaataaattttagctccaggttttagagcagcagttcattccccttaacataaaagaaaaattatcccatagaatcaatgtatgctaaaaatatgttgaagaagtttttacttggagtcacattctctgttttgcttcttagtctgatcctatggcttatctgatggtcccatactaccctagggcaaacctgaatgctgttcaagccaacatgcctttaaattcagaagtaagtaaaaagcactatttatttccatggatgtattaaatgagaaaataacacctgatatttattcaggcatactacatgctatgtattttgtaaaattttgactcatggtattctatttgtcacctcaagcctgtgatagaagttatcgtgttatatagatgagaaaaagcgttaaagggattagattaagtgacttgcacagggtccgttagccagaggtagagctgggactcgaaattaagtctttctggttccaaagcccaaacttacaactgctaagctgtgctgtatgtgaactgcctaatatagcacttggtactgtaagtgcttaagtggcagctttaatttttgtcattgtaagtttaggattagtaataacagtaaaggaggccctgattcttcttatggagtaacactgtttcagtctcttatagctactttacatggttggtatttgtaatccaagtcttctttgagatgatagaacaggtgtcctcagaccccaggtcgcagactggtaccagtctgtggcctgttaagaacagggcggcacagcaggaggtgagtggcaggtgagcaagcattactgcctgagctccacttcctgtaagatcagtagaggcattagattctcataggagcataaactctattgtgaactgtgcatgtgagggatctaggttgcgcactccttgtaagaatctaatgcctgtgatctgaggtggaacagtttgatcctgaaaccaaccccctgcatccatggaaaaattgtctttcatgaaaccggtccctggtgcccaaaaggtatgattgtacacacacacacacacacacacacacacacacacacacacaaacacacacaggcacacatggtatcaccattacaaaatcaagccttcatctggtctttctctatgctgtattcttattaatggttcatttcgaggaaactttactcacttctagagcagtcttttaattagagaacagtttcaagattaaaatgatttgcctacttcctcacttcttttatgtgtacttatctataggaaactttaaaggtcatgaaaggtgttgcccagggtctgcatacattgcataaggctgacataattcatggatcacttcatcagaacaatgtatttgctttaaaccgtgaacaaggaattgttggagattttgacttcaccaaatctgtggtaagatatcatggttttacaaataggttctagactttatttaatattattaagcagtagttcagcacttatatataatataatactttattataggatctttgtcttcagttaaactgtgtcatgtagtataagcaactatttgccctcagctagatgctagaacagcaggagtattgtgtattttaaccataagtcttaggagctacctgacattatatactcaatggcattgacaacattaataattttgtcatcattaggaaacatttaattgctaggaaacatgtaaggaaactaggtggccatctcctaaacctctctccactggtgtccctccgtctatagatacaatttacatatacgtactttgctgttttttgattaataatgtgcatttttagaaaccggggaaccttggactttttagtttaaatcctgattcacctctaatggctgttaattcagtgtcatattacctcagaataggcagtttgtagagatagcaaaatcacacaatttaagagcatgttgtgatttttttgtcgttataatggaaacaattctctattttaattgagaaataaaaattgtatatatttatcatatacaacatgatgttttgaagtatgtatacaatgtggagtggccaaatcagtaattatttttctaaacattacagctttattgagatacaattcacataatgtatacaattcattaatagtttgtagtacattcacaaagtcgtgcagtgataaccagtattgaattccagaacattattaacattcccaaaaagaaaatccatactgattagcagtcactcaaatttcccacttcttctcaagcctggaaactacgaatacactttctgtctctatggatttgcctatttggacatctcatgtaaatggaatgatacaatatgtggccttttatgctaatttcacttagcatagtgttttcagagttcatccacgttattgactgtatcaaaatgtcattcctttttattgccaaattatatttcattgtatggatgcaccacattttgtttatatattcatcagttgctggacatttggttgtttatacttattggttatatgaataatgctgctatgagctttagcatacaatattttttgtgtggacatgttttcatttctcttgggagtggaattactgggttacattgttttactttttgaggagccaaactgttttccaaagtggctacatcattttatattcttcccagtaatgtatagggattttgttttctctacatccttgccaatattttttattatctgagcaattccctttgactagtatatgttataatgcttttatactttggtcatctgcaagtcatagtgtaatgctactggagtatatatagtcttaatggttttgatatggtagctcaaaaagatgagaaaatgaaactgcaactgtaatcaaaagctggattgtacaggatttatacagattgattttctgaaatatttactttattacattagtttaacaaaattaagatatcctaagaaatataactaaattatgaattttgaaagatctcaaccttcaggggttctggttagtttaccttttgagcatactatttgcataattatagatatgactacaataattactctttagtcattcgtcatctgttattattccccaaaacattgtttttaattttcagttaaaaatatttattctgaaatattgatcaaactcaccttttgctacattttccatgcaattttcagattgaagtggttatcaggaagataaatttgaaaagtagtctgaggtcaagatcattgcttttcaggccttatagtgcatacaactcacctggggttcatgttaaaatgcaaattaatattcagcatttctgcagtggatcatctgcatttctaacaagctaccagttaatgctgtagctcctggcccttggaccatactttgagaagcaaggatcaaaatcgtagctagaaaaaagatagcacttagtgacacatgctaggcattgtatctctgtaaggtagacattatttccattttacaaattaattcaggctcaaagaggtttacacctactatgtacccataaaaattaaaaataaattttaaaaatggacaaaaaagaggttaaagccctcggtcccacagcaaataaataggagagtggggaattgtaaccaagatctgcctgaatataggattcatgctattgtcactgatcatctttgacatgttagaaatggtatatttagagaatgatcagtaaggaaggaaagtgctttgtaggatttcagttcttaaatgaattatttagaattttcagaattagaacatggcactgctgctcactcttgtgaaatttattttttaaaaagagtatcaaatgtttaatcacagaataagtggttgttagtattaaatctgttcaagtctacaaagtgaatgtaaaaaaaagtcccatagttaatttattagactgattttaagagcaatttataatagcagaaattggtaaaaatatttgaaagcaagggaatgaaatatttaaaatgaatttgttttttgtattgattaaatgcagagtacttcacagaaagtcacctcaactgtgttgtatctgaaatatgtaaaatattgtttttgcagagtcagcgagcctcggtgaacatgatggttggtgacttgagtttgatgtcacctgagttgaaaatgggaaaacctgcttctccaggttcagacttatatgcttatggctgcctcttattatgggtatgttatttttttgttgaaatagatcatatatatatatatttcagtatataaagtgatgattttatagtgattctccttaaaaataaaaagcagcagacttttagtagaactttaagttttaacaaaaactattgatatgcttcctattacctattgtgtactttctacaaattggcttgatgtatattttaggtatcatgctattgtcttggttctgttgaagtcaagattaacagtgaagatgattttgtcctacattaatctgaaagcagttcatgcatatatggaaaataaatgttaaataagccttgggtatattcctgcttccagtgtagaccaaatagctgtttctcatccatagtttaagaattaagaagttggatggagctggagaccattatcctaagcgaatttactgtggatcagaaagccaaatactgcatgttctcacttataagtgggagctaaacactgagtacatatggacacaaagaagggacactggggtctacttgagggtggaggttgggagaaaggtaaggattgaaaaactacctgttaggtattaggctgattacctgggtgacaaaattatctgtacaccaaactcccatgacacactgtttacccatgtaacaaacctgcacatgtaccccttgaacctaaaataaaagttggaagacaaaaaaataaaaagcttgtttcatgttgtactgctattttacgtagagaatgcctctttttccaaagtcttgagtgtgacaaaaccttatctttgttgatcacataaataaaaataatctccttgttagaaaaacaagagttaagagggattaagtattaagagaaggaagactattcttatcagcccaggggccagcaagcattttctgtaaaggaccagatggtctctgttgcaagtactgagttctgctgctatagcatgaaagcagccatagacagtatgtaaacaaatcagtgtggctcttttccagtagtactttatttatggatattgaaatttgaatttcatgtagtatgcatgtgcatgaaatagtattccttcagtttgctattaaacatttaaaaatgtgaaaactacccttggcttgcagctgtacaaaaacaagtagtggaatcagtttggtgcagaggccatatagtttgctgatctctgttccaatcagtgtaataaggtcaaaaaaagaaataaaagtcatagagtttgaaaatgaagaaataaagctgtctttatttgcagatgacatgcttaattatgtagaaaatctttgagaatgtacataaaagctactagaacaaatgagtttagaaagatagcagttttaatttcaatataattgtgtttttatataagcaacaaataataggaaattaaaatttaaaaatcatttacaaaagtattaaaatatggaatttgtaggggtaaatttagtaaaagatgtgcaagagttgcacactattaaaactacaaagcattgttcagagaaactcaagaagacataaataaatggagcgatacaccatgctcatggactagaagacattgtatggatatcagttgttcttggcttatagattcgatgcaatttcaacaaaattgctggtagattttgcttattttttcagaaattgacaattagattttacaattaatataaaaatggagaggatctgagatagccaaaacaagtttgaaaaagaacaaaattgaaggacccaaactacctgattttatgacttaatagattctaggaaattaagacaatgtaggcctagagtggtggttcaaaactgtaatcccagcacttagggaggctgatgcaggaggattgcttaatgccaggagttgaagactagcctaggcaacacaagtgagcaccccctgtctctacaaaaaatagaaattagctgggtgtaatggcgtgtctgtggttctagctccttggtaggctgagacagaaagattgttggagtccaggagtttaaggctacagtaagctatgactgctccactgcactccagcctaggctacagagcaggaccctgtttctaaaaacacaagtgatactgctgtgaagttagatgtccagatgaatggagcagaatagagacaatataaatagactgcacatgtatgataactggcttttgacaaagatgccaaggcagttctctgggtaaaaggagaatcttcaacaaaaatgatacaggccaactcataccatatgtagagaataaattttgattcatttcttataccatgcacaaaaattagctcaaaatgtgtatcagacctaaatgtaaaacgtgagtctaaaacttatagaagaaaacataggatgaaatatttgactttcgatttggcaaagatttcttaagtaggacacagaaaacatcaactctaaaagaaaaaaatcatttggatttcatcaaaatggaaaaccttgctcttctaaagacattgtcacaaaaatgaaaggcaagctacagactaggagaaaatatttgcaaaacatatatctgacaaaaatattatatccagattatcaagagctcctacaatcaatactaagaagactgcccagttaagaaatgggcaaaatatttgaacaggtactttaccaaagaaggtgtccacatggcatgtaagcatgtgaaagatgctctgaacaccatttgtcattagggaactacagattaaaaccaaaatgagataccactatactactcactataatgtataaaattaaaaagatcgtaccaacggttgcttagatctgttgtacctagaactcatatatattgcccaggggaatgtaaagggaacaaccactttgaaaaacatttggcagtttgttaaaaggttgaacatattcctaccctatgacccagcaattccacttctagatatttagccaagagaaatgaaagcatatgtccacacaaagatttgtatgtaaatattgaaagaatttatgtgtaatagatgaaaactagaaacaactcaaagtccatcaacagatgaatggaaaaacagtctgctatgtatgtgtctatccattggaatactactcaggaataaaacgattgaactataaatataactcagtaagataggtgagtcttaaaataattctgccaagagaaagaagccagatgataaggtttggctgtgtctccacccaaatctcacattgaattgtaatccccatgtttcaagggtggggtcaggtggagataattgaatcatgggggtagtttcccccatgcagttcttgtggaagtaagtctcacaagatctgatgatttcataaggggcattttcccttttgcttggcacttcttgctgcccccatgtgaagaagaatgtgtttacttccccttctgccatgattgtaagtttcctgaggaatccccagtcatgctgaactgtgagtcaattaaacctctttcctttataaattacccagtcttggggatgtcttttattagtggtgtgagaagggaccagtacagtaaattggtacagagagtggaatgctgctgtaaagatacccgaaaatgtggaagcagctttggaactgcgtcatgggcagaggttggagggctcagaagaggacaggaagatgtgggaaagtttggaacttcctagagacttgttgaatggctttgagcaaaatgctgatagtgatatggccagtgaagtccaggttgaggtggtctcacctggagatgagggacttgttggaactagaataaacgcgactcttgatgttttagcaaagagattggtggcattttgcccctgtcctagagattggtgaaactttgagcttgagagagatgatttagagcatctggtggaagaaatttctaagcagcaaagtgttcaagaggtgacttgggtgcttttaaaagcattgttttgtgtaatcacaaagatatggtttggaattggaacttatgtttaaaagggaagcagagcataaaagttaggaaaatttggagcctgatgatgtggtagaaaagaaaacccgtttcctgggagaaactcaagccagctgcaggaatttgcataagtaacaagtagctgaatgttaatcgctaggacaatggggaaagtatctccagggcatgtcagaaagcttcgcagcagcccttcccatcacaggcacagaggcctaggaggaaaaaatggtttcatgggctgggcccacggtccccctgctgtgtgcagccttcagacatggtgccctgtgtcccacctgctccagtcatggctaaaaggggccaaggtacagctcaggccatggctttagagggtgcaagccccaagccttgttagcttccatgtggtttgagcctgaaggtgcacagaagtcaagaatggtggtttgggaacttccacctagatttcagaggatgtatggaaatgcctggatgtccaggcagaagttttctgcaggggtggagcccttatgaagatactctgctaagacagtgcaaaacggaaatgaggggttggggctcccacacagagccccaactggtgtactgcctagtagagctgtgagaagagggccacagtcctccagaccccagaatggtagatccactgacagatcacactgtgtgcctggagaggcaacagacactcaatgccagcccatgaaagcagccagaagcggggctgtagcctgcaaagccactggggcagagctgcccaaggctgtgggagcccactcttgcatcagtgtgacctggatgtgagacatggagtcaaaggagatcattttggagctttaagatttgactgccctgctggattttgaatttgcatgaggcctgtagcccctttgttttggccaatttctcccatttggaacaggtgtatttacccaatgcctgtaccccattgtatcaaggaagtaactaacttgctgttgattttacaggctcataggcagaaggaacttgccttatttcagatgagactttggactgtggacttttgacttaatgcttaaatgagttaaaactttgggggactgttgagaaggcatgattgtttttgaaatgtgaagacatgagatttggaaggggcctggggtggaatgataatggtttagctgtgtccccacccaaatctcaccttgaattttaataattcctgtgtgtcaagggcaggcccaggtggagatatttgaattacggggtggttcccccatactgttctcatgactttagccctatgcctgcatgtatatttaaagttgtctggtttcattgaaccagcaccctcatggaaataaactagcatgattttcatcaatgcttcagtaatctattctttatatcagaagggtgaaagtaaacatatcaagtttttttttttgtttctgggaggactcataagatatcccataagtgtggtaatagcagtttttattccacctatttcctttaaatgatagtaaaaagctccatgagtaaatatattgtctgattttctactcttatgtattgttgattaagtcctttaaaaactttatttttagattaacttgtacaatggacttttttttgtatacattctatgaattttaacacacctatagattagtgtaataaccactgccacagccaggatgcagaacagttccataaccctgaaaattcctgtgtgccatccctttgtagtcacagcctcctcccaacccttaaacgctggcaaccactgaccttttatcactgtgttttgtgcttttaagaatgtctcacacatagcaatatgaaccttaaatgtaaatgggctaaatgccccaattaaaagacacagactggcaaattggataaagaatcaagacccatcagtgtgctgtattcaggagactcatctcacatacaaagacacacataggctcaaaataaagggatggaggaatatttaccaagataatggaaagcaaaaaaaaaagcagggattgcaatcctagtctctgataaaacagaattttaaccaacaaagatcaagaaagtgtaagaagggcattacataatggaaaagggatcaacgcaacaagaagagctaactatcctaaatattatatgcacccaatacaagagcaccaagattcataaagcaagatcttagagacctacaaagagacttagactcccacacaataatagtgggagactttaacaccccaccgtcaatattagacagatcaacgagacagaaaattaacaaggatattcaggacttgaacttagctctggaccaagtggacctaatagacacctacagaactctccaccccaaatcaacagcgtatacattcttttcagcaccacataacacttattcagaaattgaccacattattggaagtaaaacactcctcagcaaatgcaaaagaatggaaatcttaatggtctctcagaccacagtgcaatcaaattagaactcaggattaagaaactaactcaaaactgcacaactacatggaaactgaacaacctgctcctgaatgactactgggtaattaacaaaattaaggcagaaataaataagttctttgaaaccaatgagaacaaagacacaatgtaccagaatctctgggacacagctaaagcagtgtttagagggaaatttatagcactaaatgcccacaggagaaagcgggaaagatctaaaatcgacaccctaacatcacaattaaaagatctacagaagcaagaacaaacaaattcaaaagctagtagaagacaagaaataattaagatcagggcagaactgcaggagctggagacatgaaaaacccttcaaaaaatcaatgaatccaggagctggtttcttgaaaagattaacaaaatagatagaccactagccagactaataaagaagaatcaaatagacacaataaaaaatgataaagcagaaatcaccactgatcccacagaaatccaagctaccgtcacagaatgcaataaacacctctatgcaaatcaactagaaaatctagaagaaatggaaaaattcctggacacatacaccctcccaagactaaatcagcaagaagtcgaatccctgaatagaccaacaataagttctgaaattgaggcagttattaatagcctaccaaccaaaaaaagtccaggaccagacagatacacagtcgaattccaccagaggtacaaagaggagctagtaccattctttctgaaactgttccaaacagtagaaaaagagggaatcctccctaactcattttatgaggccggcatcatcctggtaccaaaacgtgccagagacacaacaaaaaaagaaaatttcaggccaatatccctgatgaacattgatgcaaaaatcctcaataaaatactggcaaactgaattcagcagcacatcaaaaagcttatccacaacaatcaagtcagcttcatccctgggatgcaaggctggttcaacatatgcaaatcagtaaacataatgcatcacataaacagaaccaaaaacaaaaaccacatgattacctcaatagatgcaagaaaaagcctttgataaaattcaacacccttcatgctaaaaactctcaataaactaggtattgatggaatgtatttcaaaataataaaaggtattcatgacacacccacagctaatatcttactgaatgggcaaaaactggaagcattcccttgaaaactggcacaagacagggatgccctctctcaccactcctatttaacatactattgcaagttctgatcagggcaatcaggcaagagaaagaaagggtattcaaataggaagagagacagtcaaagtctgtctgtgtgcagatgacatgattgtatatttagaaaatcccatcatctcagcccaaaatctccttaagctgataagcaacttcagcaaagtctcaggatacaaaatcagtgtgcaaaactcacaaacattcttatacacccgtaacagacaaagagccaaatcatgagtgaactcccattcacaattgctacaaagagagtaagatacttaggaatacagctagcaagggatgtgaaggacctcttcaagaagaattacaaaccactgctcaaggaaataagagaggacacaaaaaaatggaaaacaaattccatgctcatggatagggagaatcagtatcatgaaaagggccatactactcaaagtaatatgtagattcagtgctatccccatcaagccaccattaactttcttcacagaattagaaaaaactactttaaatttcatgtggaaccaaaaagcccgtatagccaagacaatcctaagcagaaagaacaaagctggaggcatcatgctacctgacttcaaactatagtacaaggctacagtaaccaaaatagcatggtaccggtaccaaaatagatatatagaccaatggaacaaaacagaggccacagaagtaatgcctcagaagtatctacaaccatctgatctttgacaaacctgacagaagcaagcaatggggaaaggattccctatttaataaatggtgttgggaaaactggctagccatatgcagaaaactgaaactggaccccttccttacaccgtatacaaaagttaactcaagatgcattaaagacttaagacctaaaaccataaaagccctagaagaaaacctaggtaataccatttaggacataggcatgggcaaagacttcatgactaaaacaccaaaagcactggcaacaaatgccaaaattgacaaatgggatctaattaaactaaagagcttctgcacagcagaagtgaacacatcagagtgaacaggtaacctacagaatgggagaaaatttttgcaatctacccatctgacaaaggtctagtatccataatctacaaagaactgaaacacatttacaaaaagaaaacaaccccatcaaaaagtgggcaaaggatataaaccgacacttctcaaaagaagacatttatgtggccaacaagcatatgaaaaaagctcatcatcactggtcattagagaaatgtaaatcaaaaccacgatgagataccatctcatgccacttagaatggcactctttgaaaagtcaggaaacaacagatgctggagaggatgtggagaaataggaacgctttacattgttggtgggagtgtaaattagttcggccattatggaaaatagtgtagcgattcctcaggcatctagaaccagaaataccatttgacccagcaatcgcattactgggtatatacccaaaggattataaatcattgtactataaagacatgcacacttaagtttattgcagcattgttcacaatagcaaagacttggaaccaacccaaatacccatcagtgatagactggataaagaaaatgtggcacatatacaccatgcaatactgtgcacccttaaaaaaatgatgagttcatatcctttgcagggacatgggtgaaggtggaagccatcattctcagcaaactaacacaggaacagaaaaccaaatacctcatgttctcactcataagtgaacatgttctcactcataagttgaacaatgagaacatatggacacagggaggggaacatcacacagtggggcctgttggggagtgggggtctaggggagggatagcattaggagaaatacctaatgtagattatggtttgatgggtgcagcaaaccaccatggcacatgtatacctatgtagcaagcctgcacgttcttcacgtgtatcccagaacttaaagtatataaaaaaaagaaaaaatagaaaaaaatataaataaaaataatatcatattagtggtatcatacagtatataattttgtgagtctagcttctttcattcagcatgtgaatcatcttttgtgattcattcaagttgtctaatgtagtttttcccttttttgtttctgaatagtgctctgttgtatgtacataccaaatttgtttgttcacctgttgcagaacatttgcattgtttccagtgtctgactattgcagataaagctactgtgaacatgtgtgtataggtttttatgtgaacgtaagtttttgtttctctatggtaattacccaggagtgaaatttctgggtcagattgtaatcgtatgtattattctttaaggacctgccaaactgttttccagagtggctgtactgtttttgattttcacctgcaatttatgaaagtttcagttcagcatcattgtcggcacctcgtattgttattatcttctattttagccattctcataggtgtgtggtagtgtttcattgtggttttaatttctctaatagataatgatgttgagcatcttttagtttgtttattattggctttctgtattttctttggtgaagtgtctgtcttttgcctgttttttaattggatttttgttttattgctgtagagttttgggcattcataaatacattctagatagaagtcctttatcagatgtcatttgcaatgatttttttctggcctgtagcttttctttttattttcttttcagtgtcttttgcagagaaaagggttttaattttgaagtttaatttattattgttttctttttatgtatcatgcttttagtgttgtgtataagaactcttcgcataacccaaagacttgaatattttttcttatattttcttctaaaagctctatagttgtatggtttacatttagagctgagatctctttggatgtaatttttgtgtaaggtgggaggtttatgtcagggttcatgtttttgcatatggatgtccaattttacaacaccatttttttaagagagtgttattctctgttgaattgtctttgtatctttgtcagaaataaatcggccatttttgtgtgagtctgtttgtggactctttctgctgttgatctgtgtgtctatccgtttaccaacatcatactgtcttggttactgtatctttatagtatgtcttaaaattgggtagtatgattctttttcagattttagctattcagctatctttccttttttgtatatattttattttatattttacatcttaccttattttattttattgagacgtgtaaggtcagccgagagaaaggaaaaatagacctaaagtcaggcgcgtaagtttattgaacctgaggggctgcttcacctcactcagaggaggcagccctgagtttacaaaatgaggggtttatattggagaagggagtttgagggagttctttggtgtggccgcattccagggttgtttgctggttaattttgtcacatatcaccttgtgacatttgtggtagcagaactttcaggaaggtgtaggtaaagtttgtttattcttccaacgacctcccgctgtgcggtccagatggttcgtaattggggtttgtttatccagcaaggtctgataagtgaagtctgctggcttcactgtggtgcctagataagggcttagaaatgtaaagaggcttgggggaagggtggacagcacggagacgtttgaggggagcgccaagaagctttatggggcagtttgtctttaagacgcagtctcactctgtcacccaggctggagtgtactggcacaatcttggctcactgcaacctctgcctcccgggttcaaatgattcttgtgcctcagcctcccgaggagctgggattataggcacccgccaccacactcggctaatttttgtatttttagtagagatgaggtttcactatgttgaccaggctggtctcgaactcctgacctcaagtgatccacctgccttggcctctcaaagtgctgggattacaggagtgagccactgcgcctggctgcttttccatgtatattttacaaacagcttgtctgtgtgcacaaaagccctgctgtgattttgattggaattgcattaaatctgtagatcaatatggggagaattgacatctttactacattgagcctttaatttgtgaactccatttatttaaattttctctggtttcttttatcaacgttttgttattttgggcttacagattctatacatgtgttgttagatttatacctaagaatttcatgtttggaagctattgtgttttttaaaaatttttgttttctagttggtcaagttcttttttacaacagtatttttttgatagtaaagttagtttggtacgaaaggctgtgtatactttgaccttcctcctcaaagaattgggcaatttattatgaaagcacatagtgtaaaatatataaaagggcaaaaagtcaagatccaagggctgtgcttaaaaaggtaatattcagagttaaactggaagcattatcaaaagattttatttacaaggccatgaagggattactgtcactttgtctttaaaaaaattttagaaatagcaataataaaaaagtaatagtttgatagcaaagctctagaatactaactagatattttgggcatatcaaagatactgtggttttagatcatttttcttatgagatccagattaaatgaagtgttctgaagactgcctacagaaaattcaaaacaatggacaattcaagtgttgtgggttattaccttcagtaataaaccatatctttttttaaacgtttaaattaggtttgggggtacatatgcaggtttgttatatagataaactcgtgccacaggggcttgttgtacagattattttgtcacccagatactaagcctagtacccaatagttattttttctgcccctctccttcctcctaccctctgcccttaagtaggccccgtgtctgttgttcccttctttgtgttcatgagttctcaacatttagtgagaacacagagtatttggttttctatatcttttaactgaaatacatggactatagttttatcatgacaccatttgtattaaggttcttcactatatttttaggttattatggaaatcttaaaggtgttttctagaagccagtttttaaaaagtataacagttctgtctgatgttacattgaaaaagaattgtgtttctgtgtgtgttgaggagtactgctgtgaagaagttgaatataaagaagagaatggccccctttctttgtttatttttatttatttatttatttttaagagatggggtctcactatattgctcaggctggtctcaaactcctgagctcaagcgatcttcccacctcgatctcccaaagtgctgggattacaggcatgaactaccacgtctgtcccccttttatttattcagagacacattttcagtgttgctttccctaaaatgcattttttcctgctttatttttctgttaccatattatacacttatttatctttattattgtctgcttctaccactcgagtggaagctttttgggagtagcttatctatcttgtttgccactatatcctcaaatgcctagaactgtgcctggtgcaaagtgggcactcaaatattagttgaatgaatgtttaaattttagccacagttatatgctgaagtattaggctttaaaaaatagttccatgtttttttcctgagttcatttacttacctctcatttatggccccatgtacatcattttattctttaaaaccttgcatgaagattttattccgactcttaatatatttctaggagatgttagtggtcatactgatcacccagtgaacctaactttgcatttctggaccttcttaataacgtgagacccaaacctttatgtaatttcagtcacttccccaaaccaggattttgtgaatctctacaattgttatttttcaaaagtaatagagtccaatccattatatttttctcctaacaggatttcctgtcctctcatttactgtgtctgctaatcttaaatctccagtgggtttatttactgtctctcttttcttccagtttatcagcagccttctagcttttttctttatttactcattcttggaccctatcatacaattcccagactatgccttatattcccatttactcctgttcttctgtttagtctttttggaaaaaactcaattttagataagctatggcctgccatttgtgagtaaaacattctttctcatttctctctctctcttttttttttttgagacggagtcttgctctgtcgcccaggctagggtgcagtggtgtgatctcggctcactgcaacctctgcctcctaggttcaagcgattctcctgtctcagcctcctgagtagctgggattacaggcgcacgctgccatgcctggctaattttttgtgttttagtagagatggggtttcaccatcttgctcaggctggtctcgaactcctgagcacaggcagtccacctgcctcggcctcccaaagtgttaggattacaggcgtgagccaccacgcccagccccatttctcctttttaaaaagttttatttctatgcgtcaataacttttttaaaggcattacattttatttctttaacagagtgtgaccaaacatatttgtttttattttttatttttttattttttggagatggagttttgctctgtcacctgggctggagtgcagtggcactatacagctcattgcagcctcaatctgttgggctcaagtgatcctcctgccttagccccctgagtagctgggactacaggttgtatcaccactcttgactcatttttgaattttttttgtaaagatggggtttcaccatgttgcccagcttggtctcaaactcctgggctcaagcaatttgtccacctttgtctgccaacatggtgggactacaggcatgagccactgtgcccagcccatatttgttaatttaaggacattattatgtctctttataacatggtggtaacatcctcccttggtgagagcacatagaacatgtttggaactaactgctttagaaagttttatctcattacaccctcctaacaagcatgtgagggagtatgttattatccaaagtatagatatgagaattttgtgtgtcagagaggaagtacctgagtgatgccccatttcagaattttagtgtctcgaggctccatgcaagaccaccttctgccttcacatcacatattattaagcctggaaggcagtcttcactgaagccaatgatgaacaactgatgaagggaacccagggctgggaaataagttaccagtaaatgtcatggcattgaccactatgaagtcccttgtatcatattattccccttttaggcatctttaggcttgtctcctatgtgctgtttttttaagaagttctctgcttacaaagtcttgcgtggatgtatttaatacttttgtttggaatacaggtacacttttcacacgtgatacctggttttcatgtgtaatccaaaaataagagacaatgggaaagttatgttccatatgctgtcctttcttgaggaccagctcacgtgacttgtgataagctctcccaccttctctgaaccttagcagtgcctctcaggaatatgctaactaagataaatggagagaaaggaacatgggtagcagccccttaaaatctagaggttttatgattctaacatcataatgaagcagactggggaatagaactcattattgtagaattgaatgtaggaggattaagagatacaggttgggccgggcgcggtggctcacgccagtaatcccagcattttgggaggccgaggcgggtggatcacgaggtcaggagatagagaccatcctggttaacatggtgaaaccccgtctctactaaaagtacaaaaaatcagccgggcgtgttggctggcacctgtagtcccagctactggggaggctgaggcaggagaatggtgtgaacccgggaggcggagcttgcagtgagcagagatcacgccactgcactccagcctgggtgacagagcaagactccgtctcagaaaaaaaaaaaaaaaaaaaaagagagatacaggatggacggactcactaatctctttagtacccttccctgtacaggaatttcgtgtattaatatttctgaaactgctttgagagccaatcaagaaccttagactggtcattcctgtcttatcagatccaaatgcagagaacttggaggaggttcacctttcaaggtttttgtttttgttttttaagatagtctatttacccatatttttattcttattctttttaaaatttctaatgtttcagcatttctccttttatcatttttatcctaataacttcttttggccattctttcaaggtaagtctactggtgacaaatttttagtgtcctttatctgagagcatcttgatgtcacctttatttctgaagaatattttcactgggaatagaattctggattggtagttctttttcttttagcatttggaaaagattgtgctactttctttaggtgtccatggtttctgatgagaaattcactgtcatttgaatcatttcctttataggtaatattacatttctctctaaccagtttcaagatttttgttttctttagttttaagtttattatggtatgtagtggcatgtgtttctttaagtttattctgtttgaggttttctcagcttcttcagcctgtgggcttatgtttttcaacaaatgtgggaagttcagcaattatttactcaaatgcattttagccccccaccctttctcctctttttctaggactctgattatacaaattttctgtcttttattgtctcacaggttcttggggctctgtttatcagggtgtttttttttgtaatgatggttgttcaaatgggttattttctattttttcatcttcagattcattagtgctttcctgtcatatttattctatcattcagtccacctaatgagttttaacatttttgattactgtttttctgttataaaatttccaattgattcttttttatatcttctgtcttctgtttctttgctttctattttaaaaatttaagtgtgtttgtaattgctctatgcagcatttttatgatggccgttttaaaatccttctcagataatcacaacatctgttctatttggtgtccggtggttgtctttttctcagtcaagttgagattattctggttcttgatataaagtgattttttattgtaccctaaacatttgggttattatgttgtgagactatgaatcctttttaatatatatatatatatatattttttgtaggcagccaccctgtttaggtatagtatgcagttccagatggggttagatatgtagttccccactgggctctgctgacatcaccccagcaaaagtggaatgcccagttgtactgccttacttctccttgctgctgacagatgggagtgtaaattcagcactttattgagttcttttgacaccgggagaccaggaggagcaaagtgttagctataactgtttcaccaccaccttattccaccttcttgtgccttgttgctacctggtgagagtggaagttttactccccagtgggtcctgccaacaccgtggggagtgggcaatgaaaaactgaatgctgactcgtactacttcacactgctttgtttcactttttttggctgctgggtgggagtggaagtaagccctgttctgagtcccactgacagtatcccagactgtagagtgacagctagtgctgtttctcactgctgtcttctgcctctgttgatgggtggaagtagaagttcagttccctgtttggcttcatggataccatgctagtggaggaagcaaagggatgacttcccatgacttgttgctgctgggtagggctgaaagtccagctcctcactcagcactactaatactacggatgggatagggggcagtttttcgtttggtgtgtgactggaatagggtatattacctattacagttttctgttctgctaggccaccctcttcccagtcctgtggctacaggaagcaggcttttcttggagcttttgtgtgtgtgtgtgtgtgtgtgtgtgtgcctgtgtctgttggcatttctgggtggcagacttctcaaggaccccatcagagatataggggggcaaaaagaaagcccagggaactcaccattatattgttcctcaagtggcaaggtcctagctacttcaccttcttctttccatcttttagggttttcctgtgttgtattatagctagagttgtttgttttttttaagaggaaaggttgatgtgaaatgtgactactccttggctggaaccccttgcatgctcttgtaccttgggagctgaatgctgttgcactgcattactttaattgagcccttggtgctttcttttggttctttgacctcctcacagccacctcattctcacattcctctcaacaattattttaaaccttttcatcaattctccacttaaatcctatcctcattcttctcagatgatcttacttcttattttactgaaaaacttgagatcatgttatgtgcttttcatcaaatttgagcacttacaaattacagtcatccctcagtatacacagggaattggtttcgggacccccacatatgccaaaatctgcgcaaagtcccactgtgagtattgtggaacctgctaatacgaaaagtggaccttttatatatgcaggctttatgtcttattaatagtgtatttttccatccatgtttggttgaaaaaaatctgcatgttagtgggccaacacagttcaaatctacattgttcaagggactacattatctgtttacccagtcttctatctttgcctcctatttcagagaattaaagtgctccttccccagtgcaagtaattcagtaccgtaacatacaatatggggttgtaaccttggagcggtaggctacatgtatagcctaggtgtgtggtaggatatatcatctaggtttgtgtaagtacatttgttatgatgttcacacaaggatgaaattgcctcatgatgcatttctgagaatatattcctgttatgtattcctgctgttaaacagcacgactgttgttttgtcagttactgagagttgaagtccctggctataattgtagacttgcctatttctcctttcaactctatcttgtggtttaaggtcatcttgtataatatgtacatatttaggattgttatgtcctcttagtagattgatacttttatcattatgtaatatccttctttttctgtagtaattttctttgctctaatgtctactttgtctgatattacagccattcttgtgtttcaacattaatgtttgcatggtatatcttctgccatccgtttactccaaaggtacctacattgttgaatttggagtaagtttcttgtaaataacatatagttgcattgttttttatttactcttgctgatctctgtcttttaattggggtttttaggccatttacatttagggtaattattgatattttagggcttaaatctaccattgtattactggttttgtttgtttcttgtttctttttctttttttcccttcctgtgcattacttgaaaaaattttctaccattgtattactggttttgtttgtttcttgtttctttttctttttttcccttcctgtgcattacttgaaaaaattttaagagtccatctttttatatatatatatatataatatatataatagatataaaatatataaattatatatataaaaatatataatatatataaaatagatattatatataaaatagatatatataaaatagatatatataaaatagatatatataaaatagatatatataatatataatatataaatatatattatatataaatatataaatatgtatatatatttgtatataaatatgtataaatatatatttgtatataaatatgtataaatatatattatatataaatatgtataatatatatttatatataaatatacataaaatatatgtatatatgtgtgtgtgtatatacacacacacacacacacacacctacatgatgtcttattttttttaaacaacacctgtactccagataaatatggtcaaaataaatgaaaaactcaagatgacattattcccatttgtctaaaggccgggtgttgtgtagatgataagcacctgccatttatgatgacaggtgatagatccaaagtaattgccagatttgttaatttttttccatttctaaatcatccataaagaaaatcacatatagggtcacatcatccttacagtagtttagcagagcaactgtgccatctagattgatgttttcaccagtaaaggactggtagtttttgaaattagcaagtatgtgcttgatttgttctgcagcttctgccataaaaggttttactctttctggtcttcattcttcaagtttgcctttgattgatttaatgtaatctttcatatacatcttgtaggcttcttttatgaagccagcttgctgcaagtgatggttcatgacaatatcaataccagtgattactgtgctttcagtaccttcacccttgggtccttcagtagaggcatttccaccaatgagcaagtcatcaatattaccctatgtcttactgaccatcttcctctccccctccaggcacagcctgtttgcagtatctcagatcttgtaattgtcagagataatcatgatggtggctggaggtagatgatagcagtgctcgcttatagcagaagcctggagcttggagcaagtatggtgcagttggaaaggcactccagggaataggaagcatccagaaaagtatattgtgtttttgagtgtattgcctcttacagttttcctagtggttggtttgggtattacaatatacatatgtggcttattacattctagtgatgtcagcatttcaccattttgagtgaagtatagaaacctcacttcctttgaggttcctttattctccccacttttaaatatcattgtcttgagtatcagatggtggtgtaattttggtttggatcatcatatatgattagaaaactcatgatgagaaggatagtctgtggtattagtcatatttctgtttttttccattgttatttcttccttcctgatgctccaagactcctttaaaaaattattttctttttgtttgaagtacttcctttagccactctttaagattgtgtctagtgacaaattcctttcgttttcccttatttgagaacatcttgatttcactttcattactgatggatagttttactggacatagaatttgtggtggttgagagttattttcttttaaaagttgaaaaatgtgctacttccttcggtctccataatttcatatgataaacgtttatcatacaaggtagtatttcttataggtagtgttttatttctctgtggttgctttcaagattttttctttgtctttagttttcccaaacatcttttttcattcctttcctttttttttttttttttaagatttttttctatttggggtttgcacatcttctttaatcttcttcaaaatttgggaacttttcaaccattattttcttaaacttttttttattaaatttctctagatttagggagaacaagtgcagttttgttacacaggtatattgtttaatggtgaagtctgggcttttagtgtaattttgaacagtgtacattgtactcattaagtaatttctcataccccacccctttcccaccctcccaccttttcgaatcttcagtgacttttattcgacattctgtgtccatatgcacattttatttagctcctacttataagtgagaaaatgcagtattgggctttctgattttgagttgtttcacttaagataatggcttccgattccatccatgttgctgcaaaagatatgattttattcttttttattgctgaatattctgttgtatgcatgtgtgtgtacatatgtatgtatgtgtatatgtgtactcacacacatacatacacaccaccgtttctttactcactcatctgtagtcactattttaaaatactcctttagccccattatttttttccttttcttctgagactctgaaagttggatcttttgttattgtctcacaggtccttgaggctctctgttcttttttttttttttttttttgtctgttttctctctgatcaggctgagcagattgtattgatctgttctgaagttcactgattttgtcttctgtcatttctgtcatttcaatttatcccatccagttttaagatttcggttattgtactttgtagttctgtaactttcatgtgattctttttaataacttttttctttgctgaaatttctttttatttaccttagagaaattataattgtttgttgaagcattttatgaccattgcttgaaagttcttgtcagataattatgtgattcattgtggtgttgattgcagtttctcgttgaagttgtggttttcctggtactttgtatgacaagtgatttttaattttatcttggacattttggatactattttaatagattctgggtcctactgaaaattttattttagcaggcagtcaccttgtttaggtttaaacagaggtcctggactactttttgaactgtggttttaacgacaatctaattttcagaaacttttcagttatattttgatctgcttgagttgttgcgtgctgctgggcctccagtggtccctgctgatggtgtttgagggaatgaaaggaacttttcaaggctgaactgcctggtgcttctaagtatgggaatggagaccctggtctatgggatgaagcttcttgagctgggtgctagttgtggcaggatctctcctttcctatgaccgatgcagaatacctccagaaccatcccttgttatggtgggatccccctacttatgggtgtcagagtgtatttactggaccagctgcttgtggtgtggttttcctttgttggtgcctgtggcctcgttggtgtctcaggtggtgctgctgctgaggatggtgaatgcttcccctggctgcttattgacagggaggtttccagttgaaccttcttgctgtttcttctggcctcacatggtggtgttgatggcaatcctattaaattcaagagaagaatgaatctacctgggctgctttctgttgcaggcttaggagttgggaaacatcagatctggctcacttatttttttttttttttcagttgggagggttataagacaacctgttactatgttgttcctctagtcctggggtcttcaactagtttttcttccttttttaaacctttcagtgttttcctttggttatattttatggtattttcaggttttataattgtacttaatggagaggaacaggaagagaccaaaagcccttttgctcattttttaattgcaatgggtggaacttatttggatctggatttaaataaactaaaaaagtaaactaatttgatatgagattactcaaattttgaaagctaggtattttgtataaaagtatttttcctataatgatatgattgtgtaaaaataaaagactgtctcttagagatatgtactaagatatttataggtgaaattatgaaatacataggatttgcctcaaagataatatatatgcgtttgttcatagggtaagagtggtcattggctgatggttgttagggctaggggatgaatatgtgggactcagaatacctttgtgtatgtaaaaaattctccatgtttttaaattaaatttaattaatttattttttgcatccccctgatttctgaagtttttttttaagtttagcttatatttcttgaacaaagtttagatattatggtagaaagaaacttgcctgatttattttctttgtacctaatttttgagtattggtgaggctaacataatataggctaccaagttctaacacgttttcttataaggtgaggaaatattaaagtgtttatagtgtgtacatcccctctgatcggtactttaggagccccaggaaccatttggttgcttgtaattagaatgaaagtgcttttaccctgtaagagagttaatgtgctttctttaagtaagctcttttctagtcaccaggatctgaagttccagagttgactcttctatagattggcgtattaatacattggacatttattcattcttactttctttcacagctttctgttcaaaatcaggagtttgagataaataaagatggaatccccaaagtggatcagtttcatctggtatgtgacctttttgacatttactggtttgaaacacatgcagtaatataaacttagatatctgactgaaagttgtcctccagtttttctaagaatccaaattaacatttgcaataaatgaagtattgaaaaaaattcaggtgccctacttaacaccacttaattaatacaccagggttactctgctgggttgtttgtcacacagattatataaataatctaacaattagggaagaatattgtttactatgtgtttcaagatcatattatagtaaaataatgttttattataacttagttttttgtaagtacctaactatatctttgtcattcacatatgtattcagccaacatattttgagtagctatttctgtgataggaattgaaccaggtgctaggattacaaggattgtggcattgagaatgaaatgaataatttagaaatgtgaacaagtaagtgattaacatctataagttgagtaattagcaagtactttgggggtactccatttaccctgatttgattattacacatcatatgcttgtattaaaatatctcatgtacttcataagtatgcccataaagatttaaaaataatgaagcccctaaaaaaagtacttggggggaagctgatttttagttctgcaaagaaagggggaattcagtatgactagatataaagaggataaatatggcagtaaatgagtctataagagtataatgatcagactctggaagttcttagctattttgagttaagattacaatgaaagagtacatataattttgttaaactcagtagttccttatttgaccacacaaatattgtataataccttctaatgtcccacgaaatcattttaaaaaaacataccttagaaatgatattaaggagctttgccacacttcttgggtagcagtaaaaagcatttcagacaacttttgtgagattataaaactttgtgttacacttcctgattatctctgtggaaggggataacaaagaaggttgactatggtttacagttttgaaaaggctatgataaaaatttattgctattagatagaaaaataccagaaattctgtattagaggttacaacttcaccaaaagtgcacatccagaacccttgctttcaggtttgatagaaaaattaccttgtaccaagttatcctgaaatttagtttaaacttaaaacttatattacagtttcgtgagtcaggaatctggacacagcttatttgggatttctgcttcagttaatttaaggttgcagttaagatgttggctgggctacagtcatcttaaagctcgattggagatgaatatgcctctaacctcacatgtttgttcataggattctgtttctttcagtttattagaatgaggacctcagttgttctctagttgttggccagaggttgccctcaatcctttgccctgtttccatcatggcagcgtgtttcattgaaatgtatacgcagagaaggcagtagactctgttcactaagacagaagtcacagtttttcatagcaaaatcatataagtgatatcccatagtttttgatagtattctctctaaagcaattctctaggtccaagaggaaagaattatgtaaagttatgaataacagaaggttggggtcttggggcaatcttagaagtctgcttactctaaaatgtaatctggccaggcatggtggctcacgcctgtaatcccagcactttgggaggccgaggtgggcagatcaactgaggtcagaagttcaggaccagcctgcccaacatggtgaaaccctgtctgtactaaaaatacaaaaaaattagctggatgtgctggcgggtgcctgtagtcccagctacttgggaatctgaggcaggagaatcacttgaacctgggaggcagaggttgcagtgagccgagattgtgccattgcactccagcctgggcgacagaacaagactttgtctcaaaaaaaaaaaaataataataataatctgcctgtaatctgcaagtaatcatgccttgctaggcatgcagctaggtatatgtataatgaaagtaaatgtaaatacacagtccccgtttaatgtgggtagctactcatggattcaaggattgtggcattgaaaatgagattaataatttagaaatttgaacaagtaagcaagatttataaattgagtaataagcaagttcaaattataaaaatcttggcttgtatagtatttgcttctgtgatctgagtcagttattagtgctgggaatggaattacctttacctacattttgtgttcacacatagctgcaaaacaagtcaaggctctgtagtcagcaccttacagataccataccacaaatggagaagaatataaatgtatggaaccatgtagttgagagagttattagaggataattaatacacccttctcatccttcagaatccctccaataatatccccaagagatggccttcagcctctgcttaagtagagtaatgctgattttggtagtttgtgtctaaaagttggtccattccatttaagttatctagcttgttggcatacagttgtacatattttctttataattatttttatttctctaagttcagtagtgtcccctttttcatttcagattctggcagtttcagtcttctctcttttttttcttcgttagtccaaataagtttaaatacctagcttttggttttattaatttttctgtattgtttttctgttgtctattttcttactttctaatctttattatttctatccttctgcttgctttagatttagtttacaacatatattacacagttatcacaccttataaaattaacaaattgtaatattatatttaaatttccctaattgtcttaaatatatttttaaatggttgcttttttgaaattagcatatcaacaagatctacctgtattgggttaatatatctcttaatctctgttgagctataaagttcccccacaactctttttctccatgccatgtattatgtgaaaaaaatgatttcattttccatactttggagttggctgattgcatccttatggtattatttcatagttctcttttccccagttgaaaaaagtggtagatacagaggttaattaaatttacattcagtttttacaggcagtatattttatattattgtgtcatatgagggggatcatttggtgtttgattgtcacagtaagattgatcagtgtgttcaggcagaaaattttgtatgtacaggggtatatttttagtttttctatcccattggtttgtttattcatatcccagtgcctcactcatttaactaaaatagactttatagtagctttttaatacttatagggctagttccttcttcactgcttttttgttttgttaaaaaaaaaaacaacaaaaagcaacaaaaaaataaagtccgaagtcccaggttggagtgcagtggcacgatctcagctcactgcagcctctgcctcccaggttcaagtgattctcgtgcctcagcctcccgagtagctggtactacagtcacatgccaccacacctggctaatttttgtatttttagtagagatggggttttgccattttggccaggttggtcttgaactcttgacctcaagtgatccacctgcctcagcctcccaaagttctgggattacaggtgtgagccactgctggccctcattgctatttttaaaatcagctttcatggctattcttggttgtcattcttctaagacatctttataattaacttgtttggtctcaaggaaaaaaattatatttttattggattaatataaactttttaagtcaacttagggaaaattgtcccatttgttatgagagtcatttttgttgaagaccataataagacttttgttcctgatctacttttgtggttttcaggagcatgtgttattttttctcatttggattttgtaatatttaattgtttgcacctagggaaggtaactatctttaaatgttcttaaaaacatattctgtagagtacagacattggcattcattcatttatcaaatatttactgaatgtctgctatattcagatactgttttttgctactttctggagatgaagtgacaaactaaaatttcaaatcttaaggatcttagagtgtaatgcagacactagcagtaaacagatgatttctttcctttttttttttttttgagacagtcttgcttggttgccaaggctgaagtgcaggggcacgatctcagccactgcaacctctgcctcccaggttcaagcgattctcctgcctcagcagcttgagtagctgggattactggcatgcgccaccatgcccagctaatttttgtatttttggttgagacagagttttgccatgttggccaggctgatcttaaactcctggcctcaatgatccacttgccttggcctcccaaagtgcctgcctgaccagcagttaaacagattatttttattcagtctgatatgtgctttggttggagtaatcataagaggcaaataaaaggtatactaaggtgtcaaataatggaatagcaacattacaggatcatttacatgttctaatacaaataatgtcctttgaaatggagggatataataaattctagctcccataatgatggtgataatgatagcagcagtagaggtgatcctagagagtgatcacttaaaaaccaaaaccagaaatagttgactagatgaagaaatttacccttccagacagagaagcttcagtgtgacattttaatagtgtcaaattctgaccagtaccttgttaaaagagggagaaggaagtaataaaatttatttgttcgtatttcacttgtttttgagagatttcagctatgatttttttccttttacactttttccccataattcaattccattgtttcagtattggaggcattccatttcaccaaaaagtacagtcgtccctctgtatacacaggggattggtacagataaaatctacgcatacccaagtcctacagttggcccagtggaacctatgcatatgaaaaatcagccctttgtatctgtgggtgttgagtcctgagaatactgtgtttttgatctgtttggttgcagatgtggaaactgcagatagggagtgctgactgtacttacttatttcatattgatacataatatttgtacatatttatggggtatatgtgatattttgtaacttgtatggaatgtgttaatgacagtcggtatttagggtatccattatcttatttattatttctatgttttgggaacatatcaagtcctctcttctggctattttgaaatatttaatacattgttaactggagtcatcctactctgctatcaatcactagtacttatttcttctgtcaacctggttgtttgtacccattaaacaactctcttcacccccttccacctcacccacattctcttagtctctggtatctgtcattcaactctacctctatgagatcaactgttatagctccgacatatgagtgagaacatttgatatttgtctttctgtgcctggcttatttcactttacagaatgactgttccatccttgttgctgaaaatgacagaatttaattccttttttatggttgaacagtattccacattttctttatatttctttaatagtgttccacattgtctttttccatttgtccattgatggacgcttaggttggagtccttacctttgtaattgtgaatagtgctgcagtaaacatgggggtgcaggtttcatatactgatttcctttttattttgatgaatatcaaatattttgacacttaggttgagtccttacctttgtaattgtgaatagtgctgcaataaacatggggatgcaggtttcatatactgatttcctttttattttgataactatcaagtagtgggattactggattgtatgatagttccatttttagttttttggaaaatatttgtactattttccatagtggctatactaatttacatttccactaacaatgtataacagtttcctgttctccacatctttgtggagatttttcaaaatagtatttggctattttttgtcattttttaaaatagtggcattctagctgatgtaaaatgatacttcattgtggttttgatttgcatttctctgatgattagtgatgttgagcatttttcatatacttattggtcatttgtatgccttcttttgagaaatgtctatttatgtcctttgcccactttttaatggaattgttttccctgtcgagtttcttgtatattctggatattagtcctgtgttggatgaatagtttgcaaatttttccttcaattcaacaaattgtctcttacactctgttgattatttcctttgctgtgcagaagcattttagttaagtatagtcccatttgtctctttttgtttttgttgcctgtgcttttgaggtcttagccataaaaatctttgcctaggccaatgtcatgaagtgtttcccttatgttttcttctagtatttttatagtcttgggttttacatttaagtctttaatcaatcttgaattgatttttatatatggtgagaggtgagggtctactcttactcttttgcgtatggctatccagttttcccagcaccatttattgaagtgggtgtcttttccccagtatatgttcttggtgcctttgtgggaaattggttggctgtttatttctggggtttcaattctattctataggtgcatatatctatttctatactaataaaacgctgtgttggttactatagccttgtaagatattttgaagtcagtgtgatgcctccacctttgttctttttgctgataactgttttgactatttgtgctcttttttagttctacatgaaatttaggatttttttctatttatgtgaaaaattacattgctattttgatagggattgctttgaatctgtagatttctttgggtagtatgggcattttaacaatactaatcttctgatccaggagcatggagtgtctttccatttgttagtgtccttttcagtttctttcatcagtgttttgtagctttctttgtagatatcttccacctctctgtttaaatttcttcctaggtaatatatttattttgtagctgttgtaaatgggattactttcttgatgtctttcttagctagttcattattggtttatagaaatgctactgatttttacatgttgattctatatcctgcgatttactatattaatcagatctaaaagctttttggtggagtctttaggtttttctagatagaagattatgtcatctgcaaagagggacagtttgactttttctttttctttttttattattattatactttaagttttaggatacatgtgcacaacgtgcaggtttgttacatatgtacacatgtgccatgttggtgtgctgcacccattaactcgtcatttagcattaggtgtatctcctaatgctgtccctcccaccaccccacaacagtccccggtatgtgatgttccccttcctgtgtccatgtgttctcattgttcagttcccacctgtgagtgagaatatgtggtgttcggttttttgtccttgcgatagtttgctgagaatgatggtttccagcttcatccatgtccctacaaaggacatgaactcatccttttttatggctgcatagtattccatggtgtatatgtgccacattttcttaatccagcctatcattgttggacatttgggttggtttcaagtctttgctattgtgaatagtgccgcaataaacgtatgtgtgcatgtgtctttatagcagcatgatttataatcatttgggtatatacccagtaatgggatggctgggtcaaatggtatttctagttctagatccctgaggaattgccacaccgacttccacaatggttgaactagtttacagtcccaccaacagtgtaaaagtgttcctgtttctccacatcatctccagcacctgttgtttcctgactttttaatgatcaccattctaactggtgtgagatggtatctcattgtggttttgatttgcatttctctgatggccagtgatgatgagcattttttcatgtgttttttggctgcataaatgtcttcttttgagaagtgtctgttcatatccttcatccactttttgatggggttgtttgtttttttcttgtaaatttgtttgagttcattgtagattctggatattagccctttgtcagatgagtaggttgcaaaaattttctcccattttgtaggttgcttgttcactctgatggtggtttcttttgctgtgcagaagctctttagtttaattagatcccatttgtcaattttgacttttgttgccattgcttttggtgttttagacatgaagtccttgtccatgcctatgtcctgaatggtattgcctagttattcttctagggtttttatagttttaggtctaacatgtaagtctttaatccatcttgaattaatttttgtataaggtgtaaggaagggatccagtttcagctttctatatacggctagccagtggtcccagcaccatttattaaatagggaatcctttccccattgcttgtttttgtcaggtttgtcaaagatcaggtagttgtaggtgtgtggtattatttctgaggcctctgttctgttccattggtctatgtctctgttttggtaccagtatcatgctattttggttactgtagccttgtagtatagtttgaagtcaggtagcgtgatgcctccagctttgttcttttggcttaggattgacttggcaatgcgggctctttgttggttccatatgaactttaaagtagttttttccaattctgtgaagaaagtcattggtagctcgatggggatggcattgaatctataaattaccttgggcagtatggccattttctcgatattgattcttcctacccatgagcatggaatgttcttccatttctttgtatcctcttttacttcattgagcagtggtttgtagttctccttggagaggtccttcacatcccttgtaagttggattcttaggtattttattctctttgaagcaattgtgaatgggagttcactgatgatttgactctctgtttgtttgttattggtgtataagaatgcttgtgatttttgcacattgattttgtatcctgagactttgctgaagttgcttatcagcttaaggagattttgggctgagatgatggggttttctagatatacaatcatgtcatctgcaaacagggacaattggacttcctcttttcctaattgaatgccctttcttccttctcctgcctgattgccctggccagaacttccaacactatgttgaataggagtggtgagagagggcatccctgtcttgtgccagttttcaaagggaatgcttccagtttttgtacattcagtatgatattggctgtgggtttgtcatagatacctcttattattttaagatacatcccatcaatacctaatttattgagagtctttagcatgaagcgttgttgaattttgtcaaaggccttttctgcatctattgagataatcatgtggtttttgtctttggttctgtttatatgctggattacgtttattgattttcatatgttgaaccagccttgcatcccagggatgaagcccacttgatcatggtgggtaagctttttgatgtgttgctggattcggtttgccagtattttattgaggatttttgcatcaatgttcatcaagaatattggtctaaaattgtcttttttggttgtgtctctgcccggctttggtatcaggatgatgctggcctcataaaatgagttagggaggattccctctttttctattgattggaatagtttcagaaggaatggtaccagctcctccttttacctctggtagaatttagctgtgaatccatctggtcctggactttttttggttggtaagctgttaattattgcctcaatttcagagcctgttattggtctattcagagattcaacttcttcctggcttagtcttgggagtgtgtatgtgtcgaggaattcaaccatttcttctagattttctagtttatttgcgtagaggtgtttatagtattctctgatggtagtttgtatttctgtgggatcactggtgatatcccctttgtcattttttattgcatctatttgattcttctctcttttcttctttattagtcttgctagcagtttatcaattttgttgatcttttcaaaaaaccagctcctggattcattgattttttgaagggttttttgtgtctatatgtacttcagttctgctctaatcttagttatttcttgccttctgctagcttttgaaggtgtttgctcttgctcctctagttcttttaattgtgatgttagggtgtcaattttagatctttcctgctttctcttatgggcatttagtgctatacatttccctctacacactgctttgaatgtgtcccagagattctggtatgttgtgtctttgttctcgttggtttcaaagaacatctttatttctgccttcatttcgttatgtgctcagtagtcattcaggagcaggttgttcagtttccatgtagttgagtggttttgagtgagtttcttaatcctgagttctagttcattgcactgtggtctgagagacagtttgttataatttatgttcttttacatttgctgaggagagctttacttccaagtatgtggtcaattttggaataggtgtggtgtggtgctgaaaagaatgtatattctgttgatttggggtggagagttctgtagatgtctattaggtcctcttggtgcagagctgagttcaattcctggatatccttgttaactttctgtcttgttggtctgcctaatgttgacagtggggtgttaaagtctcccattattattgtgtgggagcctaagtctctttgtaggtcactcaggacttgctttatgaatctgggtcctcctgtattgggtgcatatatatttaggatagttagttcttcttgttgaattgatccctttaacattatgtaatggccttctttgtctcttttgatctttgttggtttaaagtctgttttatctgagactaggattgcaacccctgcctttttttgttttccatttgcttggcagatcttcctccatccctttattttgagcctatgtgtgtctctgcacgtgagatgggtttcctgaatacagcacactgatgggtcttgactctttatccagtttgccagtctgtgccttttaattgaagcatttagcccatttacatttaagattaatattgttatgtgtgaatttgatcctgtcattatgatgttagctggttattttgcttgttagttgatgcagtttcttcctagccttgatggtctttacaatttggcatgtttttgcagtggctggtacctgttgttccatgtttagtgcttccttcacgagctcttttagggcaggtctggtggtgacaaaatctctcagcatttgcttgtctgtaaagtattttatttctccttcatttatgaagcttagtttggctggatatgaaattctgggttgaaaattcttttctttaagaatgttgaatattggcccccactctcttctggcttgtagagtttctgctgagagattcactgttagtctgatgggcttccctttgtgggttacccgacctttctaaactctggctgccgttaacattttttccttcatttcaactttggtgaatctgacaattatgtgtcttggagttgctcttcttgaggagtatctttgtggcattctctgtatttcctgaatttgaatgttggcctgccttgctaggttggggaagttctcctggataatatgctgaagagtgttttccaacttggttccattctcttcgtcactttgaggtacaccaattagacgtagatttggtcttttcacgtagtcccatatttcttggaggctttgttcatttctttttattcttttttctctaaacttctcttcacacttcatttcattcatttcatcttccgtcactgataccctttcttccagttgatcgcgtcggttactgagtcttgtgcattcgtcatgtatttctcgtgccatggttttcagctccatgaggtcctttaaggacttctctgcattggttattctagttatccatttgtcttatttttttcaaagtttttaacttctttgccattggttcgaacttcctcctttagcttggagtagtttgatcttctgaagccttcctctctcaactcgtcaaagtcattctctgtccagctttgttcagttgctggtgaggagctgcgttcctttgtcggaggagaggctctgatttttagagtttccggtttttctgctctgttttttccccatctttgtggttttatctacctttggtctttgatgatggtgacgtacagatgggtttttggtgtggatgtcctttctgtttgttagttttccttctaacagtcaggaccctctgctgcaggtctgttgtagtttactggaggtccactccagaccctgtttgtctaggtatcagcagtggtggctgcagaacagtggatactggtgaaccacaaatgctgctgcctgatcgttcctctgggagttttgtctcagaggagtacccggctgtgtgaggtgtcagtccacccgtactggggggtgcctcccagttaggctactcgggagtcagggacccacttgaggaggcagtctgcctgttctcagatctccagctgtgtgctgggagaaccactactctcttcaaagctgtcagacagggacacttaagtctgcagaggttattgctgtcttttgtttgtctgtgccctgcccccagaggtggagcctacagaggcagggaggcctctttgagctgtggtgggctccacccagtttgagcttcccagccactttgtttacctactcaagcctgagcaatggcaggcacccctcccccagcctcgctgccgccttgcagtttgatctgagattgctgtgctagcaatgagcgaggctccttgggcgtaggaccttccgagccatgtgccggatataatctcctggtgtgccgtttgttaagcccattggaaaagcgcagtattagggtgggagtgacccgattttccaggtgccatctgtcgcccctttctttgactaggaaagggaattccctgaccccttgcgcttcccgggtgaggcgatgcctcgccctgcttcagctcacgcatggtgcgctgcacccactgtcctgcacccactgtccggcactccccagtgagatgaacccgttacctcagttggaaatgcagaaatcacccgtcttctgcgtcgctcacgctgggagctgtagactggagctgttcctattcggccatcttggctccaccccctgacttgttctttttcaatttggattccttttatttttcttgcctgattgttctgactaggacttccaggactgtgttgaagagaagtggtgaaagtggagatccttgtcttgttccagttctttagaggaatgtttttctttttctttctttttttttgtttttctttttttttgagatggagtttcgttcgtgttgcccagctggagtgcagtggcgtgatctcagcgcgctgcaacctccacctcctgggttcaagcagttctcttgcctcagccttgccaagtagctgggattacaggcgcccgccatgatgcccagcaaattttttttttttttgtattttttagtagagacgaggtttcactgtgttggtcaggctgatcttgaactcctgacctcacgtgatgtgcccacctcggcctcccaaagtgatgggattacaggcgtgagccactgtgtctcactagaggattgcttttcttttccccatttagtaatgatgttagctgtggctttgttacagataggctttattttgttgaggtgtgttacttatatacctagtttgttgagagcttttatcataaagggatgttttaatctatgaaatactttttctgtgtctattgagatcgtttgccatatggtttttgctctttgttcagttgatgtgatggatcatgtcgctgatttgggtgtgttgaaccatcctagcatccctgggataaatgctaattaatcatggtgtattatgtttttgatgtgctgttggattcggattggtagtattttgttgaaaaattttgcatctgtgttcatcagggatactggtctatagttttttgttgttgttgtgtccttgtctggttttggtatcaaggtaatggtgggctgggccttgtagaacaagttagggagaattctcgcctcttgaacctttgcagtagtttgaggataattgatgttagttctttgaaagttcagtagaattcagcagtgaagctctgtggtcctggacttttctatgttgggagactttctcttactgaccaaatcccgttacttgttactggtctgttcatgttttctatttcttactgattcaaacctggtaggttgtatgtgtccaggaatttatatatttcctctaggttttccagttgttcatgtatagttattcataatagtctttatgttttgtatttttttgtttgtttgttttgagacagagtctccctctgttgcccaggctggagtacagtggtgcaatcttggctcactgcaagctccgcctcccgggttcatgccattctcctgcctcagccttccacgtagctgggactacaggcgcccgccacaacgcctagctaattttatgttttgtatttttgtgatatcaggcatagtgtcttctttttcatttctgattgtgtttattgcagcttttttaaagttttagtacagctagcagtttattgattttgtttatcttttaaaaaaattttttttgtggatcctttgtattttttttagtgtatttcacttagttctgctcccatcgttattcttcgttttctactaatatgtatcaggttgtttatttgtaatcttactccttttttgatagaagaatttattgctataaacttctcttttctcactgcttttgctatatctcatcagttttgttatgttgctttgattttcaattgttctaagacattttcttattccctctttaacttcttccttgaaccagtgattgctcgaagacattttctaattccctctttaatttcttccttgacccagtggtcattcagcagcacgttgtttaatttccatgttgtgtgtgtgtgtgtgtgtgtgtgtgtgtgtgtgtgttgtttttgagctgggggtctcactctgttgcccaggctggagtgcagtggtgtgatctcatctcactgcaacttctgcctcatgggtacaagcaattctcctgcctcagcctcttgagtagctgagattataggtgtctgccaccacactcatctaatgtttgtatttttagtagagacgaggtttcaccatgtcagccaggctggtctcaaactcctgaccttaagtgatccacctgcctccacctcccaaagagctgggattataggcatgagccaccgtgcctggccaatttccatgcgtttgtatagttttcagtttctcttgttgatttttagttttccattgtggtctgagatgatactggatatgattttaattttaaaacattttttgagctttgttttgtggcttaagatatggtcgtttcctatagaatgttccatatgcttatgagaagtatgtgtattctgttgctgttgggtaaagtgttctgtaaatatctgttaggttaatttggtttttaagtgcagtgtaaaatcagtttttttaaaattaattttctctctagattatctgtctagtggtgagagttgggtggagtctgtttctccctttagatctaataatatttgatttatatatctgggtgctctgttgttggatccatgtatatgtttagaattgttacattctcttgctgaattgatccctttattattatataatgaccttctttgtcactttttgctctttttgacttaaagtctgtcttacctgatacaagtatagttacacctgcttgcttttggtttccttttgtatggaacatcttttcccatctttttgcagcatacaattgggtcatttaaaaaaaagaaaaactcctttcaaccagtctatatcttttaggtggaaagtttaactggtttacattcaaggctgtcattgatacatgcatgagggttaatttctgtcattgtattaattgattctggttgttttgtgtatcttttgtttcttattttctctcttattcattgtggtttggtggttttctgtcgtggtaacacttgaattatttcttttatttgtgtgtttgttttaccagtggagtttatatgtgttttgtaatggtagatattgttctttcacttccaagtatacaactctcttagtagagacggggtttcactgtgttggccaggctagtcttgaactcctgaccgcaggtgacctcaggtgattccccccaccacggcctcccaaagtgctgggattacaggcataagccactgtgcccagccagatgatctatttgcagtgtgattatcggctcattattttggtgtttttttttgttgaggggagtaccagatacctcgtcagtcatcttgaaacccctccttcctgactgtatttattgaaaaaataagtccacttccttcttcattacagatttgtccttttgttcctttgttttgtaacacctgtttttccttgcaggatgataaagtcaaatccctcctctgtagcttgatatgttatagaagttcaatgactgctgaacaagttttaaatgctgaatgtttcttgatgccaaaggagcaatcagttccaaacccagaaaaagatactgaatacaccctatataaaaaggaagaagaaataaagacggagaacttggataaatgtatggagaagacaagaaatggtgaagccaactttgattgttaaattattattgttgttgttgcagaggttctttttaaaaactttggtttggttaatacacagaaatatctagaaatgttctgggactagttgagttgtatctttagtattcaggttgtgaaaaataaagatgtttggctatgcacaa

SEQ ID NO: 2353 - DNA, 122187 bp, Homo sapiens; identical to SEQ ID NO: 2352

SEQ ID NO: 2354 - DNA, 122346 bp, Homo sapiens; identical to SEQ ID NO: 2350

SEQ ID NO: 2355 - DNA, 522925 bp, Homo sapiens
tgtgtgtgtgtgcgagggtgtgtgtgtgtgtttgtgtgtgtgtgcatatgtggggggtgtgagtgtgtgtgtgcgaggaagcgggggtgcgtgcgcgtgtgagtgcgtgtgtgagtgtctgtgtgtgtgtctgtgtgtgtgtgtgagtgagtgaattccagattttctgtctttccaaaacccgctcctgtcctctcgcatatcactcacagacggggatctgacagcagccacaaacctacagtgagtgatcgctctccccccggcacgaatccgccatagagatcggcgaggaggaggaggaggaggaggaagaaaagaaggaggaggtggaggaggaggtggaggaggaggaggaggagggaaagaggagaaggaagaagaagaaaaagaagaaacccactaccttcccaggattgccttttttttttccttatctttacgcgcgagtgtgcctgtggcgcgtgtgcgcccctcgtcccttccatccgaacccgggcttggatgtttaataaagaaatcaagtgtctcaacagtcaccaaaaaaaaaaaaaaccgcaaaaacaaaaccaaaaaaattccaaaagcaaaaacaaaaaagagagaggaaaaaaaattcaaaataaacaaacaaacaaacaaggcagaaccaacctctacttcaaagcagccggcacaagccacccgtgtctgccacccagagaggggggtctctggcccgtggtggaggagttgcaggggggatcgtcagggggacagaggccgagtgacgtcctaggagccaccgggcaagaggcggaggagacccagagaggccagagagacagcgggccccagcgcgcggctcggggctggggcgccagaagtgggactggagcgaagtagaggatgccgaggagaaaacagcaggcacccaagcgggcggcaggtaagagaaacggctccgcttcggggctgccctgtgcgccgagctcctcgcccgccctccttgcccctgggtgcccgggggcaccacccacttaagctttcgggggagtttgcgccgggtgcccttctaataaccccgtcctctctcgccttctctggtctcccaaatcctccccttccaagctccggttgggttggggtgagctatcccaccaagcctttcctccttaaactttctttcctccaccctctaccccacccctaactttcttccagtctgtttcttgcctctcgggccaaagtcggattgaggatttggggtgcggagtagggagacagcccctccacccctgcatccctctgcgtggtcagtgccagtggcttttggcctccagggatagcgtctcctctcactggggcttggggcgctgaagtgtgaggcatacctaacactcgggctgcaggcaggctttggggccagcaataggagtttagcgttgatcaccaaggtggacaaaatgcccccaggaaatggatgactctttgcatatattttctaaaaggatccatatttggaaatgtaattaacaatttccctattctttaaaaaaaccaaaaagggttgtaggggggaaattccccatagaaatttaaacagctctggattttctttgcctagagagttgcaaactttgtgaaatgattcgtactgtaaaaactatcccatctgaatccttactgccccctaaaaaagataagaacaggttaatggatcagtacaatagaccttctaaagtttttttttcttttgggttgcttaattgcttttttaatagtatgctggggttttgtttctcggaaatgtaatatgaaagttcatttttcttctgccagacccacccactgaaaaatcagctttccacttgattgctagttttgatttgacatttgattgatcacctgtcatctcgctgcctttgatctattcattcttgatatatatcaataaatcactcaccatggtaactcagagtgccagtgacgcaaaccttgccctctatattcagagccagacatgcacaattattatcttgtttggcttttaatgtgggcgtttttatttctttgtgtcctttagttgaatcagggctttcgcaaaaagcttaagtttagttgttttttcctctctctctgtctttaccctcttgatttaggcaacattaggtaagactggtcttctgcagacccacctccacatttcattctgttccaactctagcaaaacatagggagaagtttggtggaacactttcataaactttgcaaagtcacccttagaacaaatccaaagttagttaggaatctgaggagagtgggcatcccttgtctgaatgtgttgaaccaccaagctcatcctccttcctcgcctgagtgtttcaaaatatccacaattatcattccttctgagcacagaattgcttccctatttgtaagttggttcaagtggcatgcagaaatattgataaagcgtggattcatatattttctgatcgtttccctaaaagcaaaataattaaaatatttttagtgaggtacgtatttggaacttgcctcatcagtgaggttttcttttttcaactctagttacttctttggaaaacaatgtctctttcctaccgttgtctctttctgcatttaactcactgatttcctaaaacttaggctgctttgcaatctgacagcgtgtggatgtgttcaatggcctttgagacccaggaacagtgagcctgctgcatctagttctggcaacataagtttaagtgtagctacattattagagataacgtccttattgttgtcccgaaagagaaccctgggctacggtccagcaagaagtgatactgccctgaaaattactctttttttttttctggttgttccggtaaagactatcaacaactaggcagtaatttaaattaccagaatgactggacatgtctcctttagtaagctcattacaaaaagtgcattgctcagaattgctcgactttgattataattatcctacgatcgataaggatccaggtgtacgtaacataacactgtatcacattatttaaatcaggtccttttcattaagctgtgtctgttggtgctggctagtttattggtgtgtgtgggtgtgtgggggtgtgtgtgtgtgtgtgttagaaacttgtaactatagtttcagttttctggcctattatattcctactgtctttgtatgtttgttttgtatgattcttattattttcaccagaagcggaaaccctttttaagctgaaaaaggatgattcatttcgtacacagtgagggccctcttaccttatttatttgctcacatattaatagaggagacagtttttcatgcagtgtttcttctgttcatctaaggtcatcaatgccctactctatttcagctgaagtggttattcacaagtaaagttagccactttggggttctgtagtcagttaacatccagggaaggggagaaggtgggttctaagattatggccatactaacttttatcactgcttaaaattaaacacaatgcacaactgtaagtaattacacccaaggactgatgttgaaagcttgatttctagcttgattaatgaataatgggagatagaaaaagcctgtgagtggatccgagctgaggctctcccggagcgctctttttcccaagaactgttccaggcaatttgattcctttgtattattagttataagttccatgtttcaaggaatcaattacagaactttctactaaagcaggtatctaaacagaataaacaagatgatattgtaagtgatgaggaattttagtctttatttgttatgttcctcccccttcagggggaagggatgtgaggggacaattctctttaaggaaacagctaaatcagagtatttccctctgaaatgtcattcttcctggctttcttaagctatgctattccaccatactattacttagggcaagaaaaaaaaagttgagaaagcagcctacagtaccccaggggtttgtgttgtgtgtgcatgcttgcttccttggatgtatatttcactcaccattaaaatacatccactattacctgaaaatattgcaggattcagtaccagcattttccccttctatgcatttcaagggagatagagaaaatggcaggaaagtaaaacagaacggtgttttgatttgtttgcattttgcaggatgcagagtggttaaaaatttaaaattgtagacttagaatctaactcttgattttctacagcctatctcagcctctgtgcgcgcacataaataatacgtattttatttcaccatactgaactgcttttatattaatgacagccaattgcaatagaacacacaatcttttgtgagcacatcttgtgaatatatcttttatatatgtaagttataggattctgcccctgcccacccaaagcaattagatgtttccctcttgctgactcttaaaggctttctgatcacccagatctgaagagtcttgcaagaaagaacagctccctcaatttattttgtttatttaatatggagatgaataatgcagattttgttttcatgaatgtccttgtgtggcagtaaacattagactattagcaatcattacttaaaagttgcaatttgcaccttaataacacaggttatttacatgggaaacatagtcaacagggacaactctgaacactgcaacagagcagaaatgacctcagagatctcttttccacctcttgatagtgatgactctgaattaaccggtgaggtcccagaaatctcaaccaacaggatggagggagggggcaggcagctcagggcgaagtttacctttaatttactgtcaagtgggacagctttcaagagactaggaatcgggtagatttgggacccttcctccctcactttgtttaaacatccttcagaaagacaagttcacatcttgaatatttaaatatctcacgcgatggattccttcacttgcccaaaagtatgtttttaacaaatgaatggaaaaatacacacacacacacacacacacacacacacacacacacacacacacacgcatggacacaataaagtccaaagggtcttagcagcacaaactcttttggccattcttgttacttaaggcagatatctgaaaaaggaaggatagattccttgaaatcgcttggtccacacaacattttggacggaaattgattgcttaagtggtccttttcccacccccgtcttgatttccttcttccacctctcacctcacccttaaagactcagactgaataggacatctcaaaagcccatttgttttaggcatttattgatttcatttttaatctgccatatcaggacacaatacgttaaccctaatcagcagattacaagtgacagagagtttagtggaaactctgtaagggagcaggggctccgggaaacttcttgacaatgaaaatcttctctgaggcttaagagtttggatgctgaagattacttttggggaggggagaaacattcctcagaaacagtctacatttttttcttccactttacatttctttatctcccagttgcccattctactgctacactttgggaatgcttaacacccaagaaatacctcccaagtatttttaggaggtcggtccctgaagcagcttgacttttgtcatagtctccaacggacgtttatgctttcatttcatcccagctgatttctcattcatttgacggaatttctccaaaggataatacctgagttgatctgtttcttttcccagggccttgggaattgtgctgtccattgaatgggttttggtcatgggggtgggggcacagactgagcctggcattttttaaagccattgaaatgatgcctcactgttcatcactgcagctgagcttatcaagtcaaccaagaagaaaacctaggccctggtcacgtttgtgctatgcctgtaattagctgacacgaggtaaatgtccaaagtcgaccttcccttccatcactgtatttatactatcaattttatttgggaatgtcatggtctgggaagactcagccactatttcgaaggcaatgcctgcttctacctaggtcccctttaaaaaaacacagaaattgccgaacaaattctatattaagaccaggcatacacggagtatcattttcgtttgatgcaaagtcagttggaaatacatttaactaacagttaaatagtgtcttgcatcgcttccctgaagcagtggtttttcattacatatttaattacaatcaaactgaacgacttttattaaaaaaatcacagtggtattaaaagaagcctggcgcacaaataattttattgcttcacaagttgagaacgcttttatatttttatttctttgagagaaatttattttaattttctaatgttgtgataaatacagactatcttttactgtagtctgtaatcagggagagcttatccttctatctttatagagtctgcttaccccagaataggtttttacattcatttttcagtaatttgtaacaattggtatttttaattttttttttaagttttacaagttctatttaaagttagaaattctcacattccttagggtgatctttggcaagcagctcttcgattataggaggaagttagtcattctaaccacataagaaagtggagagtacttgcttgcttacctgaatattacagtaagaaaaaaacaccatctatttacatgcctctaacatgtaacactattttcactggatttataatttcttttttttttcctcctactgacctttcattcacttgttttgggaactttttctgagaagaacgtttagagatagcatttaaagtggatttcaagatacatcagattttaagacattgtaataaaaattagagacttcagagcccaacggttcactgctagtctaggtctgcaaactaatgagaaagcacctctgcaaacacatagtttcaactttaacttgcacatgaatggggagcgtctccagcagtgtggccgtatccatattgctcattttgtccgagaaattattttgtccaagggtatcagactgaggtccgttcaaagacattatatacatacacagagacacagaagagaaatctgagatgcgagtgggaattgctgatatatttgtttccaaagcaaactccatgaatgaaatgattcaataatttggaggcatttgaaagtcattaaaatggccatttggaattttcagttgttgcctccctcaattttttacgtttcccctgtagaaaaagacatcctctgggcaccctcaaatattctgggatgctaaagtcatgctaaaattatttacaattttagaaattaaaattcaggaggcacagcaagataatccgattattaatatatcagtattatttagctatgcataacaacaggaaaacgcacaatgcaaaagttttagagataatgagcttagagaaattacatggggggaagaaatacctggatcatatttgaaagcatttgtcttgaattctgctcatctaaatgagagctctctttctacctgtgtcatttaaaaaacaatttcaatatcctcctacctgctaccccagcctgaagcagggactaatgaaactctctctggacacacagatgtaagacactatattacacaacactttttaaaaaattgtttcagaaaaccaaatgtgggcatgcaaaccaaaagaaaaacctcaaggatcttcgtaagatagctagctcagggttcaagatcaagagaactttgttgcggcaggataagaagacaacagcattgcgttttagctaaacatctcttcttggcaaatgagaagcggtgaagcagggaagatttttttaaggagctttttagctcttttgcatctctctccaaagactaatttaattgaaaagctgtagtgtccatttatgattaaggaaaggcctcatgtttccacaacactgctagacactaaggtgggtttgaagaaaaaaaaaaaaaggccagcattctgcagtttctgttagtataaaaattaagatcactggtcttaattacttgagtgctttcagaactgaaggaatactctaaaatcacccctgagctttcttcttaaagccacatctaagccatttctatggaaattatatagtttagatattaaggtgggtagaatacagttattgcttttaatgaaaatagttacgaagggcagaatgagataaaaacagagttggcagcagccattctatttgtaatgaatttgaaagaaacttccgtaatgctttactggatcatgaaaaacccatgaaaccttgtgacatgggagatacaaaaatgagacagagggtcaaggtcttctataggggaaaaatggcttgtgtaagtgagagcagtggcatataaatatctctatataaactgcacagggcttactttaaatcacttcaatttatcagatccttggaattttttttatgtatttaggagcctctcttttataccccagagagatatgaatagcttctgggccaagatgatgctgtagagaagagtcaaatctattctatgtgcacggtgccatttggtacagaagaaatgccaaaatgaaaagccataaatgcgttttatatcagaattgcctttggctattttcctttattagaaagttgggtacactgctgagtgcttcttcttgttttcccccttgggattagatttgagactgtggatggaacagcggagtaagggcaagtgacttgggttctggttgcagccttgccccacgctagttatttagccccgggcaagctctagagataaaccttactctccgggtaagaatgtgagtttttggagtcagactgattgaagttcaagtctctaggtctaattcttattcggccgcgtaaacttgggcaggctgctcaaatctctgccctccactttctaatctataaaatgggggcaatcatatgttccaggtgtgtggaaaggattgtgtcagaggagggctgagaaagtgtgctgaaactgttaggcaccacagggatacgagggaatagtgtgtctttaccctgaataaccagactatggaaaatttatattaactgggaaacaagcaacttaccagttatcacagaacaaggggtccagggcttgaaagaaaccagatatggatggattttgatttgtaagcctggaaacacaatggctaagcagtgttttagcctcttctcctgaggcagactcattctgggctgtttggagtccagcacccgctcaaaaaagagtttctttcccaagaaatagaatttatagcaccaccaacaacggtaacaatggtaacaatgatatctgccactaaacaagtgctttttacataccacgtgctttatatgtttacatttattcgtttacacggcagttatttcttgagttcctactatgtgtcagatgctgttctactacctggacctggaggtgaataggatggggatgatccctggggatcttgccctccaattgggggaagctagagaatatacaaagaaatttataaaggaaaagataatttcagtatagaaaaaaagcttcatgatggcaatagctttataaaagcaaaattatgagagcaggagttgggacaacagagatgtagatggtcaggggagacctctcagaggaggggacatctgggctaagtcctgttccttataactttcaagtataatccctgttttactgatgagaatctgagtaagttgcaggataactcattcaagttcgtgcggtagccaagctgagttttaaactcagctcttcctgcttccaaagtccatgcatttaatttattatgatcgtttatctagaatagtcatagcgagttgccaggaaggacccaaggaagaaccctcagtcttattattctccccctgtgtctattgtgatgtctaaagctatggggttaattgagagcctagacggaggatgctgcctttagcggcatctccagatagaatcttcaggccaactcctgtcatctgaagttgtctctttatgggatgttctttcatatgtccgtacatgcattcatttgttcaacaaatattggctgtgcatctattatgtgccaggtattgttctaggtgctgtaaaaataacagtagacaagaatagagatgcccctgccctcacacagctaatattcttgtgggctagcctaaaaagctaacaaacaaataaatatataacacaatattgaatagtcctaattgcatttcataagaataaatctggcttcatgaggtagagtatgatggagggttgccatgttatatagagtggtcaggggagctatttctccagtggtgatttgatcagacctgaaaaaaaagtgagagactagccaagcacagggctgggagaagcagtccaggcagaggaaggaggaaatgccaaaggcctaaggaggtgatgtgatctgattggttattagttgaacataggtcctgtttgtatttcaaaagtgatgatggacttgggcatgtttgctctctccgtctacttacccagcccctagtgatggtgagtaggatgcttaggatgatagaggtggcagctggagataaaaacacattcccagccttcatagagagattggtgctgtgatggatgacatggcgaggctgtggaaaggcattgttaagagtcaagccgacctggggtccaactgcagccagctgtgcactcagaagcaagtttcctcacctcattgcacctcagcgttttcatctgtcagatggggataagaattttgctcacctcacattttacttgtgataattagattatgtgacacatataaaactcttggtgcgggcccagtatttacatgggttcttcctcacaaatgaatgttttttattcttgcacttaattgtgttttcttttctgcaggaattctgagagaaatctaggcacctgagttagtccttggcaccgtttaggcagtaaccaaatatttcctgatgaatgaataaatgaaactgtaaagaaatgaatgctttcattcatatattgctttgtatactaattaattactttcaagtataaggatctctttcataggtctaaaacttttagcagacctctggaccaattgcaaatcctagctgttcttagaatatgtttcaaatgagaaaatattaatgaccaaaagacgatgattttcgtctgaatcttgtattttgcgcatcgtgacatcacgtgccttcgactgaagagcagtgatatccctttgtgcggtaaatattgtgcattcatcttctagacagtgcttgctgagaacatggatggaggggaaggagtggagggtcctcatttctgaccctgaggttcagcctctccctgcgcgctctccaagtggtgctccgagccccccaggacctggcaactctgtccctcccccacggggaacccgcgctcatcccctcaggccccaggcggcgaagcttaggggttgttaagctaatgggaataggctacgggctgtttcctggtaacgccttcttcactttttaattgtcacctccagataagtgcctgagagcaggaagaagggaagctggctggctgcctgttaagatgtatcttaggacaaagagatttgggatcctggagagcacgggggagattctgctgcctgccttaggacctttatgaacaagcgtgatgttgggagggcggctgtggctgtgtaccaggtgctgtaggaggcgctggaactggagccttgcatccgaatgacaaagtgcctgccttcccggagcttacattgagtgcggaggacagaccagggactagccagcagacagtcccatgtgtcagggtctggtgtttgcagagggtgtttgcaggggtagagcatgacaggaagtggctgttttggataagacgatcaggaaaggtacccgtctgcggaagtgatactgggtctggagtgaagcggttggaagaaaactgcacctctctggaggaagacagtgccaggcacagctgaaaatccggggctagagctactgggaggaacaggaggagcagctgggaaactgggtggccggagcagacggggagggtgagcagggagggtaaagataagcaagcaaggggctggggctgtcaccgaggtggggtgcctcggagggtgcaggagcagagtcaggatctgacttaggtttgataggctcctctggctgtcctgcgatttatcagggacccaggttgcgagcaggccgaccactcaagaggcgtctacatcaatgcagtcaaaggctatgctgacttggaccagatggatggcggaagagccatgacagtggtccggggagagaccacaagtttgcaggcagggtgctagtgaaaaagaggcgtctactgaaagctgtccaggagaaatcagactaggttagccatgaatattttctctaattctgtcttctatttttctcctccagttatatgtaagggtcttactgcaaattgtcagtctatcgttctctgagccaaagtggaaaccaataaaagtgttgggagctgcctacattctagaactgaccgtacagggaaagaggccacacttttccacgcatatttcctggagtcctggaatggcttcttcacatatttctccacccccattagacaactcagtcactaggcaagaggatggatcttggagtctgacagacaggcatgggttcaatttctctccaacgattatttcatctcggtgcgacctcaggcatctttgctttcccagactttgttttctcattagcaaaacagacctaataaaaggactcatttcataggttttttatgaggattaattgagataaaccagataatacgcttaacaccgtggtacttgcaatgaagaaaatggtgaatggtacatacatggtaagtggtcaatacattttagtcattctattaacaagttaataatcctctccatgccttgatttccttattggtagaatggggataataaaacccccttctgggtagttgggagaagtcaagcattaataccagtgaagcacttcaaatggtgctttgcatacagcgagtgctcaataaatgttaaattcttaaaatcatcaccacgattctgaccttatggactttgaagggcagatgttgtgtctcattgctttcgtgtccacaagacctggcacatagacgatgctcaataaatattatttgaaggagtgaatgatggtgacatggttcttaggagttaaaatgagaaaacccaaggagccgaaagcatgtctctacggggaaaggttagagagcactgactcaaaccatcgtctccaattatgcagttttaatgaggaagcaagcccaaccttgaacattatttaagccagagttatcccaataagcattttcctaccatgagtggtagattaagtagcattgagtcatgtagtgaaagtaatgtcccttcttcataccatttcaatgcctctggtaagtcaagagaaagtctttgataatagcctatttttaacacctctcacccttgtttgtcagaaagagcagacctcagattcagagactttagcaagcaaagatatccagtaaagaaatgaaataatggccgggcacagtggctcacgcctgtaatcccagcactttgggagtcctaggcaggcggatcacgaggttgggagttcgagaccagcctgaccaacatggcgaaaccccgtctctactaaaaatacagaaaaaaaaaaaattagccgggcgtggtggtggcacatgcctgtaaacccagctactcaggaggctgaagcaggagaattgcttgaacccgggaggcggaggttgcagtgagagccgagattatgccactgcactccagcctgggcaatggagcaagaatccatcaaaaaaaaaaaaaaaaagaaagaaagaaatgaaataataatctcagggcagggcatggtggctcacgcctgtaatcctagcactatgggaagccgaggtggcagatcacctgaggtcaggggtttgagaccagcctggccaagatgatgaaaccccatctctactaaaaatacaaaaattagccaggcgtgatggggcatttctgtaatcccagctactccggaagctgagccaggagaatcgcttgaacccaggaggcggagattgaagtgagccgagatctcgccactgcactccagcctgggcaacagagtgaaactccgtctcaaaaaaaaagaaataataatcttagacttttgttgtctgattaccatcaatgtatggcaaatgatatgggtttttcattgactatgacataaatttttgttttaaaataaaattacggcaagaaaaaagaaggaatggttttaaagaaatattaaaaaatcaattgtgtgtgtgtgtggtgtgtttgtgtgttttgtgtgtgtgtgtgtatgtaggggaagatgttgcacaagctgtgaagagggggtagaatgatgtgaggacactgcaatgccagggcagggcaaggtgcagaagaagctgtgagtaagggctgtcaagaaacccccagaagatagaggctttcattaaaacttccaaaaactttggaaatctgaaggaatctcctctcccaggatatcagcgggaagctcaggaaagtctttactcacccccaaaattttgcaaatatggagggaatgggaatgatttcctggttttgcatctagaatagaggagtggttctcaacctttatttggtatactcatcacttggagaagttgctaaaatgcaaatttgcagattccagacctacagcctagagattctgattccataggaggggaatgaggcccatgaatctgggaatctgtacattagatatccattaatccatttgaattacaggataacaggaaaaagtacataaaatttatataagttccctttttttatactctttctctctcctctctctctctctttctctctcctctctctctctctttccctctctctttctccctctctctcttctctctctcctctctctctctctcccctacccccaaaatgccaaagcacttatattttaaaagttgtttcaaagttgtttgaggggtccattttcacttgtggcttttagtgaacagaaaaaaatataagaaggctctctattgtgttacagcgaggaaatgcatgcatttacacatttgtctacctggtctcagcatgaaacagagcccagaaaagtcttcaattaagaaggagaaagacaagcaatccagaaaataatttaagagggctttgtctgcttgggagccagctggcaacctgggttccagatcagtgagacaagaaagaagcaaaagggatctctcagacttgattctttatttcttacaccctacaattctcaagactctatagaatgagggcagaaaacctgggttgtattttttggaatctcctctactttcttgttatctgtttcatattttttcatactttttcaatgacttctcttcttttttattcttccttcatttcctttgttctttcctgatttcctttcctgaatcagacttccaagccctttctatgtagtaccggtgatccatgggtgaatgtgataaaaacgatgatggtgctaatgatgaacatgacactaactgtcatcgccttaatggttaccatttcttgacccatataacaacgaagccaaaaggactaagcttgtacctaacatttaccaagcactggctacattcaggttgtttatatacaatctctccccgagacatcctgtaagctggttatgattattggccaattgaatagatacggaaacctaagttttggaaatttcaaggagcttgactaagatgatgacaagcttttagataggatactgaagcccaggcccacctatcagagtccaagctctcagacactatgctttgttgcttctcatagtatttcatgcttaacagcacagactcacataaataaacttccacaatatagtatagatacatggaggctaaggccatgaactgaaatttagtgtttccccaggttgaagtaagtcaattgtgttgtagaaaaaaaaaaaaaagatcatccctacttatttaaatccccaaacaccatctttaaaacttgagcctatgaagaaaaagaataaagacttttgaaatctcttatgctatccatgatggcatttttgtaaatccattcctgtttcactaaacaaaagtagaaaaaaatcatgaaaacccccaacacagtccatctggggcgtctcagtaagaatcgtgctcacccactccacagcatctttgaggatgtggccttaagtcagacgctgctcatctgttcctgataaatctcttgtaggctccaggactcttcctggccatcaaaaaatatggaacgcatgcaacgacactgccctcttatttattttagcaaatgaaaatctgccctcacaggtttatggtcaagatgtctaaaagatgtcttgtatttgtatttaagagtcaccttaacagtaggtgactcttaaatgagtactccaaataataggataagaaaggtgatcatgaaactcaagggatcctatctgagagggagaatgttgtctacaccagaaatcatgatagactctgtctggcaaaaaaaaaaaaaaaaatcaattgtttttagttattattggtgatgtttttttttaacatttttgtttatttatttcctttttagtgggtcacattttaaaacaacccattgtgttaatacaaagtttggcaaactgccttgccatctgatttgaggttaatctaataagaaatggaatgaaatgatcatcctgttttattgtctttaacattaatgttttctttgttagtattggatgggaagtcagtcagatggaatagaagaaagaactgttaaaaaaataaaatgagcttatttcacttgatcaatcaatttcagatataaaataattaagctttacaaatagttaaggactctttgaacaaccagcttaaaatctctgtgcctcactcctgtaaaataggcataaggagagttcttacttccatgcactattatgagaagttaaaaaggtgatacttattacatactcagaacaacgcttggcgcataataagaattcaacaaattttagttattatttcctttctcagtctctccctagagacaggcactattaaaaatctagtgtgcgtatcttccattatttatagttttacatgcatgtatatgttgttagaagcattattattctttcgtatatgtttttaaaagattgtgtaaatagtttcacactatattttgtaattttttttcctttttttttaactttatgtttggactctaaccaagtaaatagataggtagaaaaaagaaaaagagagatgataggttttaatatatatacatactaattatatatatataactaatttctctttatgtgctttgtaatattccatcataagaatgttcatttgtattcatttatcggttcctctgttaatagacatttagcatgttttaaatttttcaccattgcacaaaatcctgtattgaatattggtggtaatttttacaatcttcacataagtaatttatgtggagaagaacagttatgaaaaatttactggatgtagtaagaaaatcatttgggaaaaaaataaacattattgaaacagctaatattttataatttgaatattttttgtaacttcactgagatgtctacccctctaatgaaaaatgtctacccctctaaccaaagatgtctacccctctaaccaaaacatttgcacatagtaggcacttgaaaaatgcctgcttggcttaagtacgctgaacgtaaataaaatatatcaataatcccaataataagtgtgttaagaaaactgagtagctgccttggggtggggtggggtggggaacagggagaagtaaaaagaaaagcatgaacaacagaaaagaaatcacacttgtcctcagtgtttgtaatagatcaagcttcagagctggccagctacggctttagagatgccgagctcctggagtgttacaggtgtgtggatggggtcgggtcagggaaggaagagccccccggattttgtgttacaagatgaattgttaacaacagtcaatcccgcaatttaacactttaagcagttaaacttaagttaatgcagtttagcaaacatatattgaagctcactggtaggtccagggggtagaaataaataagacagaactccaatgtttagaaggtccatgtggtacaatatgcttttcctaaccaagaccaacatcatccttataacagggatgtgtgtgtgtgtgtgttgggtctattacctctgcgtattgagaacactgtgtgtatattttacccagcatgacttggttacactgtatgtatattttgattgtgtatttctgctgtaggtctcttttattgtgtgcgtgagttgtgaatacatgtatattatgtgtgttgtgattgaacatgtgtgatgtatgttgtgggtattagtgtgtgtgttgtggcaggggaagagagcatgaaaagcttttctgatgcatgattttgtgtggattatgtatattgtgggtattattgtgtgtgttgtagggggagagagtgtgaaagcttttctgatgcatgattttgtgtggattatgtatgttgtgggtattagtgtgtgttgtggggggagagagtgtgaaagcttttctgatgcatgattttgtgtggattatgtatgttgtgggtattagtgtgtgttgtggggggagagagtgtgaaagcttttctgatgtatgattttgtgtggattatgtatgttgtgggtatcagtgtgtgttgtggggggagagagtgtgaaagcttttctgatgcatgattttgtgtggattatgtatgttgtgggtattagtgtgtgtgttgtaggagaagagagtgtgaaagcttttctgatgtatgattttgtgtggattatgtatgttgtgggtattagtgtgtgttgtggggagagagagtgtgaaagcttttctgatgcatgattttgtgtggattatgtatgttgtgggtattagtgtgtgttgtggggggagagaatgtgaaagcttttctgatgcatgattttgtgtggattatgtatgttgtaggtattagtgtgtgtgttgggggcagagagtgtgaaaagcttttctgatgcatgattttgtgtggattatgtatgttgtgggtattagtgtgtgttgtggggaaagagtgtgaaaagcttttctggtgcatgattttgcgtttgtggtggacctggcatgttcatgtgttcttgccaactatgctgctaatggaatcactgcaaagcccttcaggattttccctgtgaacatgaagccgacgtcacagtgtattttcctgggggttcccctgtggcactgtaccctgacctcctggtcatggcttggttagaggaaaacaaaaccactgttacacaggatgtcccctgctcaggaaaatttgctctcaatgggaaatgtataagagacagatagtactggaagctccacaccctattgtaatgtctatttcctggcctctcttcctctccatgccacatgttctatcgtgtcagggattcatcttaggaattgtgggaacaattcatttgcagtacctggaacacagtcagtgggttgaatgcatgaatgtatgaatgaatgaatgaacaaggggttctccaaggttccaggcctttggaatatttagataccccagttatttatactcacagagctgactgtagtaggatcttagtaaatgtcatatagataaaccgatgcatgcacatggcactcgtgaacatttgcttatctcagaagcaggctagcaatcgtaagaaaacagttcttcagtggggcttttattcttcctctgtggatcccataggagccccttgtctcctgtccctttggtttaattattgttccttaagatcagcagggcagcccttctgtttactgtcaaactgcagccacaaatggagagaaagaatgaaggggaaaaaaatcttcataatccaggtacaggaatttcctcaaagatttttttttctttaaaagaggtgaaaggaaggtggaaaagttggggaaatgagtttccaaacttgccaaacacataaaccaacagaattgtgttgctgcctccataaatgtttaataagttttatcatcttgtgactaaggttaaacaaatgtgagtcctttgaggaattatttactggaagcaaagttatagcatcaacatctgtgtttccaatcacttagatgaggaatagatcaaataaatcatgagtaagttccacaaaataacttctgtattatcatctcaggagaagaataatgtaagcagctcttttaggtgccctctcgattggaatttacaggtttttttcttaggcttctctttttttattcatttcattatctccaaataataagtcttcactgctttgtggaaagttaccataaaaacatccacaatagaaggactttgaaatttctctctgggaatctggctatttcagccaacattctcatttgggaatgggctaacatttccaatatataacatccatataatttaacctcataaatttattttttttcacagtgatgtaatggggagactgacctggagtttataaatgttccctgctcactgcattcccccgggcaacataacattctagacagtgttttatgtgccctgattaaaatataacgtattcttgcatttcctgtggactgacctgttagtactcttagcagaacatttaaggaatacagagatgttttcaaacgtgtaacaatgcactgtgtgaggtttgtttttgttgttgttattaaatcatgatctcattttcattttagatcacagtcccctgggcgcccctccacaagaaaagttctgtgctttggtttgacttttgaatctgccagtgcactctgacaaataaaaataagcaggaacgcttgtttgtaactgcaattggaattcttaggcacatactttaagctgctttcctgaagtggagggaaggatttggaaaagttaatggggagtcccccaagataaaacagtagcaatggaaacttataaccttccttattgaaagaaaaaaataataaatgaagacaaggggaagggcttcctatagtttttgcaatcatgaaaatgacacttgtgacacatagtacactgagcaaaccaatttgtggattgagatgttttaattttctatgcgagaaacacataacaaaagtaaaaggccacccttgccttccggaggagcaaagggaagtttgtggggtgaggatgtgagctggaaaccttgctgggctgaagctgatgctgccatgtagcttttccagggtacaaatctcattccaagaataacacaaaagaggcttggaaactgcttggaggaagaagggatggatagatcaaacaaattagtgaaagataagttcccagaaaggagtatgtgtatttgagagtctgccttttattcatttaacagatatttattaatttacattgttttccggcccctgtgctgtgtatcagggcttatcaggataaacaaggcacagcctctgctttcagaggttagcaatggagtgcccagaataacgtccggaagaaggcacccagtgaggtctcaggaaatgttagttgaaagaatgaatgggtgaattaatggaaaaatagacgggtgaatgaatggatgaatggatgaatggatagatggattgatggatggatggatgaatggatggataaacggatggatggatggatggatgagtagatggatggatggatggatgagtgaatgaatggacggatggatggatggatggatgaataaatgaatgcataaagatgatctgtggctccctaggaattcaagctcatgtctatatgtttgtttctggatctaattgttgatttctgcccggattttatcacaggtgggccctgacattttcattagcaatggttcccttgatttcccttcagacgaatccttcctgaacccaggtgccctttatcctgcacattagcccctagtcagctcttacaagccataatgtgccgtgaagttctccagatttttccctggttggccactctgagtgtttttcactgctcaccacgacctctaatcaaatcagcttggtttccctgtgtctccttccctctgttttgctcctggaaactgtgataaccagatgcattaacatttccgagagtccaccacatgccaggctctgtcccatgtacattacagtgcacttgaggctcatttagcctccctttcaattgagcaggtagactattattcctgttttccagatatgcaaactgaggcacagagctgtgaagtaattagttcagatggaagacacatagtggagccaggattgaagctcaggtgtgtttcactctaaagccacaacaagtacctaacctcagcacctctagaggtcaaacttttttatcttgatgaatcctgtttttgcctgtgatacattttccagcatctcagttcctcagcagagctccagcttcacagctacagatacagagacccaaggaatggagttggggtaagctccatctttgatgttttttaacctcgctcctcattcagaatctctacatggggtggctgtagtaaccacctaccatcatcgtccatctggcttagccactagcagaaaagaacatctctctcaggacctccagcaaatattctggggttgaccttaacctacataggtttccacgaccctccctgaaccaatcactttctctggctctgtgcatccagaatgatttgccaaagcaaaatcaaagtggcattaccaaaaaagggaggaatgcatgcagagccagcagagtccatagctgtccactacattctctatagggttgcaaccaagtgctttgaactcaggcaaactgaggttccaatctaggttatttattttttctttcctttttttttttttttttttgagacatagtctcgctctgtcgcccaggctggagtgcagtggtgcaatcttggctcactgcaacctctgcctttcaggttcaagcgattctcctgcctcagcctcctgagtagctgggactacaggcatacgcctccatacctggctaatttttgtattttttttttttttagtagagacagggttttgccatgttggccaggctggtcttgatctcctgacctcaggtaatccacccacctcggcctcccaaagtgctaggattaaaggtgtgagccattgtgcccggccaaggttatttactttctatctgatcgtagacaagttatttaaccttctaagccccactttcttaattaaaaatagtgtttttaatgcatgctaagtacatagtaagttcttaataaatgttaatgtggtgtttgtagacaacagtatgttgaagactactggaatagcacatagatgtctttggagaaagagatatattcttttgaggtctgcatttatgctttggggcacacagtttaataaaaaggtaatataaaatggaagtggggtaaaatatgtctcccagaatgagccaacaggattgaaagaaccactttccaagtctagatcactgtagcatctttttgcttaaggccgaaagttcttctcaactttcctttcaggtttttatttatttatttatttatttatttatttatttatttatttattaggcaaaatgggaattgagaagcctgaaatgatgaagatgctcatgattttaaaaagtttttgtatgtcaggaatgaaagatgtggtgaggttgaacaggaggaaaaaaatgactgtatcccagtcagcctgggtagtatcacttcctgctttcctggggtaaaaagcctggaggaatatgggcattcggttgttgagaaagagtttgtctgacttctcttgctgtatttgggattgttcagagactaactggttggattgcaatttgctttcttgtggaaaaactgatctagcaacatatattgtgcgtttgagctttagagaagccttttctcttgtagtttattctcttgcatagtggtgtttctaggctgctgacatatgcgaaggaaacattgtattgatgtgtgcatgtgacagtctacctgcaacatgcatgtgctcgtggctgaatcatttgtgcatccaaagctgaggtccctggctgctgttgatttagtccaatgcatatgtaatactctgtggaaaacattcctggttagtagctcctcactactgtgttatacaagctgctggcaaaggtaattatgcttaataggagccacctttgatttaaagctgcagaggtgagtaattaaattgagctcgctcaagcacgagggggtggcatgcaacctttgtttggggacattcattgggagcggctgggatctgttacaaaggcaatgtttcttgggctcatatttgtcacccagattgtcttagaaagacatcagtgcacctgggagagatgcagcaaaggcatagtgcaggcatctctttcttcgtcctgtcccctcaaatatcaccaaaggagaactcgcctcccagcttcatctgccctggttcctgtgctcatcttgccccgggggggggttcagcactgtcctgctctctggtttctcgatgctcatctctacagatgatcacaactgatcaccaatagtgatcagtcttgccacgtggactggcagtcctgagatttctaatctgggtctgctcggacatcaacagcaacaacaaaagcataccagtcccttaatcctttaatgattgaatatgagacgaattcgtgtttgtaagatttcatttcaatcccatgggtggctattattgcatctcaaagatgatctatttgtatacatttctatattttcttttcagcaaacctaacctgataaaagaaaaaaaaaatgcctgggctgtcctctccccagccctaccctctagagtttctgaatggtaacacccaagcaagccgggttctgttgggcaaagagcctgttccaggcgatgccacctagaactggggtgacatacttgctaggaaagaacagcaactccaactaaatctttgtggcttccaaaggattcccaagctccaggcagagggttttgctctgtgataactgcaaagtgggttcataaaatccagaggaatcctaggaaaatctctttgcctaaactcccctgcttttaggataaacagatggccttacatcttcctactcaaagtatggcctgcaggccaacagcctcagcatctcctaggagctcattagaaatgcagattctcatgccccaccccagacctgcttcatcagaatctgcattttcagaggatgctcagggggggattcgtgagcacgttgagatttttagaagagttagcctaccctgaatggttgactcctgcctcctttctgacttgaaatcctcatcatttccttgcctgaactgtggtttctttctgtccttattccatgcccagctgtgccttcttctttttttggggggacagagtcttgctctgtcacccaggctggcatgcaatggcgtgatcttggctcactgcagcctctgtctcccaggttcaagcgattctcctgcctcagcctcctgactagctgggattaaaggcacctgccaccacacctggctgatttttgtattttcagtagagaccgggtttcgccatgttggccaggctggtctcgaattcctgacctcaagtgatccacccgccttggttcccaaagtgctgggattacaggtatgagccactgcacctggccaaagctctgccctcttcttggtctagttaatgccttcacatggttcatatattagcccaagggttacttgctcagggaaaccttgcctcagcctttagattaggttaaatccaccctcgccagtacaggcctgaaagcaccatatacctcactgccttgctcttttcagggttacaattctatgattcttggtttagttaatttctgtctatcgcctctgcacacagttccatgagggcaggaaccatgtccagttttatgactcccacctgctgggaccccaccatagtgtccagtacatgtagaagctcaataaatatttgttcagtgaacagatgcgtgctctcaggacatataattaggaatattgtaggcgtattgctggctacttagtttatctcttcaggaatgttcaaaacatttctagaactgttttctgtttattcaattccaggtgatgagaaaatcaactcaaccgaactactatttttaagcactttccacacattcagcattataccacttaatcctcacaacattttataaattttataaatgaataaactgaaacttacagcagtgatttcagactagcaaaatgatggcagagctgaaaaccacgttctactcttcactgccacattccactcttcactgccacattccaagacccatgagtctgaggcctcatgctctcccttgggttggaatcagagtggttctccaagatgcacagagttcccgattcacctccttaacacagatctttattaagcacaccacctgggtgccaagcactgttctgtagcagcagtaatgagtaagatccatcaggaccctgctctcaggggacagaagcaacatatatacttaagatgccatgtggttaaaaaggggctaagaagaaaaacaaagggtggcaaagggagggaaggtgagggaagggggctataaaccatagagcctttgcctccttcatttttgtatctgagcacttggctcaagggccagtgtgcgataggtctcctcagttagcatcggttgatgactgactgacagatggaatccaacatttccaaagtgggctaagcaccagctggtgtcgtatgtgaccataaaactgagcagagcaaacggccagtctagagattgggatttcctaccctgttgcccagattttcctccctctatcagccactggtttgtgactggaatcatcagaatcgcctctagagctttcaaaaaaaagtcatgtgctcagcttttccttgggcaaactgggatttctgggggtggaaaaccagcatgtgtgtttttaaaaaatcctacagttaagtctgatgtgctcaaatggttgagatgctgtataccccaaccatgtgaaataataacaccatctagctttcactgagtgcctactgtgtgccaagccacatactcagtggttaaccaaccccactaagagagaagaagatggtgacgatgatgatggtaatgaaaacaacagctaatatttattgagtaatgttgtttgtgcctggtgttatgctaaacacttatgatgtccaaatagttcatcttcgcagacgtccaatgagtctttttctgtctcactcaccattatagacatttcagagaaggttcaagtaagtatcagatatatgtttcaagcaggggttgacaaactgtgacctgtgagctaaacgccacctgtttttgtatgacctatgggttagaatggtttttacattttttaatgattgggaggaaatgtgaaaattagttttcttaggttatataagtacctatataatatcttaaattttgtctcttggcctgcaaagctcaaatttactatttggtcctttattggaaaagtttgctggcttctgccctagtgtatttttttccaacttgttgtatgtgtaggacagtcatatgagtgattgttttaggtggtagaagcatgaatttttaaaataattatggtttcatttgctgtgtaatagaaggggaaagtaaaactaatatattaaaactgatttcatggatgttactgctcaatccaatgtaaagaaaaaaatgaatctttttgaaatcaatttttaaaaaataataatacaggcagtatggagataaaacagaaatcatgcaagttatagaaatgggataaacactgttataggatcagaaagtgggatgaatagggaaaagtcaaaataatggaaacaatttcacctggatgagaaagataggagatgagatgacggaagctttttgcatttttaatattctgtgattctcagtttcttagaacccttgtttttcaggactttttgatctcttgaggtctcttccagcgctctgattccatgaaaagtttcctcgggagatactgacacaagctgggggatgtccagggttcgttatagctcaaggcacagtcttcctgtgtttttccttctgctgacttagaaagacagatgagcaaacctcagatggattcagaggtttggtggggaaatctgagaggctctctagttcagccaggagtggaagagggggacagccatctgataatgactgttgctattttaagacacagatagcagagatgaggagtagcgtgatgaaaactcacattaaaacaaccaagagaggcacaacaggaactctatgaaccccagagagacccggtctgggtttacaatgacaatgttgtgtgtgcgttcatgtgcgtgtgtgtgtgtgtgtgtgtgtgtgtgtgtgtgtgtgtgtgtgtgtgtgtttgggagggggtgctgatatttttttaaatgcagatggttttgttctctgtagttgaagcttcagttcagcagctctgagacaaacaggaaagcctgtgttattctctacaggaacacatcaaaggtagtttctggcaacagtcaaaatgtatatcaaggaaggagaaaggattcatgacctgtttgaacaactagtgttaaaaacacattcgagaagaaataatgctaggtagaggatgaaaggaaaataggagaaaggaagaccccttgcttcactcagacctaaagatgattgtttctcaccattgctagctttttcaagaataaggaagcgaaaaaatcacctgtctcatttatcatctgacaggggagctaaactctgctggatgaaactttttcttttgccccagactaaataaagccccacctcgtcttctgtttcattttgaaagaaaagaggtaaaacatgcacaactaaaacacttgtttaaaagtgtgtgacatttcaggaaggtttaacgttacgtatgtcttccctattgagtttcataaacagagtatcattgtttgatagtggcatagctgtggttttgagaaggcttgtctagaacggagttcctgagctgcttggatgatatttcactgctttgatggagaacggactaaagaacatcattgtgacctttttatcaaggcttaaaggaagtataaaaagaaaacggaagttgtcaacactcaccaggctctattgtgaggcacacaaccaacccagggaggaaaatctaaggttgcttttgtcaccttaactcacatcacttcattgtagtacaagtgagagccggaacttattggacacttactctgtgccacacaggctttgggtgaatttttgcattttaattctcaccccagtaaagagacataatggtatccatgttagaaatgacaaagaggcacacagtgaagtcaggtgactcggccaagcttctgcagctgcttagaggccaggctgatctacctagccaggggtacctgacttccaagcccgtgctgtcgacccttctggtttaactctgagtaaatttcatactttgtggagcgtccatcagccaatcacaatctaaaaataatacaaaatgaaagaaactgtcatacattatctttttttcatcttcctaacaaataagctggcatgattattctttccattaccctgaaaaataaaccaaggctcaaggagaggtcatggtctgccccaaaccacagcctccattctctggcttgaaatcttatgcttttacccaccttttgatgttacctcttaagtgatgttgccagaattagcaataaaataaatttataaaaaagaaaataaatatttttatttataaaaaataaatttataaaaaagaacaggatgcacagttaaatttgaatttcagataatataaaagaatgtttagtataaggatgtccagtacagtatttgggacctacgggcaagctttaaagaacataagttttatcacattctccaggtacgacgtgtgtattaataaatcaatagaagtttatctgtgagcagttatctcagttttttaattcctaagtcttcatgttctgaagaaatggccatcaccttgcattcccagggcctattgattatgaggcttcataaaccttaggacttgagagaacagctgggattccttcccagttgctaaccaatgacttcataatgtaatggacagctctaaattgtgcttctacgttgtagacataataagagacacactaaaggacaaatacattatctaataaagctgcctcgagcttaagagataacaaaatgtcaaaactaaattctttttctaagcacttccagtatgaaatttagttcaccgtccaggtactgtccttcattgtggggagaaacatcctgcctgtctacctggggttctattttatttcatcagcctcctgtttttctccagggatggtgtgtgtgtgtgtgtgtgtgtgtgtgtgtgtgtgtgtgtgaaattttttcctaaatattaagtcagtgcaccttcctcgcaagcgctggacagctcaggatcttattttggaagctcgaggtatgagcaggcctgagaaaattgtggcccttctttttactccttccctctgtgaacttttgagaagattccttagtgatcggcttacacgctttcaaactggcacgcctgtaatctggtaaaatgtgtcagccctatggagaaataagccttccagaagagtttcttcattgttgaggtaattgtctcctctctgacaggcacattcatcagtggcttaatggtcaatcactagttggcaggcagagtgttttcattcttccctatccactacattaggcatacttaatcaaaatgtctccgggtaatggctgtgaagagttcatgactgactgatccgttgtctgtgctgatagaaaattaacagctcagtgctggaaagatgcgagcccacagataaacaaattgtacattaatatttcatcttggggacctgggatgtgctgtccatagcaaaatatttcctggctgcacaagcaattctttctttccttctctttccttcttttttttctttttctttttttttttaattatttctttccgtaagctgtgcacactcataccacatggacagtatgcatcctgttctagaagcttcagtgtctgtggaaagttcaggggagttcatattcgatgccctgttttcatcactgccaaatgaaagcaggcgaaaccctatagaggagttgttttgttctttctttttctagtataatatctgtgggctgactgttgcctgagcatggaacacgcacccactccccccctccaattaaatacctgccccaactttaaacatatttcatacagaatatttaagggtttctggatgaaatacaaatttcatccagaaatacaaatttcatccagaaatacaaataggaaaacacacattgctcagtcctacttattttagctgtaattcattgtgttggatgattttgcagagtattctgatagtgaagacaaactgattccctagtgaagctgaaatcggtcaagcttcctgatggccaagacgtaagatgatacagcagttgaccatgtgcgaaagaccagaagggtcagagtttgacttgccttgaccccatgcaggcgttgccccgccacctcttcctgtctttttaattttatacccagaagaacaaaaacagagaaaaggcatttacgcttagcagtccagacctgccgggaaaagcataaaacaaggtgtataaatgctggaagaggaagccacaccatcctgctgcttatgagctcagggaagttctttttaaatggtgtcctaggtgcacacaaaagaaatgtgtgggcgtccgtgtgacatcacatgccataaaagacatcaagatgctaccaaaagtcagaccctcaggtttaatctgagtggttcaatataataataaaaataataatagccaactttcagtgtttactataagataggcaatatgggctgtacatgaatcttctgatttagtggaggtagataccatcattattcccattttacagatgagcaaactaagagagacaggaggaaattcatctaagaccaaacagccagtaagtgatataatagaatcgtgggagtcatcctgaactttgaacctcttcccttaactgcactacatataagaagccaggtttaagccgggcctggtggctcacacttgtaatcccagcactttgggaggccgaggccagaggatcagtgaggtcaggagttcgagaccagcctgggcaacacggtgaaaccctgtctctactaaaaatacaaaaaaaattagccaggtgtggtggtgcacacctgtacctagctacttgggaggctgagccaggagaatcgcttgaacctgggaggcagagattgccgtgagccaagatcacaccgtgcactccagcctgggcaacagagagagactctgtctcaaaagtaaataaataaataaataaacaaataagccaggtttgagctgaactatttagaaatataaaatgttgaagctggagaaaacgtgtagatgtcctgccatctgaactcttcctgttccagaggagaaatggtggcctagaggaatgggaggtgaagggtctaaggtcttaccactgctgtccccaggcagtagacacattggttttattaacaggaaattctttggagattctctgtaaatcctgcatgcagcgtgtcctgtgtcatgtggtgatgagaagctgaataaattcacacttggatcattctcgatctgtcctaggcaaggccctggagaggtactcggtgttaaaatttctggagtgactgtgacatcttgaagtataaagtagaacaaacctttgtgtatatagcccctctctccaagtactggctctttctggttattctctggctagattttctttcctctagctgatgtgtttggtgacctcactttttcttctctgttttgagaaatctatgaaatttaagataagataagcccattgggttaatagcatttcacctgcctttcctgtatactcaagaaataatcccaagagaagaatcttagctttaaaggcatcaagtttaacacagagcagggtgagatggaatgtatttaatagttagatgatccttcattcttttcttttttgtgacacacacacgtacatgtgtgcactcaaaatgcttaacttataaccagttccattgccacttcattcacttacgagcctaaagtttggaagtttgctcctattgaaagaaaagttgtaagatgttcaacattataaaaagtgcatgagttgatctgttcccagacagactcacagaattttacttaacatatattgttgcaaaaatgtttgcatccctactgaaaaatcattagtgtcactattgcaagagtagttattaaacagttaagaaaaaaagtgatattttccctaacgttaagtattcatgcctgaaaagagactgagaaatagatacagatttttatagctattctggaagaagtctccatgtgcttttgaagaatttgcaataggagcacaggctcatgtatccttagatgccttgcatggaagcacatgaccaagataaactgaacactagccaatagggagtggtgaggaccatggagtgctgcaagccccagtcccttttaatgtgcaccacggctactcaactccagtctgtagtcaccatgcaggaatccatcatctatgttgccagatcttttggtttctcaatggattcacaaacctacatttcaatttcctaagcagcacaagttaagtaaatcacacgtggtacctgaattcaatgtaaactgccattttataaactcagatttagagatacatgtagtccttcattcttcattctttcacatcattttctttggtacagatctaaaatagcatcattctaatattaatctgtcatgttgggtggtggtggggtagggtgctatggtttattttgtttggggtcaaacatgaataaaaaataaaaataggacttttctgagttaattgagtaggagttgggagagttagaggggaaaactgaatatcagtataaatatttgagcacctacaatgtgcaagttctggaaatccatgagtgaacaaagctgatgatgccctcatgacacttgtaaatttctcaataattctttaattgccattgtgactggtgctgcaagagtaaaggctgctactgtgagggtgtctgacagccctagcctggggtggcaagaaaggcttccctgaggaggtggcattgaacttgatacttgaaggcttagcaggagttgaccaggctgaagtggcctggtggagtaaggagcttctggccaagaaggccttgggtgcagaagtcctgaggttggagacagcaggtgcatggacagaggaaggttggcacgatcggctccagtgagaaagagaaagatggtaaggaaggaggttcagaaatcagatggaccaaacacatgaaaatgtttggtcattttaaaaagatgacttgcaatatggcaactgggccataaagagttaacaagaggagtatggcatgagtataggcctttcaaagtgaaagacaggaagaagcacaaaatacgtgttggataaaataatttcttggtgatgacattagcatggaatagttaccatcctagagaaggtgctagaagatacaggggaatgataagagtcatccaagaaagaaatgtgtgtttgtgtgtgtgtgtgtgtgagtatgtgtgtatactcgtgtgtgtatgtatgtatactcatgcgtgtatgtatgtatatgcgtgtgtggtgtgtgtgtatgtatgtatactcgtgtgtgtgtatgtatattcgtgtgtgtgtgtgtgtgtgtttgtatttctgacatatccatatatccagttgagtatttgcagagtgatgtgagcatgacatggttaatgattaaaatccaaattaggtttcatcaggaaaattaaaataatttaaaaaataataatacaacacagcaaatggtctggctgtgtttcctacttttattcataatactaatttatatcattataaattatgtgtaagggtgtctaccttgtcaagcctatgtttgtaaagaagaaagcattttgtatctcacaccaagaaaccaattccactgaattgtatgtgagttaatattcaaggcaaaaaagaccaatttaaatcaatacataattaaccttgatattagaattgagaatgaaagcccagtttagagtgttgagcatgattttcttaatgatatgaacagtgtgtttagtctttatgaagaaaaaaataaagggaagaaacactggatggaaagaggagagaagtaggtaaaggcatttcagaaatatggttaattgggtaattggggattgggtgtcacttgaacttaagcctgtggttaattcatggcttattcttcaggaatgacattggcagagcagttattggaataatgaattgctcacttgtcctgggcaaatagaaaattcccctggttgaataaaacagtgggaggaggcatttgataggcttataatggcttaagagcctgggttagggttcttcccctgacagtcagaaaagagaactttgggggattggatattttcagcaaaggggcaaaattaagaaaggattataatcaccttttttttttttttacgggaattgacattgatacttaaagcattttcaaaatgaacgtcaaaaacagagttaagcagcagaatattaagtcaaggtagggggctgatataataaggagtttgaggaattttagaggaaaagtagtcgatataaaggccaacttagtcaagtgtcaattattcccgttttaaaaatagagtagtgtatacccttattcatggggaatacattccaagacctccagtagatgcctgaaacctcagatcataccaagtcttatacatattatgtttttcctatacaaatatacctgtgctaaagcttaacttataaattaagcacagtaagagattaacaacaataaaaaatagaacaattataataatatactctagtagaagttatttgaatgttgtctttctcctctctctctctctctctctctctctctctctctctctctctctctctctcaaaatatcttgtactggctgggcatggtggctcacacctataacaccaacaatttgggaggccaaagtaggaggattgcttgagcccaggagttcaagactagcctgaaaaaatagtgagaccaatcgctacaaaaaatatatatatatacaaaaaattagctgggcatggtggcatgtgcctgtgatcccagctactcaggaggctgaggctggagaatcggttgaatcagggaggttgaggctgcagtgagccgtgatcctgccactgtactccagcctgggtgataaaatgagaccctacctcaaaaaaattcacaacaaaacaaaaaatatacaagcaatatcctgtacagtgctcactcttctttttcttgtgatgatgaaaaatgataaaccgtgtgtgcaaagagatgacgtgatgaagcgggacagctcaggatttcatcacactactctgaaaggcacataatttaaaacttatgaattgtttatttctggaattttctatttaatatttttgaaccatagttgaccacaggtaactgaaaccacagaaagcaaaaccacagataagtagggactactgtaaaaagagaaatagttccataaactttcaatgttaacttttttagccccaaagtttagaagattcagaggagaaagattttcccagtcaaaaagcttctgcccaaactcagacttttcagatatcttgttgaaggcaaatttccatgttatttcaatggcaaatggcagacccttggaccaaccaccaaagatactcaattatttccattaatgcagtgaagggactagaaattcattacccaaaattccccccaaaaaaagacctacattgggaactctgaggattttgtttgtttgtttgatttgtttctaatatggcttcgtggcatcttgtgtttcggggatgatgtaaactatatcataatcactatcattgtcattgttgattctcttagtcttttagagtggacaaaaggctctcgtccatgggtctaccctccccttctcacctaccattttctcctcatcctcgtatgtaaatactgagaacctactctaaccacaaagccagtcattcaggacccattgcctcaggctggatgctgcagtcttttggatggaacccaggaatctggattcctaactggaaccctggaggatggttacacacgtcgaagtttgagaacatccctctattccacccaccacattgcatcacatggcagaatgagaaaagattgatctttgaacaattccccattttgattggatcatcaaaatcctatctgcacaatcctccatgtctaaacacacactcctaaaggaagcaaagcaaaacaacaacagcaataacaaaaaacatggcactagtaactcagagtggaaaacatgactctgctgttcagtggttagaaccagctggatgcaagatcctctggtcggattttatgtgtgcccagcctgtgagccttaggaaggaggtcagttggtttctttttcttggccaactagattggaaacaaaacaaaacaaaataaaatgctgatatgctgagttatgacaaactgagacacatgtcatgagaggaaaaatgacagctttactgctgcagtgattacaaaaaacacagcaaattaaccaccaatatggctttgtatgtagagtgaaacaactttattgcactgtaaattggagacctagaacatattttaggagtgtcacacctgaaaagctgacgattttccccaaattgctattaatatttttttatttttattagttttattttccacccaactgaaagctgaaactagaattatttttcctccctagaaaaattttattttgtagagttggacattttctttattacgttgtctctgtaagagttacttagctataataaaacagtcatatttataacttaattaaatctggccatttaaacagaaatacttgtaagtaataccaataaaataaaaaagtgaatatcatatttgataagttttgctcaaacagctttctttattagtgccttttatgtaactcagggaaaaaatatactgatccagcttggcctgaattttactgtgaaaagtcctcagatgagttaatatttgtttgctgtgttttaagttattgagctaagcaggggtgtcatgaatgaatgttcaggttgtgcactgtgcaagtctgccatatctcaagagccccaattcatatcctgggatcctcttttggttccaatttcaaatatcacactgtagccgagaatctcacttttaatgcccataacaaattattaatacctttatttccaatgtaacagtggccagataagtaaacccaaagttttaaatataacaggaccaacagtgttcattcatctaatccaacatgattacattactaataaaaagccaggaccttattttatgctatataatcctaatagttcagaactagcagacttattcagtttctatcagattgtgtattaaccaaacacatttctgagatgattttttttgaatatcaaagagcacacaggagtatgtggaaaattagggtaggagcatagtaggatctcaagaaatgtttgtttcatggttaattaaataaacagatggctgaatgaccatatattgcttttatataagaggaaaattaaaatctccccagagtcagttttaagggcagttttctttacactgggaaaatcgaacaaccccacagctgcctttggaagctgtaccttttggctgaagagtgaatggttcaacttctttgagtcagtccccatctgccttcccaatagggtcattcttttctgtgcctggcaatggtccctgcactttacaaaacaaagttatgaggtaggtacaattgccaccacattacagatgagaaaagggaagcacagagaattgagaaacggggtcttatgctagtcagtgatacagctgggatttgatccacgatatctggtttcaaagccagtgttcttgaccactacacgatggcccatgactgttcagagaggtactcatacagatttatacttcaatgtacaatatttcgagataaacagccctattgtgaatcagtgctacccagggctggccagaggtcttgcatcctaattaccagcgaggtcactttgatatccagtaggtacctctgggtccatttgtctgaccttatcaccttccgttcttgtttcccgtctctgtttctgctcagttagccaccaatcggccttctctggtcccttactcctgggtgtgttccatctcctcgctactcagaatgtggtcctcagagcaggagtatcagcatcgtctggatttgttaggaatgcacaatctcaggcctctgccaacccaaatgaatcaggattttcatttaacaagatccgcaggtggttcaaacacactttaaagcttgggaagtttaggtgtggtacctattttccagaaccccaagcagctgggccaatttagaacattcccttggtttgggaaggttcgcttctccatttccctctaggacttccttgttttcttcaacaggccccctttacagccctaaccaaccaaccacacacacacacacatgcacatgcacacatacatgcacacctacacatatgcacagatgcactgacacaggtgcacaagtacactttttgggaaggcagttttcttttctcgctcatgtctcagactgccttggcccttcccggcttctctctctgtccctcgcacctgccacttcagctaagatctctcctttccacaacagtggatcccactctaaaatttcaaaaaaacgaccaaatgctggggaaattagctccaggttgctctctcttttactttgccaaataaagacattaaactaaaacaagacaagctaccctagttgataactatccctttatgatctcagaaaaaaagaatagggtttaacacattttacttgataaaaaattcactatattttcttcttgttttcttgtttcatctcagtgtgattggagttttagtatagcttcacagagtaatatttatagatcacttcagattttgtgaccattgcagcaaaaatgttgggtgatcagccatgtctttctctcctttgagtcacctactcccaggaagattttattatcccaattaaaacaagagaagtaaaggcttcccaacaggctctacttgttaatggaaggtggctatttcctgtatgaaactctcacatccctatttgtcctcaatggtttctgagctcgagcattttttttttatcatacaaatacagccagctttataaagaggaaatacatagagacaaggtactaaagaattttaaatgacactactctggaacttcaactgttctccataagaacaggaaagggtcctcagcataggttaacttaacaaatatttatagtgtgtggtccttgtcctctagactgggcgagaatccttgtcatccattctttgctactgcaccagtagacactattttaagtagttgtttgtggaattattaatatcatccctttaattgtggtctaataggaccacatctgttttgttcaccataagctccccagaaaccaacacagtggtgatgactacatgtgataacttatagtaagtggcgctaagcaaagaggaagcataggctgattacatttatttaagcatcagtgatagctttctattgcctatgtggttttaaaaaatcttctttcctttgcattcaggctcatttatttattctttcaaatgatatttatgacactcttactgtgtgccaggcagcgttgaatccacttgggataagggaatgaaaacaaaaggcaatacttcctgcagccatggagtttactttcaatttcctgcctcgtggggatgatatgaaagtgaaatgagcagtgagtgtgtattagtcagctcaggctgctgtaacaaaataccatagactgggtgggtggcttaaatgacaaacacttattgcttacaattctggaggctagaaagttcatgatcaaggtgctagcattgtcaagtttctggtaaagggtttttttctggcctgtagaagaagccatctcttcatacggcagagagagagagagagagagagagagaagagagcgagtgcacatcctcatgtctcttcttacaagggcactaataccaacctgaggattccacccttgtgacctaattacttcttcagggcccctcatcctaataccatcacattgagggtctgggctttaacacaggactttggtggggacataattcagtcgatagcagcatgttgaagtgattagaaaaattccctacatgtgaagaatgcagaaaaatttcttcacctatttatggagcattagttatgaaccaggagctgtgctggaatttggggaccaggtggtgactggaggcacctggattcctgctgctcatgggttcctaggcagtgctctctgccctgcctcaagttctaccctcctcttcctcttgactaaagctccattttctcctccttcaagaacctctcccttcctctttccgtgctaggaaatgtacccccagcattttgtatctatctcttgttaacacttataacccactttttcttggcctacttgttaatatctttcagtagtctgggaacctctcaaggtcagggacagggacttagttgttttcatacatttccaaatcctgctcccctccacctccctgaagccccagtacaacgcttcgtacagaatgagtcgtctgttcgtttgtgtgcaatgaatggatacattttgtaatgtcaccctgtgtttaaaactcccaataacttcccaaactgcatttaaagcctaattctttgccctgtctctcctctgcctacctccccacctctccagtgtggaatagcgccattcccttgttgccccacactgcatggtggccactgtctttccttctgtttctgaaaacagctgaccccattctgtcctctcagttttacacttgctggtttcctggttcttcccatggcctggcttctcctcatcattgtcactgtcacctcctctgagaagccctctgtgatccctttgctgaactgatctcttcttttcctagacatcctctttcaaccttttcaaatctcattttcctcatagcagttaccattgtatgaaattaccttgtgtatatttcatttcttgtacgggaacagtggttctcaactgggaccatttgcatcccagaggacatttttttgttatcacagttggggagaagatgtcactggcttccagtgtgtagaaccagagatgctgccaaacgttctacaatacacagaacacccccaactacccctagcaaataattatctttggccacaatatcaatagtgccaggatgagaaccccaggatagaatttgcacaatgaggatggggcctcttctgtctggttcttgtcaatgttctcatggtctcaaatagcacctggcacagcacattcctttagccaatgtttgtgtcatggataaattaagttctatgttaaaatataggagggtaatgtgacttgggggcctctacctcattattttggaagaaatggaatcagaattcaatgccacaccattagacattctctagtgaaatgatgccgttaactcaccggtgatcatgctgctgggacaggatgggagggtgagaagtgggggaaaggggtgtttttctctattcttaaggatgctgtgaagtacaccttgcccagtgttcagggggctgaaagtaagggcagcacctatctgtgtcatgcatgacaagaggctgtgccagaaagggaagaatttttaaaaataataaaaatcccgatttaatgataaataatcatgccctgcctctgacgttaaagggcatcattgtctcggctcagcgatgtaaatcaccataatggacgaatcttttaaaagtaacatggaatttaaaaatggaaaatatgagggccatgcaggatgactgtgaaaatcatccgtttattatctaggtgtgcttaataatctgctgcctggggaagaatcatttgctaaccctgaggaatggctcattttccaattcaatcattcaggccagcactgcctaggacttctcttcctcctcccttcccctccccactcatgacttctttcgtcactgtctagaaagagtctatcactgccataacttccattaaagcctccactaaacagtttcaaaagaacaaggtaggttcaccatgagctggtgcagttagcaacaaatcagccttcaattggtgagaatgactcatttgaaagggattattagccaaatgttaattgattagtggaactaaagcaattaaagtgaacagagccttagcctgtctccacccatcctcaacgcaggcatctttctaccatgtgactcaccctctgcaaattatgagcattcctggtccacagagaaatggtttttcctttttacggtttccagaattttgtgagaggctttgaaatcaagaaatggaaatcaaataagtaagtgcaaaaagacaatctactacttggtatgcctgtatcagatagaattggctggattatgctgctgtaacaaatagcccctaagtcacagtgacttaacacatcaaacgttgactttctattcacgctactcatctgccattagttgagggtggtgggctccacaggttgcatccccataaagctgaccttgcataatacacaacccccaaatcacaatgacttaacacaacagaagtttaccttttactcgtgagttgcaggtggggggcttgcttgttttcatcactaactgctaaggagacaaggacgttattctctaccatggacttggaggagaaggagaatggaaataactgtaagaaaccctgttcattaccccagtgcctagtgccttatacaattgaagaacattagtcatcatcatattcctttccccaacaattgacaccattattgaagtttgcctatgttcagatctgtgctcattgctttatgtgcggtatctcattgaattttcacaacagctctgtggcatacagggcattgtaaacctccttttctgaaatgaggctcagggtaattagtaacttacccatcatctcacctagtaacttacagagctgttttgatccctagtttgcttgactccacagcccatgacatgctacaagtcgtactgaaataagtcctctctgtctttctccctgaggatctctcaaagtgcagtggatgtaattctggtgtttcacaacatgattttacatagcatacgggccaacattttttttctttaacagttgatatgtatcgtaatgtgtatgtgaaaaagatataactcgtggcaaaatcatgatctaatagatgttattgcttaagttgaggcttaactgaatttttaagtttaaaaatagtcaagtttttaaattaagtaaatataatagggaaaaacatgaaagcagtacacaattaatggaggtttgaaaatttgaatcttttcacataaacaatccatcaaacagcctaatatttactaagattgtctgtgggctagagaatactttgacatcacccgctttgggaagtatttatcatcccttccttttaatgcgtcttcaccccaatggttaagaactttcttttctgtgcttcagaagtatcttgtatagtttaggaccaatcacattgtatagtagttacctaacatgtctctctttcacaatagactatgtaactttcatgggattttattaatcttggtattttcggctactgatccaaatagatattttacaataaaatcatggaacttacctaggtggagtatgcaatgcagtgaaagagacgaacatcgcatcaataggattctgctacaagtaacaaggaaaacatcacattcaaactggtttataaggaattactggctcatgtaattgaaaaaccccaaaatcatgtatacatcagggaaggcttgctctagcagctggacaatatcaccaagaaggcaacgtccttctgtctcctaccatttcttgcagcctcaagacggcagctagaagactctagagttataaacttcctcattcatatccaacaggaaagagaaagtgtctttttcctgtctttcccagcagttttgtagacaatcactgggaatagaccaccttatgtcatataccaagttcccaaaccattacccgttttcaggggcatgaagtgagctcattggcttggtcaaggtcacctgctccactgctagtcctggaaagggggtctgggtttccagaattctgcagaggatctgaagcaaaccaggggctaacagaagggggagggcaggacagcagataacaagaaacatgaatctgactccagtgaactggaagcattttgtaactagcattgaatgcccctgtgtcaccttgaaagtgatgactttgcctttgtcctatcacaggtcaccactgcctttaaatcagattacctaaaagcaatgttgaactttaacacatctttccatatgctgtgcttcccgtaggcaagattttgcatttgtgctattttctccagccccttttcctggtttcattttgcataccataaagatcatgagaaagcttaattcaggacacaactcttaggttctcagctctacactgagatcctgttttgtttcaccttgctaaaaacgtcttgcccagtttatctttcaattcgttttctggatcttcgtccaatttaaaaatatgttaagattatttttagatcctagtcattagtgctatgagactgttttcaaacagatttattcttttctctcatttgctcaatatttgattccctatttaaagtgcttttctcctttcaagctttctacaaatctaaacattgggagaaaaaaaatgagggaaaggaccaattctctatatttgtgtaattgtaagcaaaatgtgctgtactcttttctggccacttggcacataggttacaggtcatgaactatatatgaaggcctgcagttcaaatgagatccacagatctggtatgttcctcccagactgtgtttcaaatagacaagtgttagttgcctgggtttttttttttttcttttaaaggagacttcatttaaatttcagggtattttatatccaaatatagaattagagccttctttaagacttgatttgaaagcactgaagtcactatcctatatggcaataattgggtggagctttcactgttggggcttaccactcccactgtgactgctgggacaaggctcaaacttctgaaactctgtggccaaggagaggagactagctacagtttcttactgaggaaagggagtggtatcagggggttgggggagacccctgttgttgaatgtccagaggtggtgcctgtgatattgacccccataggtgagctcgtgtgatgtaatggtcaggtcttggcctttacgtgaatctacgtgaattccaaagtggtgaatatatattccaccactttggaattacatcctcgtgggcaagttgcctacttcctccaagcctccgttcttgtttgtaaaatgaggacattgttacaatctactcgtagaattgttttaagaattaaatgaatccatgagttgagtccacaaagcattgagcacagggcttgtccagtggagaaagtctcatgaaggttggttatcactctcttcctgtattagtctgttttcacactgctataaagatactacctgagactgggtaatttataaacaaaagaggtttaattgactcacagttctgcatgactggagaggcctcaagaaacttacaatcatggtggaagatgcaggggaagcaaggcacgtcctacatggtggcaggagaagagagtatgcagggggaaactgccacttttaaaaccgtgagagctcgtgagaacccccgcactaccatgagaacagcatgggggaaaccacccccataatccagtcattccccaccaggtccctccctggacatgtggggattacaattcagaatgagattcgggtggggacacagagcccaaccatgtcacttcgtcaccatcggtcctcgtgttattactacttctattactgttggtccattttaattttttattctcattcttcctttctctaatctcctttttctcagtctcatttcattttacttagcatggcatccttgtagacaaggtggtggtcaatatttgtatttcccagatggccaacgaaaacagccatgtagagcctaacagctgtatcctaactcgcattacaagctaggatctggtgttcacaaaaaaccaccttcgtttctgctgtttgtaaaaaggtccgaaaccactagcttcttgtggctatttttggccccataaagaggtcttggctcttgaaatactggtcacattccaattaaacagattgtcatttgccttcctgggccaggggtgaatatcaccacttacttcctgcaggaattgccaagagcaagtgggtctaaatggggtgcacacccactgtgaaactgaatagccaaaatccaaagaccagggatagcctcaggtttacactgtgatactgtgtttctggataaagaatctgataaaaataaaagaagctgctgtatctctgtcttctacctggagagaaatctccacagtcttccaattaagaccataggctccggaaacagacctgaactccaacctcaggcacaccacttaccagctatgtgacctcaggctagtattaaccctcaatttcctcatctgtaaatggggaactatattaatgtctaccttttaggataagtgtgtgaatgaagtaaggcttgtaaagcacttagcataggtctggacagagggagctctacacaaacatttgttgctgttatgactgaaacaaatggtggaccaaaccatggcagtttaacacacatttatatctcccccatctcctttcccagcccttcccctaacgctgtggaatagcacttggattgaataaaggagggaaaatggttttaggacaataactgaataactgaaccactttggatttttttctggggggaaggtgtgcaggaatttaagcagcatcagcctcacctaggaacttgttagaaattcagactctcagaccccaccccagacctactgaatcagaaaccatgacaatggaaccacgtgcgctgtgtttagcaagcctcactggtgattccaaagcacactagtttaagaaccactggtttaaatggaagttggaactccgctgatgctgaatcaaattgggtttgccttctttcttcctttcttcccctctacttaacaatgcctgtgtcagcctatttggaaccaaatttctctgtctcataatggaaagaaaaagcatttcttccaataatttccccttacgataaatatgcatctctgttttttatttttcaaaagccccagaaaagcgtgatgtgggaccagcctttaccaactccagcaggaactgatcataagtccaatgaatatattcttaggaaggacttgtcctaattatccactgcaggttcatcttactgtgtctctacaaccaagccatgtgctagatggcaagggaggaagctgtatttctatgttaagtaacactgatgtatccagatacttggtttttaagtagtaatttttttttaactttcaggcaagtaaaagaaacaaagtatcactgaggctacttgaaggaatcttgggacctgagtatgtttattaagtatttttcttctttcttcttccaaaaagaatttgaggagatttttcaataaaagagataaaatcataaaagtaacatggtggagggacaaataggggctcataatgaaggagcagatcagttgtgccagaaaacctaagctaagaagtgctactctaagtgactgcaaaatgaaactcagaggttcctggctgcaaaggcaaaaagagaaacaggatgagtcacagagcctttgttctctaacaagaaagcagatacattcatcaggaaagaaaaactatttcctagcactagactctaagagaaatttatcgtggagtcccttacataaggtacatgagtatgtatatttaacacagatctccggtgttaaccgtgggatttatctgtcttttagggaagtaaatttcagagctcagcaggttgacagtgtctcttcaaatttacagtgtcaacgtgcagtaaactagctgcttcccatgccacgttttactggaccgtctatcaatatttgatcaaattgggccaaagtttcaaactgcccttaaatttacccagagaaagtgcttgtacatgcagaatgcctgagtgggcttcaaaattgagtccttgtgaacgggaagcatcttttaaaaatatatctgcaccgtttgctcaagtctgaatccttcctaagaatgcttataatgtaaatctatctgcaaatccatagttgcccataaaaatgccaagcacatggcttgtttctcccaggtatacagacaataatttacgtgtaatcgtgtctctaattgtatatacatctaattgtacatacatctaacatgaataatgttattcacagaacatatgtggttgactaaaataggagttcctttgtgtgaacctaaaggattgattgagatgataaaatatcatcgctgctctgactacgtctttgatatttgtatggaataattacatgaataggtccaatggttttattaccatggcgatgcattgtgtgttattgcttctcttcttgtctaaactggttttccaggactctgctggaaaatgcacctctataatcctcagactacccccccacccagatctgctcctgactccatataaaagtaaattcttatcacctgggaatgtttttccttcagcctaaaacagtctctgttccatattcttgaaatcccaggatggaagtcttgcttgaattatagaagtcttgctggttgaagcattgctacattttttgggtgtattgtttcaccttaatatataagatccttttactgtccaacatgagacacttggaggtggtgttcatggcctttcaaggctggttcctatcccatagtcagagatataatctatagagcctttaactcaatgggaaatgacagaaattgcagcgggaagcagaattttatccaaatgttcttcctctgaattgttaagcattaaacctcaacattaacctaaatgttcagagatagttctttcctaggtatgtggaatattaaccaaatggttttggcaatttacatttttagcctctacgcaggagtacattccatttagaaaactagatattctaagtggtggaagatgtgacagaggcgttaatacttgaagccatcatagttcaagttgtagtttcagtattgtgctttaactcgttttttgtttttttttttgctttttgttttttatgagttatcaagttatcatgtttcaaataccatttttcttccttatagttaaaaacaacagcagccaaagcccttgcagtgaatattttgtgatattcaaacctgtgggaaacaggaatatcaaggacatttttctttcctggattttctagtattttgaaaattttgtgctgtttataaacaagcaaattgtccactgaaacgcagcacaccagtgagcaatctttgagcagtgtagggaatctgacttgagcgttttcctgagtgccctctgtttgcaccattagtgttaaatgtctgtcagcctttccattgtagtcactgtttttctgggatttattactcaactctaaaaaccagctccaggctacaaattgccataaaggggaggtcatttttttcccctattgaagtagtgtgggtgggaaggagaaaaagtattcattccaccctcttattttttttttgagtcaaaaaacaaaaaagctgtactcataaccagagtgtatggcttgatattttattgaaataaatatgtacataaattattatcttatcttaaaactgttggatgatgttgagagattattgttagtaggtcaagccaaaacttgacgttttcaggggaaaccaaatcatatgttctgcttttaatctggcgtttcctggtttgtgttttaagggaaatgtccttcattggatgaacctttattttgtgccttggaaccaggcatacgtgataacaggatacataaaaggtggtaattgtccctgacctcaaataattaatggtctaggtaggagaagaacattaaaccatggtttcctaccatgtgcacttgctcttgcagattttttttattattatactttaagatctgcagtacatgagcagaatgtgcaggtttggttacataggtatacacgtgccatggtggtttgctgcacccatcaacccatcatttacattaggtatttctcctaatgttatccctctcctagccccccacccaccaacaggccccggtgtgtgatgttccccccactgtgtccatgtgttctcattgttcagctcccacttatgaggaacaacatgcagtgtttcgttttctgttcttgtgttagtttgctgagaatgatggtttccagcttcatccatgtccctgcaaaggacgtggactcatccttttgtatggttgcatagtattccatggtgtatatgtaccacattttctttatccagtctatcattgatgggcatttgggttggttccaagtctttgctattgtgaatactgccacaatagacatacgtgtgcatgtatctttatcttgcaggtaaattttaagcatgcaaccctaaaatatgtatatcgtgtgtaaattatatgcatatgctactgtactagcaaaaaatgtgcttcattaaaatgtgtacaaaatggaaatttgaaaagaattagatataaaaattaagtttatgtagatagtattaaagactatatattattatatattttatagatatgcataaatattatttatatgtaaaactccatcctatttgctcatagtatttaaaaaattctggcttttaatttttttaaacattttatagtaagagcaaacatttaatatggttcataatttttgaagatcttggtttattacttcatcatatattgattcaaagatctggttgtcaattattattattatgtttagtgacttcatttaaatggctgtactagctgagatataacacaaaaatgcatgagttcaagtggatccaactaagcccagatgatgaagtccatgtatccagttgcataggcacattgaagctgcccttcctggaaataggctgagatttaaggaaggagccaaggatcacatcagccctccaccttgatgaacttccccgccccacccctgggtgcctgcccccggcagatgacaccttcacatctagaacaagtcaggacaccagtgtcaacctgtattttcttactttcagataaaaattactatttcttacctaaaaagaaaacacaaatagatataaattcaatttcttatatgatcttcctgtcacaaaatgaatcctctcttgaactctctgcagtgcacacaggcccccaaagggagacttactaaaatgtaatatgagcttccaattctctcctatttataggatgaccctcacctttaggagctcttcgactgccagtgatactctttcagccacccccacccataaaaacatgtagttctctttcacccagacagtagtccctgagaaaagcgacagaagtagagcccgttaggattgcaggaggctgtggtatggcagtgtctggctggtaggtgtcccatgtacccaacaagtgctctttgtcatttgtttttcctctctaagcaggaaattattcccaaccctaagttagtgaaaccaaagcttcctcttcccaacacacacacatacacacgtgagtctgactgcttgaattcagaggcaggttccatgaatggaaccataactggagctggtttgagaccaagtttataagaaacaggatccttctcattgtgcctgccctcctgtgacctgtctgcaagctcttctctatgtcaggccacctctggccccaactgtagccccaagatacctgcaggaattgggataccaaggcatcctctcatattcttttttttttttttctctgagacaaggtctcattctgttgcccaggctggagtgcagtggctcgatctcggttcactgcagccttgcctcccaggttcaactgattctcctgcctcagcctctggagcagctgggaccacaagcgcacatcaccacgtccagctaatctctcatattctttaaaaaaatttttttctaagacaagccaacaaaacttctatagctatcatacatccacaaaaagatgtttattgtggcatgcttagtaaacccatgcaaataagagagaaaaatataactgtcacatccacacatggtatgctgttaacattttgctgctttgtctttctgtacatttaatgcctttttaacaaaatattattatacttaaagtatgtactattttgtaatatccttccttagttaatgatatatcttcaacatcttttcatatttttaaatagtgctgtagaagcttagttttaataataaaatcaatttcaggctgggcgtagtggctcatgcctgtaatcccagcacttttggagatcgaggtgggagaattgcttgaacccaggggttcataagttatttatgtatttatgtttataaagacagcgagaccctgtctttataaacataaatacataaataaacaacaaaaactacatttcattaaatagtactctaatgtactctaatgcattaagtcagttcaagttgtttgcaacttttttgctatcacagccatattctaatacaaaaaaaaaattgcagctgaatatttgaatacatctatgattattttcttgggataacttccaaaaagtggaattactgagccagagctgtgtttatgggttaggatgtacttttcatttttattttaaaatatatgcatatgtatttatacatgcatatgtacagttcacatatacacatacacacatatccatatatgctcatatatgtatttatgtatgaagcaaaatggtttcatccaataatacagttctactatatatgctgttagagcacatgcaccttatggtactttatctaatcttagttgttgagaaaaaaatcatttgtcaaggaaaatgatggctaaccctgaggctgaagtaccagatagtggagaggggaagggatggtagaagaggatggtatttaccacataggaggagtgacaagtagaaaagcctggaattggtaaaagacgctgcgttcaaggtaccaacaaatagttctgtttggctggaatgaggatagaagatagatgaaagataaaaggaaagacccctgctgggtgcaggggatcgcttgagcccaggagtttgaagctgcaataagttaagatcgtgccactacactccagcctgagtgacagagcaagacttcaactcaaaaaaagaaaaaaatgtagagaccctgaagggacttgaaacccatactattgagtttacaccttgcgaacagcacagtggggctatggaaaatgccatttaaggagaggagagggtggttagatattttttttaaaaaagaaaagaatcccagtggtcaccaggtagaaacttgattgcagcgacacaggactgcagtcaggggaaaagtggggcactgctgaagttatccaggagacggggcttgtggttgcattggaggaaatggcaggacatggaggcccaggagctgatttcagagccattaagaagcagcatctacagagtgcaggaaatccagtctcttctctctgccttgggctcaatttgttgggaaatggtggtggtggatagcagacatgtgggtaccaagtaccccatatgatagaataagtactggagagactgagctgatccacacatgaaagccacactcatggagtttccccactacatcccccttcacctggatggattttccaagcagtgctgagaataacaaaggttcatcctcagaatgaactccttcaagcatcacatccccgatgtggccatctttaaaccatctccttgtttcaattaagagcaacagcaatgtgggccacagaacccggtggcgggaaccctgggctttgtttattgcctaacaccttggcaatgtttgatgactcgctgctcctgttggttgggaatctatttctttgccctggaaattgtgacttctagactgaagatgaaagatggactttttctctttgctttgtttttccttgttggttagtcactttcattcaatgtcatgctttttggcggaggtggtgccttaagatcttggacctactgagtcagttggggcaggtttctcagcagtttcctcagtgcctgccggattgtgagatgtgctggagatgggaataactttttcacactttacatgttccaggaaggacttggtggtgagtgaaatggcttcctctggcctgcactctggagattacaccatcttctagagctgggttcattaactcagatgtctaaaggacccaggcaagttacacaaatgaatccactgacaggtgtaatataatggtgatgtggcaaggactgtgattaactgaacagttcttggcttttataacagacacagctatgacaatgtgttgctagatctctcaatttttttagttcattcaaaactatgcttttctaattggatacttacaaaggaatatgggtaaaacatacatgtgaattatcaagcatactaatactatgagcacctatcaacctatctatttgaactccattcaaatagaacattgtaagtattgttcaggtttcttgagtgagacccccaatattacacacctgccatctgcagtagctgctgactaaaattgaatgtttataattccctcgttttcctctatagctttaccacatgggtttatatcccaaaacaaggtattattgactcattgcacatatacaaagagacaagtacaaaaatattcagtgaaattatttgtattagcccagaaattttcattaaaggagaatataaaaatatattgtggttttaaaggcataaagatgggctaggcgcagtggctcacacctgtaatcctagcactttgggaggctgaggcgggcagattatctgaggtcaggagttcgagaccagcatggccaacatggtgaaaccccgtctcaactaaaaatacaacaattagctgggcgtggaggcacgtgcctgtaatcccagctacttgggaagctgaggcatgagaattgcttgaaccctggaggtggagattgcagtgagctgagattgcaccactgcactccagcctgagcaatagagtgagaatctgtctcaaaaaattaataaatacggataaaccacagttatgcaattcatatggatggatgttggaaagatgtgtggcgaggtgaacaagcaagttgcaaacgtacagtatgatcacattttgtgttttataaaactcaaagtgggaggagctttcctttttcttcaaaaattctagaaatttggagtttttttgatatctcccaatttttttcatattagaaagcaaattatcatattaaaaatgcctatgactgccaaataaaatctgtctttggatgatatcctgtgagctgcatgcttctgacttctgctctaggaacttagatcaactcttgttttaacatctgtgacgcacctactatatgccagttccttatatttcgtcatttaagcctcacaacccctcaatagggcagaaattattattagttttagtcccatcttatcactgaggcacagagagaggaagtggttttcccaaagctataccaccaggaagtaccagagctaagatttgaaccccgccactcagcctcaaaaatcctatttgtaattactgtgctaaactgcctcttccctcccacctggtggttgatttttgctgaagatgtgtatgtggtaaattcacagacgacactattctcaaggttttcagtttccctggaaatagagcactgacttaaaaaaaaaaaaaaaatagtcaacctgggttttgcctaacaggaaattcacagtttcatctttcaaaaagaaattccgaactcagccaagaagccaagatcaagcacatcatggtcagcaagcatcaacagaaggttttaggttgctgtatggagtctctctggtctctgggtcaattttttatatcatggttgccctttataatgagggcatcaattctgatgagatatagatggagatattcttaaataggttacagtatgtgaagtttctgaagtcaatggccattgtgtctctgaaataaaaatacctttgtttcttctggctataaaaggaatacacatacattgtaaagtgtggaaagaaatttaaaatcacccacagatatcaccactggtaatatttggactacagcctttcaaaagctttttcacatagagatgcgtaatgtaaacattataatcatatagaggatagcgtaatccagtagagttttacaatcttttttttcctgagtacttaaggagaatatctttttccatcaacagataaagaaacacgtaaaaattttaaatggtgataaatattccattgtatggataggacatatttatttaacctattaacttcgccttattgctgaatgtgggctttattttttttaaaatttctttctattctaaacaacactgagatgaacatccttctatttgcatctttgcacacttgtctatttttctttttgggatagcatcccagaagtagaattgccaaaattatgcctgtttaatgcttttgctacttattgccaaatcaccctagaaaggataatttattgacttgcacataaagggcttgcttaatgggatttgatattcacaagctttgaaggtgctatcgcagcctgtcatgtctggggcctggaggtcctctctgatgtaaatcaaaacatttgagttaacaacattcagccttgtcagtcacccacaaattataggaggcctcctctgtctttgtcaataacaaaaaagggaaaaattactccaaaatggcataaaaattaggaaccagacaagtagtcaccaaaagaagacaagtgagacaacagttgaagaatttcagatttgtagtggagtgcagcaagtgaacaggaattgtctgggtttatagagaaaggcctgtagcatctgactcctgcgtgcttggtgacagggtcagtagcacagagctgggcacagagaagtcactcacacagacggcaagggtggaaaagtgtatagagggttgaggagcttcactctgtagtgggagggtatgatcctcaacagcagcagaatgttaatttccttaagtcttaaatcttgccctgatatggtatagatttttctctgcaactctttcatattttcagctcttgcattctgtagcaccacatgggagaatatgttactcaagagaaaatttttagtgatgtgtgttttgtcttcatttctgaaaatagtctcagttgtggaaaggcaagtaatccatgtgcagcatgattagggaaggaaggaaagaaggaagggagggagggaggagagaggaaaggaagaaaggaaggaaggaagataggaagagagaaagaaagaaagaaattcaaagcttgagtctttaaaatctttgcgtctctaaaagaaaaggatttagttatgggtctgatgcatacagctggtatttctagcaactagtgtgggcttcttttttctgctgcaatctattcattctgtgcatcttaccacaaattgctccaagaggaaacacagcctccttaggaggctaaagtccaacgaacgtcagatccagaacaacattgctttgcgtctctatttaacgttagagcggatgactttttgacacgtttatagctgacgagttctatagccagtcatgcaggacgattacgtttgaactaatttgatgaatcaacttgatgttctcccatagcccccataaccttcaggagcatatgtacccaattttcaactggaagtcaaaaagaagctttgaaatttggctaatcccatcatatccgcaggacccgtctggtggaataatcttgggacataaactcttgattgatgccaaaaatgggaagaaccacttggtaatatcatcagggccatcagtcaggcccttggtaggtcttgagatagggtttcagaggccagcgattgttttgtgagttcttgaataattttgtggtgagggaagcagagttcattgtcaaagcatttgggggtcagaccccggggaaaaatcatttctcattgttggattcagtttgatggggatttgtgagaaccgatgaggaggcgtaaagatttcctgagttacttttccccatgtcctgatttttttttttttccgactcctttcttgccaggaggcctgctagcatagtcattcagagcatgagtgtgggagtaagaatgcctggacataaatcctgcccttaccacactcccatcattgcacaatactgggccagtcacttcacttctctgcaacttgccttgctctgtgaaatgtagataataatcgttcatacccatggggttatactggaattaaatataacagtatgtacaaagggacataaacagtgcctgatatataagctttcagatactagaagctattggctatagactagtgaattttggtgactttccatgcccagaaagttgatagaacttgattaatccaaacagattaagtaagtagatgctatgatttgaattcacagctggtattattttttccccaaaatcgttagcaaaaagactattgtgccatcacatagtaaaactgattcttgctatcgagaatagtccttttctacagctgagagttactagtatgtggaaccggctgaaagcaggtggcttgctacatcataaattgggttggctgggtacttcatgtgttcattccacccatatttatcgagtttttcctactgcatgccagtgtcaatgtgtgatgtgaaaagaggagaatattttggggaaaagcgaacataagctctaccagtgactacctatgtaagcaagtcacttaatcactctgggccacagtatcttcatcattaaattgagataagcatgatccgccttctaacgtctcctgcaaggagcagatgggattgtataatccaagggcctaggtcagtggctggcacatagaaggtgctcaataattgctgtttttatgccaggaatttgttttagtcgccctctgcattgattgataaaaagctttttttttttttttttttttttttggagacagggtcttgctgtgtcacccaggctggagtgcagtggtgtgatctcggctcactgcaacctccacctccctggttcgagcaatttgcttgcctcagcctcctgaggaactaggactgcaggcatgcacccctaggcctggataatttttgtatttttggtggagacaggatttcaccacgtcggccaggttagtctcgaactcctgaccgcaggtgatcctcccaccttggcctcctaaagtgctgggattgcaggcatgagccaccgtgccctgccaaaagccactttttaaatagtaagaggattttggcagccttatagactcagatatctggagagcgtagcacaggacataggacatattatattctcgataaatacttctcgaatgaatcaatgagtaaatgactagcttgagcttactatattaataatacactgtttactagtaaatcaacacgtgggaaacaatagacagagacttgtgggagcatggactttgaagtcagaactgggtacaaatcaggcttggaaacactagctagatgcccccttggacaggttacttaatttctctgaggctcagttttctcatttacaagttatttgtaataacagctgcattaaagggttgttggcttatatatattatcaatagcttttattatagtgctgcaaaataaggtgtctgccccatagaggtattgaaaatctactcactgggcatctactttgtgccaggcactgggtactggggataaagagtgagcaagacagacaagatccctggcttcagggagatgacgaactggtgggcaggctggacaataaataaccatgatgacttttggtgaaatagaatttccaagaagataaaatagaataatgtgtttgtgagtcggaagttattttacaggaggtaatcaagaaaagctcctttgaggaaggaacatgaaaacagttaccaatgagaagaaggacccaagcatgccaggatttgagggcgagggcttccaggttgagggaacagcaagggcaaaggccctaaggcagaaatgtttgctccagggttcttttcacaccacaaacaatgaagagaatggcccatggtaaagtccaagatcctcaagagcccactcctgcaggatcttataggtcaggataaaatatttggattttattctgagtgtgatggaaacgattggcagggttttcacagctgggtggcagagtctcacttccttttcaaggtggattactccagcagctgtgaagattatagagatcaggatagcaggaaggcaagtaaggagactcctgtctagaaagagataattatcactggaacaaagaggatggcagtggtgagggaggcatgaacgacttaggacgtggtttgcaggcagcaccacaggatgtagtagaggtgaagcagagagaaggcacctggcctctgtcagcccacacgactacaagcctggaagcctcaagttgcatttcttattctctggttgcttctccactctcctctgtgatttgctgctgggtgccttgatctccatagcaatgagtcctcttttctcctgtgagactgatctggggatcaggaacctcacctctgactcccagtagaggtgaaatcagcagtggttcaagggaaagaggcaatgcagcagagactgatttctgggatgaggttttttgtttttttgttttttagttttttaattcaatatttacatgggtccacttagtgtcataaaaggttttaaaggaacttgctataaaaactcaagaggaaattaaatgcaaaccagtacacaccagatgcaagataggaatcaagaaatatagtgaatatttcctgtggtatattaattaaaatattatttccccgtaggaatataataggatgccatgatctattgatttatttattcaactagaatttgccatatatgtcgctccaagctggatatgaggaaagggaggtagataacagtccctactctcagggagctttcagtttaatggggaagacaagtatcaaagaatctctataaaagaaagcagagttcattggtttcatagcagagagtagctatttgtgtagcagcggagtgtaggtgacagacacattaggatcacttttatactacaaagattagaagtgcacatcaaaccattagcatcagatagatattcctgactgaagacctattcataagtgtatattttttatacatatttgttagaatatcagtgattaagaaaatatacacatattattcacttaaatataaaatatgtttattgatctttaggaaagacatttcacaaataatccttcaatgccatattaccaagtaaaattttcctctaactcaatgactaattccgcttctcgaccacagaaaaaggttgaatatgctattgtgtgcagagcaacaaatgaagtaaaaatttatgatgtacccacttaatttgacccacatgtactcaggatttcacgtgaggcttgggagttatttattccttgctgaaatgattctattctcttaccttgctttttcttttctcaatatgataaacattaattaagtatctgctttgtgcaagacactgtgatccgaataagcaagtcatgttctgtgatgttaaatgttataaaaataacttttattattcatattataacaggaaatttacattttgaatgtacctttaataacgtgtatgtatatgcacgtatacatacacacatatatacacatatgtattagaaagaaatagaaacacatatacatacacacatatataaacacatatattagaaataaatacacatatatattagaaagaattagaaataaaagaagttttaaaaagtaaaaatgtattctacattttattatgtatatcatatataatatagagaggttgggtttattgcattacacattatatattatatatgatatttataatctgtacataatatgtgtatgtattactatgtatatgtatgtatattatatatgtatttataatatatattatataattatatatattacataaagtatatattatatattttaaaagcatgtaacaatacatattcatatataacaaacattatttcacataaactttatattatatatgtgtagatagacatctctttaatggaatcatattgcttatatttgctgtaattttgcttttttacttagtttcatgaatatcagtttagtcattaaatattcctttacattttaatagctgctgaatatttcactttttaagttgatagtattgtatttaattatggtattagtgcagtgtattagtattataatcctcctaatgttgcatttatttattttttccctgatcatttctgttatgaggaacatcctgtcagttaaataagattctttccctatgatgaattttcaggcgccgcctccgaggtcggggcttcctgataattgccagtgtcacccttgccaggtcactcaggcacgggtcagtgagcgctcaggaagcagaggcagaaagggctccacgtgtgctatcactagtcagattattctgcacacaataaaacattcttttgtacaaaagtgaaatccctaagtcaaactgtggcttataagcagaaatcctggttagtatttcaaagttctcttagcgttttctcctgcgacttaaaagacttaaaaacgtgaaaagacatggacctaagactccaaacaaaaatacatttctttgaaactaaatagctcttaagtaagaaaaaattctatagatcttcaaatcatcccctaagcaaaatattctctaattaagtatttctgtatttccatctatgttcttcccaggcttggggctgttgatcagacctatttttacgggtaagtttctaggggtcatagaagatacagattttgacctgcttaatgtcaagaggttgcacggttgatttgtccagttgtgaattctatgaatgaagctttttgcttaaataaaacgatattcccctctggctgctgtgagcaccgggagacttgtttcggcagtgcctgggtgctggggcagggccggtggccctggatcatccgctaccaacaggacttgcctgtgtgcatctggtccaccctctctccacacccaacttcatgagatgcacaggggcctgtgtgcagagcagggcgagtctgccaggacagaatgcctgggtctgcttggttgggtctccacatgcgctcaggtaaatctcagtctgtcgctcatgctcgtattcactgtgctgacaagctccaagcttggacagcgtgtttagtgtaccgcaggatcaccttcggggagggaacgacagcctgcccggggctaaaagaaactgcccaacaagagaatcgcttgaacccgggaggcggaggtcgcagtgagctgagatcgcaccactgcactccagcctgggcgacaagagcgggattccgtctcaaaaaaaaaaaaaaaaaaaaaaaaaaaaaaaaaaaaaaaaagaaactgcccagaatttgaatgttgtacttgaaacctgcttgatccttaaagttcatttctagtcatctccatcaataagcctttgggtttgagaagcagaagcttactatcccagctaacttgggccttacaggaagattgggtttctcccctggggaagagtggagggttgctgtttacggcctgtctactcctaccaagcactgtgctaggcatgatgaatgcctttcctgctgaatcctcttctcactaagagtattgatcatctccatttcacaggagaaatggatctgaaagtgatgacataatggctgccttttcttagaaaatcccaaaccctggcccctcctttaggtgcctccccaagctctcattctgtctacttctttaactttgtcccatgtccagcctttccttcctctggctacaccaaccgctttttaacacatgttgcttaacacatatttaatgagggtctacctgtaccaggtgtgaataaaagagcatccagagagataaaggtactgactgttgttattgagagatactcatgcagacatatgtatttgttagaataggtattctaacaaagttcttctgggtccaagggccttttcacttcttgttttttttttgtttgtttgttttgttttgtttgtttgtttgtttgtttgtttttgagatggagtttcactcttgttgcccaggctggagtgcaatggtgcgatctcggctcacagcaacctctgcctcccgggttcaagccattctcctgactcagcctcccaagtagctgggattacagtcatgcccggctaattttgtatttttagtagagacagggtttctccgtgttggtcaggctggtctcgaacttccaacctcaggtgatccacccacttccacctccctacacttttcattcctgccatctggaacccttctccttcttggtctacacatggggggatgtgctttctcaccatctcagtgacttcatccactttggaacctaccccgatcatctgattaaaaatactccctgttcccagccatccttgatcaccccagagaactttccacactcttgttgttctttaatttgtctacatgaatatttctcaacaacaagtgtcagtacctttttctctctcgatgctgttgtattcacacctggtacaggtagatctttattaaatatgtgttaaccaaataaattgaacaaatatttataggcctctttctgtgcacttgacactgctctaggcactggggatacagcagtgaacaaaacaaataaaaatctctactctaggagggaaagacagatactaagcaaaagagtgaatagttggtcaacatggtgaaactccgtctccactaaaaacacaaaaaattagctgggtgtggtggcaggcacctgtaattccagctactggggaggctaaggcatgagaattgcttgaacctgggaggaggaggttgcagtgagcagagattgtgccactgcactctagcctgggtgacagagctagactccatctcaaacacacacacacacacacacacacacacacacaccagtgaagagggccggctgtggtggctcacacctgtaatctcagcactttgggaggccaaagtgggcggatcacaaggccaggagattgagatcatcctggctaacacagtgaaaccctgtctctactaaaaatacaaaaattagccaggcgtggaggtgcaggcctgtagccccagccactcgggaggttgaggcaggagaatcgcttgaacccaggaggcggaggctgcagtgagccaagatcgagccactgcactccagcctggagacagagcaagactccgtctaaaaaaacaaaaacagtgaatagttagttaggacctcagggagagatgcacagtggtggtggggtaaagcaatcagcccagagacgaggcctgtctgacaaggtgagacctgaatgaagtaaaggagcaagtcatggtgatgtctaggagaaacatgttccaggaagaagcacaaaagtcctggggcagagtcatgttggtcaatttggagccgcatggcacctgtgtggctggtgtggagggaggagggctaaatcagagggcaggtgtggggtaagtggtgcaaaggcttgtgggctgtgctaaatatctcagcctttggtgtcaaatgcaatgggagccatggaagggttttgagccaaggggtggcatggataaatgaatgaggttacacaacttgagagcagagaagctgggatacaaactgggctctctgagtgcagtttgctcccaccccgtccccccacccatcattgctgcatctgtccctggccacgtgttcttccctgtgcattttatcatcaaagtgaggccttagcctttcacggaagcctggttgtgggggcttagccctgacctggtggcagggtccattttgttttgtttttcctgtttgtttggggacttagtgtccacccttggacccaacgacccttacccaggtgcggtgtcttccagctgatcccacagtggggcccaggttgcatcagctcagccttccttaggcgcagcatttgctccctccccgagtttgacaccccacagcctggcacggtgccaagtatgagtaaattgggctcagggttcctgttgttcctattcacacagcagctgctttctttaccgtgccatgaacctgatctcctggcattgtcagtcagccctctcttctcaggtgccaaggggaaacgaaactggttagtctctgcaggaagctgagccgtctcctaagtgcccacccggctccttgtgcactaattaccagacagtggactgaaccttttgcatattttattagtgaggactctaagtttcgagtgattggaaacccagtgggtttaaatcaagaagattaatttatggcccatgtctccaaaaggccggggaggccttggcgttgccaagttggacataagggctcaaatgactcatcagaattaggtcttattctttccatctctgctttcttctggaaacttctattctcaggacctagcaagatgccaaaatcagattacatcctaatatctcaataagcccagatttactttttaacatttctagtagacatctgggaattgagtctccatgcccagtcctaagcctgttgctttgcccagggaatgcagttctctgatccgccagttctgggtcacccattcagccctggagccagcctaggagtcagcccatgtgaccctccaggaccaacgacataaaggggacagtttctcaaggaagactagggtcaaattaccagatactggataggctaatataacagatgccaagtcacgctcactcttttagttaatcctcggagaaccctgtggcatagtaattatcccacactgcagatgaagaaggtgaggcccagagaagttaagctggccaaaagtatgcagctggtaagtggcagagccagcatttgaatacagattcgcctttctgcaaaatccatgccacgagtctcctgaaacttgaaagaaaagtgttaaaacaggatcgagatgatccttgatacccactgcctaaagcagccctactggcatgagctcattccttcttctaacttctttgaagcatttcaggtgaattggaagtctgttttccaggaaatctgattatggtggcaagttcctcccagcaagaacagagaggagcattctgagattttcctggaaggaaataagcctctcctacattgcagcatattacccaaatgtgggaaaaaaaaaacatatgcccatgacattctcttatataaatgtgtgggggcatgtttcaaaagcatatatattaatatcttctgtgtgtatgtatataaatataggtatttatccctctgctggattcataagcatcgagtgattcaaacattaattacaatctccttggtgagggaaaatatttttccttctatcatgttcattttaggatcatctgaagttcatctttttagagggtactgaatcatctggcaacacaatgttctttaattgttagattgtatacacattttggcgttactttttctgaacctcctactcccttgatttttattattaactgtgagaaatcacttcagtgtgctaggcatatacattcgtatatatacacacactgctattattatatataatctcaataaattctgacaatgctttgaaagaggcagtactattattgttattatggatgaggaaagtgagtttaaacaatttgcctaatgaaacatgaagatcatagggaatgatggaattgggactcaaatttcgagttctttcacttcagaaagtgaaagtcagttactcagcctcagaacaactgacatttatccatgctattaactactacactattatggaagtagagaagaaaaaaaaaaaaaaaacactggaattccaagcttccaaggctaccaaggaggctaaaacatctattggggatttagtggaaaatttgcggaaatctatcattgttataagtgcatatgtttcgatccagcaattccactagaaatgctggcacaaatgtgcaaggatgtaaatataaaaaatattcaatgcagtattgtttatagtagggaaagctggaaatacttaaatgtccatcactaaaaagtcagttaaataaattagagtgcatgattccagtggagtgcagtgtcactgtttcttaaagtaggcagaacctctaaatacaggcatgtggacaggtaaataagaaatattttaatttttttaggttggcaaagaaagcataattccagttttaggggaaaaaagttagcatctatgtctgcatggagacgggataaaggtgaatgtaaatttgattgtgcataaaaaaattgctggaaaaatataaatgaaactggtaacagtggttacatcagggaagtttttattctggggaagggatgttcagttatactttatatgccttatttatactgttctcaacaggaggtggttttgcctctcaggggacattaccaaatgtccccgtttttgttgtcacaactcagggagtggggtttgctactggcatctattaggtagagaccaggaatactgataaatattatcaattacacagaacagccctcacaatgtaggatcatcctgcccaaaatgccaatagcaccaagattgagaaactctgcttgtaaccctaagtgtctgagtttattataataagcattcattaatcttgcacttaaaaaaaaaatctctgaaacatagtctccattctgatacttgagtggaattattgctgctgctgccttcatagatcaaatcaaagtcacaactttaatactttggccatgtggacataatatactttttcttccattaccagaacaatttcttcattcgaatataggatttgtatatatttatctttcagtctcaaagataggcaatcttataatataggtcccatctcacagattaaaaaaaaaaactgatacctggggaagctcattgttttcatggacagccaatgccagctagaaccttggtaaacaaatttaatagtttctggaaatattaaattgcttaatctcaaacatctgtacttcgctggagactcaaagaaaaagcactgagctatattttcagttctttaattgggataagaggtaagtttcctaagtaatccttcattctctatgagagggtatgtactccatcattttgtcctccgaacagaaatacttcctgctcaccgggcattcacatttcagtttggagatacagggtgagtatcccttgtttgaaatgcttaggaacagaagtatttctgattttggattgtttcagattttggaatacgtgcaaagagcatccctaattcacatatttgacatttgtgatgctccaacgagcctttcctctgaacgtcatatcagctctcaacgtttcagattttggagtcttggatttcaggttttcagattagagatgcacaacctgtgacacatatcttctgtcatattccgctctgtagcgtagccatggtgtgttgggttttgacacatcaacattctgagtgcaagatgatactgagtgtgactggtgtggagtgagctgcgagtgaagtttctaatgaggaggaaaagtgtgctgtaaaatctgtcatggtccttgtgacaccagtagctctcacttagcaagacactagctacggccatcagcgtgtcagtggctccaggacagaaggaagttgctgagccaaggaccaagacttgaagtggcctgtgttaagcacccccttcaccaactctgaagtgtaagtcacagagttcttggaccccagccccagttccccaacctttaaggatgcagacagtgctgcttgtatgttttggggtgctttctttctttgtttgtttttagacatggggtctcactgtgttggccaggctggagtacagtgatgcaatcacagctcgctgcagccctgaactcctgggttcacgggatcctcctacctcagcctcctgagtagctgggactacaggtgcacaccaccatgcccggctaattttttgaaaatttttgtagaaacggggtctcacttttttgcccaggctgatcttgaactcctggcctcgagtgatcctcccagagtgctgggattacaggtgcaagccactgcacccagccctttatttttaaaaaattaattctcatatttgtcaggatgagataagttatgtggtgacaaagaaaaatccccaaatctcaatagcttaaaacaacaaagatgcatttaccactcacactccatgcccacagtgggtcaactgagggcttcttctgggactccagatgactagagcagccaccatctgacaccagcatggcctgcccctgtgagaagggaagagtacagcgggtcatacgctgactctcacagtgacgtcctcacttctggtcacatttctctcaaccttccgtgatttcaaaagggtggggaagtgcagccagaaaatacacatgagaatccaaaaggagaagagacccaggatatttgcaaatggttctagtgatttccacagtccactggtagttggtgtaaacatcatgtgcacatctgaattcctggatccttttgagaaatcacaggaccttgggacaatatgcatggtgtaggaaagggggcactcacgaatagtgactccgtttagacgagacatttccccctcagttcccaggctctacctatcctgattcattcacctaaggaatcagctttgtccctgtaggaatttggattggcaacttttgaattaaagtctaatccagtggtaacagttcacccatggagtcagataacctggcttcgaatctgggaaccacccttatggctgagtggatttcactctctgcacctcagcttctctacctatgggtagtaatcccggagggatgtggtgaggcataagagaaaatccatataaagcacttaaatgagtgcctaggacagagacaacacaactgttccatcatcgtcatctttccaaagtgccactctgcatgtacctttaacttacacacacaaaaatggggtcatacagtaagtgctgttgatggacagatattgaccagctctgctcctttctctgtatctgtttcctgtcttataaatcaaaagggtcggctcagaagctttctgaggtcctttccaattctgacattctgtgactccaagatccaaggagggcccccagattccttcttgagctttcaaagcattcccgatgtgtgctttagagtgggtctggacagtgtatctgtcaagggggctgcaggcaagaggggagacacgaagccaaactatgagacaagcatgggaacagccttaaccgcaagctctagccttgaacccatccaaagaacactgatgtgagccaactgtgcatatctgttgattaatcttcccaggaaatgatgttctagaaccctccacagccacgtgacctccgccgccaacatcagccatcatctggactggtcttttcatccagggcactcgatggtggctagcaaaaggacccccagcccatgctgaatgccaggatttgtatttttatcttgccctgcaggctgcctcgccttgagcaatgctgtgtgatgacagagatattatcaccctaagctaaaatattcaccaataacgagacaatgaaaacagttgctagaagtctgcggtgaatgcagagggagcaaactctgttaattattcaggaaatcctcttcataaattcatttagatttctgcaaatgagttagtatttgattaaaaaaaacaaaacaaaacaaaaccctgggaactcagcccaagcagtagagtaggtataggcttgaacaagttcaggaatcagacagccttggacgttcagccccatgaccttaaacaagtctgtgccccctcaaaacttctgttacctgtctacaaagtggggatgctaatactaacctgtggtgttgggaaggtggaactaacaggatgcattctgtgtacttcacaaaaggtctggctcatgagcccttaatgcatgttatgaacagggtaacttcactgtggctttcttattaaccatccctgtgtatcgctctaaggagagggcagagtctcaaggctattcatgtttgaatgaaggtgctggaaagagacagaggcgtaagggatcctgcatgcctcatatgaagacacatgtgaacacaaggaaacatggctccagtgttgcagctgcttctgatttttcaagataaattttaaaagcataatatttatttgaaacctcctgatttttaaatgttaacattaaacaatgccggtttggcttctgtaaaacagactctaactcttcatatcctgaaagataacatgactttattaaggtataatagaagcttgtttctgtcttatataaaggtctgatataaaagtctcggtaagtggttgagagctagcaggacacttcttggtgttgggatcccaagtaccttctctttggttgctctgccaccgtaacacaaggcttccttctgatggtccaagatggctgccctggattctaccattatatgcacattccagccagcaagaaaggaaaagcagtggaaggcaggcccctctttttaaagatataacctggaaatcacaaatattacctccactgacagctcagtgtctagtgcattgccacaaagctgtatctatctgacagaggctgggaaatgtagtctctattctgagtggtcaaataccaagaaacaggagatctatgagtgaaagaaaaaagaaacaaagctacaacaagtaattcagacttaagaaaaacactatgacaaccaagcaaaatacagtcacgggccattttggagcaaaaaaaaaccattctttactgaggatgtgataagagagtgtccttataataaaattcctgtgtgttaaaactactgctgccttcaacatcaaaataggttccatgcatggagtgcataccccatgcatggatgtggtgttaggtgctaaacatacatagattttcgctgactctgaaaacagccctgcaaggtagacaccgtcgcacttttaattggcagtggaaacggaggtcagaaggggagacgggatgtggccaagttagtaaacaggttcgtaagtggctgagtggcgatcccatctcaggcctgtctgcccccagcgccttttgtggtactctgtgcttgaatacagctggcgctgaccttcctctccgctcaacattctgcatcattctccatcttgtgcaaaggaggaactgagagccacagtgtcacaacatggactccagagccccagggtagagccgatcaaagacagcccaggacccattctgacttctggcctttcccgttgttctttgatctttgttttcataagttacaaattcctccacctacttacatttttaaaagaaggggaggagagagagagagagagagcaaaataataacttcttagccggaactgcttttcttcaaaatcacgaataattgttttcctgctctgtctgggaaggcattcccctctcatcttttgcccaggacttggcaatccactttccatctccccttcgcttgtctttctttagcatccacgttccgtgcaatccatcatcagagccattaccctcctcctgatcaagggtggaatggaaaagctccctctcccttcaacacctaccaccagctctttgatttgccgggcgtgggcagcaggaaagtttccggcggatgacctcagaccctctccatagagagccccaccagcagctcatcaccatcagtctgcaaagtgagaactcaagtcaggctctttggaaacagtcagcaaatggcttctagttcactcagtgcagaaaagcttttcttttttccccttttgtatgggattttgtgagtggggggttctaatagctgctcactacacacctccagccacccactgggcttgccagtgttctgtgcaacacgccctgcgtcacaggtttcaataacaacaaactctgcacatttttaaaataaaaataaaataggtcagagattcacccagctggccagtaaaccagggcaggatttctctcattcattctttattctaccgaaactgtctgaaactcagtcttcatgcctatgaaatggacagaataatcatatctatttcatgaggttgttgggagtattcattgacatcgtgtttgtaaaatgcccagaagcccttacaaagggcgtcaggccctttgtaagcaggaaaggaaagctggcttggatgaacatcggctattggtactgagctaacaaagcagctatgaggaccaaagaggggcccctaatcccttctctagcctcttttctcaccattccatgactccaattttgtgttctgacaatgtcagattccttctagtttccctcatgcaacatgttctgactgggcccccagctcctattcacggtgctcttccagtacgaattcctgcccccacccctcccgtcttcatggttaacatatattcaacctaaaactcaactgagaggtcacctcctccaggaaccattcatgattgcctctttacttttcccaagctgaggcacatcccatccccagtgacgtagggagtcttagtttatctttaatttgatttttcagacattttatgttttactgtcttcaccattaggtagtgccctccataaaggaagcgcttgtgtcatatatgtctttgaattcttaggattcagcttgggattgtacactgaaactgctgaaacacctctcagagtagacaaggaaggaaaggagagacgaagggaggtggggtggggaaggagggagaaagaaatggtgaatgaagcacacagcacagtgccctaaggggaaaaaaagcagcatttgaatcaatagtaggtactttaggctgggcagtggctcacgcctgtaatctcagcactttgggaagccaaggcaggtggatctcttgaggtcaggagctcgagactagcctggccaacacggtgaaaccctgtctctactaaaaatacaaaaattggcctggcttggtggtgcatgcctgtaatcccagctactccggaggctgaggcaagagaattgcttgaacctggaggcggacgttgcagtgagctgagattgtgccactgcactctagcctgggcaacaaagtgagactcaatctcaaaaaaaaaaatgtatatgtgtgtatatatatatatatatatatacacatatatatatgtgtatatatatatacacatatatatgtacatatatacacatatatatgtatatatatatatgtatgtatatatatgaatgtttatatatagtggctacttaaaaagtgttttgtgattggtatatttagttgttcttactactgctgccgatttactctcactgttgctaaccaaagagcagagttaagtctgcaaagaaagataccttcccttttcaatgatgaggttagtgtcttcacaaataaagcatctgataccttagtctgatacattagatacaaattatgactaataatttgccccattttccaagttttctcttgattgtgttgattgactcaataacgactcagctcctgattcagagatgaatcaaagaatgtcttgcccgcacggggctgtgagtctagatggagagacattcgtagggagctgtgtaatgtcagcagagacgtgtcataggaagactgatgaagcagacgatggagaaagttgagttgagttggttgctatttaaaaggggttgtctaggaagggtctttgataaagcaactgaataaagagctgaaggtagtaagtgttaagatcaaaggatctttataggagatccaaccacctccctctaaatggtagttcttggtgtgctgtgtgtaaacctcagagtatttgcagaaaggagataactatttgggagctgcgtgtatcaacatgttccagaatacataggatgttggtagaagccacctgaagataaaacagtctgttgattctggcaaaatagataaacaatatttactatctttactctagaactctttagagctttcaatagattaatacacattgcagatctccaagtgggaactagagcatttagtatttcctaacagaactccttattcaagaagcatattgtagctgggcatggtggctgactcctgtaatcccaacactttgggaggctgaggtgagcagattacctgaggtcaggagtttgaaactagcctggccaacatggtgaaactccgtctccactaaaaatacaaaaattagcagggtgtggtggctggcgcctgtaatcccagctacttgggaggctgaggcagaagacctgcttgaacccaggaagtggaggttgcagtgagctgagattttgccactgcactccagcctgggtgacgggagcaagactgtgtctcaaaaaaaagatattgtaccacttgtattcagaggaatgaatgtattttggtaaaaatgacttttgagtgggtaccaaatctaaagaaatattcttatcatattactctgtggcgcacgcacacacacacacacacacacacacacacacacacacaattcaggtggatttgcactggagccctgtaagtattcaagctcttttgctgtagagaactaaagaaaacatcaagatatcaagtagttttattgatttattccataatattttctggaacatattggcttgtctgagttacttacaggccttgccacctggcaaaaatcatttcaaattattgggaaaagagccacagaagtggaaaatatcaagaatatgggctccgactgcacaaggctggactcacacacaagccctgccaagttctcacacgagtctccgtttatgttgcttctaaaatggggtccagttgcaggacaaatttttgattttaatcaaaagaaaggtgcgaacccatagaacggacctttgcaggagaaagaaacaattgtggatggatgtgaaaaccgaggcagctgttgcttcacatagataatatgcccattaccttttggaacaaaattaaacatttttaagtgtattaagatacacataacattgcaatttatcatctggaacattgttaagtatacagtttagaagtgtcatgtatatttgcatggttgtaccaccagtctccagaactttttcatcttgcaaaactaaagctctatacccatcaaatgacaactccccattctctcctactccccagatcctggcaaccactattttatttcctgtttctaagaacttgactattttaggtacctcatgtacgtagaatcacgccacagttgtctttttgtgactggcttatttcacttagcacaggggtcctcaacccctgagctgcgggtcgctactagtcctttgcccattaggagccaggctccacagcaggaagtgagtggaggaccagcaagtgcggcattagattctcatagaagtacgaaccctattgtgaactgtgcgtgtgagggatctaggttatgtgctccttatgaggatggaatgcctgatgatctaaggtggaacagtttcatcccaaacctccttcctcccctgagccaccagtccttggaaaaattgtcttccacgaaaccagtccctggggcctaaaagggttagggtactgctgacttagcataacatcttcaaggttctgtgataacatgtatcagaatttttttcttctttaaggctgagtattattcctgtgtatgcatatactacatttcgtttagtcattcatctgttgatggacacatgggttacttccacctcttggctattacgaataatgctactacaaatacagtatacaagcatatatggctgtacaaatatctcttagagaccttgctttgattgattttggatacatacccaaaagtgggattatgcctgttagattgcatttcttaagacagctctattgtgatacaattcatataccataaaattcacttcttaaagtataaaattcaacagtgtttcgcatgttcacgtagctgtgcaaccgtcgtcgcggtatctaatttagaacatcttcatcaccccaaaaagaaacttcatatcctttagcattcacacctccttcctcccttccctgagccctaggcagcctccggtactggtagagagactttctgtctctatagattgacctgtttggggcctttcatatacacggagttctacgctatgtgatcatttgtgtctggcttcttccacttagcataatactttcaagattcgttcatgttgtatcagcacttcattcaattttattaccaaataatatttcatgaaatggatatgccacactttatttattcattcatttgttcatttgttgatggacatttgggttgtttctgctatacccattacttttgttccttgccaatgactgcatatctgtagcctcataacattcagaatttcccttttctctaccaaatgtgcttaggtttcagggacaaacaaggtcctctgtgaaaaggtagccaagagaacggtctaggtagcagacaatggattcattcccccaccatcttattccctccaaataaaaaaggaagaaaaagaaaactgcttccatttgtcttaaaagctatatatgtatgtatatgtgtgtgtatatatatatatatatatttttctcgatatctaatggaagagacttgtgctctttagggaaatcaataggagggataacaaccgattatactatgagaaagaaaattttaaaagactctttggaaatagcgcatacataaaacatttttgaactatctgcaaatgtagaaattatgcctcaatgcaagggatccatgccaaagtaaaagtctgctcaggcttttatgaatttcagtgttagtggcaagtttatcactccagtatctgtgaaagccactgcatttgtcccatgttgtccattgccatgagaggaaggggctaccctgtctaattagtgactgcgccctaactgaactcatagtgttttctgtatcacagttcttgaccacgtatccaataatagcattttgattttattgagtgccagattaaaagatccttaggggtttggacaacatatttccttgctctggaattgaaaagacatcgaagtcagatccggagcgaatcgaggaacgatgtaccacaaggtggcccacacaaaagctatgtgggcaattatctcatgatttgagcagcctgacaaacttctcccttctcactcatatttcacacagatgcagccacggtccaactttgttacaaagaaagagaaacttgtcatttgtttgatcatcagcatggtgtaagaatttgcctgtcacttgtttaggataatggctgaatttttcagttttcaattgatgcttggcagcttcgatgtgttagattgctctcaaacaactgaaagaaatccacacatcctatccattgtcaagctcatttagcagattattctaagactaaagtaagggaaggtagcttgtgctatgaatcttttaagaaaatattacacagtgtgaacaaaagcaaatccgcagaactttaaaatgtcagagcccaaagagaacttagaaatccttccattgaaacatctgaaacctcacatgcccacagagtccaggcaagtagcaagccaacagcaagagatgtagattgagtctttgccgccctaggaggggttctagtgtgccagactgtatgttttcataaaatttgcaaaagtaagatgtttaactttaattcattaatagggctgtcactttttgacatcctcctttttttctcccttatgttagggtgttagatggcattggagtcaccccaggaattttgtattcatgggctatgggcactatacagcttttaaaacttcaggatccacaaaaccagcaggtcagatagacactatggcaaagtggaatgctcatgctcatttaaaggaggtgtttttgcttagttcctgacaattactgtcaggtgagaattgaagggctcagtgtggtcagttctctcaagggaagccagaaatccagatttatatgtcaaatcttctgatttcaaaatgttgataactaaccgaacaacactaatctgaaggctgaacttgatctgtgggctgtcagtttttatcctcaggctaaattcaacccttgctattgatgacaaaaaaagcaaatgaacaggtctaaaaataattaaccctctatccacaccattgtcttccacaggttttatattgaaatcatcaacctggttttcttataatcattcgttgagcatttcttgagtgttaagtgtgcattttaagtacatttgggtttccctcaagcttagctcttgattaaatgagtccaaagtagtccacatccaggttcagagttaggagacaggactggatgtgaaattatctcactgtgccaggattttgaaaacaattcactaaaatttgcaataattcagacaaggcttcagatacttattaagagaaaagtttcaaaaagtggtgtgggattttatatttatggacatgttattgtaatcctgctgttagttataatttttttgcatgaactttgagtgatttatagtacccagaggtaatgaatccattcccatttttactcctcctctcgttggaacatttgcatcagttttctccacttctcaaacatttttttcagttgatatttccatggctggacccttcttatcactgaggtctcaactgacatgttacctctttaaaaaaatctttccagaagatcttagctaaattcaccaactcccagctctctatcccaggggcagataaactatggctcacagtttgaatccagcctgcagtctggctttgtaaataaagttttattggcactcagctacatttatttgtttacctcctgtccatggctgcttttgtgctaccccaggagacttgagcagttgcaacagagacagtgtgacctgtgagtcccaaactatttactatctggcccttgatggaaaatgtttgccaacctaagacttttccattgctattttattttcttcacagtaatgcttatctgagattacttattttttacttgtttgcttgtttgtttctgaattctactcttagaatctgagctcctcaagagttattttatctatacctagaacacagtaagtacacaatatattttggttgcgtgaacttaataaattccatgcttcagccttttttcttatagcagagagggctcctaaagtccttctgtgcaggtgggtcctaaggatcctgctgcttttcagtactacagggaatatcaggccaagttttttattgtttctggttgtgcaaactggaccaactatatacactgaaacaggtgatgcctaagtaccagacccttgaactggatgaggaaaagccaagatgggaaaccactggaaaacatcgcagtctattgattctgtgtatcatttcgcccaataccgttgtcgttatcaagggctaactcttatttgtcaagtaaagaaagactacaggttcaactgacttctaagttagcaaacattttggttcctccctatctagttaaataaatgagtttctttttctaaagcctcaactcacctaaggacagggttctttgtttttctctgcttaattgcgtcatattcctccataccaactacacaaaccccagcacacactcagctgcagattaccatcctgtgttcttgtcacctcatgcattttacctgctggaaataaatgctcacactctgcccaatcccatctttccctgcacctggacatgcttcagaactccttttgtctgttcctctctctcatgtgcctgaactcttctgtgacttagaatctctagcacatgattcagaaccttaggatctgtccagtggcttcttgtctgttagtaatttttgttctctcaatgatatggtgtggctgtgtccccacccaaatctcatcctgaattgtagctcccataattcccgcgtgtcgtgggagggacctggtgggaggtcattgaatcattggggcaggtttttcctgtactgttctcatgatagtgaataaatctcatgagatctgatggtttcataaagggcagttcccctgcaccgctctcctgtaagatgtgcctttgctcctccttcaccttccaccatgattgtggggcctccccagccatgtggaactgtgagtctgttaaacctctttttctttgtaaattacccagtcttggatatttcttcatagcagtatgaaaatggactaatacacctagtaccttgtaagcatgcaccatttttactcatatttatatcttcctcttttactcaatttgtgtttgaccgaacttgaatctgcagtaccaggcccctggcattgtgctgggagttatgccaggcactaacaagaccactgaaatttcccagacgccctacaaccttcctttgggagttcccataccatatagtaataagcctgttaaaatgcacccacttgccaggttatgtatgtttttttttcttttaagaaatcataataattcatttgctttttatgttgttattatttattataatcataacttctttttatgtctcaaccaatgcatatttggtcatatccccaaggatttgaagtcccttgaattttttagaggcccaggagaagctggtatacctaatataccatgccccaaatacctactgtattcatactgctttagcagccctggacactcacagaaacagtgatgaacacgcatggttcttgtcctcagggagtccagagtccagggagtgaggtgcaggtaagcacgtggtaatagaaaactgtgagaaagtccattgtgaaggatgggcagaagctaaataagatttgaggacatggacagaaatggggtcaggaaagggcatggaggtcccctccctggaggaagtaatgtcttagatcggtggtccccaaccttttgggctccgggaaccagtttcatggaggacgatttttctaggactggaggtagggggatgatttcaggatgaaactgttccacctcagatcaagcataagttagagtctcatgaggatcgcacaacgtagatccctcacacgtgcagttcacaatagggtttaggcccttgagagaatccaatgtcactgcagatctgacaggaggctcagctcgggccataagactctctggcccaccgctcaccacctgctgtgtggcctggttcctaacaggccacagtctcgtactggtatgggtctgtagccccagagttggggacctctgtctttgatggcctcaaacaatgcaaagtggaaggatccaacttgaattctgcctgtcaaaacacagccaatttcccccaagttagccttgataaatctacctagtcaacaaactaattcacctgaagtcacaatcataacaggctacagtttgtgaggcctgatgcaaaatgaaaaggcagggccccttgcagaatttcaagacagcaacagcagggcattaaaccatgtatgggcccttctgagcatggggccctgtctgacagcacgggccacacacccatgaagctgaccccgttagttgttctaaaagtggggccagtgtcattcaaaagacagtaggagaaaaaaagcaccatggactaaagccccaagtacatagcagatgctcaaccaaggtttgtggaacaaggctgagtttctttagtttattttgcttttcttggaaataggcctgaccaggtggcaaatgtctgtaagaaagcagttactttgtcattttccctttctagaagctcaggacagatgcagagatccaggtctggcctggggaaacatgaccagtctggctgccttttgtcttggagatgacttgggtattaatacatatatttcgtttgtttgaaatatatacatgcatttaaatctgtatacaaaaccttttggtggacattttctccacatcctatcctgacagaagatgacgataaactcatgctagtgatttttattaagtctcattgagtgtattttcagaagctgccacacaaggaaatgtactaaacattttttccctgtctgtaaatgtgagtagtcttgaattgccaagccaggtaaaatgagtccatggataactcttaaatgtattaaactcctaaaatattagatccttctgcaacagatgaggtttggtagtgcagctcattagcatttgaacaaattagtgagacttttaaggcatgttgttggattgagctaagtagatgaacacagtgaattccagaccctaatgactccatttatcaagggagcaggttttaacataatgcataaacctttctcacatggccattttactatgcatttagttctattgcaacatggtgctttgggcagaggaaatgaaaaacttaaacaaggttaacattccgagaaaagactaggaaaaaataaatacccccgtccctccccaaatgaaagatgatttacaaaaatgaaaatctgtatcgataacagagtcttacagatgacaaaatataccagtgatggtttgtgactaggacatgagctgccatttctcctgaattcatatccagttttagggataatgtaatgaaaatgttttagtgtgattagtaagaggttattaattggttaaagaccctcctacagctttgagatttattttgaggacaatgaagaattctatctcacttattttgtttcacgttcctattgactttgaaatgttgtccttttttctgtttatgtatgcttaagaagaagaactaaagcgactgtctttcttcttactcaggaagatttgccagaatttaacactaacacttcatccctttggaatacccagtcgttcaaaattttttgttttgcctattagtgatttaaaaataccctagcttcatgacatttgcagatgtagcattatggttttgtctatcaaggaggcagccaaaggccgagggtttgtattgtgcagggtggcatttatatgtaaaagtgtgtaattttactagtgagctgcccagagctatgtcgaaatgtagatttgcggcttctctcttgggctacattgtctctgcctgccagtgtagttgtaaagcagtacacacaaaacaggtcactttttacaaatgacttttgattctacatttatacggccattaagaaactaaagaagtcaaaatttttcagatctacctcactgaattttatgaaggaaaagatatgctttggtagattcataaatttaggggattttgagggctgtagaatgtatctccaacaaatggcaaaggtctatggcaaataactctgatttctcaggagctgtttccctgctactcacataaaaaacacttcactactaatacctaaaacaaccccatagttgcttattctatccaaactattatccaaagttatttccttaaaaagttgagtcttcccaatttccctgcctccctaatgaaactggttttctacacggtgctaggcaggacacaagtattgacagaataagttatgctaagttagatagctgaaactggatagaatttccatcactcagaaacagaaatgtaaagttggagcttaagcatggagcttagcaatttgtcttccatcttcagaaaactcaaaattatacttacgtagtaaaaatgggttaactaaataatatcctgaatagaaggaagagtgtttaaaagtgttttttcataaaagtgagtaaaaatattaaaatatccttctacacaacagtatcctttaaaagtaataaaaccccatcaaaaccgtggatatcaacagccagatttttcaccatatcctggcagcactcagaagtcagggcaggcctctcttcctcaatgaatccttttcctggttttcacagtctaggttgggtggtggtgtttcatttccttagtcattctatattcctatccattatcatacttattacatattgcttcattgttttcttatctgtctgtcaattcaatgataagtaccttaccggtaggtacaagatcttactaaaggttcctttcttggttctaagtacaaaattgacactgttgaaccccaaagaacatttgtgaatgaattaatcaatgaatgactgaatgcaaccctgaacgttttttgaagcttcagatattttgaacgccagaaatgacaagaaaatagaggtaaggttggagaatttcaatctttactctccttttaagcacatagaggaattctaccacctctttcaataagaatcagcaatgcacagatcaccagcacatgcgtcagagagagtccattgtaggggctcaacatatattcactgagctaaacccaaatgcatttgaacttctgcccagtagcttgtcaaaagacaccctgagtcattctaacagaggatcataagagatgaaaaggaaaagatataagattatgaaaacaacattgcacatctagtctggacttctctaatctgcccagtggtgaatccaggcagcaggttatgaagatgctgggagatttcctgtgtagagttgttgagctgaactagctttctcaactattcatgttaatgtgtcaccagtcttggaactttcttttactgacaggttgtatctatttttcctattctgtttttgtgaactcaacttaaaacatcatccagcaaggttccagaaagactccaggcttcttagtgagatgttatccaaatggcttgattctttggatttggcactagaaagagacatgttttttatgtatgatttaaactcaaattccattttaaaatcaacgaatgtgcttcacccaaccacctcaaatctcagagacatggcccacttgaaataaaggttaacaatcttcaagtttaattcccaagcttttctgatatcattttcccaattatagattgcatcattttttcttccctatgtaaataagtaagtctgggctgaagttaaaacacttaagcaagaattagcaaggctttctttaaaaaaagtaggccatatatcttccaagaaatctctatgaagagatgtgtttttataccttaccaggaagcagctgtggtacaagagtgggaacttcaactcttaaaagctgtttttaatctcaactaagccacatcaccagttaacctctctgattttgtcatctcatctgtaaaatggaaattaattgtgccttccctacagggctattatgaggataaaataagacaatcaccaggaaactgcttggcaaattgtaaagtgcagtataaatataagagatattaactataaacggtcatatgggaggttttcgagcacaaaacagtaagctagagaaaattctgaggcagtgcaaattcagaaaggaaattataaaagtaggtataaccatcctaatagttgtgacaatgtaatttcagaatattggtgagttacaacatataccacatttaagtgtttacaagtgttagtgtttacaagtgttagtgtttcttgaacttcataaaccaacctctgttacctttcaacttttcctctgcagcttcctcatctccctcagccttcacagaattgaagagagttagggccttgctctggattaggctttggcttaagggaatgttgtggctggtttgatcttctatccagaccactaaaacgtactccatatcagcaataaggctggttcactttcctatcatttgtgtgttcagtagagtagaactttttattttattcaaaaactctttgttggcattcacaacttggctacctggttggcacaagaggcctagctttcagcctgtctcagctttcaacatggccttcccaactcagcttagtcatttctagcctttaatttaaagtgagagatgtgtgcctctgcttttcacttgaatacttagaagccatggcagggttattaattggcccaatttccctaatttcaggaaataaggagggctgaggaaagagcttccctatttccagtttgtttggcacccccgaaacaattacaacagtaacatcaaagagcactgatcacagatcatcataatagatataacaataatgaaaaagtttgaaatattgcgagaattaccaaagtctggcacagagacttgaagtgagcatgtgctattggaaaaaatggtactaataaacttactggatgcaggcttgccacaaaccttcaatttgtaaaaagttcaagctttttacaaattgaaatacctctgaagcacaataaaatgaagcacattaaaccaagcatgcctgtatatgcacttaaccaaacatttccagtactgtaaaatactctaaaattctactttgcctatatattacatatgcacatttatatagatattatgcatttaaataaacattaatgcaaaggaacatatgcataaaatgattcataatataaattatggacaatttaaagatttttaagggtagatttcagactgtaaataaacttactactttcacactcatcccctgcagaagatgagaactggcagtatagtctaattacttaagtaggagtggtggacatcattgtgttattttggagcatatttttcatcttttcttaagtgaattgtaagtgaatagaaaatgtgtgtttgcttgcatgcatatgcatatgcaaaaatcaaaactgatttgcccaggtactcaacttgagcacaaaatcacaggcatgaatatgcaaggaaatttgaatgtgtgtttgtcagcaaccgaatatttggcaaaggggaaaaattaaaatagattgcacttagagctcaaggaaggaagaataaacacaaatttacaggtgagtgttagcaaacagcacatatattgaatagtagtctgaaatagacccatctgaactcggtgggaaattgacattctgtttgtgctactgtgtattagaactggaagcctcaagttatatttcttaatagcgatgcagcaaattactatatctacatggcaggcacttggcttttaacagctggcaagattgagggttatttgaggcatttaaaataaaaatttcagataagatcaaatcagtgtggtcaatcagcaagatagtcaacaggtatttatgacaccaccacttatctatatacatatttttaaatgttgtgcttgatgggatccgaatggggaaaagacccaaaacattaggagatctctggctctggtttagaagaccaaatggtaataaacaagggccttggagtcacacacacctgccgccagaacccggacacctcttactttctaagtaagctccacattttatgtgagggctaggttctgaagccaggccattaagcaaaagtcatgtacagtcagaattatctttgaaattttatgtcttctatgcttaagccttctttattttttttatgttactgaattaagaacgtttgagcccctatgccattagaagacagaaatttaatatcagccaagacacacacacactacttgggaggctgaggcaagaggatttcaggagtttaagagcaggagttcaagcctgcagtgagctatggagtgcaccatgcactccagcctgggcaacagagcaagacagcatctctaaaaaataaataactttttaaataaataaataaaagacgtagacagagaaacacacacacacacacacaattgtgtgaagccttttctcgtcagttttatgcccacaaaagtttgataattgctgtgctaatgaaagggccaaaaagaaagtctatgtgtggatatctggacttttgactcatcctgcctttaagatatgatactatcaaatccccagtgtgaggagcagatggtaagacttctaaagtgttcctgcttgccttcagggtttactctactcacttataataataagcctctctgactttaatacatgttaatagacctatttgatgtttagaggattaaatgaaacagtggatggcaacttctttaagggttaaattcgaaaatcggtacataagttacctgtgctttgtgacacttcttcatttatgtgatctttgtcaatgcacttaacctcactgcgcctcattcgcctcgtctgcaggatgatgcaacacacaatacctacttaaaggagttggtgacactctaagtatgataatgcgtgaagagctgttggcagactagtagcaagaaattaaaacatagtaactattttattattattacaaattattgttgtcgtggttgagatgattattattacttgtatgctctgagactttggacatgttaccagatctttctgtgctttagtcattcatctgtcaaaagggagcatgatatcttttcctcctacctcaaagagctgcagaaggaacaaaaaaaagacaaggggttggaaaagcatgaaaggttgtacaagtagaaggtgaaaacggaataatgaaacataatattcaaatcccaaggcaccccagtttcagggatgttgcaaaccaatgtaatctgcagaacaaggcatgtggctgaatagcaacacagtcgggacccaggcagatcgtaaatggttggatttgtcctgtccccacccctggggataccacttaaagtgcattccctctggaagggggcgtggaaatcttgctgtggaatacacaggaccctaccttcctcccagaaaatactaccatgaagagtggctttgtgctgcagacgtgaatatataggtctctagcccaaatggcaagaaacctattgttatttttttcacaactgaattaaattcttattataatcacctttgccattggttgacagaaacgtaatctctgtcaagttagggcatgtaggttaattcagcttcctgagattgtgcctaagttccagggtgtttacagacatccaagaatctgggggtcatacgtggttctcagttatcacctgtatccacgctgacttccgcagggatctgcagctccctttctgctcaccgactgaaggctattccggaactgctggggctttcctagaaacgtctcaggccccttgctcagttgcagcacgcaagcatctccagtcttctgctcctgcgtcatggtgcgtgtggaagaaggaatggcggcctaggggaggtggagtttctttacaaggcattggaacagagacctcttctgctcttgaatcgccaaactcaaggggaagggttggtttatgctccctccgacccccgactccactcgaggccaaggaggccctgcaagtagcaagtggaagtcaggacacagagctgcttctccgctccgagtctgaatggcaaagactgcttctccttcactgccccccaccccccacaattttcacattcctctcaatacccaggaagccttatcttctacgtaaagggaggtgagaaaatggaggtgaagtggacctccggctatcgcgttttgctctcctgaagctgtttcttgtttgtttttgtttgttgctttgtttgtttgtttgttctgagacagagcctagctctgtcaccaggctggagtgcagtggctcactgcaacctccgcctcctgggttcaagtgattctcccgcctcagcctcctgagtagctgggataacaggtacgcgccacaacaccctgctaatttttgtatttttagtagagacggggtttcaccatgttggccaggatggtctcaatctgctgagctcgtgatctgcccgcctcggcctcccaaagtgttgggattacaggcgtgagccaccacgaagctatttttttaaatgctaggatgtctccttatgaagtccccaaaccaagactaaggctccttgttcagctttctcccctatgatgcctcttctgaggcaagggctgcgtcttttacagagtggggtgcaggagacagcttcagaaagtcccgctgcaggagtgggaccagctcctcacatttcaaaaatattatccaccaacaatgtttagaacattacccagaaaggtagatttctgaaggagttgagcgtgcatagtagagcgtgattctgccataatctatgtggttggatgagaaccagtgaattgctttggtccgtttatgacaacgtgaatagtttgtcttatggtgataggggaccagtgattctagctttgactgtctcttcgatggttgatggtatgtaattgaaacaagtgatcctcccccttgccccccatcacatcctattctgccacattcttaagggaggtgagaagtaactctttatgctttgtcattcttgagcaggttttttgttatgtaaaaagcaattataattcagagaaaaacaactcaatgtgtgaaatggtaaaataattctaatgtcacttgcaggctccagttggggtctgcagaatacatctttgtatggaatagaaatacatgtgcccaaatttgagaattgtcactgaaaagtaacctttctctttctagccctcctgggcagtgcagccaagtcctcatcagtgccaaaaatatacatttagcaaatgtccatgccagcgcctcactcccagaatgcacagttctcccaagctgcttccagagccttctaaagtactttcccactccatctctgaccctctctaacttggtggtgttcattctgcagacaaatagatcttttgaaaatgtaaacgtgatagatacggtcactttcttgcctttaaaactcctgccttccctggcagttctgctgtggttctctgggtgtgttagtggctgctgggacaaagtgccacaaactgggtggcttaaaatcacagaaatgtactgtctcagagcttcagaggctagaagtgcaaaaacaaaggtgttggcatggcattgctcccactgaaggctctggggaggacccttccttgcctcttccagtttctggttgtggccagcaatccttggcttgtagacacatcactctaatctctgtgtctgttgttacatggctcccttcccctgtgcgtccgtgttgtcaggtggcatcccctcttttggtgtctgtgtccaaatttcctttgatttttaagaacaccagtcactggacaaggaccaatcctaaagacgtcatcttaagctgattacacctgcaaagacccttcttctgaataacgtcatattcacgggtaccaggggttagaacttcaacttttcttttcaggggacacagtttaacccataaccctgggtttattcaggtaaattccaacactttaccatcacccacaccagtctatggatcccgagtcctgcttgtctctttggcttcaagttttgttgttgtccttctcataatactttcatactccaaactccactggacttctctgttttttgaattgctgtgccacttcccactttaggaaatttttttgcaagctatgcattcttcctgaattgtcttcctctccttattccctactgcgttacttttctggcagaatctgccttaagcccccacaccgagtctagttgctttgccatctcctatagctcttccatggcactgaccacacttggcaatcaagaatgtatttgtgtgactatttaagtcataacaatcacaccagtgtaaggtcccagcaaggggtctctggccagagtaggtgcttaataagtaattattaaatgaataagtataagatttcataaatgctaaattagattacagtatggttggttaagtcccataggacacccatatgacttttaatcttaagaaaaatggtccttttcatgcactctttggattttagcacgctgcaacttaattttggctttgcagaggaatctattagagattttctgttgttttttttttccataaagaactgaggcaatgactgtgagaactggatttagaagttgaacacctaagaaccccgtttttcttaaaataaaaaaaaaggtagaatagaagagaaaggaaaggaaaagaaaaacaactgtgtcgagtgttaggtttacagttcagggaagcaccaggagccattttatctgattttgttattatttaaccactgcacaaacgagaagagcccataatcctctgtggaataatgcattaatcctcattagttgtcattcagttgggtctgctttctctgcgccatgtgaaatatgaagagataccttcccaagaaggataaatgtgttatctcatagttcacctactttagaatacccagtgggctgcactggaagtatatgttgtttatcattacttgtagggggcaagatgggccctactgaagactgctggaccgtgagtgatttatggtgctttttacccctccaccgttgggggaggtgtccacatggttagaattccatctgtcccgtatgcagcccctttaattaatgatttatcctattatcttccttcctgaaagaaaaaaatatcgaggttttactttatcggtaaaactaccatctaccaaaacagaatcattatctaaatccgagtgacaaacaagttgatgggagtattctggggaagagaaacctaaggggaaacgggttaacaaaatcccttgtttcctgagggaaacattaggaggtgttccctaatcctgcctagcaaaaggtcaatgctttgatacacacacacacacacacacacacacacacacacacacacacacacacgctcaagtttccatataacgagaggaaaagcaaagagacgccactggatgaggggagccattaatacagtgggtttgacagttggatgcttgaaaaaaagatgacttcttattaacatgcaattgtcaccatgttaataatgaaatattgatctgttcttgcttaatgaaaatcagcttattctaatttacccctggaaagaggaccacttagggtcccgttccaacatctttacactatccatctatgtattgtttatagctagatttattttttagtatgcacctctgagccagggaggggagaagggaataatgaatgtcaggtaaaccaaaattatttgtcttttcttcttttgttgaaattcagtcatcttatttagcaagaaaaacttcatgaaagaccttagaacaacattacagggtattcatgattttatgattaaatgattacaatcttttccaataaaaatactgttatataagaaatgtgaaccttagaaaatcactagcactcctcatctaaagcttgatttacagctatttataaccatatatgcattacagtaaggactgagagaatccacaagatttatcagtcttactcatggagaacaattttacacagagaaaccctgtctaatagcctatcttaattagctgccaattttgtgaactatttctgttttatagtcacagtttttctactcatttatttacctgcgctttcgaaattatctgtgaagcaatctctttcggataatagggaaaggagccagtgactgtgaccctctaaaaatgtagatcatttttatttacaatttaaaatgtaaatgctttggggtcaggcctctgcgaaaagagtaattcacaagtcaatacattactccttcacacttaaacattgattaccaagaggcacatacagtgatgtgtgtgtgtatgaatgtgtgtgtatgtgtgtgtgtatttaccaatgtagtggcttttattgtttctgttaggtgttgttgcagagaggttcacataaacatttatataggtttcagaaaacggttgttactgaggaagagcctttttctgtttacacaaattcagaacaaagaaacattgctacagcttccggtaattgacatgtgggcgtgttcttcaagtcactgactggaagaagtgagtgtctgagatttatttttgacaggacttaaattactggtagtctgacacatttttgaacaattactagacactgaggtgtttaaagtaatgggtactatttgtttgagggatggggaagtttcaaaaccgttagaacgaaacaattttccatttgattagtaagatgctaacactcacatttatattactaaatagcacatacataaatgactcctcgagtgagaattttttctcagaataaaagttgtactttaaaaaatatcccccccatttggtgaactggtgaatcatggagttcaagagaggaatgagcctctgtgctcactgtcagctttctcccctctagttctttagatcagtccctgaagtatacagagacgggagcattgtcctgctttgtttcaaatgtcttagaaactagggcttaatgttcattaattagtgactatctttcaggagcttctaaacattgttgaaccagccatctgaactccgactgctaaattaaaattcacatttcatgagctgctagtgtccccaaaagataaagcaactacagctgccataattggcaacacactgacgttttaagttacccaaagagtcaaagcagtcatttttcttcctccttctttcctgttcatgggtctgatgaagataaaggattgcaaagtctctgtcctcttcttttctatttactatggcttaaaaagccaggccaattttgggggaagggtctatctcacggacctacgtgttcttgcttgtagttcttaaagctgtgggtcgggagaacccagagctgacttctgtgacccatcacaggtgacatgggttttattgcttatccaagatctttttcctctcccctgcatccagggacgtccgtgaagtcatgtcccctgaatacccctggagagtagtactgtgtgtatctgtctataaaaatctcttttgcttgttttattggagacactgagggctttggattgtcgttgtctcaaccaggaatgatcctgtactgccccagctccccaacccaggccggcattttgcaatttgcagagtcatttttggttgtcaaaacagatgggagcttttactgtcagcttgtggggtagagaccagagatgctgctaaacatcccgtaatgcacagggcagccccacagcagagaatcacctggccccaaatgtcagtcgcgcggaggctggggaaccccggtggaatattctgtgctatgctgtagtagctggggtttgttttcctaaccaacaaatccaaacagaaaagcatcggggatgctaagctgggttggagcagaagtagtttgggaaattcttttgtttctatgacattaaggactttttttaaagggatgcatcccatgtttttggcttctttaaggcaacatggtatacaaatacaagtgcaaagagtatcttcagggtataccacaaaatcataataatccagcaatatcaattaccacttgggggaaaggggtcctactatgtttctctcttagaaataataaaaatattcattgactgaatgctcacagctgctctgcagccctgcttctgtcccttttcatttgtaagcttggaaaataaaattgtccttcctagtctcctcattcctcattgcaacatgaaaggggtgaatctaaataatgtcttgtttccattctatttgtaagagcccataaaattgataaactacttatagattttaattaatatgattaaaaataactgatttggcttcattttctccttctcatttgggtgttttgacaccatccctagaaggttttccaagactcctctgagaagtccatttttggaacctagaaagtatgggaatagagtctgtgagactggacatttccttactgtttactggggggtcgaggcaggtaaattcactagaatgggatcaaccattagccttgaaaacaataaaggcatatacttctgcccatccatccatcaatccattcattcaatcctccattccttcatccatccattcatcccttaatccattcatccatccctccgttccttcatccatctatccctccatccatccctcccttcatccatccctccctccatccatccctccctccatccatcccttcctccatccattcctccttaatccattcatccatccctccattcctttattcatctatccctccttccatccatccctccattcatccattcctccatccatcccttaatccattcatccatccctccattccttcatccatctatccctccatccatccctccctccatccatttatcccttaatccattcatctgtccctccattccttccttcatctatccttccatccatccatccctccattcatccatccatcccttcatccatccatccatccatccatcccttaatccattcatccatccctccattccttcatctgtccctccctccctccctccatccattcatcatttaatccattcatccatccctccattccttcattcatctatccctccatccatccatccattcatccatttctctattcttccatttacacatatggatagagacacatctgaaatataattaactgaaggttagagtaatttctagatgctgggctactgaatgattttaaaactttcttctttataattttctctattacttaaatacagtaagtatgagtcattttaacaatgaaattattattttttaaaaggaaggggatgatacgggatgagctaatggatgcttttcaacagtccaggaacactgttttgatagttgaaaagagtggttctcatcttttattaactccattccgtcaagttaaaaaaaaaaactggtctattttcagttttaggcctgggttgattgatgtacatttttaactttgagacatgcatgtttaattatagttttccactgacctcagtgtttgttacttatactatacattagctaaaagtagacactattaattatacagatttgtttcaggatttcttgggggcaggattttgctacatactttgggatgcctggtgatgtgtgaggtgcttccacactttctaatttcaaatttcaaggatcttcagtctggctgcagtgaaaagaaactaaaaaactgacttcgcaattctagcattgtaaaagacatgtacatacaactgtctctcaccttcatgacatccttggtgaactcttatgtatcttttaaactgctgttcaaatgtcgccttctcaatggagccctccttgaccactcccttgtgaagttagaggattcttcctttgagtaagaagttaaatgtttcactttcttctcacaataccctgtattgtacttggaaatagaagttaccacattgctgaaattatgtcctaagtatcagtcctttctactggattttgagtttccagagggctaggaccaggattcatgggtctttgtgttcttacagtgcctcaattgctcaccaggaagtgggctggccagaatacaagtcagaatgagatggatgcagtacgaagtgtagaaatccaacaaatgtgtaaaaggtaaaggcaaaccagatttttttaaagcttatgattgttggaaagttcaagtatacacagactaaacagctggacaaaacttgcaaaacaatgaagaaaggaaagaaaatagtgattgctatgtctgagtttcagggactcataataaaggactattcagattaagaaaaggctacttggaaactatagatactaattatttttaactatagatactaattatagtctgaattttaaagaaaaattcaggcacatctactctgtgccagggaaggtgctgaaggaactagcatgtgtattactcgtttttcaacagagatatgtattgttagtcccatttaacagatgaagcaattgaggcttagagaagcaaatgacttacttgaagtcatccagctcatcagaaagaaccccaaccctcccaaggtatttgaccttgcaggtcagtgtttttcccactcaaccacagatgttttatgtcctcttttgtcgctgacgtttcctccatgtggaaagctttgaaagtgctccagtcacattttgaaatttcatgacaaaaaattgaatgtcatccaaagcatagttgaggatttaaacatccctgtcaatcctggctgtcatcaccaaaagatttctatcccaacgatagatcattgtgacgtgcttggcctaaagggccctgggctgttataatgagtaagattggaatctactgagtaatgcaaataaataaaaaagagacaggtagtctcagactttttcattattgccttctttgctgtgaagctcatggactgctctgtgcaaaggatctttctttttaccattttaatagcctgtgcaatgggattaagaaagatcttgggtttttcattcaacagatattttcatcattaaaatgcttactgtttttgagcacataagtgactctactggaatggtagtaggaaaatagggacacgaaggggatttgaagtcagattatgaaagcactgcatgccaagctataaaaggagcgacaaatcagggaggttagtttctgatactaaccttggcaaacacagagaggggagaagcaagtgcaaaagccctagatgaaaatgagtttggatagtatgttctagaaacagaaggcagcaggacaggtgagaactaaacaaggcagagcgtgataagatatgagaatgaaggtggaggaaggagtagggtgatcaccagcccaggctgctaggagactgagggagttcttggggtgatggattttcagtttttaaactgggagagtccacggcacactgggacaagtcagccaccatcggtgggagccaggttctgctgggactggggaccatgggaaggagtttgggctgtactttacatgcaatgggagagactgaatgtgttttaagtggcacattctcaactgcattcagtctggagactgaaacactgattccttgttctttggcaagtcacccaacccctcttgacctcgctttcctcacttctagcgagaggtggttacaccagatgatcttcaaggttcctttcgactctgagaccctaggacacttttcactttgttctgtagacagaaaagagtggtcaaggattactgagcaaaggaataacacaaagaattttttgaaggattaatctggcagtagtttacaaaactaatcacagcaaagagagatctgaagaaaacagttgagctcttacagtgatccaagcaagagatgatgagagcctggactggatgacagcagaaaggatgatggagacaggaaggaagggtggagtgatattaaccagaaaaattgctgaatttgctggcaaactgcacatggctgataatggagtcaccaaagtgtgatttaattcattcattcatttgttcaacttactgaggccctattgtgtgccaggcactggatgaaagtagatgagcaagtccttgccttcacagagctcacaatctagtggggaaaccagtatcagactgcacgtttcagttgtgcttaatactatgaaaggactgggccagattccatacaagcgatgcggaggtcctgacccagtctgaagatcactgagggcttactgagatgagtgatgtcaaagctcacagctaaaaaagaaaaaaacagcactaaattaggttgatggtgggaggtgagggtggagcaggccatggagtggagaacattttaggcacaggtaccttatttgctgacaacatgaggcaggaagatgttgcacattcaatgaacttaggaaaacacaacctgatgaaggactagatggaggatcctggaaggctggaaagagttaaattataaaagggacttgcagatgcataattcattttggacgcaattcagagagtgatgggaagtcattaaagaaagagttataaacaagaccctgatgtgcagtttcagagttttgcatttttgtatccggaagaatcatggtattcctaagagaactcgggcttagagagagtggagaggtaaattctgatggaaaagcaaaagaggggaaaggaaaagtgtgaccaagtggaagtagtctctcaggtgctgaagacacaagtctatgagcttagcagagatgagaggtaaagataatgctctggaggccaggcacgatggcccatgcctgtaatcccagcactttgggaggctaaggcgggtgggtcacttgaggtcaggagttcgataccagcctgggcaacatggtgaaaccctgtatctactaaaatacaaaaaaaaaatagcatggtggcgtgtgcgtgtaatcccagctacttgggaggctgaggcaggagaaccatttgaaccctggaggcaaaggttgcagtgagccaagattgtgccactgcactgcagccaggatgacagagtaagactctacctcaaaaaaaaaaaaaaaaagataatactctggggatcatctgtacagttggagctgtgagagtgaattagttttgtttgagaagggagagttagcaaggggagaaaagattgacaagaccagagtcttgggacctgtccacatattaggagcaattctggatgatccagagatagaaaggcaaacagaagggaggacgacccaggaggtttaggcacatcatacacagcagccaagcctgagtcacacagacagggtagtggaggtatcaaatactgcacaaaggtcaaagaaaaacaaagcctgacaaaaggccagtcagtgtggcaattaatagatcattcgttatcgctgaaaaggaggttggtgactaatgtttggattacatcaccttggacaaaattaataacaaatttcctgatagtcacttgcaaagatgcaatggaaattggctgctcactctccctgtctgttctgaaatttcttaactttgtgaacactctaatctcctctgagtactgcagcagaaaattgaaatgtgccctgtgtacaatgtgggtgagtttctgttacccaaatccttaccttttagatgtttagaatgtcaacttctccaatttactgaatgcgtaggcagagtttgcatgactgtttctgagagtgaatctatcggaaaggagggagaatgacatgcgaagagcttctatcaatcacgaatccagctttagactgcaaaatctgtgtgttcacgctaagaaagggagatttcctgaagtcaaagatctaaacccaaaatctaaaaacatatgagtaaagagttttgcacttagggggattactcagaatagagaaaataatgtgggtttaaccatttcatgacagctttttttctattcctttgaatgaacacctagacattttttaaattaaaattttgagtaatacttgttcattgtagaagatttgccaagtccaagaactacagtatgcctgacacctaataaatactcgttaaatatttcttgaaaaaagacatgaaatggtacaagataaaactggattagagggactctggcatatttgggatcatgttaacacttttcgatgtggtctttgagcatggaggaattattataggtttttagtcacaggattacatcataaattatctttgaaaaataccctggctgcattttgctggatgtattggagtagaatgaggatggattcaaggacagcagtgaggtagttactgtgataatcaggtgacaaaaagatggtggcttagactaggctggcagcaatagagatgtagagaagtgggtggattgagatagatttggtggtaaaaatcaatagagcttggctatatggtaaatttagaggtacgctgggaataatggagtgggggaaaattttggtaaaggtaaaaatcgtaattccatttgggaactgttaagtttgatgttcaagagttagggagaagaccattgggtacttatctggatttcaacataatacccaattacatcaatgtcaaagtcctagcaaatagaacataatgaacccctggcagtggacgagcatgtttagggtgagattattgaggaagaaagactaagccctgagaaaggccaatatccaacattgaaaaggaaaaaagtctgcaaaacatgagcttttggagagcgtggaagactatcaacatagggtgattgtcaaaataggaagtaatagagaagagagtgtctcaagagggaaaaagtggttagctctactaactacttttagtagaagtcagtaaggtgcaagttgaaaaaatgcacactggacttaacttggctgagctcctgggtgaacttagtaaaagcattcacagtagaccaatgggaggagaagccagactgggtgggttgaaaaataaatgagagatgagaaatagagacaacagtgtgcatatctcatgcgggttgccagacagtggttaacgtagacagtgacatgttcacactggaagaggttaatctgcagagcaagtgcaaaaccctctcaaatcgctgctatgtttaaggcatcttagcgctacagagacagaataatcctgtgtattgggaatacagaaaggaaaaaatcaggaatgcagagacttcaagtctttagaggccaaattccaaggctttggtctgagccaggcactatttcaaacagctggattatgtgccaatatgcctaacgaagtgaatatcagctggccccacactggtaataaaacgataataactctataaataaatgtattgagtgctgactgtgccctctatcacactagccactctataccctttatctcatttaattttcacaaaagcaccagcagatagctactatagctactagtaacctttttctttttctgttttttttttctttttttttgcagaagagatcctgaggtccacaaaagttgaattatatgtcctaatacacatagcttatgagtgaagccgtgattctgattggtctgactccaaagttcaacttaggttattcagtctcttcaagttgttgttgcccaatgaaaacttgttgcctagctaactggaaatctgactgaatttccagactagctcagcttacctaatttaataaaaaacatcaagacccgaaaagcaattatgtagaatgattcgaatcttaaacgagttaatatatccagagctcttatggtaccagacgcatagagagccttatgtatgtgtttcccattaattcttactaaaaggctctagagagaaattggtctgcccttccctggtgctaatcaaacattgtgaatagtaacaccattttttcctcccaagggccactaaatttctgcttcttacagagtagttttcaacttggtcttaaggaagaggatggtatttcctggctttgtgcttaatctctttacaggaaatgatattgttgtaggcaaggacaaaggtacaagtgtacacatttaacaaatgcattgaatcctctattaacattgcaagtcagttctttagagcaacagtccccaacctttttggcaccagggatcagcttcatggaagacaattttccacggacaaaggtaggggagatggatggtttcaggatgaaagtctttcacctcggatgatcaggcattagttagagtctcctaaggaatgtgcaacctagatccctcgcatacacagttcacaacagggttcgtactcctatgaaaatcgaatgcccctgctgacagaaggcagagtttaggtggtaatgttcgctcgcccaccgctcacctcctgctattcagcctggttcctaacaggccacggacctgtaccggcccgcggcccaggggctggggacacctgctttagagtcgtatcatttttgttgatccagaataacaaagagatgaacagcctaagtccaccagctatgagtttgggattgaatttgacaccagtttaattgaggcagccacggagatcaaggcaaaaataacacttcttaaggtcccactgtgtagtgacaaacattagcttctttaatcttcataatgctgtcggttctgctataatactgcttttaaaacatgttttttagagacaggatctttctctgtcacccaagttagagtgcagtggcatgatcatagctcactgtagcctcaaactgctgggctcaagcagtcctcctgcctcagcctcccaagtatctgggactacaggcatgtgccaccacacccacctgttttttttattatcttattattttttattttgtaaagatgaggtctcgctatgttacccaggctggtcttaaactcctggcatcaagtgatcctgcctcaaactcccaaagtcctgaaattacaagcctgaaccactgtgcccagccaatgcttccttaaaacataattttgctccaaaatggtggatacactttcagcttgacactgagtttgcatttgtgtacgtgtgacttcgtccttgagaaacactgaacacagaaaactgcacccagctgaaccaggccatgtagaaatacacaaaagcaaacacacacatacctcaaacatctactcacttccttcagctggtgtgccacaagccccacccacccatgcacaattgctgttacaacgctgtaggattccaggtaacactcctcccaccacttccaacacccacttccacggctctttattaaggtaaaatacttatttatcacggtgtttataaattttttcaccatttaacctgcataaaacggtgctactgtttgtattaggttcctgcttttttattatatgttactgacaggagctttgttctcccaaacccattttccccgtaagctctgtgggttttattgtgaaatttagaagactgtggtcctttttagaaacacacaaacaccttatattagactgactgtacgtaagtatgaaacaaatatgtttattcttttttttttttttctgagacagagtcttactctgtcgcccaggctggagtgcagtcagatatttttgttcttattcccattccacaaatatgaaaatagcccagaggagatgaataacttacccaaggtcacccgtcactgactttgtatttgtgtaatttcgtcactcccttctcttaacagacacttctaaatagcttcaaagcacattgaactggacagttgttgcaaaccagcttcaacattacaaaaataaacattttccagaaaggccttcactcaagatgacccacacaactctttgaatggtctatgtatttttaaatcatgtggtaatcccctttgtacatactaaataagtcccattctgctcacatgttaataaatttttctcatttgtgagagttgctgaatagagcaagcgaattgttttactcagtaggtggtcgagccataataaagaagcctcgtgattaagtagagttggagcctcttatctttctcactgagtgggaggcaccattagtagtaaaagtaattacctgtgtagaacacgctgattgcatcaagtacctactacacgctactaagatagtcatctccattttagagcttcttaagagatcttcatttgatgttaattttacattttaagccaaagtacattatttttggaaaacattgtcttagctggatgaactcatttttaaagcctttcaaaggacttctgtgccctggtgattccctcaccgatgccctttctccaaaatggcagctgcaaagctgtctaaacaaagttggaaatgataagccacctaaatgtgaaagaatctatctggcaagagttggttttatgtgggggtgaaaaacctgtgctttcatctatgaaatcacaaagtccgttatgggaaggtgttggctatttaaagcagtaattcctgagaaactgtccatgccaaatcttgttaaatgttgtactggatagtttcagcaaatttcaaattcttctctgatgggaatattagaaacagggtgctcctggttagatggaggcaaggccagagccttgacacttagtggtggtaactcagaaagagtcctcagcagaggggttttggaggccagaggactcccccagctctgtctttggctgacaaaatgaccactacttgcaacctaaccttctgtgtataaaatgaacagattgaataggtgtcccatctaagtccaaattttgatgtaggtatacagctaatcatttattagatttattagaattctttatgtgtgtgcatttacagttaggcatctgtgcaatcgtccaaccaatgaatcacaccatgcctttgagttttccaattctcccttaaatgtagctatcaatgttatttttacttataggaccccaaaatgtgaccttccttagggaggtaaataagacattgcttgtaggcctgacttgaggcttgtaaatagctttccaaattaataggtctgcaaaaatatattctgaagcctcacatttctatcggttttaaccgtatagccagggtcggtgatccttttttcgccatatctacttctttcatattgctgatcacatcggaaagccaaaaaaggactatcagatatgatcaggttacctgataaaaagaacaaacagttttcgaagtcagacagactggttcaaatcctgtttctgtttattcaggctcaaaccttagtctgtcattgttaccagctgtgagacattctgcaaattatttaactaattgaagtatcagtttcctcatctataaattgggcatgacagtaatatttgcttcaccgttataaagactaaaagcaaatgagatagtatggaattctgtttctgtttttactggaaggaattataaaaatttccagtttgcattgataacttgaagagggaatgtctattttttttataagttttcttccctttctatgtgaatttttttaactgtaagcatttattgcattttttttacttctgtcttttaacatcatttgatttatcttgggtaaaatcataagccttctttattattgtttaagtttctctgatttaaaaaaactaaaatattattaaaaattaaataagataacatagctaaggtatttttcataatgtttgccacagaatagccactaatcaaatttgtcataagtaataagatcacttccataactacaaaaattttataacccaggaaaagtaaagaacgacaaaatacacagcaattactcaaaagatttttcattccacttattctggttaatttcaggtcctggaatcaagaacaagtgtttatatatcggttaaattgttttataatgaattttgaagaacccttggaattatttttgtgttggaattatattgtattaaagagtgtttgaagcaatttggatattcaagtggacttagttttgtcggggttttttccactaagatttttcactgtttgggcattatttaagattcagcccaacaatatgtcactagctaaaactgaatgatgctgtaatccatacagaggacaaatgacaaatttgttgactaaacttctatcagtttggttagtgaggagcattctgattataggtgggaatttttgagcaagattgactcttaatttcatgttcaatttttaaaaatttattcatcctttcctctgtttttcttcctttccaaccaaacttcctccctccctccctccctctctccctctctccttctctccttctctccctccctccctccctccctctctccctctctccctctctccttccctccctcccttccttccttccttctttggttaagcacctattctgtattttaaaaccagtagtcaagctcagttcatacttttttatgcaagtgcctttcaccaagacaaaaaccaaggcttgaactaacatttagcttttctgaaagcaatttactgagaaagtaagatgcttgggttttttctgtgtagacattaataatcatttattagattgttaggcctatttcaagccatgtaacctcactgggtctcagtttgctttcctccaaaatgggataataatacctgctttatcatatacatgaagaatttagtcctgtgctagctcatggtgcatttgttaaataagaaaaatagatgctgggtgtggtggctcacgactgtaatcccaatactttgggaggctgagatgggtggatcacctgaagtctcctgacttcgagaccagccaggcgaatatggtgaaacctcatctctactaaaaatacaaaaaaatcagccgggcgtggtggcgggcacctataatcccagctactcgggaggctgaggctggagaatcgcttgaatccagggggcggaggtcgcagtgagccaagatcgcgccactgaactccagcctgggcaacacaatgaaactccatctcaaaaagaaagagagagagagagagagaaagaaagaaagaccgatatttcactttaggtagaacttttgcatgtcttggagaatctgaaatatgaccaggctgtcagtggggaaacacaccgaggagaaactgcatagtggtagtggcttggttcctaaagtaagacaaactcaggtgttcaatgctgttatttattgaacacttatttacatgccaggccccttgtcaattactttgtatgcattgtacactaggtgttattttattattcccattttacacataaggaaatgaaggcccctgaaagagggcaaggactttccccaggataaattacaaagttcagatttaaacccaggtggtctagacctcatgatcttaaacactatgcccccaggattcagggccagaaaggtgcctagctgcaaagtcatgcccattactgagttcaacttcctcaaattccccctgaagtaatcccacgcagggctcagtggtggcgttcaggcgtaagcattaaaccacaagccaggcagaccttcatgagggcttctcaaagttctcctctccagctgcgctcaacctcacctgtgcctctcaaggcctagggttattgtgcatgtggcatggtctccagctgttcctcatcctgacttctccatctgcaccaatctctttgcatggaggccgtgtcttctggtctcttggtagctcagtagtggtggggtgggtgccagctgcccactgtgcatctcaatcaaggtttctttagttgtaaggaagaataactctcttcaaaggaaactaagcaataacaactaaacagtaacaacaaaaatgtctaaggagggcgctggcatagaccagggaattgatgcaaaggtggggttgagtgggatgtcggagagggtagagccaggtatctttatgaaccaaaaggtatatgtgttttgcaccttccttcagactttccttctctcaagatcgccatatctccattcagatttttgggctaatctctaccaaaagcttggctctctgtgggtagcctactttcagtccatttgtctctgattgaggtggagtctgttagggcttgaggagcaagtagttcttgtggaagggaaggtatggcttgaatagatcatccccaagtgtgtctaccacattggttctttggaaggtgattgttggagaaacctcctgtcaggaatgatgtatatagggcaaataacaacctctccctggtggccttaaccataaaatagaagtatggacagctctgttcatcctaacaattatttataggccacctcaatttgcctctgttaactggaactcgtgtcctgaaaccgtgtcttccctttgcacagttctgtggttgctgagatggcatgcaccataaggagtgtctgcatttaagacttatcttttaatgccagttctccttccaggagctggggatatagcaatgaaccaatcaaatgttcttgcctaagaattcaggtaagggagaaggaaaataaaaaatgaatatattagctagctggcatgttagacgtgaaatgctaaggagaaaacaaagccaagaagatggtagaggaagagtcaggggatggggtggagggtttcatgctagataggatggccaagcatggctctgcggagaaaggaacctatgagtagactcataggaagtgagaaaacaagccatgtgatgatctgaaggaggagaattcataataccagattctcacatggctagaccttttgccctttcttgagcaacagcctgtcatgaatggagagaagaattgaggtcaaccaaaaaagggaaatttttttgcccaggatcagatgcttttccaagtaaacaagtagttactccaagggatatttccaggagattcttcaactccaaaggccaaatcttcacgtttccgttactgtagagctttctaaacacagataattgtttgcacagttggtcagctcacacaaatcccttggcagtttctacagacatttatgcattacacattttcgatccttggcccaaagttctgatgttttagctctgacagtcggctcatgagaactcagacttcttgatgcaagcccccagtcttcacttttgaaagaccatggaccaaagttttaattgcctcgtgggtgtctcttcctcttcactgggtgcacagcgttactcataatcatgcttctgatttgtgtctgttaaaagaaggatcagaaacagactggcaaggtcttacagttcttggtaaaactcttggaaaagactttcttttttgatttgcttgtgtattttagtggtgtcttcaggctatttagagaaaagtagtatgtctattgattcggccattggcagggacttaaatgatggtacgtgttggctgtgtagtacctctgcttcttctagttggattaaatccaaggacaggtaaattcttttggcatttggcttgaccagagactttgtatctgccatattggtaattggccaccttggtgatttttggactaatgctccagggagagaaactaaataactctctcctccaaccttttcccaagcagttctctctacctggcattattttttaaaattgacttaagctttgccccctcttggaagcattctattaccccatgtctgtcttcaagatgaattcagcttcctgctctgttgtcccataagtatcctgggcatagttctgctctgggactcatcacctattgctgaaatccttttgttttcttacctgtttcctactgaacagagagcttcttgaggtccagcactggggcttaatttgattcatttagtaagtttttgttgggaacttactatatatgaagcactggattcaactctgggaactcaaaagtgaacagaatgtacacaattctgctctcatggaatttatagtctactggagttagacagacattttaaaaaattatcatacaggaaattgcaatgagtaattttgttgggtactatggagggaaatcctttaagggccctgtttgtttctgactttaaagcactagcaacaaattggcattaactgattatgtgatttgaatggaattgaggatctcagcgttggccctccgtcctgctgttgtcaactctcccaagtttttaaatgccaagttgtagttgcctttgttccgctaaattgaaaaatttaccccgtgcaaatgaataactaaattcatatttttttgaagaattctatctaaatggagatttgatggctttcagaaacctttaaaacttccctttcccccatatgaattccactatggattgacatatggcatattttcaatgtctagtttttgtaattaattgaaggctcactctgtctgagaaagagagtgctttggcatttccgagacctgtggattccatccagagtaccacacagcaatgcagagactccactgccgctcacctagctaggaggctgcagctctgtttgtgaaatgttgctattcagctttcaagtttattgggagcactgagttccaaggatagcaattaggttgttctgcattcttcggctggctcaggatgcacgtgctgagactgcacatcatagcaacggctccttgactgccagggagaacagtgtgaaagctttccgtggctcatctcaaccacctcctcctcgcccctggcgctccgcaatcctctctactccttggtgatacctttttaaatctccccattatgttcaacagcatgtcagctgagagttcaggcttacgagatcatgtccaataggccaaagtgtcgaaaataaatgttagctcataaaacatacgtggcacatctatagggcctgaggaaagcccacacagagaaaaaaatcttaagtgaacttgtttaacccagcagtgacaggtacaggaatgggattttctttttttttttttttttttttattaaacagagtttttccaacttccaggctggcaaagaagttgtaaagggaatgtacattttgcaccgtaatagaaagagataagtagggatttttccaagatttggaaagctggtcttcgtaagtccatttatttattcaacaaaaactttatgaagtatctattacatgccaggcactgtacttggcatttgggataacatagtgactgagaaaagatttgcccttgagaaaaatcacagcccctttggagggactgacattaaccatttaatcacataaatatgatttttcacacagtaataatagctatgaagattaaaaagctagatcataagatacgtggctataagagaactccctgatagggtgacattttagataagtctcaaagggtgagaataaactgtctacatgaagaacaagaaaagaacctttcagtcaaaggaaatagcaagtgcccagaccctactgaggaaggcctggggagcgcccaagaatcctgtgttaatcagggttctccagagggacagaactaataggatagatgtatatatcaagaggagtttattaggagaattgactcacaattgcaaggtgaagtcccacaataggccatctgcaagctgaggagcaaagaaatcagtccaaatccctaaacctcaaaagtagggaagctgacagtgcagtcttcagtttgtggccgaaggcccaagagcccctggcaaacaagtgttgtaagtctaagagtccaaaagctgaagaacttggagtctgatgtttgagagcaggaagcatccagcacaggagaaagatgaaggccagaggactcagcaaatctgctctttccatcttctcctgcctgctttattgtagctgtgctggcagctgactagatggtgcccacccagactgagggtgggtctgcctctcccacaccactgactccaatgttaatctcctttgtcaacaccctcacagacacccccagaaacaatacttggcgtccttcaattcaatcaaatcgacactcaatattaactgtcacaaatacgaaggagaccattctgactggggttgagaatagggtggagagagtcagggcatgaagccatgggggaataggtttgctggaatttgaaagccatgagacagagtgaggagttccttccaattgaaagattttaagcagcagaattcagacatgaactttggctgggtttggaatggagtgcacctctgtaagactgaggtgcaccatttccccgtctgccaaaatggagcagctgacagcagcttgcttgcaagggtctccgagcccacaagcccaggtgtgctttgaggtggcttcctcagcatcttaagataactcacagcaattattttgctgtggatttgcagaataaacaaaggcttcatcgagcctctggtttgaggtaataagtcactaatgctgtgtgtgcacactcctaagcttcaagcctgtgtggattctttcttcaattttactccccttttcgtttgctgttttgtttccaatatgtcatgtttccatataacaaaacacgcatacagacttgataccatttaatatttaattcaaataataaaatacttaccatatcagataaaatgtttacatgtatgaatgtttatattccctcaggagtgtgttttggaggatgggtgaaactctgatagcacacagtggcattttaagtggtacacagataaacttcctaacaatttaattgtaatgtatttattttaaggtgtaatacttgtgtaaaatgaggaccacatcaatttggtaattttgtagctattatcgctagattgccaatgtcagttgtgatagaaaatacactgttcaaattcatttacttaagaagtgagtttatgtaaagcctggatagtagtgcaggagatagttctataacggcaacattggtgaaagaagtacatctatgctgagcattataaaacacagtcccttgaaagggattgtgtagtcatcagccacttctctaggtttgtatgccgctcccggttttcactggatgtgggttgcctgctgagcttccagcaaagctacagattcaagttgctttgctgaaaatatagcttaaataatttgtaagatttacctactacttaaatccttcatttatattctgattttgctcattaaaatttgcaatatgattgtattttatatgcaaagccatactatttcttggtagatccatttattcccttaccttagatttttgaagatgcaaaagtatcacgacttcctgtccaaaaggaaatgaggcactgttgatgccaatgcagcatttatacttaatgtagagaaagcactccattatagtgtacttcagaaattcagagagtgtgctaaaaacccgtgcttctggtcagcctcagtggctcacgcctgtaatcccagtactttgggaggcagagagattggaggatcactagaacccagaagttcaagactagcctgggcaacataacaagagcctgtctctactaaaaataaaaataaattagctagacatggtggtacccgcctgttgtaccagctactagagaggctgacaagggtggattgctggagcccaggagttcaaggttgcagtgagccatgattgcaccactgtattacaacctgggtgacaaagcaaggccctgtctcaaaaatataacaacaaaaccgatgcttttgtttgtttcccagaggagggttttggaagaaactactgacacagcatgtgacagcaagcatcacactcacaatatcgtttccttgtgtgaccgctcccatcaattagaattgacatcagttccaatcctatactttatagccctatacgagagaccttagtagaattggaaaccaacctagttaccattctgtgttgtcacatcccttttttaatgtgtaaactgagtcaagtgtcgactgaagcttcagccagaattcaatgccaggattcattctccgtcttaacactagccaccagatgatgttttatcagtcaacttgagtcttctcatattacccgttgactgtgttctgtttgacaaagaagctgtgtgggttgctagtatatttttccctcaagaccacctaacaaacacggcattacttgtgggataaatgttagccatgggaaaaggaaacaatattccctggtatgctgctcattgtcacatgctatgtctttagtttcttctgaaacccttcttggaaacatttctctcccagttgtaatttgtatattgctgcatcttttgaaaaattattttgaagtcttaagataaaatactacatgagaacggagtgggaaaggatctaagaagcagttgtaaaaataacattctgggacagtggcactcatggtaaagtatctttgttgcatcacgtttgttttggacattctgctggctagaaagagtagcatagaccacggattggcaaactttttctgtaaaagggcagtggatatatatgttcagctttgcaggtcatatagtctctgcagtacctactcagctggaaagcagctatagactaggtaaacaaatggccaggattgtttcccaataaatcttatttacaaaacaagcggtgagccggatatggccctgggactgtagtttgccctgtgctagggagcacagaagagatgcatttgactcttagaaatatacagacctgagccacatcctggctctgatacttaccagctgtgggtgcctggccatctgaaagcatttctcagctcatcagtttctacttaagtaaaatgggaccaattatacaacccctctgatgggttattgggagaatctaacgaggaatgctcagtgatgaacacagacctgacccagtaagcacacatccaatgttagatgctactgtggctgctgtgttgccgtggctgctgggttggaagccctgctccactcttccccctccagtctgttgcccatagggaaggaagagtaaccttaacatggaaattgacccaagtgtcttttctgcttaaagcctttccgtggtttcccacgcctttcactatggcctgatctagctcatgcttccttttccaacatggtggtgctgctctccttcactctcgctgggtgggctccagccatactgaagcagtgcatggagctcttttgtgccttgggacatttacatgccactttcttttccagaatgttctttctttggcttttctaatggctggtgtcttctcattcattatgtgtttgcttagatgttacttcctcagagaagtctttatcattctcttaccataactattttctcataactctcagcaaaattcatcaagaaccgtgcctgtcttattcacagttgaaatcacagtgctttgtacagtgttctggcacataatagacactcaataaacacatgctaaaaataagtgatttaatgatttatgatgataatcattatcatcatgaataaatctgaaagcataggacctcagccgggtttcatcagacttcaaccgtcttcaaactacttcatgatttttaccttatctaggtaccacttttgttacaaatatttacaattttttactcccttttttgacttagtttttttttttttttttaaataaaccagggattgacaaactacagcctcagggccaaatttggccctccgcctttttttgtaagtaaagttttattggaatacagccatgcccatttattactgtatcgtctgcagatgctttcaccctatagtggcaaagttagatagttgagtagagactgtctggcctgcaaatcaggaaatatttactgcctgattctttacagaaaacatttgccaactactgtactaagtcataaaaaccaccaaatcccatgtttgatacgctagttatgtttttgttttcattttcattaaaaacaatcttgtaactattatgattttaaaaaatgatttacttaagggcccactaaaaacatcttgtctgccatctctggtatatgagccacactttgggaaccagagccacagtagtctttaaacttcatcagtgacattctacacctgggtgaaagtccaatatgtgggtccctgactcggtgcaagttagaacattttcccctccagagatcctttagtgactacttcattttgggaagtgcgattttcaaatttacccaatggtaaactcatgggcctttctccccacggtgcagtacatctgcctggcgtactcttgctaaccttccacacagcgtgctgagagtctgatgtgaacatctgcatcatggatgtcattataacaggtgtcaaaaatgctactatgcccccagaacacctagactcttcacaagatagatgaaacctatggctctctgtacctgtgcttccagaaatcaggactgatggatttttctcatattatgaatagccagtggctgttctgttagatggccctttgtaaagaaaattctgcctcccagaagtttccccagatttacctgttgcattatgaaatctcctgtaaataatgcagagaaatttgcagatgccttcttatttttgtttttcaatgaaaatcatttcaggtaatgaaagttatgacctcaaagtgaaaggtgtataaggtaagcctcttccaattacagcaggcagaaaacccaacgcaaaatggctcagacaatcaggcaatttgctggctcacgcaactcaaaagtctaggacaagctggcttcaggtactgctggttcaagccattaaattacatcacaaaggtttggtttctctctatatatttctctgggtcacttttgctatgttggctctatcctgaggcagtctctctcctcgtggtaaccaggtggctctagcagcctcagctttatatctctcaagagtaagtccaccgtcacagagctggcctctgtctcagaagttctaggcaatatctcatgatatcaaattgggtgtgcttgtgccaggctcaaccaagagaaatgggatgtgctgataagtcacatttaggacatgcgacagctggagctggggatggagctagccagccccctgagaatcacatggactctaaatggggatctcaaagcaagatgataagatattattagaagcagcatgaataggtggcagggaacaacaacagcagcaacaataataaatttctgttacataaaaagccagcttgctccccaaggcttgattttccatttcaccttctactgcaggattttcaacctaagcactcttgacatttagggccagataattcttcgttatggggctgtctcgtgaactgtaaaatctttagcaacatccctggcctctacccctgtgatgccagtggcatctccttcttaccccccaccccagttctgactaccaaaaatgtcctctgggagccaaaacggcccccagttgagaaccactgcctactgttacaagtggaaagtggggagcagaggattatcacctcacaattcaccagggaaataatactaaagggggaaagagccactcctagggctgggcttgacaacatttcagcattgggtttgaagccttcattttactctctttctccaatgaacctggggaaggttgtcagaaccccaaagggcccagccaatcctatcagcagaagcaattgtagtctagggtttaaggatcctagggtcaggaagttctaggtctccctcctgttaacactaacacctctgtgttttttgtttgtctgtttgtttgtttgtttttagagacagagtctcactctgttgcacaggctggagtgcagtgctgcaatctcggctcactgcaacctctgcctcttggattcaagtgattctcttgtttcagcctcccaaatagctgagactacaggcgtgcaccaccacgcctggctaattttttgtattattagtagagacggggtttcaccatgtcggccaagctggtctcgaactcctgagctcaagtgatccactcgcctaagcctcccaaagtgctgggattacaggcgcgagccaccatgcccggcctgtattgttttttagtacaggtgtgagatttcagtgattataaatgacaactatttagcaaaggggcaggcgtgagatgatcactcaataaatatgagctctaattttgtatgtcattatcataagcatcatcatcatcatttaaaccaggttttctcggccaggcgcggtggctcactcctgtaatcctagcactttgggaggccgaggggggtggatcacctgaggtaaggagtccaacactagcctggccaacatggtgaaactcgtctctactaaaaatacaaaacttagctgggcgtggttgtgggcacctgtaatcccagctgctcaggaggctgaggcaggagaatcgcttgaaatcgggaggcagaggtagcagtgaggtgagatcctgccactgcactccagcctgggagataagagtgaaactccattaaaacaaacaaaaaaacccaaaaaccaaaaaaaacaaaaaacaaaacaaaaacaaaaaacaaaaaacaaaaaaaaacaacaaaaaacaagttttgtcaagctcaatggtattgacatcatttgggggcagacaattctctattgcagaggactgtcctgtgtgtggtaggatgtgtagcatccccaacatccgcactgtagatgtcagtagaactctcagttgtgtcaatcaaaaatgtctccagatattgccaaacatcccctgggacaaggagggggatgggatgagggacagggtgggaacaaaactgcctctgattgagaaccattgagttaaacccactcaggggacagaatgaccatctggcacagtaataattctcttgctatgttttattccccagagctggtcccatgattttcccaataaaaataagaaggtacttcccaacctgcttaagaaaatgtttgaggtatcaaggccagatataatacccagatgactgttattagcaactctgatttcctgatgcagagatggggaaagcattcccatctcctttggcctttatgtctcagaaatgctgtctcaagactcctagatcacacttgttctatttccagtttcaatctggcccaggggatccatgcagcaaatccagttagttacttaaaatgtgtcttaatatttggcaaccagatggaaaatcattgctccaaaccttggcctgcatgttctaatgaaaatgcttgttagatttaatgaaaaccagatgtgaggacgatctggctgtgacatctgtcaccccattgattgccagggttgatttggctgatctggctggctaggcgggtgtccccttcctccttcaccactccatgtgtgtccctcccgaagctgcaagctcagctgaagaggatgaccatcccctatagagcaggacaggtctttggtcaagggtattcgagtagctatgctcccctgctagaacctccaacatgctctcaaggtccattagatttaatgaaagccataggccagaccatgaatagtgtggcgttttagatacacaagaatggatatgcagaaatatggtattgctgatgatgtggatgtgtacaatgaggacctttagttttcctatgtttgcctgacactgaggtttcttgtgatcagtgagaagctaagtctgatttggagtctggtaaactcggctcccaccattctccattcaaaatcagcagaatattgtggttacgagcatagcatttggagccagacaaacttcaatggctacttagcagctatgtgtggctggcacatcactggtactcaataaatactggttgactgttgaatattgcccagcctcagcgataataatgcataatgcttagtttattcatcttgagataaaaacaatgtctatgtctggggtagtaaattagataatctttgtaaaacatttagcacaaaggaaacagtcaaaaaattatagttaccatatgtaacagatgtacgagattcacagccattttgttcattctttattcattattcaactcatttttatttagtgcttactttgtgtactgtcctagcaattagtaagtcaacaactaaagagacctaaatgagcaattgcatactgttttctagttaataatactgcaaatgtttaatgtgtagaatttttttggtcccatttgaatccactgtgtgatgaattatcacaaaaaaatgaactgtctccaattatttaactttctcaaaaattagctagaaattcaggggggaatttccctctcagttcctgccacatctccacagcattcaataatactttttaattttcaaaaagaagtgaagtttccaggcaaggcactgacaagtaagtttaatggaatttattgcagacttattcctgatctatcccaagagtcccttgatttatttagtttatcctataacataagaacatgggctacatggatgaggaatgcagtcttaaggccagggttgtggttttctgtatccttctgtatctttggatggttacaattccctctcttagcatattttcatatggttaagtcttagcgtgattccattgccaatgagtctttgcctaggtgcttggaccacctttgatgccatcttgtggtcctacatataattctagtctccatagtgaatgaatggtgacctcccccaccacctcccagctcagcctaagaggtaatggaatgatcttctattgactaggcaccagcaaggaagaaagaagacccaaacaggtgcaggtcctttgagcgagggtcaggtgtgaaggatgcagctgcattcctcaaaggcaagttcttcacagaagcttatctggaatgtcccaattctcaatttaatagtaaaagtcataaaccctattattattatcatctagtgcttgtagagggccttccctgttgccattctcttgtcttagagtagtctacaaggtccagcttagactcgacttcttgcagaaagcctccacaatctctcacatctgaaataaaaatggtccctctctgatcatttgctacaacctgtttcttcacaatacttcttactgcctgaacatatcatgcacatttttgtttacttattgtattagtctgttttcacgctgctgataaagacaaacccaagactgggtaatttataaagaaaaagaggtttaatggactcatagttccacttggccagggaggcctcacaatcatggcggaaggcgaaaggcatgtcttacatggcagccggcaagaaagaatgagagccaagtgaaagaggaaaccccttataaaaacatctgatcttgtgagacctattcactactacgacaagagtatgggggaaactgcccccatgattcaattgtctctgacaaagtccctcccacaacacatgggaattatgggagctacaattcaagaggagatttgggtggggacacagccaaaccatatcacttatttattgttattacttctcctctacacactaacctggtcctatcatgataatggggatctgtctgcagcagcagtgaagggggaatggaaggaatccactttttgccaagtgaataagcaagtactcagtgccaggggctgggctgaggccactgctgaatactggctgttggtggtgattcagtggctaagatttgaccccaaaccaccactggatgcatgttatcattaatcctggagactcactgagattagttaacttgcttgagatcccacagagagtaaaagatggagccttgatttgcactcgtggactctgattctgtgcctgctttcttaacctatttgcaaacggcctcaacctcactttgccccttcatttctaacaagggaagttcctttgccttcccgttttccaggtcattgcccaggtcctaacccacctgtctggttttgcaaaagtctaaacccctcgttggctgtggctttctttcccccattaatattcagagctcaagttgcatcaaatggttaaaaaataaagtgcatattattaaacttttcaataatggagtcactttaatgttgggaaattctaccacaggataatgctttttggcaagctcctgttttagcaggaagcctgcagtgaaggtatgcagagagagagagtgagggggcatctgtttgctgtcagtttctctgacagctctgtttgtgtcaacgttcccaaggatggtaactatgatttcacaaaagggtcaaagcccatcaaacctttttgcctgctgtggtcccacccccaacccttctctcctgcctctttgtcccttctaaattaaatcacattccactgccttttattgaacaacctctggacaaaatactcttccacacactcctcgcttaaggcaaagtaattggaacagaaagtgctactggccaagagccaccaactaattgctttatgcccaactcccctcgccagaggcacacccagcattgacaaatccatggctgtttcccagttttttgaggtttctgaaacaattggtccaatcttaatagtggggcaggtgggggagagatgcaaagcaggggtaggggtgggagaaaatgaattctctgtagtcattagtaccttttacctggtctgtttaatctcctattattttgatcatggatatctggttttttaatttcctgtaatccagcaaggaatgccgttctaaggacatctgtggtctctgctttttcatgttccaaaaatcctaaaagagatgttttgtcaatgactggatatttcattagaaatccaaagattcccattaacttgaattattttcatagctctgatcaacttttaggttaataatacatgatatttaataacctgttcagatcgtcaccaaaattattgatttaataatatttggtcattaataatgaaaaaggaggggggagtgatagttcctatcacttacgtcaatttattccttattgcgttgcaaatctcagggaaaaccaatcattgtagcaacttttaatatcccaccgtcgttcttggtagaagccaggaaaatgttctgcattttaaaatgtctgtattcttaagtttaaagaataaatacaatgaaggcatctgtttaatccaaccattcttgatttcagaactttccgacagtttgtagaaaccacagcccccactcctcctgggttctctagcacatctcaattggctttcttcctcttttttattatattctattgagtcacattgtaatcaccttttgtggttctttgctaatatactttgaaatttgaaacaagaattgagctgaaaagttcatcatcaatttattttggcaacatgaaggttcaaatagttttcctgtagaggtcgtattggtgatggggttaaagtgagcatttcatcttatatgaaaaaaagtagaagtcacatgtatgaaccagatgtgtaaatattgattactattttgaagttatcacattttatttccaactttaaaatcacttttttggggagcgtcttttgaaatttgtcctcattgttggaatatccctatgaggacttttttttaatttggtaacaataaataagtctcttggctgacttccaagaagaacctacattatttcaaattctattcaatacttaatggtgttatggcaaatttccagcacctaactttccaggcaatgagaaatttccctctagaattgtattttgatggaaactgatttcctgtattggataaataatggacaatatgtacgcaactttagctcaagaaacatcatcagatttcccccaacctgaggccttctctgcacatgccagaacatctgcaggaaaaaagtgcctggggcaggtacagggtcactgtgtctacacagtgctagagcatctgtatatttgaaaacattcagacaattaactctatttttcactttttgtcacatagacccagtttgagtttaacgaaaaaaaaagaaaagaaagaaaggaaagggaaagaaaaggagaggaggtgggggaagagaggagaggggagggaagaagaggggagaggaggggagaggaaggaagaagaggggaggggaggaaaaaggaatactcttaataagaccgtaaagagtgaagggtgcaatttacggagagtagaaacaacctttgcaaaactcaaacggtgtccataacatctcagctgaaaatatgttttgggttctacaatagtgattctaaatcctgctataacacaaatacttcataatcaacctccccccatcttgtttaatatttaatatgtaaaaaagttattatggtagaacggaagaatatgacttggattttgagttgagcagctcatgtagtttaggagagggcattgtttttcaaattgtggatcaaggcccattagtacaatgaattttgtggattatgaccagcatctttcttttttttttttattatactttaagttttagggtacatgtgcccattgtgcaggttagttacatatgtatacatgtgccatgctggtgcgctgcacccactaggatagattagaatacatttgagtaccttgcatgtagcaagggaagtaaaattgtttaattgactgtttctttataacatatgagcgcacgtgtactgggtcacaatatcaaatgtgttttttactataggtcaattacaaagaaaaaaagttctaaagccctggtgtagaaggaacagtttctcatattcaggggtagaaagaagtaacataaaagctaatatgcaagaattatacctcccaagtatattgaaaaaacataatcttttgttggtttcattttcctgtatccgagcaaaaatgggtatcttttggttctacttctctctttatttctcaaatgctcagcagacagcaaagtccccaggggtttcttagacaaacaacctctgatggtatgtttaaaggagagtctaatttcacaaaattaaaataagccaactacctaatacatatgtgtgcattgattgcttttatttaggaaagacaaaatgtcattccaaaactagaagaaattgtttggggggaaatattttgtctaatttgtagggaaagcagagagagtgcttcagcttggttttgaaacaggaatggaagtatagaataacttcagttaccaacatttttaataacagagaaaaatcatctcacttctccattctgccactataatttcaggcccacaggtaggttgacctgacatctgggaagtgtgacttgcccctcaccatttcagttacagggcatatttgctgtttatacgaagctggtggctctcagtatcatggcctttcaggtgcagattttgatgctccatgatgaatctggctcttgccacacctggattttaatattcattgttaacttgaggagctgccgcaggtgggacaagatttcattatgagctctttgaacttataccagttatagaagtggagaaatagatttcacccaagaacatttttaatgttatgtcagagcccaattgatctgatggacttttaatgacttcagtgataataagagagatcatgacttagacccgcttcagccagtgtggaaaggttgctggcaatttgcatggtctgatgagatctgaagtgggaggaaatggacatctgagttctaagacatcgcgctctgcagaggtgccatgatctgctggctgctggggacattgaccactgggcacgcgtgctgtgaattctgcatgcctcaagtcacctgaatacatcagcaaaagtcataacctatcaagaaagcaggcagactggggggtggggggaaggtgggagggttggactcacccacagacaccggaagacctgaaagaatgctgaataaaggaggagtggcgaaagagaggaagaaagtttccccactgttagaggccatttaggctgcttaagagcactaggagcaatccagagaaagtacttttcacttgcattttaagcaaataggaggtttagcaggatattatcacctggagagcacagtaatgggtaattgagtagggaaagggactgtgcatttctgattaatatttaccaaagtctttgtgtgttttttccttaaatgttaatgatgtgacagatccgactgaagaaaaaggacactgtggttgggaatatggtactgtgcccatcaaattctgcctcctctatgcttggcttatgatgaataccattctttaatagcaaactggtgttcgtgaagaacttattacggaggctaagagaaaaccaagaatgaaggaatgcccgcctggcagtgatcaatcaccccctcttaaagatgaaccgatccttctgttttaaagtaacagttcttacgaaggtctcaaacataaatatgcaaggcatcgaagcaattaccgttgccccatcctattcatgtttctgtgcatgtttgaggagaaggtgaagatggcgcccacctttcccgggagagttttcttctaggagaaaggagctgaggctcttctccagataaggcttcctattaaatggaggttaattattagtaccagcagcataataatatcctaatgccaaaggacgaagtcacatttggttagagatttctgcattcctagatgcagtagtcaaaagagagtcactcccaagagagctagctaaggaagccatgcttgagaactaaggaacacgagagtctgtcttcagagccaagatgccccagacccggaactcatttcgtggccacgtgaaatttgcaatgcctttttcagtttacccctgactttatcatttcttgctcaaaaatctttaaagcaagatttctccacttcctttaccttggcactgctgacattaggagctagatgattcttctgagaggggctgtcctgtgattgtagaatgtttagcggcatcccaggcctctccccagtggatgctggtagcagcccctttaatagtggtgataattaaactgctttcagatattgccaaatgtctcttgagcggtaaaatctccccctgttgacaacaatgactttaaagataacttggcgccttcagaaaagtttaatcttttctgaatgcccaaaggccttgatctcatctcctttaacctccacttatcattcactgataccaatcccatagagttctctctctttttttaagttatattttattttatttttatttttatttattaattttttgaaacagggacttacagggtggcccaggctggagtgcagtggtgcaatcacaccccactatagcttcaacctcctgggctcaagccattctcccacctcagcctcctgagtagctgggactgcaggcacaccccaccatgctcagctaatttttatattttttgtagagctagggttttgccatgttgcacgggctggtctcgaacgatcctgggctcaaacaatctgcccacctcagcatcccaaagtgctggcattccaggcatgagccaccgcacccagccttattttatttttaattggcaaataataattgtacatatttatggggtacgatgtgacgctttgatacatgtatacattgtggaattatcaaatacaagtgtttagcatatccatcatctcaaatctttaatattgtgggaggagaacctttcaaatcttctattggctattctgaaatataaaacatattattattaattgcagtcatcttcctgtgcaatagaacaccagaacttttttctcctatctaactgtaattttgtacccattgactgaggtctccctgatcctcccacgctccagcctcttataaccacctttttactcgcttttactttttttagatttcacatataagtgaggtcatactgtatttgtctctctgagcctggcttatgtcacttaccataaattatttcctctagggccttctcacactttctttttttttttttttttttttttttttttttgagacggagtcttgctctgtctcccaagctggagtgcagtggcacgatcttggctcacttcaagctccacctcccaggttcacgccattctcctgcctcagcctcctgagtagctgggactacaggcgcccgccaccatgcccagctaattttttgtatttttagtagagatggggtttcaccatgttagccaggagggtctccatctcctgacctcatgatccgccggcctcccaaagtgctgggattacaggcgtgagccaccacgcagggcatttttttttgttttttttttgacacagagtccctctgtggcccaggctagggtgcagtggcactatcttggctcaatgcaacctccacctcccaggttcaagcgattctccagcctcagcctcccaagtagctgggactacaggcatgcaccaccacgcccagctaatttttgtatttttagtagagacggagtttcaccttattggccggggtgatcttgaactcctgacctcaagtgatccgcccacctcggcctcccaaagtcctgggattacaggcgtgagccaccgcgcctggcccttctcacactttctaaaatgctccaggagcaagccctctgcctgtatctttcccgttgctgtttccttttaggcccagttcactgtagggtcctggtgcccagaacaggccctagaatatggacatgcagatgacttgaccttctcccacagccctgcatctgccaaaattccctctcccttcaagccatagcccagtgggttctttggcagaaggcttcaagtctatcatcatggttgagaacataaactctggagctatcctgagcttaatttctcctcctcaacctgccagccatgtgattggcaagttactgcaacttctctgtgcctcagtttcctcatctataaaacagatatcatagtggagtccatgagggcctcagagggctagtgtgagaatttgtgaaaaaagcatctgtcacgtaacaaaagcagcaccacctcgcctctgtttgccataagcagcacctcctaacctgaagccttctctatgggagaggtttgaacatccatctcagttttcttgtagcatattttcattgactacattttctgagccaaaatcaggacatggtgtgtaatagcatctaggacaagggtccagaggtctgaaatatgagcagcctgaaaacctgtggagagtagttgtcataattatagttcattcccatgtgtgtgcatacacgtgggtgccgcacgtatcttcccaacaggtcatgggtgggagaccgtatcttcatgtctgttccatgtgcagaagtattaatagagtagggagagtgtagggggcccctgtggaatatttgttgatttgaattcttctaatttaatgaaaggagagcctctttcagaaactcctctttctttctggctccccaagtccttcagttaagaaagagatgatcttttgcaccctctaatttcttaaaggcaggtcctgcacttcttaccagaacaattcagggtaagatttgttatttgtcagaacttgtggaacaatgttttgttttgtttttaatttttctaaacataatctctcttccccatggggagcttgattaaaatgtagatttctaggcttcagtttagacttaccaaattagaaattctggtgatgagacctgagaatctgaatttttaaatgcatcccaaccactcatgtttactcttactcctgttgagaaccacaactttaggataaagcagcaaaaagtagagaggctctttggcattacacatacacagagccagagagagtctgagcttgaaaatgctgccatttttatgaggggagtaagacagaattattttcctctgtgctttctgtcatgttctggataatgtaagttatgcacatggaggcattttcttttttaaatgaaaggcttgtattccacattccacaactcttaaaaacaagccgccctgaggaggaggactaggtttttacaattatagctggaagacggtacgtgttaccctcaacacaaagggcagcacaggtagtcgacaagttctgagaattctttctgaatatcatgagtgcagactgtgacttcagagcatcccttttgggaagtctccattagcaggtgtaccaaaaagggttccatatggctccaatatccagtaggattggatgcatatttgagcacaacccaaagagatgaaataatccatccttggtttatttctagatgattaatctctcctcaatatccaagacctgttttatgattaatttgagttttcccacaaccaagaatctgtatcacatcctcaagagtaacagagccccacatccaatgtgatttatttaagaaacaaaagcaaacaggctgctgagtctctaccttcagtgtccctggttcgccaacaatttcataccattaatttctttttcttccttccctgcagtttctgaagaatacacaactctcccttctgcccctccaccctctaccctccaagaactcaggacagttcttgggattttttcattatctcttttcagctggaggtattccaaatggacctcttgaattcccaccctctcatctcctgacttctcctctcctgacttctcctctctccatacaaacattctcaaatctctcttttcaacaaatagacaaataactgaaatacaaaaatacacttccgtacttcagttttctcattttaaaatgagcttaaatatagtatctactttatagggttttgcaaggattaaatgagttagagctaaagctcttagaagattattggcccacaggaagtgctcatctactctcaggtaataatttcatgggagggtgtgtctgtctcaatcacctatcatctgtctgtcggtctctccgcctgtctctagacctatgcttctttctcaatccaccctatctctctcttatctttcattaccaacctctttggaagagtccttctcattttctccctggagctcctcctctcccactcactcccatctctttcaatttgctttggccaaccctagctggacctgaagacgtagttgcatggcccatcctgtgatttctcttttgagctcatccctccagaaagtactgcaatattgtgcacagaattttaattctccctttgttttatttgcagtgttgcaatggagtttcatcgatatttccctttctaaaagaatcattctttggttgtggatgtagttgcggctgctgttgttttcctggttatgatagaaacagaagcttgtagtcctagataatctctcctgacctactttgtaagaattggagtgctgctccttcccaagctctgtgatgatgcttttgctctgttcttcctccaatgacccagtaaatgtcatggctccctaggactctgtcctgggttctcagctcagctcagctcagctcatctcctctttacactcagagatctcaaaatagcaaccttcaagaaggcctggtccacagaaatgttctgttggagcttcacaatactttaaaaaaattagtttctacatttccattttttcacctaacaattcctatttctggcttcttttgaaaaatcagggcgtttcagcatgccaggcttgtgtttctgtgtgatcatggccagctggagctatgagtagagcagtcttaatcagggcatttccaaattcttacaaccatcttcacttaattctgttcactgccccgcccctctaggcagcttaagttgtcattcctattgtgctagccctaggtaagttatggctccgcaaaacaaggacagccaaatttttatttttcagcccaccgtgaccctcatgcccacagccaaattcccatacatgttccaataaatcccagactttctccggccctctcttgctgctcacacttgctgcagcccttcttctctatccctttagcataaccttcagaactcaacattccatctgagagagtgttcagatctggaattctaaaaggaaaaaaataaattatgttatgcattactacttggaggcatgctagttgggcaccactactctataagaagactctagttacataataaaaaaaaatgttaagaagatacgtgatcaacaaggaaggcaggccaacgtctgttggagcagttgggatatgagataaagagtactggaaatatggtggtaaggggtggaaattcagaccatagtgaatccaacagccatggcagagaaaagttgggaggcagataacattaaaataaaataaaataaaataaagcagatgcaaaacctaaaataaagctacagaaagagcttgtgggttggcggtgccaccgagatatagatggaggcagagacttggggaactgttgatggttctggaagatgcagctgagtcccattttgggcatactgagtcagatgccagcagacatctaaagagaaaggttctgtacagttgaaggcaagagatgacatgtagaatagaagggtggatctaaatggcagtttcagaagtcacctatctatctgtggttttcaaaaagttctctgtgaaaaggagaacacagggaaagaggaagaaaaatgaggagcccaggcaggagataaagattcaagaagtgcaaggtcaatcagagaagttcagaaatcaaaatgataatttgatataaaaggaaattgtccaagagggtcaactgagcaaggaagaatatctgcataatatatctacatgaggctctcagacgtggccaggagaagattatttattcagtcaatgaatatacactaaacatctattatttgccagaaagcatgccaagaagaacaattcatcactgagattatatccatcagtgtagactaggttttgctacactaaactcccaaatctttacggcataaaataacaaaagtttatttcttggtcatgaaaggggctctgatccctgtcattctcattctgggcccagactgataaagcagccaccctttgaaacatggtgcttaccatgacagagagaaagaagatatgaatcagctcttaaatctcctcccagaatggaaaagcaagtcaggtggcccacgtaacttcgagaggacatcaaagtgtaattccagcacatctgcagagaagagacctggaacattggtgcaaagcctcagtgactccaccagggttgattccaagagggagtggaagacattcacagccctaaatattttcatgttatttctctaacccaaggccaactagaggggcccagtgcaaaatggaaatgcagaccccagatcgagccaggaaagtcagtgtttccttccctcaggcccccaccttaactcagggttgtgggatgacccccagagattgcacgctctggtacctgatgcagagcttacaatccttgggggtcatcccaccacctgggtcagggatgggcaagaggccccacctaccatgccttggtgctgccaccgccttgccccatcctgagatgctgagggcacgtgtctaaccctgactgtctccacacccatgtcccggcctcatcaagaactgagaaccatggcagaatatgggccttccctcacctatatgacccagttgccacccaggcaaaaccaggtaataggagcaagacagggacaagggaggaagacaggtagggcccaggtcaccagagggcagggaggggccagctgagagccctgcttagggagcagggagagcagaaccacacaggagcccatgctccaagcccctagctcatgtcctatgtcccactggacttcagttaacaaaacacaaattcacagataaaattattaagaagttcttcaagccagcaaccacagagccccttctgagagtgaaatcctgtgcaactgaactgccttaagtccattttaatgcctcagttttgactggaaggacatatatctcttctgccccttcacttgtcttctactttttctatccttccttccaattactctcagaatcatattcagattagggataatcctaataagaaattcattttttgttggttttttgtttgtttttgagacagagtctcactctgttgcccaggctggagtgcagtggtatgatcatggctcactgcagcctcaacctcctgggctcaagcaatcctgagtagcaggggctacaggtgtgcaccaccacaccttgctaatttttgtatgttttgtagagatggggtttcaccacattgctcaggtcaggaattccagaccaggaattcttgagcacaagtcatctgcccatttcagcctcccaaagtgctgagattaaaggcgtgtgcccctacacccagctggaaatacgtttttgatgtaacataaatcccatctactgagattacatgaacaagcttgaaaataacctattattttttaatagtcttcatcaaagatattggattctttgtaacccttggtttggggcctgagaaaaggacagggcaagggtggaaggcacaagttaacttggcaggacccataattttcaaattccagatttatgcaaagtttaagaatatcagccacggcttgcagtgagattgcatatttgataagccctcagattccctctttgccatggaggcggactgcagaagaagtcaggtgtcagggaaatagaaataggtggtcttaatgtgctctctggtgttatatctgtctgtagagaatatagcttacaacagattagcagacctgacatatactgagaacgcagtaagaatgatgctgttgatgttttcagaaatccctggagggaaattttctccttttttcttctctttctttctagaatttgtttgtttgttccccctctgtacttcgttgttcgttagcccactgccgtttatctccctgaaatagttttgtgtatctaaccatattaaacccatttatttattgtagtttatcgctgtttagcgtataaaatgtttatttatcaaccactcacgtatctaacatttacctgattgctacttgccgatgctgtgtgttggcatgtatctggctgggctgcacatatatttgatattcttagataataggagtaaatagaactgtttagaagttctaaagagaggtttcagaatatctaagaggcaaaatattctgcacccagaatgtgccctaatacccagaaaaatgtgtcctagaattgactctgagtgtgtctgaacaataacaaaacttggcagtccttaagcgtaggttaatcccttttagtatttgtgcttttaataccttaggcatctcctcttatcacaaattaataagtattagtgttttatataaggctgctttccccagtcatgtctgaactccataatgggatccagaagtgtatggattatctggttttcactcagcagtggctctttgacacctctcaatgcatggtaccaaaaaaaaaggtccatatagtcagggcacggtggcacataccttataatctcagctactcagggggcttaggcaagagaatcacttgagtctaggagttcgtggctgcagtgagctgtgatcatgctaccacatttcagcctgggtaatggagcaagaccctgtctcttatgaaaaaaaaaaaaagaaagaaaaaaaaaatggtccatacacatttctggagtggatgttgattgcttggttccattttgaccaagactcttacttttctaatctcttataaatttgcgtctgggattattctaatttacttatatgtgtttcatggacgagtatacacaaagcatccatgaagagacaatctcagatgagtgctcagaatctgggctttggaactgtgtttatacctagtcttgagcctaactagctgctgaatcttggacacatcacaaaatctctctaaacttcagaccctcatctataaaggaaaaatagtactagtacccacctcacgatatgtcatgaagaagaaacgagatgatcaatgcaaactattccgtatacagtaagcactccataaatactagctaccactgctctttccagtgcagtctggtcaaattacatgtgttgggcacctctgtcagcaagttagaaatttgaggtgtaaaatgggcttctcagtgcaaacttgttggtgtgttggtgctgtgacctctttccgccactctggatcttccccaaatggctgctcttgctcagacagaggcagtctctagagtttacacacaaccctaatttccactgaaattctttagagaggaggtggtaaaagagaggggtgattatttgggccttctgcttaaattattttatgcctggggtgtgtgtgtgtgtgtgtttgcctccagcaaactctgaagcaggaacaatgcatatgtgcactaaataagagttaccgatgttttaaattgtgcccaccaattctgagggtggacctgagaggcaggaaaaaacttgggttgggtatcacgcattcttccttgcatgtgggagtgttaattctcagtggctggtgtccactgagatggatgaagtgtccttgcaggggccaagtcttacgcatttgggtggcccccttaccttgtcaggcttcctcatttgttcattccacaaatgctcatcaaggccctactccatgtcaggcactgtgctgtgtgtgggggtacaaagtttttccccttgtggatcatacctctagaatagagggaagccataaatatgtgattgaattttaagtactatttggtagcaatatggtttggctgtgtccccatccaaatctcatcttgaattgtagctccaataattcccacaagtcatgggagggacttggtggcaggtaattaaatcatgggaacaggtctttcctatgctgttctcatggtagtgaataagtctcatgggatctgatggttctataaagggcagttcccctgcacacattctctcttgcctgctgccatgtaagacatgcctttgcttctcctttgccttccaccatgattgtgaggccttcccagccatgtggaactgtgagtccgttaaccctctttcctttataaattacccagtctcaagtatgtctttattagcagcatgagaacagactaatacaggtggcatgacaaaaataagtaaataaatgacacagagcaaaggaattgagaatggtagtgaggtgcagaggtggggagggaacaggtgttttaattaggccaacagggaggtggtatttgggcaaaacaaggtgagagaatgagtctggtgagaggagaggaagcacattccaggcaggtgagcagttgcaaaggccactggtggggagatgaacttcaagtggaagaaggggaggcacataagcaggatttgggggattaaaattagaaattatggtttcatattgaatgaaagaacaacaaaggaatgagtggattgatggatgtgggtgtggataagtgattcaatccagcagtggggaaaccaatgggctgctgtggttacagtcaaggaaaccaagctatcgtgagacaggtgatgcagtgagaaaagtcttgtgttgcattacttctcttccttatatcagttagctctgtaatctttctgagcttcagttttctcatctgcaaaatggagataatctttaatggttcttatcagaattagagattctgtatgcatcaataagctactgctattaattgattgcattacattatatcatactattttaaatatttttcaaaatgatgaaaaaggaatgcacatttaaggagggaggggagatgccctagtgtttgactgtgtagctcattttgtctttattgcataggcaaatcattattcggtaacctggaggttccttttgcaatgcaaatctctgtaagagaagaatgtgatggcttcccacaggccacctctctgggtgccccaatgtcttccttactctcctgactacaacctcgctcattctctctcagctccttaagtgctacaggcttctgctcctgccctccaccccacggctggtacacaagccatttgtccaactggtctcaagacattttgcacaattttagggcaaactgaccacctagaaatgcagtgtgaatagtgtcccctgcagctgcagaactctgagatcctgcaagcctttttgcatggcatgaacgtcacctacctcctgatttctccagtggtcttctactcatacttgagaccctatgtcctcagggaacctcctctggcctcccaaatgtttgtttagtatattgttttgaatggcattttttaattctgccaacgagaaggtcaatgatacagctgtatgtatttgctagtgtcttagtcagtctgggctactatagcaagaaccacgggctatgtggcttgctcaaccaacacttgagcaagtttaaatattccagaggctggaagtctgaaatcagagtgtcagcattattgggttctggtgagggccctcctcctgatttcttcatgggggagagtgagagtagggtggaggatggtgtagagaaaaaggaaaagggagagaaagagagagagagaatgcttcagtgcacgttctctcatgcctcttcttataaggacatgaatctcctcatgagggctccaccttcatgacctaagtacttcccaaagcccctatctcttaataccaacccattgggagttagaactacagcatatgaattttaaggggaacaagcatgcagttcttaacacctagtaagctccatatagaggttcctggccaatatcatcactgtctgcaagagataacatatggcatatcttccttaccaagaacaatttggagttagctaaactaatttaagtcattcatccacttaatgtatagttataaagcacacacaaggtatcaggctctgttctaggcactaagaatttggaaatgaacaagagacaaaagtacctgcccttcaggagcctccttcctggtgaagggagacagacaatagttgtgtatgtaagacaatcagctagtgctaagtgccattgtgcacataagacagggttatgcattcaggaataacactgggagaaggaagcagttctagattgagctgagaaccaggtgaaaaataggagccagttgtgcaaatatttagaacaagagtgtatcaaggagagccagcttcaagttcagaagtcctgaggcttagttaatggcattgatcagtcatttggcagtataaactgatacaccgtattttaaagccgtaatcatggcaaaaagcaagtgcattcaaggcaccacttgggttctaagtagctctctgttcccatcttttggccaagcagtggacaaattcagtatgtttctcactgcttaatccaatgtcttccctcaatctacctgtctctccattactaaatgactgaaatggcacctggatgtaaaggatgagaagtgtgtattttcataaagacttgtcacagttgcattacagttgggccacatggagaagtgacagaattattatccttcttatcactcaggagaattgtggaattgtacagtgatggaatttgctcttgatcaccactgtttgatcggcatgcttagagaatttaccagtgcattcatgggttaaaagggatatccagataaaggagccagatgcctctgctggcttacgctatatgggtaaatggttcttacgaagcagtgtatgatagttttgagggttagtgagggaagatttaggataaattttgtaagaaacaaatagattttaattttaggggagcggggtgggaagaagagttaaaatatgacccaaaaaagaagaagaaaatcctagtgtcttatgtgaggtccactgaaagcagagcctgaggcagggatttaggtgctggtgatttatagagggagaggtctcagaaaaaaaaataaaacaaaaacttacgagagagtgaggaaagcaggacagggcaggagaaagatgagtggagggagggtgtgatctcagggaaaatctgatcttggtctgaagcacaggcagagggctctggaacataaactccagtggagctgtcctcatttgaggtaagggggttggatttgtgtatcccaatgtcagccagtcatcagttatgggtgtcagggaggttccttaacctcccaggtgggtgactgctagcagcctctggggacaattttctggaggggggaagctgtaagcagccagcagccaccactcacaatagccatagaatggccacaccagaaaggcatcttggtgggtgtactagtccattctcacattgctttaaagcgatacctgagactgggtgatttataaagaaaagagcctgttccacaggctgtacaggaagcatgatgctggcatcggctcaagaagctcacaatcatggcagaagatgaagggggagaacacatcccatggctgaagtgggagcgagagggagagagagagaggtcaggtgctgcacacttttaaataaccagatgttgcaagaactcactatcattagaacagctccaaggggatggagctaaacgattcatgagacactcacccccatgatccaaccacctcccaccaggcctcacctccaacactggggattacaattagacctgcaatttcctagggacacagatccaaaccctttcagtgaggtattcatcgagtctcctgcacatagattctccctctgccaaaaaagatctatttttccacaaaagaaagtgcatacattcatttaattgttaacttatttattcagtaagatcttactgagcatttgctatgttctagatatcggtgtcacatcaatgagtaaactggatttgttgccagttgtcatcaaacttaagcaaatagggacgagacacaactaaatgagacattgtaagacacgatgataagtgctacagcaagagaggtcaagttcatggaagctcagagccctcagtgcagtcaaggggagagagtccagcgctatgctgcccagcatggtaacgatgaacacatatgactgttgaatgctggaaatgtcactaatcccaatggagctatgttttatgaaatacacatagactatcaagatgtaatatgcaaaaaaagaatgtgaaagcttccactgacaatgtttatatcaattatatgttaaaatggcaacattttgaatatattgagttaaataaactgcatttttaaaattaattttgcttgtttaatgtggctgctagaaaatgttaaatcacatatggggttcactttatatttccattgaatggcatagctcttggggcttcgtaaagctttatttcttcccttctgcatcacagaaaacctcacagaacagtcttctagctaacgtgtatttccactgaataacttctcataataaggaagatgtagccaagagtctctaaatctaatattcagcatttctaactgtttgaggtgcctatgttttgttttgtttttaataaggccctctaattatggattcctctttatattttcctctggtattcaaaggatcacaaacatacaatttccctcccacatcccatctagataattggagtttgattcaacactgtttccatccaccacggatacaattctcatttcatgattcctttctttcccttctccacatggaatgagcatgaatatgaatccgtggattccaaagtgaaaaggcaaagaaatataaatggtttgaagtgcgtctcttttcaagcaattttttcacctaacctagtaagatgtcactccgcagagatctcacagcacagccacactacaaagtatgataatcgttcaaaacataattgaaagatttcaaaagttgaactggaagcatttttgtcagagtttattgcaactattttgtatctttaaaaaaaaagtttatgaaagttctgtgacaagaagataaattatggaaccgtaagaatggggaaataaatgcattctggagactgacaaacagggcaaatgacgagaacatataattttagaacacaaaaaaaggtaactaaatttgaaaaattgcattagtgtatcattttctgtgtatgagccattagagggaaaaagtggaaattacaccctgtaacaaagtaaaaatgttttcagtgtttaaaggtaattttgtaatactgctactattacttaaactcttacctcttataaaaaaatccaaagacaggacccctggtgatattacctgtgtcttaggcaaagagcaacaatttgaattccattcaaacacatttgtattttgccaagtgctatcaagccctgagttgcataatttgccgtataagtgaaatagatacttttcctctgcacatttatcactctcctgtgggcttcattactgacaatcaaatcatagaagatgtacaaaattgtcatgatgcacttattttctcatgatattcgatacaaatagttcttctttacaaatggcctcttttttttttctctttgccacaacatttttgctgtctttcagactcttaggaaagttccagtgatagactttttttcccagcaaagatgtaggcctccttggaaaacaaatatttctatttggggaaaaattaaaaatgcttcagacagacaaaatcagtattgtttacaggtagttcttttactgttgctccatatgtgtgtctgtgtgtgtatgtataacatgtgaaagtatttatgaaaacaatagcttctgcctcaaattgtcttcctttagaactcatacatgtctcattactaaatcatcttaaggattaaatttagggttacaatatctaataccccaaatctagtattaaaaaaaagtaaatgaggcagtgggcaagatatatatagccttcattgtctagctattatttttctacttttcagaggattatgtttcagtccactctgaacaatgatggcaggcagttgacactgcacctgtaattggaaagactgcagggagcagtggggactgtgataaactgaagactcatagcctctggagggaggaactgctctcaactcctgttttgagttactatgtgggatgctacattcccccctttatttgtcttcaagagaagccaaaaatctggatgtctttcattgagagacagttattttctgatttttaaaagttgataatgtttttaaaagtgtataaacaccaaacaagccaaagaaaacacattttccagcgagatacagcctgaagactgccagggtgtggcttttgtggaagagactcttctctaagtttctcggggaagtcgaggtcattaaacaagagtagtggagtaagtcctgagttttattgtccctcctctctccctcccagcaagtgatctattggaaatgagatcgtctattgatagatgttgcttaaaatgtcatctacattagctgcaaatattccacttttcttaccaatattgatagtatttgaatgttaaaaatagtgatttctggctgggcgtggtggcttatgcctgtaattccagcactttgggaggccgaagtgggtagatgggttgagctcagtagtttgagaccaggctgggcaacatggagaaactctgtctctaccaaaaacacaaaaaattagccaggtgtgatggcatgcacctgtggtcccagccacttaggaggctaaggtgggagggtcgattgagcccagcaggtgcaggatgtggtgagccaagatcacgccacttcactccagcctgggtgacagagtgagaccccatctacaaaaaaaaaaaaaaagaaagaaaacaacagcaacaatgatttcctctatcatcaacaaccatcatgacattattgtcatcaacatcatcagcagtagcatctagttgagtatgttttaggacaaaaaaacgaaagatctacaaataagaccacttttattttctagacttcaagttaatttctatttctatcagggcaaacagaaggcttcaattttaatcttttacggggtcctctttccctaaggttgagccagggatctagaaagtactccagcccaaggtgtttggagggaagagggggcagctctctggaaggatgtacagcctgttgggttacggggagacgttcatcacaccagtcaggatgctctctctggcatctgggccatgcttggaggatggatatttttcggcaaggctgcctctggtatcacggctacctagacacaccaaagatattgaatccctgggatgttggcttccattcactgtgcagtttctcctcctcccagccaaagtggactctctttttcatctagaattggtgggggacagggcatgaggaaggcccactctcaacccccacttctgattaaatacattttcttttatttctgttccaaattctctaagcttccctagagatttaaacttttggaaataaaaactgggggaggtactgggtatttccgctttctactcttccacttcccttccctgacataagaagcaccacccataactacatgaatgggttggagacaaaacacggattaaatcacagaagtatctcctcactgtcaccaatccggcttctccagccacctctccatcagctctgtgctggatctcagtaggtattgtctcatctatttttcaaagcaacttctatgaagtaaatattctcatccgtgtcagttatctattgacaggacagtgctccataaccaaaacctccaaatctcagtgccataaactttaacatttttttagctcaccagtctgtggagtacagatgacctgggctagagctgggctgatctcagttggtcctcttcaataaacgtatgatcagcttccatgagggattacagcctctgcttgtctggactggactcactgacatgtttaggggattgactatcggttggctgatctaggacagcctcaactatgatggctaggacaacttggtcccatatcacacctgtgtaattgtggagcaggctaacctaggcattttcttcttacatcaatggctgagggtaaaagcctgaacaagtccattcaggtaagcatttttcaagtttttgtttgcatcacacttgctaacatcccagtagacaacatggcacagtcaagcctacagtcagagtaggaagatacaagtaagttagccggcaaagggcatagctagagaactgaagtactggggcccataaaacaagcactaccccatttcccgaattatggaactgaagctggaagaatgaaacaatttgtgtagggccagagcctgaaagtaaggtggctgggctttgaacccatacatgcctggttccaaaactggactcctaagtgcatgactctactgccttaatttttaaaaggtgcttataaaaacaattctccgtgttaatgcagcatcttccaggccaaatggagcgttgggtaattgcctgcttaatatggttgatagagaaagcaaacttcaagccaaaacacccgaatttcccctaaacatatgtaatcatcttaattttctcttttcctctgttgacatagcttagggaagacaactcccttttagcgtcagccagtgtttccctgggaagcagcatgcagggaaatagggttggcattctttcctcctaaaaaatgcattttatgtaatcctgctatctttcctgggccggcccttcactacccactggggatctctcttgcttaactgtactcttttccaatgggtttgaacccccctgcatgtctgcaatcaggcttctgttgggcaatttgggacccagatttagtcccaatcacttgaatccatttggaggctgaatttcattcctaatgaacaaactgctcaagcagtgctgatgcatctggaaggactaggtcactgatcagtgactggtttgttccagagggcagtgttgtcctaatctgagagacagatcacatttttgaagagctaaatgcaaacctagcatcaggaggagctctctccatgcatcatcgacatgaccaggaattgccaacttggctttacggatgattagactttttagaatatggcatgaagccctagttatagactcaagttataacaatagtcatcatatagcaataaagattttctgaacctttgtcaggtagcagaacctatactaaactctttctttgcattttatcttcacaaccatcctaagatgttgatgatgctacatgcccattttccacctgaagacatggagatttaggtgacttctttcccagggccacactgtcagccagaaagtgacagacacagccagggagtgggcataacacgtgattgttaggaggttagcaaactttttctgtaaagggccaaatagtaaatattttaggctttgcagaccatgcaacaaccactcaactctgctgctgttgagaggaagtagccatagataatttgtaagcaaatgggtgtggctctgtgccaataaaactttatttacaaaagcaggcagtgacctggatttggcatcactttcaagctatattgctttggccaatttactcaacctcttttggaatgcgattttgtcatctcgaaaatgaggatgataataatcataatgcttaatttatagggtgattttgaggattaaatgaatgttgcatagaaagttcttgtttatattattactaatggtttatattattgctaattattaataattacaaagagatattgtgaaaggccgtagaggagagaagtcaacagcaagtcctccctgggcataagtctcatctctcctggttacccgctgagtggccttgggcatgttacttactctctctgagcctcagtttccttttcttgtaaagaatagtaaaaggatgagtctcacagaatgattacaaaggtgaagtacatttaatgcctgtgaagcttttagaacattgcctggcacatggcaagcactttctggttgctcgctgtattactattattgaataatcatgaattgagcccaaatggcctggcttcctacctcaggctctttcccaccctacgttcctgcaggggttcttaagtattttatactatcaggcaaccccccggtgatctgctgacacctgtggaccccttttcagaatactgtttttgaatgaataaaatatataaaagattacccaaacacctaattatacaggaatgcagttaccaaaatatttaaaaaaaaaaaattgtgatgcagttgtagatgagcttctttattaacacattagataaccaaatctatcagtgggcttaataattacaacaattttgaaatagaaataagcctcagtgatatttcaatatctctgcaacaactgtaatgtgatatgcagatatttatgatttgtattggtgctaaagtcacaagtcccatgacttagtggctacattgataatagcagaaatgctaaatttcacttaaaagttggtaaaaataaaactctgggtttttgtttgttgtgttttaaatgcacatttatgaaattcccagattcatgggactcttgatgtccataggcccccaggccaggaacctctgtgcctactaccctgaagaagccattttaaacagtaataaacctgaacaacactagtgctcatccacataaatactccttgcatctagatcttttggcacataaacatcgattagatttggcagagcgatgtccacaaagagagccagcgcttcctatgcctgtgcgatcacacagcattcattcctgggtatgtgagccagaaattagggactgccttgtcccgtaatttgatgccctacatggggaaagattgtcgttgggactaagccaacgagaggtaatagaaacatgataccactgacctcatccaggaaaaatagctattgtcacaggacagtgatgctgagtatttgtaggtttggggagaaatatatttgttagtgaaatggagcttactctggagtgagtaaaggtgaattatttttcagatgactagaggaggtttatgcaatatagtattattgagtggggctattaacagagtgaattgctattgtgacatgccattaaattgtttttagtgtccacaaaggtatcattcaggagctggcagggttagtaacagagttgtatttttggtggacagcagtagatcttgaaacaaaatagcatattttacaaaaaagtaaaatatgaccaaagctgaaagtctatagcgcgaggtagtcatttgcaactacttgacaagcaccccgaggatctgaacaaggctttccggatccacactgttgtagatagtggaggctgaaatctgagcaatccatcaggaaggggaagtgaaggaagtgagaggtagagataaatctgaatcctgggctctttcgaggatgttctgtccgttccatgaatgtacctccaacatgtagcagagagactggcttaataattattggctgaaggaaggaaaaaggtaaaaaaaaagaagaagaggaagagaaaaagaaagagggaggcaggaaagagagaagagagagcgaatgaattagccaaccaaactattggtggtatattgatggtatctatagatgcacatgtggatctgtgtgtgcatgaagatgtattcattcatttgttatttttcaataaatatgtattgagtgcccactaagtgttgggcactgtgccagaaactaaaaatatattcaatgagacagaaaaggacgaagctctcagatgacttacatttgagtgagggattcagagataaacaaggattgaaataagcttacttcaagatagggctaagtattataaagaaaacaaacaaaaaataaaaacattgtaacaagggagaggataactagaaagaagctatggctgggcatagtggcgcacgcctgtaatcccccaatgctttcggaagcccaggtgtgagtattgcttgaggccaggagcttgagatgagcctaggcaacgtattgagaccctgtctccaaaaaaactttttttaatagaaagaatgggctactttgggtaggatggtggccctgaagctgaaaccttgatgacaatgaaccaaccatggaaagatcagtggaaactgatgtttgattgacagcgacccacatgtcaggcatgcactcagttctttgcatccattatttgatttaatctttattgaaaactgtgaggcagagtatttataacaacttcatcgatgacaatgaagaaagtgagactcagagagacaagatgacttgctcacggtcagagggccaggaagaggcagaggcatgatttgaaccctgacttgctggatccaaagcctcacagatgagccagggtgccctgctgcctcaagaccaagggaaggtctttattcctgttcatgctaatgaggggagaaaaatttgctctaaagtctctgtcttttgatttgcaaatgagtgttctttttttaataccatgttgtggctgtttttggctggtcacttggctttaatcgtaaaacttgttgtaatccagatagtagatttcatcttgagggtgattcctaaatgatactaaagaaaatgtacatctttcctatgtggtcaaagaactgagtcatcttcctaagttagatggtggtggggaaagggacagggacttaaagaaaacaaattcttccactgaagaggctcaaccccatatgggacacattttctcataactaaactcatatgggctgagccatgtggactgttagaaaaatagagtaattttagtatcaaccagctacatcctgctctgtttctgccttggtgccttggttttattgtttgtttgttttcttgttccgtacctgcttcactggggccagtgaatttggtgtttgttgttgttgtttcttggtttttgtttatattttaagacagtagattgctataaaacattggtagtatgatgatagataattgcttaccaaagacatgcaacttaaaccaccaagtaccataattgttactgttactatgattatttggggtatcaattcgctatattatttctttatgtcaatacccagagaaatgagcaggagcacttttttttttagatggagtctcgcactgacgcccaggctggagtacagtggtgcaatctcagctcactgcaacctccacctcccaagttcaagtgattctcctgcctcagcctcccgagtagctgggactacaggtgcacgccaccacaccaggctaatttttgtatttttagtagagattgggtttcaccacattggccaggctggtcttgaactcctgacctcgggatccaatcccctcggcctcccaaagtgctgggattacaggcataagccaccatgcctggctgggcaggagcacttccatatgcgccaggagaaagtccaaattcataaccccctctgttgagcactttggtaagagatcaaaggcccatgaagtgaacaaaggctgtgaccccgtacttacatatctagcaatctagtaggagaatctctgcactaagatatatgtaaaattatatccagtgaaacattggtaaaatagtgaaaaattagaaacaacaacaatatccaataataaggaaatatttatttttgtcagtaatataaaaacttttattattttagggcaatacttcccaaatttcagttatttgcgcaccattttcacaatgtgccaaagctctactctttattatttaatttttaaattttgtgggtacatggtagatatatatatgtatggggtacgtgtgatgttttgatctaggcatacagggattggttacttttttaaaaatcgggcaatggatcatcacctagcattaaaaattcatgtttataaaatgaaaggtttcccacatattaagtaggaggaacaaaaggcaacttacaaaatagtgtgtacattataatctgtaccatactatatccatttatagctataatatatcaataagtggatgtaactatagatagatactgttggataatattgttattacattgttatgatacaatttatcatagacagtgctcttctttacatttttctattacttccagattttccttatgaaacatgacattatcaccaggaaaatatgcacacacacaatgaatgaaggtcggcgctgacggtgcaagtttggctgtcagtctacgcagagtggctctgcgtgtcttctcccctcccgtgccttgcttaaccttcggttggatgatccacccttttctgtggccagcgctggctcctggcatccttctgcttgccttttggttttcagcacaaattcctgatctgattcaccaggtcctgcttaatatgtattaccaaccctgtgttgacaatttcagaaaaactcagtcctgcttttatactcgttttcctctcggaatggtagccggcaaaaggtgttcttagagatggggggtcctgtgtcttactaattcccataaagggaaggggagtggcagaagaagaaaaaaagtaggaaaagaaaatgttagttatgtgtggttgatagtggctcagtgggtttacatattatgatagttatcaatttcttagcgctagatgctgcaaatctaaatctatgtaagactcaagaagtggttgtgtgtcttgcatgtgaactgtatctcacagctaaaatttaaaaaaaaaaaatagaaagaaaagaaaagaaaagaaacagtcatgggagcaagggagagcaaaagccaaaggtgaattttatttgttgttgttatttaaagtaactgggtcagccaggtacagtggctcacacctgtaatcctagcactttagggggaccaaggtgtgcaaatcacttcaggccaggagttcaagacaagcctggccaatgcagcgaaaccccatctctactaaaaatacaaaaagttcgccaggtgtggtggcgtgagcctgcagttccagctactcaggaggctgaggcatgagaattgctagagcccggagggtggaggttgcagtgagctgagattgctccactgcactccagcctgggtgacagagcaagactctatctcaaaaaatatatatataaataaaagtaaataaagtaacagggtcgactgatttcagaggaatgtgtatgttgaagggcagtgtggttaggagagaagatctcagtcgctggattcagagttgcctgggttcagacccaggccctgaattcatcggcgttgttaccttgaacagagacagtactatttggcaattaatacgagcatcaagcaaccagacacccaagttccaatcccagctcagcaatttctaagtgtgccattttaggcaagtcacttaagtgtctgagctacacttctttgcatgcaaaatgagtgaaatgctatttcttttacagaatcagaaatatattattaagcctctgacacgtggatgatacataaaatggtgactaatatcactttcagtgatgatgatttcattttatgtatgtgtcttccaaagaggaagaaaaataagaacatgaggaagagggaaagataaaccagattaggttgtttatgatttcatcaaatggagaactcctgaacgttttgttatgtgttttgtttttttgtgaaacacaagaaagtcaccaggacatctgtgtgggcatgtgtgctcccctccatattagattacatgttttaggacaataaatcagtgaaagaaaagtaataaataatgcatgctgacaatgtgatcatgtttattaagaagcaacagccttgtcatcttcattttcttcttcagtgattctcttctctaagggttttctctgcagggactccctgcaatctagctggaggccattctctaattcctgtttgcagaaatacctgctttgcaaaaaaataagttaaaagctgaacacctgggtcctctgatgagtctcccatcaaatgcagcccatcattagagatggcttctcagttttgaacatcagggagaaacgagtggccccactccacgcctcctgcgtgttggtgctttcccaccctctgttcttgctcctgtctttctgctgtgagttttctaagaagtatctttaggcatctagattttgaaaaagaaaagaaaaagctaacttttcttttcctagaaatttgcagctgctaaaaccagatgtagacattagtaccttgtgacatctgaagattttaattgggtttgcattttaatctgttactcttcactcatttgcacttgaatgacaacccccccccccccccaaaaaaaaaaagccacactagcaatcctagtctctcagatgcctggagcagaattttgctctgtaaaattgaagagtgttgcatattgagaaaaagagagggagcgagccaggttgagaaagtgggagtggtgaaggagagtagagggaaagagacaggaagagagaagaaggaagaacttgcaggcggtagccaggagcaccctggctggagtagaaggaacctcacatgcgcctcaccctcagccttgtatcacctctttgaaaatgtaatgatcaatctgacccaggcagtaactgttctgacatgccctttcctcaaatgtcttgctgtctgtgtcctaggttctgagagagggttctatcttttgagaacagagctagcttaggatttcagtcaagggtcagcttatatgtctctaaatacccttgaatcccctgctcccactgcaggtttctcattattctttctgcccctaattttttttttttttttgagatagagtctcactctgtcgcccaggctggagtgcagtggcaccatcttggctcactgcaacctcagcctccaggttcaagcaattctcctgcctcaccctcctgacctggcttatttttgtatttttagtagagacggggtttccctatgttggccaggctggtctcaaactcctgacctcagttgatctgcctgcctcagcctcccagagtgctgtgattacaggcataagccatgacacccaaccctgcccataattttttttgtcctcaaataaaacgctaatcttagaaaaccacaaaggtccccctctctttctctccattctccttcctagtattataccacctcttcatcccaagacctgcatcatcttgctgaaggtgtgtgtactgtgacactttatcattgagtgccaagcctattgtgcttaaattattcactagtcaattacctgtgtacagaatccatgtttaattagcttgtcctgacataaaatatcaggattttatgttccctctggcttacctctgacattcatttttaagttaatgttttgtcttcttgcttccttcattccctctcttccagccttcctctcttattctctttctaccgttttctatctttcatgatgcatatctcttttctctttctcattcttttctctccctgctagcatttgattaagttacaaaagcagtaatatctatgtttttaatattattcattgcattgctttcctgaccttctttttccctccagggtgggaatgcagcccctgaattccttgacaggtggccactctttgacacgttagactccaacttgctcaccttcttccaactggcttcagttcattccattttgaccactgccatggttggcttctacatgatccccatttgtgtctcaacttggtctcctcagccaggagctctgagctgcctgttccttgcctttgatgtacctccatttcctgtaattaatctcagctttcccacagctcagcagtacatgacagacacaaggataaagcacccagttcgagccagctccagtgtctctccacttgtatccattcctcgtggtctgccactttggtaggcatcatcttaccccagaggtagcacatatgcatgccatgcagaaaacacaacactgacttctgttcaaagaaaatcaaaccgccagaaagtgaggtcatgcaagcaggcagctcgtcatattctcaacagggagctttgctggataattctgcttaaaaatacatatatttacatttttatttatatttagttctatgtatattcagtgttccaagaaaaactaataaaaatcaactaaacatctagccattccagtgaattctatcgcattgccaaatatagtattgggagcattgtcctaactctgttgtctccgtggtatcaaaagccagtatcactctgtgttcttgattttttcttatcgacattcctgacactggctatggggtgtgttcagcaccaaaaggtctgttttgcctaaccctttgaccaatagaacaagtagattggaacaatctgtccttgtaagggttctttataaaaatgttgtccttgcattctttgatagattttttaccattttttctgaaaaaaaaaaaaaaataggccacgtttcatgggcaagaccttgatactatctggagaaacagatagccacaaaaagtactttgaaaaattaaaggcattctactcattctattctctaaacagttaaaggcactctacttgccccatgagtctcaatttcctcacctataaagtgggcacaactcagcacgccagaccaatagcaacctctctgagataacccataaagaagtgctctgaaaaccccagaatgttctaacaatgaaaacactgtgctccatcttcatttttatctggaaaatacagcaaattatattttctttgaagctgtctacaagaagtgtttggctggattagccagttaatgttagcaaactgtgttgagatattgaaaggttttgtaaaaaagaaaacaatatatgtttttttctgacactgtagaatgtttagtgttcatttaacctggagcatagcacacctcaatataaattttctcatcatttgacactttttattgtctctgcttaccatctgaaagaaggaagctgggcatttggaaaggggggagtttgtgtatctcaggattttgacttgtctgtgtcttccgaaggagatgcatcctctatgtattacgcagcaacttgctttgctcacttaaagatatagcatggacactcttaacaattcggcagctacatagctacacggacaactcggtgtttttacgcactcacatgttacataattttacataattacgatcacattatatgatatttgctgcttttatatttttgttggtcatcttctccctctttatgtactgaccctttcactgttggtcccacccctttcccactacactctgctatcccaccccatccgaaaacccaaatcaacaacttgaagaggacgttcacactttatgccatgggaatatgacctgtttgtgacatttatactctttttctctccaggccatctctcccctgacaaagaaacacacacacacacacacacacatacatgcacatgcagacacacacacacacacacacacacacacaagggttgtggcactgcctttttattttttaatctatgtttgtgaaaatggcaagcatcctccaagaaagaagacctcaaatttgtgtctggttgctttttgtcttatttttaaaattatcatatggtaaaattgactttctcctgtggtatacagttttatgaactttcattcatgtatagatctgtgttatgacaacaacagtgaggacccagaagagctccagccctccagaaaactccctcctgcttccctctccagtcacaccctcctcctaccctactcccggtcaacctttgatttgttctccatctctatcattttgtctttgaataatgtatatagatagaagcccgcagtaattaacctttggggactggcttctttcatgtagcataaggcctttgtgatctgtacgagttgctgcctgcacctgccaattactcctttgcattgcagaggaatgttctggtacatggatgcactgccgtttgttgatgggttctcccaagagtggagatttcctatggtgctggttaagtatgtttgtttatttttattttattttattttattttgagacaggttcttgctctatcacccaggctggagtacagtacagtggtgcaaccatagctcactgcatccttgacctcctgggctcaaggatcctcccacttcagcctccagaagtgaggctggaactacaggtgtgcaccaccatgcccagctaatgttttatttttttttttagaaatagggtctccctatgttgtctaggctggtctcaaactcctgggctcaaatgatcctctgacctcagcctcccaaagcattgggattataggcgtgagccaccacacccagacaatgtttgtcccatttctagtacttcagttttaggtagtgtattcgtgtgctttctgttgcttataacagaatatctaaaagtggtcaatttacagaggaaataaatgtatttattatagttacagaagctgagaagtccaaggttgaggggctgcatctggtgagggccttcttgctggtggggacactccacagagtcccaaggtagcatagggcatcacactgcgagaatgctgagtgtgttaaggtgccatgcacaagtctctcttcctcttataaagccactagttgcactcccatgttaacccattcattcattaaccctttaatgcatgaatggattcatcacctcttcaacgccctacctctcaatactgccaggcaggggacaacattcaaaccatagcaagtagagagcgtatattggtgcatgcatttaccaaattaaaacatggagaaaaccaagggatcgaagagctagtttttaagggaacttaaaattaatttgagcttacatggcagatggactactgggaataataactccttccaccatgtattggctacttgctgtatgtcaggcactgtgctgaacactgtatttcaatattttattacctctcttaaagcccacttcagtagacactcttaattctgttttatagaagaggaacctgtaacatcaaagtagttagaggaaagtatccaatctccctcccaaacactggaacttcccagcagtttgtgcttctcttggcttgagttaagagtttcaagtctcctttcactcagtagtttagataaacttgatattatagtttcctttcattcctctaagtgatgcaaattgctttacccaaagaaaggcatcacattacaccattacaggaaaaaaaaaaatctactgaggaagaaggggaaaagagatgtttggattttttttccccttcatttttttttctacctgattaaaatgactgttaggatccattttccccttctttcttgttaagtgaagatattccgatcttacatacagaagcaaaatgaagaaaagagatgatcggttatgtggtttaatggactgatatcgtctagatgattcacaaagcagggagggtggtgtgtctgccctcctctgcctgtccctgtgtggggatggcgcttgggttccgaaaaattaaaatacatgcaatcaaccagttacctacttcaatttcccactgtagttatcctggtttgcctttatcattgatagtaacacttctgcagctaaaaatctaagaattagatttacaaaataccaagaaaactgctaacagaaatttttcttctattagctatgtagcatccacagctgggcagacagatggataatatattcgtgtttcttttttttttttttttcattctaaacactgtgtatcaagtaaattgttttccccaggaaggatcttgctggctccgtcaccaagaattcagctcctgcaggttacataactgttcgttaggcattgaagagctcaagattccagcgtctgtgaataactgatataaatggaatcactttgtaaatggctgtcaggaactgcccctccattaaggagccacgtctagcccatcacagttgccaccatccctctctcacccatcaaatctgccgctaaatcctatttggtctacctctgaagtggccctcaaatgagtccctaactctcttcacccccacggctgctgcttcatccaggactttgtcacctttcagacacattcatatcatcgccctctagctgatctctgtgcacgtagcccctttaatccattcttcttattggcaacaggagcatctttgtaaagcacagctctgacctgatcatgtagttccaaaaatactacagatcccagggctccaaacaatatttccacaagtgtagcggataagatgctttggaggaacatacaaatgaatacatttcatttgaatagttgtggtatttttagagctatctttaaaaaataaatctaataaagtgtatttttaagtgagctacttaaaaaagaaatccccaagtcagtagccagccaggacaaaaattgtgaaagtggtccacaaatgactaatgtttggaaaacactggcagaggcagaaaatccaaactccttagcccagcattaacaatacttcatatatcagtggccgggcgcagtggctcatgcctgtaatcccagcactttgggaggccaaggcgggcagatcatgaggtcaggagatcgcgaccatcctggctaacacggtgaaaccccgtctctactaaaaaatacaaaaaaattagctgggcgtggtggtgggcgcctgtagtcccagctacttgggaggctgaggcaggagaatggcatgaacccaggaggctgagcttgcagtgagcagagatcaagccgctgcactccagcctggacgacagagcaagactcttgtctcaaaaaagaaaaaaaaaaaaaaacaatacttcacatataggttcctccaaaatagcaaatagtcaccttaaggtctgcctattctccctccacacaagcttttcaaccagggcttttctctcacccttagtcacatcaaacactcggcagttttttcagcacactaagtcctttcatatttgtgctcttcctccaccccccaacccctgccaacatattgttccttttatctattctagattgtatttttctacctgatggacttctatatatacttcaaaacccagtttacatgtgccaaactttgagaacccttctctaagtccctcaggtggaattcaccaggcctctgagctgctacactctgctggtaacattcaacacctgatgttctggctgtttcagtaggtgtttccttcaatccccagcactaaggaatcccacagggctgtgcccaagtctctgtctctattgaccagcggtgggcatggtgcacagagaagggctcaaacattttctgaacaaatgaggaaatgaatagctgagtgaatcaaggcagattcaagggtgtctacaggacagggaggtctcacacacaactaatctgacaaaaggaattaatcacaatacaccatcctccctgctaagtgggtctgagaaagttgttctgacagtgtttctcaagctacttaaccacaactatcttttcttctttaaattactctgaaacatttacccttagcaaatggtgacacagctgcacagatgccttcacataacactcacaagacttactataactgcttgctctctgcctctcctccccaccagattctcggtttcaccagagcagagactaaggctattttgttcattgcagtatcacctgctagtacagggtctggtttatagtaagtacttgttatttcctgaataaatggcatctaaatacatattccatgaatttatgtggccaccagactatctcgatttttccttgaagaaagagactgggcaaggtgaggtgggaaacctcccacagaaggccccttcaaagcaagccctttctttaaaaagtatttgccctgcgtttactctgccctgctgtggtaccagctgccagcctggagtactttccttcattccctgaattcccactgtcctcccaatacaaatcaatctaattctgtgttactggccagcattttgcttttaagtggcagtgatcaaaagtggaatctttcgtgtcagatagagggctagcagagtggctggcacatggcaaggcctcaaaagtgctattatcatttacaataatttatcatgatgtttacactcctaatgataataaatgctatgtgcaaaaaacttggttctctttttctggtcccttttatcattttatgtccagtcctgaatccattcgactgtttattaggattcacactaaaccatacctatcagtgatagctgccctaagaagcttttttgcatgtttctcagcatttaatcattttaggacttcgctacagaacttctctaatcccatcctctttatgttcactcatgcatgtactttttatctggccgtttttttgcctcactggatcttaattttctcagtccttcattaattcgttcgacaaatatttactgagcacctacgctatgcaaaggtactgttctaggctctcagtgcacagtgttgaacaagacagaacagcttttaccctcataaaaagtttactgtagtggggagaaagacaaaaagaagaaaaaagggaataatatgtacataaataaatatgcaatatatataatatgatatactaaaatatgttaatagaatatagcattatatttaaaagatagaggggccaggcacggtggctcgcgcctgtaatcccagcactttgggaggctgaggcgggcagatcacgaggtcaggagatcgggaccatcctggctaacacggtgaaaccctgtctctactaaaaatacaaaaaattagccaggcgaggtggcaggcgcctgtagtcccagctactcaggaggctgaggcaggagaatggcatgaacccgggaggcggagtttgcagtgagctgagatcacgccactgcactccagcctgggtgacagagcaagactccgtctcaaaaaaaaaaaaaaaaaaaaaaaaagagggacagtcacgaagacctgaacctcagtcacagagtcagtggtttcttggtttaatttctgattctgacccccatggctatattccctggccttgccaggtacccaaccagatctgtattatctcatgacccaaacaagcttcccgctgacctttgcacgtttccagtcttaccactcctcaggcttcccagaccttctgccgttggtggttctgatctgtgcatcactctgggaagagggagagctttgggggcaaagcatgccaggtagaatctgtccagggaaggggtgagttgagggacggtgtggacagcaggtactccagggtctttcccaaacccgtatcttgcctatcaatcaaaaatgaagctttgtgtgtcttgcatttcaaaggcatgctttagccacagagaactttctggaggttcctccttgcactgtggaaacattatttagcacagcatcttaaatgaggtaggcggtatgggaatatttgttaagtgtttgagaccatcagaagctgaccaccaaggaggttctgggaatttaactccattgatagggatggtgcagtgagccacgtgggtaccactgctgtccctcggtggatggaggacacctatagctcctgagcagacagcaaaatgagctccaaggagccaccccaggccagcagccagcctccagagttgtctgattcttcatggccctttttcagactggcgaaggctgggagcccagggcatcattagtatccttccatcacttcctcattagttcttagatagtgttttaatgacagcttgagaggctccgcatcctggcctccttctatttatgatccccaccgtgttaatgtgcacttaatgagaaattcttgtcttgcttgtaaatcctgtagccggcattcaatttattgacagatgtttgcttggatctctttaaaattacttcataaatcttcccagataaaaggcctcaagtttggttattaagacaaggccttgttgacagtttcatatttaactgtttagaactcagctgtcagggctgtaatggggtgtatggccaaggggcacagggcctgggtgctgtttgtcacctttcctgcacctatccgggccctccctggtggagtgtgtctactgtttcctgcaatcccctcagttaacttctgggtgacctcgctgtgccttgcacttattcatttagcatatcagcttgtcagtgtgatgaagtgttcctgctgataggcgctaagggctgagtaagccacagtgcctccatcaccggggagaagtgttgatgggagcccaacgctgaggtcgcccttcccacaacagccaccaggcaccagctggaaacctgtgggcttcacctccatctgtgggcaggaagcaagtggatgtcagggacggtggtggggggctctgcttggaagttttaagaccacactcatcttttgtggccatggacttttcaataccatcctaagtcaagattttttgttgtttgttgttgtttttgttgttgcccatgacagaaaactcacctcaaaatgacttaaggaaagagataaaggagaagaaagatagttaactggctcatgtgattgaagagtacaggggaaacgaccttcaggccaggtgcaagggttaaggtaattttgtttcactctcttcctagggtcctccttcctctgtattagctacactctcagatcctgtcctgcccccagcagctccacagggcttccggttcagaccggaagaacaggagaacagaaggccacgtgcttctcttccaaatgcccaggaggaaaaaggctaattaagtctcattggtcccaccaggtcacatgtacaggctttagccaatcactgtggtcagaggtaggctatgttttgattggttaggtctgagtcacgtgatgagttccaatacaagcacaggaaggaagataaggccagaggatgttctctagagaaaaagtggggctatgttacctgaaccagtcagcacacatgttcagatattctgatcaagttcagaacaacagcctgctttgtctaatgcttgcatttcattttgaaaagttgttatacattggcagcctctgagctgaactactgagggtgtggcctactcatttgcagagtgcattcaaaagattaaaattccagaaaaccctggagaggccaggccattgagaggtcctctaaacccacccacaagccggtaacagtattaagatgaaaaaaaaaaaaaatgctctgcttaatactatcacaaatcagcccattgcatgtaagacgataatgagcacttgggccaaaaatagcgtgttttttgcttacttgctggtgtcctgtcacattgcattgcttgaactgtgtcagatcgcattgagtaactttgcttaatccggcgctgacgtgacccgctgctttgcaacacttaagacaagtgtgtaggagcttttctcctcagtccattttgtgtgtgtgtgagtgcagtttaccagatgaggcatatgtaaatactattcgaattgaaaacacatctatttaagctagaatttattaaggggcctgtaggagtgaaggcacaagaaacatttactcacagaccccgacaggcttctacagaagactcactcctttgccccagaaaataccacgtttactaaattctgatattcacagtttcctatgtggaaacttctgaaaagtttagggcacactatggctgacagccggaaggtaaacttggctatgattttctgttgggccaactccccatgcccctgagaaacacattcttcacaaaaaataattgtaataggccgggcgcggtggctcacgcctttaatcccagcactttgggaggccgaggtgggcggatcacaaggtcagaagatcgagaccatcctggctaacacagtgaaaccccgtctctactaaaaatacaaaaattagccgggcatggtggcgggcacctgtagtcccagctactcgggaggctgaggcaggagaatggcgtgaacacgggaggaagagcttgcagtgagccaagatcgtgccactgcactccagcctgggcaacagagcaagactccgtctcaaaaaaataaataaataaataaataataataataataattgtaataatcttgacttagagttgccttgtaatgtagcctcccagtgggttctccttgcccactgcctagacacagccgatttatcaagacaggagagtggcaatagagaaatagtttaattcacgcagagctggctgtatgggagcccggagttttattgttattcaaaccagtctccctgaaaactcagggattggagtttttaaggataatttggtgggtaggaggttgaaaaatggggagtgctgattgataagtttggaaatgaaatcatatggagttgaaactgtactcttgcactaagtcagtttctgggtggaggccacaagaccagatgagccagtttatccatctgggtggtaccagctgatccactgagtgcagggtctgcataatacctcaagcactgatcttaggttttacaatagtgatgttatcctgaggagcaaattgggaagtttagaatcttgcagcctccagccgcatgactcctaaaccatagtttctaaccttgtggctaatttgttagtcctgcaaaggcagtctagtgcccagacaggaaggggatttgttttgggaaagggctgttatcgtctttatttcaaaggtaagctataaactaagttcctcccaaagttggttcagcctatgcccaggaatgaacaatgacagcttggaggttacaagcaagatggagtcagttaggtcagatctgtttcactgtaataattttctcagttacaatttttgcaaggagggtttcagtagtaataacagcaaacgcttatacaatgtttgctatctgccagttatggtttaatcactgtatatgttttaactccatgaatccctacaacagccctatattattaggtattattattattccactgagaaaactggggcacagagatggtaaataacttgtctaacaacccataatattcatggagttgagatttgaacccacacagtctgactccggagctgtgctccaaatactatatatactatgttcctcgtactatgaggttatatgggtaaacacactgactcaagattcatgccactaaatagtattacatgtattaaaatgtatgaaagatgaattaaatatatatataataatatataaaatacaatgcagatatatatgtagcctaagtattttttaaaactttctcttcaaagaattgagtccagatataataattcacaccaacaatgtttattaaaagaagatgagagaggaaacaacggcaaaattaaattttgttaaaacaataaaatgaagcagggagaaatgtaattccacaagaatgtattcaactaaaattggagtgaaaatttgggcctgaggatcctgaaagatacagcacaagaaaaacaggtgaagagttataatgttcgcctcatcccaaggttcaaagcccatgcctgtctctcaagacaagtccaagagaaatttctcccatggttcctctgatcaggacatggtgggtggtgaggaacatcactttcttttgaagaaagagagttggaggaggaccagggcctgatagaaatcccatgcattggtgtcaaaatggcagacccactctcttttcctgcacaagataatagggcctctgtttttctttccttatctgtacaaatgtgctgtcttcatttgtgttccccgagaatgacaccttgtatcaagaatttgagtacacattctttctttggttgttgatcctgggaaaccctaatagcagagtggggccataagacaggaagggaaggatgttaatgaagggtgagttatccagcctgacagcccagtgggcagcaggagcttccttgtgctggggaattctagaagagagtgtagaacacacacctcagagttatcccaatgagggctaaggatgctggggtagtttttaaccaaatcttcatctgtcattgcttggaagcttctaggggcattattctccagcatttccagcttgccctgtatgggaacagccagacaattgcccttaaccagagaagcacaggtaatcccagaagaatgcttgggagggagaggtacatgcctaggaaatacgcacaaggcacagaagaactctagcatggataattgtggcccttgcctcctagcacagttgtaatgactgaatggtaataaatagaaagcacttggactgctgtctgatttgagaaaaaacttaagagttggggaaaatcatgttggctcacaatactaaaacgtctaggagaaaaccttgaagcttcaggaaagggtggatccaggcactcaaatatattggtctaggcaagagcatggtgggagggaaatagcctgtgctgaggggtgcagagcttgtggaatacagatgaattttagagtttgatttagtaaagaccatgttgtctttgtggtccatttcatatctagtatattaagcagattcattgtcagatactcaaagtgaactcaaatcatcagtgaatgcagttgtggggcagggggcggatgagtcaacacaatttggcatcatgtagctaaaaccaccagtggtgtgatggatggtttcatttcttcttggactgttttggcattgtgtagacggagcctaaattggtgcccgcacctcacactaatcatgcccagagagagataacatggagctattgagatccccaagcagcactttggcacacacactatctgacaatatcaagagatgaaggaggcctttgaaatgagctttcgcgcgtgagtaatgaccttcaggatgtggctcaggattgtcttttgaaactggtatatcttgatggatgattgaaaagctgctgtctttggtatagttttcgtggttttatatttgaggatgtgtaataaataaatgtgtaattgccctcaacatgatgcaagaccaggaggtgaagatgacacagaaaagtcctataacagcataaaattttattaggctccccattggtaggcaagtcagtgttgtgtgaacaaagaatagtctgtcttaaggtgaccaagatagaaaccaatacagtgaggaacaaattccaccagctgatttgcagggaggtagaggagcgaggcgggcgtgaaggataggtactctcatttttaagatctttatgaaagtagtttcaggacccgtattaataactgcaacaaccacctgaaccattgaccttataattctgaagattaaccagttagtatttataaagcatttgatgttattttttcagttgatgggaatagctacatttcagtggcctgtaattcttaattcattgatgtcttcttcttccattttgatgctaaggttgattttgtgcccaatgtattaattacatgctttttgttttttattctttgtgatctcaactcagcttattacatattttttgtttcctcatgtgactctcattattggctttatacatggataaatctatctgtctcttctaaattaactttgatctcttttagtgacaattgatgggtgacaaccttagatattatacatggtgcctggaaactgggctcagctttcttttcatccccttttctttcagtaggtcaaagaatgtctttaatatctctgtataaactccattttgaagatttgtatgttaacagttttgtgctatcatctacaaaaaaggcatagacacaaaagtttaattgtagtcctaccttcttcaatccagtctagaaacttaaatgttcacaaagatttaataatattgtttaatgaatactaattcaatatttttcaaagctttaataatgtcatgtcataatatcattagaaaagaaatttttgattgttggttgccatatcactgtggtattaatgtgatttgtgtgagactaagatttctttttgtttgttttaaaccaatattcagttccatcatatctatgcataagacatgcataaaataagtggtgggtctattttgttttgttttgttttgttttgagacagagtctcattctgttgcccagtctggtgtgcagtggtgccatctctgctcactgcaacctccacctcctgggttcaagtgactctcctgcctcagcctcctgagtagttgggattataggcatgcaccaccacgcctggctaacttttgtatttttagtagagctggggtttcaccatgttggtcaggctggtttgaattcctgaccttgcgatctgcccgcctcagccacctaaagtgctgggattacaggcgtgagccaccatgcccggccagtgggtctatgtcttataacaagatttgtgttgttgttacacagcttaaaatagaggcatttgcacaaacctgataaatacaaatgtgtcttttggaaagtctctaaattcctacagctaatattttctatatcgtactatttagtgtttaattatctacgaacttcaattgatcacatgaatgttatttctctttggggatttgatctcaaatgtctagaacagtggttctcaactggggcaacttcatttctcagggcacattctgcattgtctgggacactttttattgaaacaactagggtggggaagctgttagcatctagcgtgtagaggcgagagttgctgctaagcttcccacagtgcacaggacaccgcccaccacacagagtgatccagcttcgaacctcaatagtgttgaagatgagaaatcctgcataggaagaattttgctttctatttcttaatttcttgttctggatatagtacaggcctgacaccctgtagatgctcatattcaatttgagaatgtggctgagtttgcctattaaatcaggaccccaagtggatctaagtgcagtggttttgattgaaagaaaaaaaaagtttttgcattcaatatgtatggatcatggggtgggggttgatacaaaatagaaaaaatatatagataaagaaaatgaagacatctcccaatcttttctgagattgccatcaacataaaaggcaggttattaatcttcagggtacagtctttgtatggagggaatcccttgggggttattggaaattttattgcttttcattggactcagtgtaaaatggggtaatttaggcttaacaaacaaagctcgggttgactcactttttttcagaggctccagaaagagaattctcacagagcaggaatcaaccttttcctccataaatcacaggaggaggtgagaatttggctaatatccagagcactgcaaagaaataaacaatgcaaagcaatctgtggcttacttgatgccagtttctccgtagataaatatttctgtgttttgatcttatacattcttccccctcaagctgaaactttttctgtctctcttccagtctgtctgttaggcgaggccttgggagcaggatcctgacaatgtactggtcagctcttttagggttttttttttttttttaaagttgatttcctctgctggtgagccatacatcactgacatccctgtctgtgctgcttgtctgtgacagaatgacaggtgtcatttgtcactggggcttgcggaagctgtgggaagagggattgaaattttttttctggaagggctcagtgtctgccagatcattaaaaagggggctttccaaagaaagctgtgtgtaatgtgattgcacttactgtcaacgataggctaaaagaaagagagaacatcaaaagggagtgagagaaagagggggaggaaagagaggaggagtttctgccaggggcatttaaagttcttgagctgccaatgcaaggatctgctttagttcagttctagtgtgtgcatgctaaataagtccttcagagatttccgctcagctcatggtgccaatgaggagaccgtaacaggaaacctctttaatagcacttcttctcatcacatattatgtagggcatggagacagacttggtactatacagggcatgacttgcagtccaatcattgaagagctgaggcaggaaaacctatttgaacaaaagcagagggtcccaataaatcacgaggcaaaactgagacctgctggcaggctccttctccaaagagacatttacagcatcctgtttgcataagcacgctcggaaaatgcccaagaatatctccttgcagcttctctcctcttggcatgaagtccgtcaccaaatggatctccagggatcagggaatagagtctgcttatcatttcattgcaaaggggaagtgttccttattctactccctgtgccattaaagtaataaaaagaagttaacactttcatagttctgcctatgtgccggacactgcggtaaatgttttacttatacacctcactgtaatcttcatagcaatcctatgagatcgctatttctgttttggggatggtgtcattgaagcacagagaggttaagtaacttatccaaggttgcacacttcttggcaaagctgggattcaaatctggatagttggggtctggagtctatgcttttagcctcttattgggagggtgaatgatgaacacagtggggaggccagatgattttgataacttccagattgcaaatctaaccatgctgatttaggaaattaacaatttagtgatgatgcaaaccagggatctgcaaactacagccagtgagtcaaatcccacctgaaacctgtttttatatagctggcaaactagaaagaattttcacataaatggttgaaaaattttgtaaaaatctgttttctcttttgttacataagtacctgcacatatcctcaatttagtctcttgtcttgcaaagcctaaaatatttactagctggtccttcacagggagtgttggtggcttctaatctaaggtaaaatcaactacaggaaaataaaataaaataaaataaaagttttttaaaaaaaagaaggaaagaaagagaaagaagaaaggaaaaaggaaggaaggaggagaggaaggaaggaaaggaggaaaagaaaaagaaggagggaagaaaggaaggaaggagaagatcttaaaaagagaagaaaaggaagggacttcatttaaaagcaaataagaaaactaagatcctcaccagtggagctctgaggccaacagaaacactgaaattgggctggcttaggtatacttacgtgggaaggccatcctttcaaaataagttttccttgactgcctttccacaaagcctgctgcttggagagacaaattagctattaggtaatctagttaattgacaagtgacttaactaattaccctaacatgcttattaaatgttacctttcccattctcaacacattgttagagcatcaatgtatttaaggccttatcatatcacgctctcttgacagcacattcctgttaaaacagaaggtgcatgcagtatgttttttctatcactatttttctccctctgtggttagagtcataagagatagaattgggagctgggtacataacaagcccatccctattaaggaacaatgtcctattatactggtgcctattcgctgagatggatcaagaatggactaagtaaagaaataatgcataatatcaagcctcggctaatgggtgtagctaaagcttagagaaaacttactttgactctggactagtctttcctagctgggagggctagtgtctatatttatacaaatctacaaattcctcaaccaaaattctttgaggcagatgtgttttacagttcagagttttccagatcttagaaagagaatatggtacatataccatgtagtagataatatcttcaggaaggaaggtgaggaatagcatcttgtatgtaaaaatataaatatttctgcaatgaagcattaggattactaaatgagatttttttaagctttaaaaagttcaatagatttttctgctacatgaatcacagaaaataagtttaaaaaaacttttggtattcagagcttttaggattttgggaatcaaagataagggattgtgaactagggtaaatgttactatcacctcatggcctttctaataactacagccttcaagttatttttaaattttatattggtcataattgatacatatggataccattggtgattattctttagcataatgtgagatgaagcatgatatatatcaagatacatacaaaataatatgtatgaatatatttcattataattaatgcctttataaaatactaagcaatacaagacggttggaagtaaatacaaagattctcttctgtttagaactgaactcgagggcaaggttgctgtaaaatgggaagcatcatctggtccaaggttgacaaactctgatttctgccagagccacgcaggtaccatgtactaaaatcctaagatatacatttttcacattacaacatccctgaagttaggatgcatcctccattcttcattgtacaatagtttgattggcaacatttttttttcactttcttgactgtgaaagtaaaaaagcattaaggagcttagatccaatccactgcagtctcagaggtgagccagggaactcaggtgacttaggagcttacacagtttctacacagggctcactggggctaacccaaattctgaccctgaccctcaccctaactttaaccctgaccttcaccctaatcttgaccctaaccctgactctcagcctaaccctgacctttatcctgaccctgagcttgacccttattctaaccctgaccctaatcctgaccctgattctgaatggctgaatggctgttgctctactggttgttgccacacagaaacacagaccaggggtggccaatcagatcttttgagagaagctagaaattcagccatgcagtctcacaagatttaactgttgtcatttattaaccctatgtaggacaaccaagacaggtcaggtatctagattggatctggccctccaacacctagaaagatttaatgagttgattgaccaatatcactctgctgaaatatgaaattatgtctgacacctatggttttattttttgtctgattggaatgacaggtgaaatgataaaagcataagcccagaaactcagggaactacagcagagagggagagatattcaagtaaacataattacatttataacatggtgtgatgctaccaggggctttgaggacccagagaagaattgcctaccccagtcctgtgcaggcaggaaagaacactcagagaaagtgttcaaagctgacagaggaatgagtagagggtggtgtgggagagaggttgatagggatattccagggaaagggagcagcatgtgcccaggtccagaatccatcatgcctcagaatgccttttcaaaaatgaaatcacccataacacaatcaggacatcctatgcagccgcatggaaccaaaatcagctgacctattaggaagttgataagagagaaaagaatatctgctgtgaccatagcccctgacacatcctatagctctgtagcgaggcaagcataaatgtccccagcctgggattctatcagagctcaaagagcaggactgttcctgcagtgtggccaaagcaggcagtggcctagagagtgctaggcaagaggtccctgtcaccaggtattacttcaaaagttgcatgtgccaccctgtccctctcctgcttggtcaaggctgtagatgaccacatcaaattgtatattgggatgttacagttcttggactgcaagcaggatcaactgacttggtaacttaaacaaaaaggaaattccttgcagggttaccagtaactcacagaatggatgtgaaaggtggaggactaatcttagaaatggttcaatgtcagaacagaccctgagtctagaaagtagaaactgcagaccagtttgttgaggtcccaccactggactaaatgaattgctcttcaaatttcctcattttcttgtcttctatggtcaagatgcaaatttcatgaaaagagtgtccagtttgcccaactggagccattagcttttgctgcattaaaaaaccattccaaaactcagcagcttaaaacagggaccacttatttagtccgtggtcctgcaggtcaataattttggctagactcagctgatgactggctggtcttgcgtggccttagataagatggttcagctcctctcataaggtctctcatcctccagcaggctaacctaggcttgttcccatggtggtagcagagttgtaagagcaaaagcctgtaagtccttgtgatctagtctcagaactgtactgtgcttacttctattgcattccattggacaaagtaagtcaaaaggccagcccaacttaagcaatggaaaaataaatgctatcttttaacagacagagcttcgcagtcacatggcaaaatgtgtgcatacaaacaaggccaatttaccagcaatcagtcatactggctaggggactagaacaggggacttgaaaaagagctttatcaggctacatctaatggggagtaagtagcaactcccccaaaactttagttttgttaggaaaggggaatgacctaagtgaccaaaaaaaatttttttaagaagtaaatgtttttttaacattgctcctatgtatgattcattagaaataagtgtcttttcccatgaacaaaatttgtttcagcagtaaaataaaaataacaaataataaaattaggtctcccagcttctcgtcaacttcctggcatagcaagaactgtgaccttccatgcacaaccactgcgggtgccctctcttgcccagttgaaggatccaaacagtgtggcccagagatttttgattcaaaaatcaatttctgaaatatatgatgaagttcatcaatacttttctttctggactactccagccctcattgaccactcctgtctttgaaatctgaatgcactgaaatctagaggtaactatgagagctgggcttgagtcacacacttcccgtatgattctgagtcagtgaacatctctaaaacctcaaggttcttatctataaagtgagtatagaagtgtagctccctccaaattttgtgagctgtcactgagacaatctatataaagcacatagcatagtatctcccgaataatcagcaaccaaaaactatcctttgcttatgccatcatcattatcattattgacatgcatttaattagttcttctgccccactagaaattatgacatctaaatattaccttctgtataaaagatgcctgtcacctcgatgtaagttgaaaaaaaaatagttaatatgtgtgagacttttgtttcttctaagacaggtgtttgaatatgcatttttttttttttttttttttttagttttgtcaggaactacataaaggttaatctctttttctggcaaatatttcctgagtgcttccatgaggactgcgtgggtagctcacctgtgattctgatccggaactggaccctccctatgaagtattattgtatcaattgtttgaccaggcagggaacacctgacctaccccagtaggtaataggggaagagtttaataaaaagacaatgaaaaggtaggagtggtgtttaagaaaccaagaagggatagttcagtgacctgagactggtgtcagaaaggaacctttggtagacgaacataggactcatggtaacctggtcaaaaggaacccgtgggatatatattcccgcctttcctcctcccacctgcccatcccctttgggcaaactccaggggtagccagaggacagaggatctcattgaggggatatatcagggacagtctcccagggcacaggtctgggaaggagggtgcagaattaatgtacagggcaagcagaagatacccgggacagatcactgaagattgagggaaaactcaatgcacaatatcttcccactttgggaagacccactctgaaaatgacttcactttttaggacctgggcccaggaaaaattacaaaaggttttaaaaccccgcttactagggaattttgcacatttcatttcaggagatgggttacctggtagatctcaatgttgtgatagactctacattggcctcaaaagacaattaagacatgatcctgttttaagttaatgagaaaacattccatcactggctgtctgggtcacaaacttgtagcctacaagacaataccacccctggatgtttctctaatattttttaaaactttaattaggtattggctaattaaatataaggaggttttacatatgtctctaaatgcctgtttcttttcagaagttagaaacctgaccccaagagtctcattttctcctgggaacaaggggctgcagctgagagtgtgcaagctctccagcttgccacagtcctcaccattctctgttgtctctaattagccagacccacgtatcctttaccatttttattgttcttgcactctaaatttcatcatggtaatgtttctttttacccatatctctatcagcaatgggccaaaaaagctagttgaagagggtcagtgaattttaagcaaaatttaagaaaacatatgtctctgtggaagaaaagaatcttcctacacttatatacacaaaatgatggtgtctgcctggaaggatggcaactcagtgggccttctttggttatcttattggcttgggtcacatgggcacttgggtttgcagtcctgagaaccctatccttttacattcaagtcacacattccagaaggagagcacttttgtatgcaccatctcacttaaacctcataatgaccttgtgaaacaagcagagcaaagcttatcactctttaacctaagaagaagctcaaaccagttcagtgattttcccaaggttacccatccagcaaatgtcaggactaaaacccagatctcatcatgaagggcaaactcccatgattcagagacgactgaggcttgtgtagcccagaaagaaaagaattgctcaagtttgtcctacatttcaggatgaaagaccaaatgtcgtgatttctacactgtgctgaattaatactttttcttaattttttttctggcctacttcatttccccaataggttatattctaaaggcagtcaaagattataagataacgtttctgtaggtagggggaaataagagctgttgaaatgacctgagtgtcatctctatctctggggacagataccatctcacgacttctatctgcctaagagaagttaagcaagaaggtgcagagctttattaagcagagaaacattagacctttcagctgcttgtgccatctaattacctgtgactcctggcatcacatgcaagctttattactgcatgtgtgaaaactgcaagtcctgctttcgtatctgccctttgaaactcctccaaacatctacctctactcaattttcagtacagctagaatcttaccctctatgagcaaagaagctaatttctcaattatgcttgaaatttagtaattctaggaacaattttttttagagcttagatccttatgggcgtaaaacactctgattgtgtttaaggattctaccttttatcagtgtctccagtgggtttgaacagaattacttcctttggcagttttctggaactctctataaattcattttactaatgttctgttgaacaaacctgttctatcctccaacattgagttggtttttttttttttttttagagacaggatcttgctctgttgtccaggctggagtgcagtggcatgattgtagctcactgcagtctgaaactcctgggctcaagcaatcctcatgctttagccttctgagtaactaagactacaggtgcgcactaccatgccacgccccgaattggtatttttaaagaaagtattctcatcatgaaaatttctgctttgctataggaagcactagataaagttgtttggttaacaccaagtgaaactagtgttatgtatagtaatgcatctcaacatatttactctatttgataatgaaactgatttacttctgcttttagagagagggagagatgaatggatggttccttgagtgttcttcatgtatttatttatttattcaactcacatacattaaatacctactttatgtttcctaggcatttgggggtcgcaataaagagtagtaaaggttcctgacctcaagaaggttatactctaaagggaaagagtggtgggcagtcacagccacaaaccaatgaatttcaggtagtgaacactgtcatacagagagaaactgagaaatttgagtgggggattgtgaattgctgctgccttgggtggattagtcaaggaagatctcatttgaggaggcgatatttgaacaagatctgaatgaagtgaggaaggaagctgtggggccgtggagggaacagtgtcccaggtggaagaaaacagccaagacccggaagtcaccatgggctttagagacagcaaggagacccggatgtctggagccgaatgaggaaggcaaaagtggaagaggccaccagggggcagactgtgcagaacctatgggacttcataaggactttggatttcactggaagagtaatggatgaggctagaaggtttggggcaggagaaaagcatcatctgacttacctgtgagcaggttgactgcacaccggtggatggaccgtggtgggggtgagctgggagcaggcaggcaggacagggctgtggcagtcggtagtggctgtggctgggctgatagtggtgggctgatagtggtggaggttgtgagaaatggttggattgtgggttaatttttgaagtttgagcctatcagtgggagaacaggacactaagaaggacagagtaagtggcgtgtcctttaaatgagatgatctcaatatccccagaaagtggctcctgtttttactctatcaacatccatttccaagaccctgcctcattgcctgtcagagtgtcgggccctggaacgctccagctgtgataatgtcgtggccctcaaggaccaccccctccccaaccatggagggacaagctaaatccctccttcatcaccaccgcctgttccaggccaccatgggtgcacacccagacttcctgtagtagtttctcccatggcctccctggctggtctttgcctcacctgcccactttgcacacaaaagccacaacaatctttctttaaaccttaaaacattctttacattgactctccctcttttccttcattacatttatttttaaaagaaattttatttcataactatacagggaaaattagcagaactgacgacagatagaaagtaaacatgaaaacaaatacgataggtacaaaacaaggttgtcgaattccagctcatttatttgacagcctcttaccctcacaaccatgctttgttatgaccattatctcattttaatcctaagtaaactgagtcccagagagatcaattgatgtgccaaagttcataaagcaaggcagggaatgtaccaccctagtttccagagttaaatgccaggctgagcctgtgtttttgtcttttcctcatcctctatagtggagtcagcaaagtacagctcatgggccaagtccagcccaacatctgtttttggaaataaagttttattggcacacagccactcttatttgttgacgtattgtctgtggcagcttctgtactataatggcagaattgagtaggtgctacagagaccatgtgaccctcaaagcctgaaatatttattatcaggccctttatagaaaaagtttgccaacccatgttctagatagaaaaaaaaatgaagtacatcaaagagaataagttatagttcatggaacacacataatgtctattcttcccatgactgcaacaaaatgtcagttaaagagaaataaatgttttttcaatgaatgatttaaaaaacaggagttaaaaaaaaaaaacaggaaaacacttaagtgaccaaagtcaataagttttctattgttcaaaataggaattgctcttatgactttattctttcagttgattctgacagtaaatttattcattcatttttttcattcatttgacaaatatttatttaatgtctataccatactaagccagtacctgtaatagcaacagcatgttccatgctgagcaaatctgacatttttcttgcctgaacattgctcacctctggtgatagacacagttgttagtcaaataattataaaatttgactagtcagggaagttggaggaggctttcctgaggacgttgtgtttgaggtaggagctgaatgatgagcaggtgaagaggagagggaagtccatcatcccagaagggagggtccacatatgaaaaggcccagtggtaggagggcacatagtaggccctaggaaattcaaagcaagatgcctgtatgtctgaagaacagaatgcaggaggggcacatgggagagaggagattggggaggcaggtatctctgaccatactgggctaagaatttcatgttaaagagttattctccatcctaagaaaatggaaaacattgaaagggctaaagggggtggtagttttttatgggatgatctttcaccttcatgggttcaggagtccacatcaaatcccttatggctatgccgagtctaatccctagtcgtgcaaagtatctcttctctgtgttccataatcatctgttgttcagttcaggcatttacagtattgctggagccaagtaaagcatgcacaagtgcagtaataagacagacattttcagggccgggggcagtggctcatgcctgtaattccagcactttgggaggctgaggtagacagatcacttgagaccaggagttcaagaccagcctgaccaacatgacaaaaccctgtccctactaaaaatacaaaaattaacttggcatggtggtgcacacctaaggcatgagaatctcttaaacccgggaggtggaggttgcagtgagctgagattgtgccactgcactgcagcctgggtgacagggcaagactctgtctccaaaaaaaaaaaaaaaaaagacatttcagtttgccctttctagatgaaccatgtggcaaactacacctctggaaacatttttcttttgctcaccataggcccatcttctttgaatgtacatcttcatctatatattccctactcttaatctatttctttataaggtgctaataggccaggtgaaaatttccactaatctattaataaaagcagaccagtgataggctttaagaataaagtcatgataaagttagcaaatacagaggggaaagaaacagcaaaatgtttggggttttttgtttgtttgttttcgagaacattgctacttggttccattagactcctttgattgtacatgacagaaaccaactctggttattttcagcaaaaaaaaaaaaaaaaaaaaaaataggaggtaatgcaaggctatctgatggagtggtatttgacttgagagctcattattgaggaaaaacccagccaaatgaatgtctgcggaatgagtgttctaggcagtgcaaagatcctgaggtgagagcaaaagaggtgtgccacagggttggaggaaagacccatgggtgggaggagggtgaacatgacggggagcactcagactgatgagacagggctttgtagctcatggtaaggagttttaatttcattctctgtgatagaaagccttacatgtgtagtagtccgttttcacagttctataaaaatactacctgagactgggtaatttataaaggaaagagatgtaattgactcacagttctgcatggctgggtaggcctcaggaaacttacagtcatggcagaaggcaaaggagaatcaagtaacttcttcataaggcagcaggaaaagagagtacaagcgaaagaggaactgccaaacacttataaacccatcagatgttgtgagaactcaactcactatcatgagaacagcatgaaggaatccgcccgcatgataccatcacctcccaccaggtacctgcctcaacacgtggagattataattccaggtgatatttgggtggggccacagaaccaaaccatatcatagggttttaagtaaatgagtgatattatttgagttagagtagagaaatatcacacttctataaacaattactatatctcaggcactgtatatccaccttaggtccttttcctttaatcttcaccaatgaatgggtacaattattatcacttctcagattagtaaagtgaggcttagggaggaaaagcaacttgtttggagtcacatagtgactatatggcaaatctgaacctcaacccttgtcatctgcctccagttcctggctcaaaatactcattaaaggctcatttttattgccattgtttatgatgtttatttttctaacccttccaagagtgttttgtggattgcattattcttttcttctcaattttataaataaaagagactcgcctcaaaatcacaactgaaggaaaaaaataacaaacttgtagtttcctctaaagaacttcacggacacccagctcagaagaatttggcccggccagggatggggcggggagggaaggactggctgccgcaatgttttgggttcggccatcccatttgtgagaattaggaatgttctttggacaaaagatcaaacacaagcttactcctttctatgctgagacgttgcccactcgcttcctcttttgtatctttcctggtaactcgacttcagtttctctgatggtaaagagatgagatcagccactaggggatcggtcgatgggatcaggtttcagtcatcaaaaaattacgtcaagtgctaagcatgagttaccttccactgccagtgtcagcccaggacgtgactgcagggccatcaatcctgccttccttgtccttgtagatgttaaaatacagggtactctgggaattcattagtgggggtgttgcatgggaaaggaggggctatgctccaggaaaagtgggtatagaggcagagatgtagctttctaatgctgttaccttgcacattctaactattaactgcagagacatctgctgattgttttctttacaaagcgggggagggggagaaaataagaaagttaatttcagagttggaagcaggtttaaaatgaccttcgtcagttataaatataacatctacttacttttaaccagtttatttccaattcaataacttttattgagtgtttccatcataataattgtttttaaaaagtttactattagaaagtactgaaaagaatgtaggaaaacaatttcctccatagtcctactatacagaggaagatccattctgtttcctgtctatcggcctctctgctcctcttttaaatactgaacccaacttttttattgtttcaaatgatgtgactatattgtacctatgatttgtgtgataggcgtcacacccaggaggtgtgatggtccccacctgctgagatccctgtccttgtgtgattttatcctcttgaaagtggatggacttaccctcctctagtaaacagaatatggcaaacatattgggatgtcacttccaagattaggttataaaaagatggtggcttccatcttaagtgcacgcacgctctctgtctcttttttttttttttttttttttttttgaggtttcagggcatctttggtgccacagtagctcaagaagagccttttattttattttattttattttatttttttttattatactctaagttttagggtacatgtgcacattgtgcaggttagttacatatgtatacatgtgccatgctggtgcgctgcacccactaatgtgtcatctagcattaggtatatctcccaatgctgtctcttgaatcactcacgctgggggacagccagtagctgtggtgtgggctatcctgtggtttggtgagatactgaaggcgtcactaggcagtccacaagcctgccagaaatcacttgccaaaaactacatgagttaacttaggagtggactcttcattcccagtggcttgactgcaacctggtgagagattctgaatcagattcactgagctaagccccttctagtttcctaaaccacagaaactgtgagataataaatgtttgttgttgttagttgctggatttttgaataatatgttacacagcaattgataactaatataattttttattctggttttctccattaattatgtcataagcatcttatcaagtggttatattatattgtaataaccatgtttatgtaacatcatcaagtaggagtatttatacttatttattgcttatttaatctctcctttattacaggacatttactttgttctgttttttgtactataaacaccactgtggtgaacatctttttatgtagagcttctattttttttttagctattatcctaaaatagattggaattagttttaggattaggaatcagcttggattactggatcaaagggtaagaatatttgtatttctctggatttttattacacaacttctccccagtaggagagattaatcaatacactactaccagaaatgcaggtcaatgtctacttcatctcacctttgccttttattttgattattgacaatttgataggcaaaatatttcatagtttacaactattaaaagaaagagatcattttcctggtcacctttcttaaaaaaaaaaaaggaatatacataggggttgaaatactgagataaggaactaaatattaattaactagaagaagtgctgtccaatagaactttctgtgatgatggaaataccctctatctgtatgtctacactagtagcactaggcatctgtggctgctgggccctgttagctagtgcaactaagaaactagttattttttgaattttattttattttaaatgcccacatggagttagtgactactatattgaactgcactgttctgaaggattaaatgaaatactagccttctatagaagaaagcagttgaagtttgagacactgaagctttcgccttcctaacaatatccccttttccctacgcattggctttaaataggatgtcccatgggtctgacatttaaatcatagtaacattatttccataaggaattctataaaataaacatatgttgcctaccataaaaggacacgcttagagggacctaatatcattgatgtttgtttgagatgcaaggatccttgattgatggttatatgatcaccactttcatttaatctctgcttctactttccaatatccctgcctagtggtcttgcaaaccattacacttgtcacagaggctggcatgaatgagtcgatggatagatgagtggatggaagggtggatggatggatggatggatggatggatgggtggatggatggatgaggatggataaaagtaataataacagctaacactcatagtgtgcctattaagtgtcaaaatttggacgcaaggttttacctgcaacatttcattcccattcaatctttgtaacagcccaaagaggcaagtgtcactaatttttcctgtctgacagatgaggaaactgaggaaataactagtaagttacacaggccatgtttgaaccagatttgtctgccttcaagccttttcctaatcaattatccaacatcacaccatgaagctgtgaaatacagcaccatgcattatttacaccttgtcacattgtcgtggtggcgattgaaaattttctcctgcaggtagctacagatgctagggagaaaatgctcaaaactgacaggtacctcacttgtctctaaaagtggctctttcactttttattgctgaccaacttctaatgtgtcagtgctatactaatgtggttaactgtttgcctggggcagaaaaataaagcttctgacatgcaattaaaacctgtcttgcccaattgggcgactaatgagatcagcaagagtggaagctgcctagttaaggcgtagtttgtgtctcagatccatttcatggggcaagtgaaagagtggccaagtggagtcgcctgatggtgaatttgaaacataattaggtagtcctcccagccacccttgactgcccatttgggtccacatgcagactcactcacaacggtgactgcaaacccttgcacagccacttaacactgagctcctttctgatgggctcacacagcattcccatcattctgtcctctggcctggacactgaagttcatcacaaactttctagtttcagatggtggcatatgtttagttgtcccgttcccaaatctgtgaactctttgttcctgcaatgacttatcagaaactaatacaagttgaagatttgtctagaatgggctgtgacgacaactggacatctccaccctttgaggatattgctgggagcttagagtccttgttagatttccccatccttggttttgttattaaaagatttctcaggaggtattggggcagtttcaacatattctattaatcaagttagttttgatttactttattcaacaaatgttcattgaaaaccaactgggtaagaaaaattctaagtgtggtgcacacagacattgaataaggcgaatttgggctgggcatgatggcttacacctgtaatcccaacactctggaaggctgaggtgggaggatttcttgaggccaggagtttgagaccaacctgggtaacacagcaagagcctgtctctacaaaaaaaactaaacatttgaaaaattaaaaattaggccaggagtggtggctcatgcatgtaatcccagcactttgggaggctgaggtgggtggatcacttgaggccagaagttcaagaccagcctggccaacatggtgaaaccccatctctaataaaaatacaaaaattagtcaggcatggtggcacatgcctgtagtcctagctacttgggaggctgaggtaggaggatcacttgagcctgggaagtagaggtttcagtgagccaagatcacaccactgcactccagcctgggcaacaaagtgagactctgtctaaaaaataataataataaaataaaaaatcaaaacaaaaataaggcaaactctctgcctgcatgcagcttacaatcaatggtttgaaaaagacaataaacaggtacataaatatctgaataggataatctcagatgctgctaagtattatattaaaaaaacctgataatgtaatagtgaatgactaaaaataaaggtgggaacaactatggagacaacggtcagaggaaggtgacatataggctgtgaccagaaggctgagtagtcccagtcatgacaaaaatctggaggaagacctttctacacagaggaagcagcaggtacaaaggtcctggggtgagaatgagttgggtttgttctttctggaaaagaaagatggtggctggagctcaatgaatccagaataaagtgggaagatgaatgtagaggccagcagaggccaagtcacatatgactatgctgtctgtggaggtgagcttttattctacatcaagaaggatatagtttacatctactgtaaccagacactaaattgagcactttatatacattttctcttctgatcttcacaccaaccatataaggtagacattattttcactatataggtgagaaaactggtgcttaggcatgtttaataactttcctaaaatcacaggtaggaagcagggaagtcaggcttcaaacctatgtttgaccccatcactcattctcacagtcaccaagctgtgctgagatcagactttgtgtcagggtggagaatggtagggagtaatgttttgtttgtttgcttgcttgtttgtgtgtgtgtgtgtgtttgtgtgtgtgtatgtgtgtgtttaataagggactctaggtattcctcatatcatatcaattggatggcagtttaattcataatgtcttaaacattgcaatctcaaattgttcttcctggaggcctgtgtgtttgaatgagaggtgcaagtggtgaaggtggcagagaggtgaactttgcagcacctgtcaatgcacgctcccactgggtggggtattacgtcccccgtagagtcatgtgaagttatgacaaatgtgacattagcaccaaattggaataaagaagacaaagttgaacatgtgaataactgtctttcaaggtgtttctttatgcccaggtgacaaaaagtccctggtacatttctgtctgattttctgacaaactgactgccacaatctggcagggagtggcaatagtcgccttgccagtcatgggcaacctgatttgttggactgcagggtctgtctggcatcagttggtcattgttctttttggcatcatgggtgtgtgattatgtccagaaggcaagcaaacctcagtccccgagatcaagtgcactctcaatttgatttgttcagggtttgtccaatggcactgttgacatttttgtctggatagttgtttgctgatggaggctgtcctgtatatcgtcggacgtgtagcccctaccctcagataccactagcacctcaccccaggctgtgacagacaaaaatgactccagacattgttctatgtcccctaggagccaacctccccacctgagaaatgaaaaccactggcttattcacatagtctagtttatgagaatggaatgtgttcttagttaaactccaaaagagttaaaatccactcaaatataccaatcctgaagctagaaataacatctatggctggctattcagagactttgccttagaaaacttatgatgaatactggaaaaattgattgaatatatatggattccatgacatactctgaaagatgtttttgcttgtctgtctccttgtattaggataattaaggctagctggtgaaacaaacagctaaacatctcagtggcccaacacagtaaacatttatgtttcacatgtacaaagttgatctccacgtggtgactcagatgcaaccttctttccagggtagctctgccatctggagcatgtggcttccaaaaccattgaaggtgtgaatgagttctgtaactgatgcccatcacttcttccctcatcccattggccagaaactgggaagagtggtcttcctgtagcaagagaaagaagaaataggatttggcaaacaggtggcatcacttctgctatcatcctagatatcggcttttcagtttattgaataatgttcaaaatcttcttgatttgtaacctgaattacaaataaacaatagttatgacagtacagtcttccctaaacatgccaagcatcagaattacagactcctcacgtcctgcccatccattccaatttgagaggtctgaatgaggttcaggaatctgtaatttttacttgctccaggtaagtgggatggataggtatctaggactcactggtctcagatccaagtagtcttacatcttcatttttactgcccttcattaggttaagaaattgagagttggttctcacctttctgggctttatttgaaacaaaaactgtattgtcagctgggttcagctcttcctccaatctggtaaactctccaagccataattgtaccagcttctggcctctcaacgtcattgctccagccgtgttgagctctagtctcccatgcttccttgaccaatgctccacactgctcagtaatctcttaggaaatgcaaatctgttggttttaattctttgcccaaagtcatcaatgatttcccattgtcctaggatcaagtccagatgttttattatctacctaaaacccttttcttccagctctcttttttaactacatcgccaaggctagcatggttcctggcatatagtaagcccctcaaaaaaatctgttgcatgaatgagtttgtagaatgcactgaactgtgcatatatgtaaatttaaacttgtcagaagaattagatgtcattccccctcccctttttaaacagaatccagtttatatcagttcttcacagtgtcaagaactcaagtcttgagaatagttgtctatttttatagaaatttgcatatcaattaataaattttgcacatgtgcatgcccaggtatgtgcctatatatacattgtatattatacttatgtaaaggtatttatacacagttatgtaaccaatgtatggtatgtatacttatacattcataagtaaatatattcaataaatgtatgtgtgtataagtgtgtatatttacatatatatgcccattttttctgatctgcataccaccattgaagacaagaatgctacttgtcttcaagaatgctacaagaataactactgtttggaaaacagatgtgaaaactgaggcttgcagaggaaaatcaactctagcagagccacatagctagtaattacagagccaggttttgaatggagatctattcagccccaaagtctagactttgtctttcgattacactgcttttctagggctatgctgcttctaattccatgttaacatttatactgtaaacagaatcgctgttcctcataaataagcaaatgaaattgacatctaggctaagaagccgtagactgcagcctgtatctactgtaatgtgattctgaaagagttttgttcattttctcttaggatagatacagttttgtatttcctagcaagcgtatgccaaaatctgagtctgcttccttagaagtttggcatctcttctctctcctaagatgaaccagggtttctgaatcttgacaaccttgacgctattgaaccagatactttcctgctatgatggtggtggcgggggccggggaggctgtcctgggcactgtacactgttgagcagcatccccggcctccacccactggatgattgtagcacctctcccccaggttgtgacaatcagagaatgtctccagacgctggcaaatgtaaccccagttgtgaacgctgaaatgtgtggtatgaaaaaaggtttctaatcataatgctgagcttagcggtactaaaatagacctttatataatgaaagggcattggtttgtcttccttaaggtgagggatattggatgttaggacgtcagagtggtgtttgggcccagctctagccttgcccaagacacacgtctctggctctccctcctccagtcccaaatccccacacctttgatggtgctcctctcaaaaggaaggaaagacaataaaaaatgaaaagaaaaaaagtaattaaaaaaaaaaaacacaaaaagatatagtttcaaaattacatgtccttacagtctgtccagctaatagaattatgcaccgcagctttaatttagacatcgagtttcatctcttacttaaatgtatctgtgtgttttaataggaacattcagctttgcttttattaatgcaaaaacattaaggcaccagccctcgatccgaaagccttaaagggctgtttccaacagaacctgtcataaaatgtgctctcaagcgtgtcccctttaagagactccagaattaaatgttcccgtatgtgaattttattttgtacagcacatttgctttatggctacaattaagttagatgtgccgataacaatgtctgttttccattttaaatcgcacatttcagacagtgtgcattgttttattatctaatccacatgcttttaattgcaattatggtcccttatgagtcccctgggagggcatgattgcaattaaaaatgtaatttaaatgttaattaattacattcattttctaaactgggaaaatttcatttattattttcatgtgttgtgcacttatcctaaatgcattaccttctaaatgttttttttttcctaaattaagtgttatgtttataaaacagggtgtttaataccctttaaaatttttgtgagggtgtttgtacaaattattactttaaattaattgattctgagctatatgcaggagctatatgtttaatatataataaaaataattttgttgacttttctgaggctaaaacatggtatcaaaatatatgtttttctcatttattttctggttgactttgatatggaaagtctacttcttatgactatcattattattgttttttcttaaacaaaggaagaaaggtattgttactacaaatgatacagatcattaataagaaaagggctttccccctagatgaaaattgcaacctctaaagaagaaatttataggtagagtaataagtcatcctgcctcatatgaataaaggggaacaaaaaaagaaccacaaggacatgaagctttaaaaatcattgtaacttacgaggaaaaaaaatgattgttgtatgcatatctcagtttatccagtcagccctgtcatttttctgtctatctcactttgcctagaacaagagggtcattttagatatgaattataaagcaatgtctatctactttaaactctgaaccatatcaattttggttggttttagtgaattaaagtgtaagtcccaagaggacaagggcagaatttgtgtttttcccaattcaattccaagtatatgctacatgtgatcaattaataaaaaggcttttgaggattttcttttttccatttgtttcctcttcaattggccaaatcttcttctagctcttttattttaaaaatgcctgctatgtctgaactctagctattgtttgggttttatttttatttttattttttagatttaaaatatttaaaagatgtcttaggaaaattctagtcagttaacagtttaagctgctctgtgggtagaggaggaagaaataagagagaaaagaaaaagttcccagacttacaacgttcaacaaatacttatggcatctttactctggagtctaagcttgaatcgtttgtaaaatcgactctgtgcctcctctgggccagattatgttgctaaatcctcacaaccatcctgtgaggtgagtactatcattatttctgtttaacagagaggaaactgaggcacagagcattctggtaacttgctaaagcttcacggctagaaagagggaaagccaggatctgtgccttggaagactgactctggacttgatattccattcggtcctcttcaccagagcatggctaagaaacactagcaaacttgagggaatcacgagagtggactccacacagcaggtagagaggaatgataggaggtaggctctgaagacaagctctgtgggtttgaatctactttgcatttgtataaccttggacaaattaccctccctgctgtaagcctcaatttcctgttctgtacagtggaggaatggcagtacctgtctcataatggtcttgagctggtgcatgacacataatgaacacagtgctcccagcacaaggaaatatcaactgtagctgctactattaaatagagctctgccttcaagaagcttacagtctagctgagaacaggagtaaatgatagaaggccagggggaataactttaacaaaataaaataaagtagattaaaataaaaatcaccaaattgtccatccataaaggattggccaaataaactatatcctatccacctgctaaaatgctaggtaagtatttaaataataataaagcggaggctgggcgctgtggcttacacctgtaatcccaacactttgggaggcagaggcaggcggatcactaggtcaggagttcaagaccagcctggtcaacatggtgaaaccccgtctctactaaagatacaaaaaattagccaggcatggtggtgtgcacctgtaatcccagctactcaggaggctgaggcaggagaatcgcttgagcccggggggcagaggttgcagtgagccgacgtagcgccactgcactccagcctgggcaacagggtgagactccatctcaaaagaaaattaataataataacaataaagcagatccatatggatcaagcttttaggtatattgttaaatgaaacagtcaacagtctgaacagttgtgtaactgaaaaggggatggatgggtgggtgggtaggcaggtaggtaggtagaaagtatttttgtaaatgcacgatcatgttctggaaagatatgagaccatacacagtgatgatttgggggttggggctgccaggaaggtgtgtggaaggcacccaggatcttgttttgttttgtttgtttagattttatacctctgtgtgtagtgtgtgtgttttacaaagtccatgtgatacttttaattttagatagaacttcaaagtatacacaaacacatacagacagacatacacacacatacacatacccatgaaggcatggccctgaccacagggaaattcaggagggagaggaaggggaaatggagaggaagagacatctcaggatgctggagtgaccagcatggctttatctgtgtgttgtcctagctctaacggttttagcatgggagagatgtcaaatgggctagagtaagaacaaagcgttagagctaggatagggttgtgcgcccagccagaagctgatagagaattaaggggaaagttggccccttgggtaatatttaaatctatgaagaataaaatcaagtagaaaaagaaaaaggaaaacaagagattccttgccttgagcttcagatctaaggagaaactttcacaaaccccactagcagttgagacctggggactcaaccataagtcttgctgtttgtcaaaagcaacccttcataggccatgtcgaataagttccagcatttttaattaaattggggccagtggaatgggtcacagatggactgggctcattttcaaatctgcttctgctaactgtgtgccttgtaggactcagcacccaccttctttatctgcagagcaagaatgataatactggtgggtggatgcctatcaagctctgagttgtcaagcctggcactcaaggcttagctatcatgacgcctgtgtctctgggacatgctcagggttattctcctttaggctctgccttggtcacgtgggttccaacaaaggaaaatgtaaaatggaatttggggtgattcaagtccacggaggggcagtcccagtgtaatatttagacaaatccagagaaatgcagcactttttaaattgggtcccaaacaaaaatggcatagtggtaggaaggaggcagcgtgaaggaggaaatggatcaagagcaggagaaaaataaaagaaaaaatgaataggaaattgcaggaccccatttctgagggtctgaataaataatctttcttggctcttcgttttttcattattttacaaatgtctttctctcgatgagtttctgtttgctggcttttagaatgagacgtaacgggggcagcaagaggatgattcctgactatgttatagctccctgggctttttcttctccttctcctccttcttcttctttcttttttttttttttttttttttttttttcaacggagttttgctcttgttgcccaggctgaagtgcaatagcacgatctcggcttgctgcaacctcctcttcccaggttaaagcaattgcctgcctcagcctcccgagtagctggaattacagtcgcccaccaccacgcctggctaattttttgtatttttagtagagactgggtttcaccatgttggccaggctggtctctaactcctgacctcaggtgatccacctgcctcggcctcccaaagtgctggattacaggtgtgagccattgcacctggccccctgggcgtttttttcttctgccttggcccttggtggttttgtctgatgctcaatggccagaaggaaacacacccttgtgcttatatcaacggctttcttccaggaagcatggcactgctttcagagcatgcacacattgttatcttgtctgttcgagggaagtcaggtcagtcttctcatctgtctcccacagataagcagctgaggcagagggtggattggggtagggcagatagtggctgctccaggccatacagtgaatcaggaattagtgccagaatgagaagttccatcggctcctctagattgcttggattcagattggtggtaccccgacctacagacttggttagcatgtcacaaagactgacttcccccaacctttgttgcattcattcagctaaactttactgggcacatgccagctgcctgtccaggtgtggggaatccttcagtgaacagaacagagccttattctcatggagattatttgctagcaaaggagacccagagtaaaaacgtaaataaataaacaacgtaatttcagatcattacaagtgctgtgaagaagatgagtgtgcacacacccctttaatccagatatttgacactgactggacagagttaaattccctccttgctctttcattcacaaggtgtttgacaacaggtgctgaactgctggagttactgctccttagttctaaggtcatcttcaggcttttccctctcaaatgccttttccacattttcctcctattttctctccctctttcttttacccgttttcccctcctgtctgtatcttctccctgataagcctcaaagaatgcctcatagactgaaatagttctttgccctcatccttaaaagttgctgaacacctgtagccagcaggtgtcagagggacagtgctagaatccttttgggaggaggtgtctgctaggcttagctcacctcattccccagtgcagggagccagcgggtaggtttctcaaagccctcttaattgagggttgctagggagcattgttagaatgaaaaaccaaggggacgtgactgaggactcccaacctgtgcatgtttcctacagcattgattactggagttggtgaccggtactggtgcaaaactccctaattatttcacagggcttaagtcaagagtaacaggatattagtgatttaatcaacattgttatctctaaattatatttttatttagaagttgtatttctttgtttctttcttttttttttttttttagacgaagtctcgctctgtcaccaggctggagtgcagtggtgcaatctcggctcactgcaacctccgccccctgagttcaagcgatcctcctacctcagcctcccgagtagctgggactacaagcatgcgtcaccacgcccagctaatttttatatttttagtagagatggggtttcactatgttggccaggaaggtctcgaactcttgaccttgtgatccacccgcttcggcctcccaaagtgctgggattacaggcacgagccatcgcacccagccagaagttgtatttctttatgtatttatttttgttattattgtagaaattatattgtagaaattttttgttattatcattgtagaaatgggagtcttagtatgttgtccaggctggcctcgaactcctggcctcaagtgatcctcctgcctcagcctcccaaagtgctgagattacaggtgtgaaccactgcatccaaccactgtatgcatctttgtaacctacctgccttaccaggggtaaaaggacacctaaaccagctcccaggaaaacctctgtccttacccagcatggttttagattccaatacaggttaaaattgccgtggctcatgtgaagatgaagagttagtataaattgttagttcaggatttagtggagtgcatctcaaattttaatgtgcgtatgaatctactggggatctcattaaaatgtagattctgattcagcagatctgtgccgagattctacatttccaaggagccttcactggtgcacatacggctggtcctcaaaccacacttgaagaagcaaggctttagacttgccctttaattccagttctttcttcagggctgcattaggtcttccatgaatccttggcacctttaccttcggggcccctcgcatttaaaaagatattaaaaattatatcctatgattacattagtatacagacaaatatgttaatctacatttaagcagtttcttctatctaaaagttcattatttttcttctgattttaaaataaataaaaatctggtcatggacccacacataatgtttctagggacagttcctaggtgctctccctacagtgcccaaggtaggacttgatcccaatgttgagaggagttgccccttactgacttcatgctgaaactctcagagcctctatttcctcatctgtaaaatggggatcacagtatctctcgcactgctttggctctttgcacagtgcctggtgcattgtaagcactctggaaatgttagcttttgtctccaaaagttacctggctccccgttagctgtcactgtctcatgacctattaaaagtcagatcctacacacatcactgctgctctcttaaagctgtttgatatgtcctactggttgcatgacctggataatttccataaattaacctcttttaccttccatttctgcgctaccctgctgttcctcttctggaaggaccctatcatctcttggacgcagcagacagcgatgccacacgaacttctgccatgacactcggcacctcccgcgagtgctcagacactcatctgcagcttgctctctaaactcatcatttctgtagaaaggcagcacagcccctgatggatctggaattaactgtcgatttttctgcctgtcactctgagaagaggaagggaccatagagctaatcacatgaggcatcaccatcactgttttcatgttcttttgtttatcttagcccctgactcctcttgattgtacttgcctcaatcctaagactctgtccattgtaaaacatgctgtagatttggccaaagcttttttggggaggagtgagtgagaggtggagaaggaaccctcgcatattaaatgtacacacaaattgcatcccaatttcatgtggaaattaaaataaggtgatttcagagtgaaggaaatgcaatcatgttttatggagtttgataaaatcccatagtctcattaaggaaatagtcatcaccaggatgtgggcctcactttataagaagatagagtaaaatgaagcttaattttcctttgtaatatttttgatacttccaaatagtgatagcatccagtcatagcatcgccaaatgatagatgcagaatttgctataaatttggattttcaagctatatcctttttcattttcttctataggaattcctatcacatgtactctttgaagtagtaatgtaagatcttaagttttcataagcactttgcattgcaattcagagcatccactcatgcgaaacataagctgtagttttagtgtgatttttttaaaggggaaaggggtcaaacccttgccagttggtcaaactcttttctttttagtttatcttcatcacagtccaaatctttctcattgaacgggaaacattttctgatctcaacctttattgatacaaatgttgatttttttttttttaaggaaaagagtatctccttcctcaaaagggatttcatttgagtgtttctttctcattttcttcgaagtaattcttccaaattgacccacaccacatcgagtcttggtctccactgccaacctcaattataaaatggaaactaggtgaacaaattatcaaacctctgtatgggaaatgtggaaaacatttagaaatattcaccaagatttacttccagccatcatgacttaatcacaggtgctgcatccgtaattttcaccttacagaaagtacataagcagctttgcagatttcagtgctaggatgccaaaggatccagagaagtcataggtgagacttcaggtggacaaactacctggacagttgacaaggtttccggctgttccagaagctcacgtgccacctgagtaggcttactgagtgatagcccataattgacaggtattacctcttgactctgaacatctggtctcccatttactccctcccctggttcttctgtgacccatcgtcattgtccaggcggccttgcctgttgaacatatcgcttgaccagcactgcttcctggatatctgtagagcctttggcatacccacacgtgtattttataaaatttaagttcaaactaaagcgtgctgggggccagagaagataaatgccagcttttttatcgtcaaggtaacgataagagattcactagaatttacatagcaccaaagtcgatttacgtgcttatttactctgttgttctcctttaaaaaagatggagttaccctagcaactgtaagatcacgtgatgttcagaataaccgtaatggaaacaccttctgaaaggaaaatacgcatttcaccagatgcatattataggcacataaactgtcatttatagaatgtcgaaccattttggaaatgattggaggaggttcatgtggcattgagtactttccccattaattacttcagtagcttcagagattctgtgacaaaagaaagagattgggagaaagggagggctttggatcttctcctgggcatgttgatagaattgtacactgtatctcgataagcacagcagcagaaagagcacattaccaaaatccatctttcattacatttttgcatttgggtagaatctattactctattcaaactttgttccaattcccaggatgatggcattttccctagagggatggtttgctttgtctaaagcagaatactcaaagggaacaatccgaagtagaagaaacccccaagaaatggcttggtcactcagccaattgggtttcatttcagttttacaaattaatttgctgaagtccagggtgagatacaggtttatgcagagatcacaccagggcagcccttcctgattttggttcagtcttgcatgctcaggataaataaagcaaccctggagaactctgtagttctaaaactcatgtaggaggggccacaactgccaacatccttctcctaacactgctgaaatgtatttgattaggagcacaccattcgggtgataggtacactaaaagcccagatgtcaccaaagcagaatgtatgtatgtaagaaatctgcacttttacccctaaatatattttttaaattaaaaaaattataaaataaaatgaaaagatcacttgttaacacaaagcaaaaagggacaaggagctgccttactgagtcagacatgtggctcctaggaattggagcttttgttttgcagaataatataaattagatcccatgatctcctatccacgatctcatatccagaccgtctggataggagggtctgccctttagacttagctaaaaccccagccaattgccttatttcctggtccctccccttcattgagtgtaccccaccatttctcacctttctttttcacatgttcctcctttccccagctcttcgctgtctcagtgtttttgcagttaagtttctcctaacttcactgtcatctcctggaagaacttaccctggccccgctagataaagaatctcttctctacatccctttttctcttttccatagctccagtcactctctgaaatgatattgttcatgggtgtgtttgttccttatctgtttccccaacaagacaatagactccgcagggaaaggaccatgttgttcttttttcacaaaggtaccccagctccaagaagagtgtctggggtgtaattgctgctgtgtacatatttactccacaaacaacagactggaagacagtctaaatagattctgtttctgacagatcaaaggaaacaaacagaagttcagcatctctcttgaaaacaaatacactggacagaaaaaagaggtctggaaagatggactgagcccacagacacagaaaagcatctaacaaatcaggggctctgaggagtgaggagtagggggtcgttgcttttatttagaaattaacaactgtgggccggacacggtggctcacacctctgatcccagcactttgggaggccgaggcgggcagatcacgaggtcaggagattgagaccatcctggctaacacagtgaaaccctgtctctaccaaaaatacaaaaaattagccgggcgtggtggtgggcgcctgtagtcccagctgctggggaggctgaggcaggagaatggcgtgaacccgggaagcggagcttgcagtgagccaagatcaaacaggagaaagagaaattaacagctgtgcccagacagccagtgtggctgaccagaaagactgaatttagcaaaacatggttttaaaaaaattaaatgaatgaaataggtgaagaagtgatggtagcaacatgtgggcctcaattctctgactttttatttgatgatcttaggatattatgcatcagtccatgttgccccatcaaacacctactacgtgccacatatagtgcctaggccggcctgccttcctttccttccttccttccttcctcccttctttctctccctcccttctctccctccctccctctcttccttttctttctttcttccttccttttctttctttcttcttctcttcctcactccctccttccctcttgactccctccttccttccttctatcattttttctctccttcttccctccctcctccgtccctgcctccctccctctctcccttcaatatttagtaaatcttcattatggctccagcatggttttagagcttcagtcattcattcatttgttcattcatttaacaaatatgggcaaagtactctgatccatgcaaaagtggattatccagtcatgagccacctctgcatagaggtaacgaggtgggcggggtttgccctcatggcatttccagtctaaacagacattaaacagttacaaatgattgactaaatgattatttaatggtattaagtcaagtaaagggatcaaattatttaacacctgctaatgattaattaaaatggtatacattttgccaaagaatctctctaacttttggtaatctgaacttctctctttccctttgataaacgtgctcagagtaaaaaacaaccaactaccaggagggttttctgccaaatttgttcccagaatgtttaaagatgagtgtctctcatcttttcctctgtaattcattctctctctgtgtgtctctcctctctttgaacagggatacagcctatgtgtgttcaatgttctaataaccccaaatttagacacaaaccattatttactgatatttaatgaagtcacctcatggcgttttaatgattgctagatggaacaaatctaatgattgttaagatggaactttacaaaccctttcagtcaggacaagtggcctgttctccccacttctccttgaacttggtgtactgagcaaaagacatgcaagcaatgaggttgagactcatttttcaacattacccaaagaacagtgtgtactggatccctggcagctgagaaaggacccttcccctggctgggagacaaaacttcaatgaaattagggcattctcccaacccaaccattcccaccctgtgctgatgtgaaaaagttcaaaggatattacgggcaaagctctcaagatgtgtttccctcgagaatatttcaggtcacccaatgtgtaagggcccctttgaagtcaagattgattgaaaaagcacaagggtgtggagtctaagaatttggatgtggccatcctctgcgtccctgagtgaagatgctgctcgggtcagtattcatattagcctggcccattccctttgcctgcggtatttacagtaacccacatgcagagcaggtggaagccaaagcggggcatagccagggattgtggcaggggcttgaaaaagtgttttcttttaattgtagggggatgattctgtttggcaggattcaaggctcagctgtgtgtgagcagatccttcatacacaaccacacacacacatatactcagcttcctctcacatttctcatggaaaactgatcacacacagctctcaggagtttcctggaatgcaggataagacattcagctgatcagtgactgacatactagggacctgatttcctgaaattaaagccactgccactgccttgtatcttgaggcaacacaaagtattgtctttttaagtttttattttcacaaggcagcatcgttagagtagccaggatgggtcaaccattcgaaggaaacaaaggtgtgagagcaaggctgctctgcagattgcatccacttctctggatgcttttgggatgtgggtggctccagtctccccgttggcctcaggagtgttatcctgagagaaatgaagggagtcctgcctggcagcaccattgcccacaacgctatccagaagacgtgcaatgccaaggccaacagtcagttccctctcagtcgcttcacctcctgaatgcatctcaacttgtattttgccttcatcctgccatttttctctctttgtggcctcttgtgggactgtggctttgcaacacagcatcatcaaataaatcatctttccatgcattctctccttccttcaccccttcccaatcaccaaggtcagttgtcctttatggaatttgaaatgatttttggatttgattcaatcaacaaatatttgctaagcagctaccatatggcatattctgtaccatgtttctgggaatgcagtggtgaacaaaaccactgagataaatgcatttgactgactttttctgaattttaacgcatcttggagttactgtgttttggaggtcaatattgtttttctgagcattttactcctttttaaaaataatcttttttaaaatgacagaagcaaaatgtgaattttaaggcattataaaataggaacaaacataaataagaaaataaaaacatccatcacccaaagatcacactactaacatcagtgcctacttccagaacattctctgtgcatatatgtatatttaaacacaagactgtaatagacatgctgttatataacctgctattttcagtcaacaatctctatttttcattttaataatttttattgtttttaatttttctaattttataattttttgagacagaatctcactctgttgcccaggctggagtgcagtggcacagtcttggctcactgcatcctctgcctcccgagttcaaacaatactcatgcctcagctcctgagttgctgggattacaaccgtgcaccaccatgccttgttaatttttatatttttagtatagatgggatttcaccatgttggccatggctgctctcaaactcctggcctcaagtgatctgcccgcattggcctcctaaagtgctgggattacaggcttaaatattcagaccataatcatattcttccagttatgccataaatatccttttcagctggattggtcggactgttcctaaattcaggaacacgtgttttatccagttgttttgtttatacattttttaaaatctttcatctttttatgacccagaattatagaagagattgagccaattgttttgaagaatgtctttcctctgaatttgtctgggagctttttactgtcatttagcctgtttctccaacccctgtagaagtgatgcataaaacctcgtgggttcaaattggacatttatttttctagaacacacccgacatgtaggctctattgcaatacatctgaaaacacaaaatctgtttgctccaaaattggtgatagcctctgacttaagatgatggtggccaggcgaggtggttcaagcctgtgattccagcactttgggaggccgaggcaggcagatcagatcatgaggtcaggagttcaagaccagcctggccaacatggtgaaacctcaggaggctgaggcaggagaattccttgaactgggacccaggaggcagaggttgcagtgagctgagatcacgccactgcactccagctggggatacagagcaagactccatctcaaaaaaagaaaaaaaagaaagaaaagatgatggctgctgcgttgctccattatacaggtacaacagtttacccacttgctgctagaaagtcatccctatggctctattctcttgctaaatggatgttcagttgcccttcaaccattttcttaatggtttgaacactaattaataatcccttgcttgtatcagtaatttaattgagtttttaaatgatactttttccatatctatcagcagactacaatcattttgttggctcttaactttgattctttcatcatggcttttagaactcaggtgaacattagtccaagtcgagggttactgtgaatggtgccatcttgggactggcacttgggtggatttcttactgacataaagagggctttaatcagccctgctgcaaacgcttccaatgtctctcctttctcactatgactaacattgatttggcttctccctatcacacgctcttattaacttgattcatatttccctttgatgtaagctggtggaaggctggggccagcttgtgttgtccagctgttgctatttgtgtgcatctctctttccatctccttcagtggctccttgcaattgtccatagcaggaataattataccattacaatcatcaaatgtttcaatttaggacattcttttagagctgggtattaaagatttaccagctcaccagtggtttaagccatcggtgttcaaacctggctgaaactcagaattgcctgaagacttttctacaatacaactttcaaaaacccactgcaaacgtactgaatcagaaaccctaggcttgaagctctgcaagtctgtgtctttgataaaatactgcaagtaatagtttgagggtttggggtcaagcagtcagctctaggaagaaaactctatatgtgctcacatccatctcactttttctgagtggtctcaggttgccatcctcaccacctgtattgttttcagggcagcatgtcaaaccgaggtacccccattattgaagaaggtttcttttcacctgcctgcaggcattcatcacaccacctctcctctctgccacccgcctttgctttgagtcttttatcccatttccaagtcattctctgtctggcatccacctaaatacaaccacacgggggagggaggcagcagccgtattaacaatctcccctcatcaatcacttgggggagagttacttctttgcaatctaaacatgaaagcttgtctcctcttgggggcagtgtgtgcgcagggacactagggtttaatatatatatatatatattttggggccaggtcgaaagaaacccctagggcataatctccttaattacacttctgccatttttcatggagcctggtagttcgaggagcccctttctttgtgtgtatatagccaaaatgagttttaagctgtggagggagcaacctaatcaatttccttggcctgggccttttagaatccaatatagcatagatacaggacagtgataatgatttgacactcgccgcacgtctgggggctacacatcgctggtgaaaaaatgtcatgcccagatgaatactgttggcctctggttccaacacaacaccaagaaaacattgcagtattatgagaattcctgttccttctgtcgatacgttcaagatggttcttacttctgagcaggtatcgattgtgtataggttaggccccacctgtgccatttgtcatttctgatataatatcgtgttatcgtttaaagctgtaatgggagaggtgtctgtgtttaaagcaaaccggtgtctcgagctttgataaatggctagatggtctttgtttctgcagcagtgagcagttggcttgctatttgctttaccttttatccaagaataactgtgtgaggagttctggaagcgagcagtatcattttgtcagatgtggtccgtggctagccgggtggtcccagcagaacagctgtgggattttagcacccgacaggatgttagcagagggcctgtgtaaatctgaaacaactcaagctccacatggctgcatttggttgaaaagttctcagtgctgtttttttttaaggtgagaggacaggaaatgctgatgggaaagaaaaaaaaaaatatgtgcttgggataataattttattcagatggagcatttctgagaaaaagtgatctgagggaaaagggtggtgctatcatgagggaaaatgggaaatcagtaaagtgtggctgtctctaacatatgcatacctcccatctccaaaagcgtggctcaggcagctcctgctacccttaaaccacccgcctcctggtaacatggctcaccctctccatatatcattagaaccctcagaaatgtggcacgaagcaagtctggaagactttctgttcctggaactgaaggtattcgtgggttacaatcatgacacttaattcatcagaacaggcagtttgtcaggacaaatagcagtagttttgtgcccacagttcccttctcaaaattcatgaaaaccaaaatgctcccacaattccaatgcgactttgcatggcggcaatgactatcatttctctctgccttctttaagggggaggggagggccagccatgtatcattacataaatggtacaacatgcctgttcccccagctctacagccgaggggacttttggagaagcgcctgacatgaatctgctcctaactgggagtcgatcaagttattttcagaaaagttcaccaggttttcaatgttcagtgtaaaatctacattggactagagatacaaggcaatgctaagcaaccttgtttcctggagcctgctcttcactttgatttctctaggacagagaagctttttggtgatgagtccatactttctcaacagcatctttctaaattaatgaaatgcacttgctagacaatggagagggtctgtagaatacacaagggctatgagacagaataaatgtccacaagccttgttaggatttggtgctagtccatagaagaaataggtccaaataggtatataattaaatatatatgtctagctccatcttacacacacatatacatatgaatacatattaataaacattcatactctcataaattcagtatacctatgaaccagctgcctaagttataagaacgtaaattgcctatatatatacggttcttacgtatataagaacctgattagcaagtacttatatgtatcaatattttaaattatatacctactgtataccaggcatatatgtacattagtgcatttaatccttataacatgtctatgaggaaatatgattatccccatttttcagatgacagagatgaggttggagagagctaacattctttgctcaaaagcacacagcttagaagtagcagattctttcctcatgccatttctaataggtcacacaaggatttgcatatcatttatttattgtacatgtttgaaattatgacaaggtgtacaaatgtaacgagaaaaactttcccctgaaattctaaattcagaatctagcagagttctagggaaaaagatttccatccttttccatgagctttccagagcaaagaaacctacaccttggaaggcccgttctattaaaccagaatatgcaaatagctgcaagaagcaggtagatgacataagtcaaatggaagtcagaccataaagtggtgcagacaatggtgaactccagggcacacatttaaactgaaagggaatctctgttcagctctgtgcaagaaatatggactcagtggtatcagatcacctgatttttctgtttgcttgttttcagagaaaatactctgtagaaacattaataatggtacctcacatggttgttacaagaattaactacatgattattggtagaatgcttggaacaaattcataaagtgtttggaacaatgcctggcacattataagcaccatattcagaccacatattagtatcctcatcctcatcatccttttccacatcaagagtgtaagagccacgtgagcagagatgctgtctctcttcttcagctctgtatccctggtatgcaatgtaaagcaactgctcaggaaatatttatagaataaatgagtgatagaaaggaaagtacaataaaatgcacttatccctgcttgattaattcttaaatgtctgggccagacacaatggctcacgcctacaatcccagcactttgggaggccaaggtgggcagattgcttaagcttgggagttcgagaccagcctgagcaacatggtgaaacctcatgtctacgaaaaatacaaaaattagctgagcgtgatggcacatgcttgtagtgccagctactcaggaggctgaggtgggaggatcacccgagccagggcaggttgaggttgctatgagccatgatcatgccactgtactccagcctgggtgaccaaacaagaccctgtctcaaatatatatatatatatatatatatatatatatatatatatatatatatatattttcttaaatgcctctgtttctttttgtatatcgctatctgtgtttctgtgtgtttaggtctctctttctctttctttctctcattaaattaaaataaggatgagaatagattaccaggcaagctggcaaaatggctaagtaggttgtccaaccagttgtttccttgcgagctggtatctgaataataatgtcccacttgaaccacacagcccccattaatgacttacaccaagggggttcaaagacaggaagtggcagcagcagcagcaacacccctctagtggttctaatgatgcagggcgagggtgcctcttgctcctgggcagaatggaaaatggagtagagagccccaatccgtgtgcagaggtgccgttttcaacaaagaaatcctgccattccaaactgtcgagacctttaaaaataaaagatgtgctgtatttccagcactattcagtattcatgaggcttcgcagcttgttgtaaggcaagatgaaaacaatactcagtagattttcataagtgacatgtaactgcaagattgatagatgatgcagttttaatgtatgtgaagttcaaaaccaacataaaagcttccaggtagctgaacaccggatttcaaacccacatttcttccagtgataagccctagactttccccaagtctcctgcatctataaaacaaaaagtgggcatcaccctaccgagggcagaatttctactgagcctccaaggacaaaggctgggatgtttccatgggtgtagcagggggtcccagggtacattttttttgtgaaatgaatgtgatgaatcatgaatggttaaatatcactatttgcttctgctaatgaatgctaaagaaaaagaaggttgaccttcctgatggttcagggagcacagaaaattagttacatttctagtcatttcccaaaacgtccttgctgtatatctcatagcttcttggccactctgggtttgttatgtattatcaaaatatacacacgtatacatacacatgtgcatatatatatatgtacaaatcaaacattattacgtattgtattgtatatgtaatgtatatgacctatgcagttaaatatattattcataactatgcattatacagtgaatatagggttttatgagttttcatggtcagcctcaattaagcaatatttctctactccattccatgaatatccattacataacattcatgaaatgttataaaaagttaaactactggccaggtgtggtggctcacgcttgtaatctcagcactttgagaggccgaggcgggtggatcacttgaggccaggagtttgaaaccagcctgggcaacatggtgaaactctgtctctactaaaattacaaacattagctgggtgtggtggcacgtggctgtagtctcagccacttgggatgctgaagtgggagaatcacttgaacccaggaggcggaggctgcagtgagctgggattgcaccactgcgctccagcctgggtgacagagccagactctgtctcaaaaaaaattgagttaaactacacatcttcactttggaacccttctttccttttgtcttatcacttgttccccagcactgattgaatattaggacctgtcaagtaccgaacagaaagtactgtaaggaagtctgacatagacacaaagagatgacatatgttaaagagaaatatacatacatgtcagcaggcatacatacacatgtgattgtttctatattgatgagtcttcctttcttttcacttattctttgtcttttttggaggagagtgctgagattgtctctttttattttgctttggttccagtctagttaactcaaaatgcatggggttagaaaaattaaattaaattttaaaaatcacaatagcagtgaacattttataacattcagtgcttaaagtatgtgcaaaacaatcttacaaggagataatattattaacttggttttatgaacagggaaatggaggctcagagtggttgatcaacttgcagaaagtcacacagctaataagcacaagaggttgatttttcattgtacctgttaaatagacatcagcgagatgcaagtgccagagcaacataatggacaattttgagatccacgctgttctaacccttctctggctaaaaaaaaaaaaaaacaaaaaaacaactttgcttgtgcatgtcagacaagaaggcttccaaaggacaaggacaacctcctttgtgtattacattgtcactttctaacacagggcctggcacagagcaaaagcttagtaaatgtagagtaaaaaagaaagggagaaagtggtaaggtggtgactcccttgtgggcatttgggagctggaaaaccaatgagatctttccaattttaaggtgagcacaaaaggaaggacaatttagtgtctggaaaaaaaaaaaaaaaacccacaacaactggtctatgaattggctgcccagagaaggggacagggcagaatgtaaagaccaggacagaagggctctcctgggtgtctcctgacagaagatgagagaaggaaaatacacaaggtgaggtatttatctcgaggtctctggcttctcattggcaatgctggaatctgaagaaaacctgggtctttctcctacaacttgagctcacatctcctgattttcatcattgggcaatttttccaaacttttcattgttttggctggatcctgttgagaaagatgatttttctcagggctggaatacaagattcctcaggttgagataggatctaagccagggatgctaaggtgtcactgagttcaaagtgggaatcttctatgatctttgcccatgggcagagcggctgtgccagcaggtaaacaccacagtggggacatgcggaacgctcttatccactctacttgtccataggatggtgtggaagaccccaaaacagagtatggtaaccacctacctgtgtcgtctgtatagaaccatgaagaatgttcctcctttgggcaaagggttttaaaaatactttcaaaaaaaaaaaaagaaaaaagaaaaaaaaaacaccacctctggtttcctgtattcagaaaaggatctcatatcaactcctagagattcagagaaaaaataagaaaatgtttccagtcttctgtttcctaccctctttgtcttgttcccttctcctgggctgacaactgctccagacacattgccgttcgcaatcctgttaagtcaagagcatgtatccttaggggctctgcacccaggcagtggctgctgtcatcaactcgttatgcactgcctttgccccccaacacacccccttttgtaacattcatcctatttgttctctcttttgtatgttgtctccctgtgacactataatgtaattgatgactggaaccagatctgtctcgttcatcactgttccccaaatctaaccaagaaggtgcctagaacacagctgatgttaaataacttttttcaatgggttgaattcatacaggcacccaccctttcttttcagtgctcgtaccacaggaatggtctacagcctggcaggggctcagtgtatatctgttgaataatagaagcagcacatcagagattgccactgccatccgctgtaggaaagcaggtctcttcttgagctaagaggaaacccatgttgagttgacaataagagggaggaaccttgaacctgagggagttgacagtaagagggaggaaccttgaacctgaggaagaggagtcagtttctctagcattccgcataaaagacaaagtggacaacggggaggttctcatttccctcctcctcagtgctcagactttggaacacaagttgtattgcttgacctatgtgtgtcttttgaccacctctgatgattcatttatctgatttgagtgctttcctgatggaaaacacagtctgttggatggtagttcactgattccctcttgatgtccatcatctctagtgatggccttccatgagcacaatggcaggattcttgaccagttccccgaactcttctgttttgttttgttgatatgtgtcttctgttttgttgggagcctgctgttgcttacatagaatgtcctctgccactggtaatgaccttcatgaaagaggctcaaaccctgatttgtaatctctaagagcagcctcccacgaggtaggatctcccagctgaggtgaatacctctagttggcttttttaaattaaggctccacattgtaactagtcaacgtacattattgggagagtgaatgtcaatgccactgcgttttctttctctcctttatctttgtcagtgattcaaagacatgatttatggttagtctccgactttcagcatcatccatcaagtcctggtttcactacagggctccacattgtaaatcataccgaagggttgtcactcattccccttaaccctttaggggtatgtttcagggtcgctgtccaagaaggaaactttgtaagatggcagttgagggggcttgggcaattgatagggactcattaagtcagtggcattaattacttcacctaatgtgatcattattaaggcctgggtaaggcctgggccagctccacccagcccaggcaggaagagaaactcgctcccggtgacttgagaaacacacagattcctgaaccagctctattctgttttgaaatgtccattatggatgtgaagtgctgagtttcactttggaatcaatcacaggctagttctgattgtgaccttgcaaagattacagaatgagtgcaaagacccattagcagctgctatttcaggctttgtaaattaacagtcctctcctcctcccacactttttttcatgtctctatcactctgtgactctctgtccctttgtcaccttcgggaaggtggggattggtggcaaggggtgagactgaaacttgcaggcagaggagcaggacttttgcagggccagatctccccttctggctgattccagtcatgcaggattaaggctttgagacatggcacacctggtagaagcaaaatccaggcaactggcattgaatgaatgggcgtgctcacctaccagaagtctgcaactagtaattgcgggtcattaatgaaaaaataaataaatatatatatatacacacacacacatatatattcttgggatctatttgttcagagtctgcatttggttgaaagcgattttgttcctgaattgtgcatagctctgttttcccatggtaagctgatgaaaacaactatattggtgaaagatatacaggtaaataaagtgaaggtttgtaaaatatgaacgttcatcatctaaactgtgttttcataagaactcctcctcagatggtgcttgaggggctcaggacttggatgttttcaaatacaggtcacaaatgtgcctgcggtcttcatttttccaaaaattagcacttatttagtcttcaaggattaaggcacctcagtttaccaggacagtgaccctgacgggtcccctctttacccagcattctcactttccagcatacaaagtggctagtcttaggattttatctttcttggaaagagcacaaggatcttttcaaactttaaatgacccagagccatgaatcctcctaacagccttggaaggcaggtaaactgttgccgaactagtatttcacggagcagcccttctctcttctgccctccctcctgctcagaaatcagatttatatggtatacacagtgtctgcagacctaactgcaggtgacttagaaacggagagcctgcagattaatgtgcccattcagaatgatgtattctatttttttgtgctaagagcagcgtggatggctcgttgggaaggcataacaagggggccagtctcggcttctgcgtcgcagcctatcacagaaagggcttctgtcgggtctctgttgtgaagtcagctactgactgccatttgaattccatcgatacgacgtcttctgtttatgccacatggatttcattatgcctctgatcaaaagaattttctaggcgctgacaataaggaagcaagttgttcagctcatggaactaatagacaactttgagagtccctttccctctcaatgagcaagaggaattctcccttctcaatattgtctgtccctagaataattgtacatttctgcaaatcttgttcaggccaagagacaacatcccggaggcatcaagaatctgctgctaaaaaaaaaaaaaaaaaaaaaaaaaatgtgctttcaacaaattagaatacgccacctagtgaagttcttaattagcatggcacctcagatataaagttaggaggcctgattgcggtcaactcaccccgacctcttacttgaaggaacccggaattataggaaggactctggaaagaaaaagaaaatgtaattaaattaaaatagtcctgctctttctgtctgaacctagcccattactatgataccttgtttcatgatgtcttgtcggaagcatttagaatggtgaattaccccccttttaaaaacaggcagacaaaaaatatatatacgatcttattcacacaacatgtgggtcagtgttttctggttagcatcctgcctagaattccaggtatttctaaggtattcaactctgagtggtgcaagtcttcacagatctgtatttggtgaggcatatttgccagatttgccatggtggcaaatttaaataaattgtccagatgcatacacattaatccactggctggaagccaggaatatgcagtacagcctcagcttccctatgtccaatttcccctgggacttttctttttacacagaaaatttcaagctgtgtgtgtctaaacacagaagttgccttcctccttcctaccttctctctccataatcggtaatttttcctcccatcagccccatcctcgttttcattttgtcaaataacagtgtgactttgtctttgacattaaacagttgtatatacttttagcagtttgtttactccatctgtatttccaatcagcgaggaaggtttaccaaagtggttcattactgatttatttatgatgtatttagatagcaaatatgaaactgtcagcagttgctggctaaacagtgttgacagacattaataacatatggtatagcaatggaattatgatcttttaatttttaaaaaaattttgattctcaacgtgcagttttgggttttgcatttcttaggtaggtgcgtgcaaaggagaagacttttaacaaaactatgttttctttttatttgtaacctttggggtttcctgttggtgacattaacatcttctgtgtctatttagctgttcaatttaatggaagacaaatcctcccaaaggtttaatttactcttgcaaactgaaatcaccgtattcacactgtgggaaatggccctaattttcccaaccttcagttgccatcaagcatataatttatttctcccccttcgatacattccccattagaaaacaaagtttttgatatttaaatgttaccaagttcaaacggaggaaccgagtctcccgtttctgcaaaatgctgttgcaggcatggctgcttctacctgacagccacccatttatactgggccagaacagacaaacatttgaatttctgacctttaattggctgttcctttgagcttatatggttttttccagcaccaagggaggacatttttcagctcaactcaaaggaaaaacaacaagcaaacccaggtagcagtaaaattcagcccatttgctttgaagtaagcatgggcattttagccagaaggtgacccgacaggcaataaagtttctctttggccaagaattcttccatggttccgtaaagatgatctcgttttccagactccaattcgttcccttgaatatgtccaaaggacatgaaagttaacattagaaaaaaaaataggagtcttctagggcaggaaatatctgtgatggggatccattgagaatttggtaaaagctaacaccttctcactcagcatacacataagcattacctgtaatttcagggttctggcatcctgggaagcccatccagtgtctctggagcccagttaagaatcagccatcattcaggtcattacgggatttttgtgtgtgaagtacaagaacttgccttcattttctaaggttagagtggggaagagatggctcatgtgccacatgaactgagtacctctggaagctcttttagtgttttatacacgttatcacactggatcctcaaaacaccctaggaagtaggtataagacttaatcccattttgcagatagggaaattgaggagtaatgaaattgaaattgaggtcacatagctgataagtaaaggaaccacacgtcaaatctcaacactgattcctgagccaagtcaaatgggaaattttgcttaaaatgaaaaatgtaagttaatttataagcttttaccttcttgatttttttttcactatttcaaaactgcaaagcatattggaaattatccctttcaaatatcttactttacctttgaaataactaaacccagaggaactccaagacttgtcctgagttaaacaattagaggctgagccagagctggcttattccgacttgggattcagctttgataatcaatgccataccatgtccttgggcatgttaaggcttgaacttaaacataatggtggctagttttgaaatatatctaatattttgagaatattaatgacactagaaaataaggatcagagagccatctctgtcctaatcctaatcccttcactgctgaaactcacaagaaataataaggtgccccgactagagcacacacttcctcagatcactattggaatcccacctctgatgcccactgtgtgatgttaggcaggccccagcacccatctgagtgttgctgtttttcccatgtaaatggcttaaataaagcgttctatacaaagccatcgttacagagcctgacgtagagccaacattcattaaatgttagtttgtagaattatatttattacaagtgtgtttagaactaaaatcaagacatgtggctgggagcagtggcttgttcctgtaatcccagcactttgggaggccgaggcgggtggattgcttgaggtcaggagtgaaaccctgtctctactgaaaacacagaaaatcagccaggcgtggtggcacacgcctgtaatcccagctactcaggaagcagaggcatgagaattgcttgagcctgggaggtggaagttgcagtgagccaagattgtgccactatactccagcctgggagacagggtgagaccccatctcaaaaaaagtaaaataaaataaaaaatcaagacacatgaatattgtctattcaatgtagacatcttctacagtccccagtcttcaaagccagagacagcgaaactccagtatcacatcccaacacatcaagtctctgactttccttatctctgacatctaggggctcatgtgactaggttaggcccccactggataatctccccattttacagtgatctgatttgggagctcagttacatctgaaaaactccgtcccagcaatgcctagactagtgtttgtagaacaactgggcaaaggtgtgtgtagtgtatatcgggggcaggaagcgtgtgagccaggaatcattttagaattctgcccaccacagcctcagtcttctaatctgtcaagtggggatgtgcagtggtttctatggcacaggtgcctgtgaggagtaaatgtgtatacatcacgtagtatagcatgggacataacacacatccacgcggtaccttgcagctatggttcttggaagggaaaataaaactcagatgtggaatagtttatcagatgagggtagtttagagctcaatcctgggaggaacaaccaatcaatcaatcagcaagaacatattatggaacaccaagacgctttgccagggattgggtgcgattgccagaagctgcaatggatggcgaggaagagctgcttcttgtgggcgggtggagggggacttcctcagggtatacacagtctccttgggaacttgccatcttgcctctcctccctgccacagtggcaatgttcatgcagtgtcacatgaccaaccaaggggtgggtttccaggttgtgtgacagcgagtgcaagggccctgaggtgagccttcacctgaaaaccaggaaacaccaaggatgccagtaaggctgagcacagtgaacgaaggagagaggggaggaaactgagtcaaatctgggagtgattggaaacttgaactttgagtattttatgacgttacggataactgtaattgttactatttttttggatgtgagaatgcttatgtttcaaattaggaggagattggatatgcattaaagacaagagtgctgccttcaccactcccatgtggatgaggatgttctgtaagacttcttacagtccttcttgctgcgtttttggggatttgggggatttttgtttgtttgtttgtttgtttgtttgtatcctgttctggttttggcttcacagagcagaaactatagttggtaccgaccatggcccagacatccaaataaatagtactggttgtttctcaacacaaatgaacaaacaaacaaggagaatagttcttttcttttggaagtacatactaaaatatttatgaataagaggatatgaagtcagagatttgctttaaaataattatggtgggaacaatggttggaggtttagatgaagcaagattgtcctgggttgacaaatattagaatgggttgatagtaaatgaagatgtattattcaattggatctattttgggatatgtttgaaattttccattaatttttttttttaagaaaaaaagaaattgagtcaaaagaaatggcaaggatcagatcattgcaggtcttatagctggggtagggactttttacttctaagaacaatgggaaattatcaaagagttctgagcagagtaaactcatctgacttacatttgtaaaggttattcattttggattgctgatataacacattatcacaaacgtagtggcataaggcaacataaattcattgtctttctttctggaagccagaagttggaaaccagtttcactgggctaaaatggatgtgtcagtaggcccacattccttcgggaggctccagaggagattctttttccagcttctaaagctgcctgcattcttcggctcagggctcccttccattttcaagcagggaattgcatcacggtgacctctggttctgctgtcgtatcaccttccctgactccgattctcccacctccctctcataaagcccctttgggtccttctcattttggctacctggaaaatccaggataatctctttatctcaagatccttaattttctaacatcagcaaagtccctttcgtcacataaactgacattcacaggttctggacattcggacgtagacatctttggatgccatgatctcgcctgtcacaagggacaagggtgaagctgagggctgtgaggtttcaagcctcagcactatggacattttgatccacacccttttttgctggtggggtggtgggatggggagctgctctatgcattgttaaatgtttggcagcatccctggccttgacccactagatgtcagtagcacctctcccccatgcaagttgtgacaatcaaaaatatctccagacattgccaaatgtgccctggctgacaaccgctggggtagcgaagtaatggcagagaaggccagaagtgattggatcccagttgtattccaaaggcagtactgacaggtgtaagcctctctctctgcccatcgctaaccaccacaagtaacaagagagactacctttgcatatgtgtcgctcacatggacagtatggaaacaaatggcaacacacctttgttgtcagcttctatttaatgttctctccaagcatttcttttgctgctggaggacaaaggcagtagctgttactccttttacccatgaccttcctcggtgattggagcattgtagagggtcgatgagtacctgctggctttggttttataattatagtctcactacacctttgcttggccattgtggaaaaagaacctaatatcctgtgtatcactttctcttctaagtgaaatgtgagacatcgtgttggctaagtggtttggaatcgtcgcacagaaagaattaaccttaatataaagactttgcaacttggtacatgattctctgcagtgtagctgtgttgatacttactagtaataattttatatgcccccttaatcattgctagaatttagcgaacacttactgcttgttgaccactgagctcggtgctttatgttaatatatattatctccatcttcccagcaactttaagaaatagaagctattattaaacccattctacagatgaagaacataagattgagacttatgcaaatcaccgtagcataggcagaggatacatttcagaaatgtctaaattctaaatctttgctcttgaattctttactgtattgccttcattctaggctgcctggggtgccttgatccaacgaagggaagtcaggtttagcattggaagctagcaagacttaactgttttgttgatggctttaggctttgggttttgatgtatgctataacttgtaatacttccagccttggggagggagaggcaggggtgcttttctgtttcaggagagggatcagccactccctctattcactctgcctttctctcttggctaccatggctatgtacaaagccattagcgatgaatcatacgtaggcagatcaagggacacaatatgagctgtttagtcttttccatccttctcgatatgaatcattgtcagattcagagctgtagctctccttatataactttagctgctccctcagatgaatctatgggcacaactcacctttaagctgagaggacaaatgaagttcacaggtgcaaggcagagaactgggtctgagcagactcaaatttttttttttttttttttttgagacggagtctcactctgttgcccaggctggagtgcagtggcacgatctcggctcactgcaacgtctgcctcctaggttcaaacaattctcctgcctcagcttcctgagtagcagggattataggcacccaccaccatacctggctaatttttgtatttttagtagagatggggtttcaccatattggccaggctgatctcaaactcctgaccccaagtgatgtgcccacctccacccaaattttaagttctgttttgagggttcattgatttggcatgggggtctcaaactcataggtctacaggggccaggctggtgtgggaaatgagaaagatggtgataaatgagacatgagaggctaagaagtgggtgggatggcaggcagattctccagcatccacactgcctcccctaggagggcagactcatctccagccaagggtgccaggtggagtgtggtctcatcgccagacataggctttaccaagagaaaccaggaaaataaatttttatgcgaaatctcctgattttttaggtcttggtaattcgtttgttttaaaactgcatgtcccaaaccaaacccacctaaaaactgaaactgggttataaactctgccttgggaacttgatcccaagctctctagacctgcaatgttcaagcggtatgtcccacataccacatggggctactaagcccttcaaatgtgactggtccaaattaaaatatactgtaagtataaaacacactgaacttgaaaggcttagtccaaaaaccgtagtgcacaatatctccttcatttttataatatgatactattatatcataattttataatatactattatatcatattatatgatactatttatatcatcatatgatgatatgatatactatatcatcatatgatgatatgatatactatatcatcatatgatgatatgatactatatcatcatatgatgatatgatactatatcatcatatgatgatatgatactatatcatcatatgatgatatgatactatatcatcatatgatgatatgatactatatcatcatataacatgatgatatgatactatatcatcatataacatgatgatatgatactatatcatcatataacatgatgatatgatactatatcatcatataacatgatgatatgatactatatcatcatataacatgatgatatgatactattatatcataatatgatataatattttggacatactaggttaaataagatatagttatataaatcaatttcacttatttctttctcattctttaatgtgactactgaagcatatgaaattccatgcatagctgacattctacttctattgggcagcgctgcttgaagccttcagtatctgatcacttgcaacaaaaacagagacataataataatcacagacaccatttaccgggttcctaccatgcatcactgtatgaagttttttgtgctttcttttatttcatactcagaataactctttgaagctataatcttactatggtccccattttatagatgtgaacattgagtattagaaagctaagtaacttgtggccgggtgcggtggctcacgcctgtaatcccagcactttgggaggccgaggcgggcggatcatgaggtcaggagttcaagactagcctgaccaacatgctgaaaccctgtctctactaaaaatacaaaaaaagaaaaaaaaaattagccggcgccatgtgtgcacctgtagtcccagctactcaggaggctgaggcaggagaatcacttgaacccgggaggcagaggttgcagtgagcagagatctcgccactgcactccagtctgggcaacagagggagactccatctcaaaaaaaaaaaaaaaacctaagaaacttgctaagagtcacacagttatcacgtgagcgattcaattctggatttgtctacaggttttcagataataaagcccgagcaattaaccactgtgctaagcaagaaaaacacagagaatttggacaaatctgaggagagttggtggctggcttccaacatgcgcctaagcttaaaatagcatgcatttcagcccagaaattatggtatctctccaactttgaacttgtgggcaatgcttcatttaaattcagaagacagaaaatatttccaaacaggtgtactttactctgtgcaaaatgtacatattctttctgcattgagctgaaaccaactatttgtgacttgaaacacatttgatatgcacaaaggaagttccaaatgttaagaaaactatcctgggtctttttaaaactcgtataaaaagatctacatcttccttcttttgtgaatatgcagccgcactgtccattttgcagggttaggcctttacctacaggtttttcctagacatgagatccgagcatatttacctgaacctgatacttgtccacaatttttatggaatagactcatgggtgtgtttgggaattggagggtccctgggaatgaatactcctcctgctccctctcaatgccttcatctgcttctaaaaaatattcagtaacacttgtagaaggcatggtgatcagtgcagtgtgagctttaggttcagataatcctgagcactgatcgtgatgctataacttatgagctgtgagcctggtgaagccatttacattctttaaggcttagttcccttatctgaaaaataaagacatatgggccgggcacggtggctcacacctgtaatcctagcactttgagaggccaaggcgggtggatcacgaggtcaggagtttgagaccagccttaccaaagtggtgaaaccccgtctctactaaaaatacaaaaattagccaggtgtggtggcacgagcctgtaatcccagctactcaggaggctgaggcaggagaatcgtttgaacctgggagtcagaggttgcagtgagccaacattgcaccgctgcactccagcctgacggcagagccagacgccgtctcaaaaaaattaaataaaaaataataataaataaagacacacatagcagtcaccacatatgattgctgtgaggattaaaagaggttagggtctaaatgtgccagcacagtccctggcacaaaacaggcccccgagtacagtagccattattactaaataataaacacgatgatgaggataatgatttttgttcctcagcccttgcttttacttttctgactctaacactcaggactaaacttggtcaaagggttaaaacaaatagagaagggaaaagatttcatctatgagccaccaaggtcatgggtatttggccgaaacacttacctcttcaaggctttgcatctgggtctttcatccccttgcttttttgaacactgtataccctctgtgaatgtaaaaacatttgaagagtatcaagcactccacgggtagtggcagttgcaagaagtctggtccatttttctacctttcacactgtcagagcacgagaccttgggatttttataatccaaattgatactctctaggaaatctcttccactccagctccctgccctggaaagattcattttcttgtgggcatttctccagccctggtgggtaacggtgactgagggtgaattcctaaccttcccttgataaggttcaagtcttgctaatttgaatctctcctattttgctcccatccacctggtgctgtttgatttatctgtgcttgtttgtggattcactgatcactttcttattactcttccacctccatccatttcagtttgcggtgcctttcaggtgatttcttatgccaccccttaccacctgctcaacctgacaaattatcgactcaaactgttgctcctgacctggcgtggtctcttcccagggatataaatgatgcagttcagagggataatgatgccctaataaacatacagttgttcctgtttcagcctgccctgtttgaaattcaagcatgccacaaccactggctgctgccctagtaaaggcagtgagaaggaagagagggaaattggagggctgagggctgagaaatccacgagcaccaataatgagatcagagaaatcacagaggggagttgttgtttttttcaggggtggggggcacttaacatcttattttgctgtagttaaaaatcaggcaggagtgacaggttccctctccaatcaggtgtgttctgaagccctgaagtttggtggcaagaagcagcaataaggccccagaagcaggaggtcagtagagaggagatgccctcagctgcccatcttgcccctaccctggctctcacttgtagggacatggctgcagaggcctatctgaccccagttttgtccacagccacatctttagagatgagcaccctaaatcccacttttataacttagactctgaaaacctttccagatcacagatttggggctgcagctcttcttttttattttatttttttatttattttagagatggggtcttgccctcctgcccaggctggagtgcagtggcactgtcatagcttactgcagccctgggctcctgggctcaagcaatcttcctatcctaacttccctagtataatagttagggctacaggcatgcaccatcgtgcccagatacattgttttactttttttttttttttttttttttgataaatgaggtcttcctatgttgtccaggctggtctcaaactcctggtttcaagcaatccccctgcctctgcctcccaaagtgctgggatgacaggcaggagccaccatgtccagcctcctgtagttctactaattgctattattactcttcactggagaatcaagtcaaaaaatcaataaaacaacatagatgcaaatatctttgaccttgttggcatgacagttctaccaccatttcccctttagctgatggtaaatcgcattcgccctaagaccaatttctttggagaatgtaagcctctagcataagtaataaataaataaatgcaaccttaaatcaagatgaagaccaccctaatgtcttttctcttcacaaacccactggtggcgctagtgagcagggatcacacaggctggctgttcctcaccctggactgttcctccctttggtagatacagaaatggagaagacagggagctcacagctactgttgcctgccctgtgccaggcatcagctcttgtttctcatttaatcctggatcagttctttgtagtaagaggtgtaaccctgatttgtgaatgaggaagctggaaatcaagcactccccaagtattgtaacttgcatcaaaccctccgagagcacatttcccacccacatcctgcttgacttgataatgactcccaacacgtacggatcgcttaccaggtgtgaggcggtctgtgtgtcaaagcagtgcacttggactttctcatttaaggtcgccaacaatcctgtaggttggaattgctgttctcctcattttacagtcgagaaaatgagctcagagcagttaactaactctttgaaggtcatacagctagaaagtggtaaattctagaacctcacccccacgccctgtaaccactgtgcagtgctaccacaaaggtgtgtttgttttatttccttatgccagaaacacagtaggtggtgctgctcagcagacagctctgggcgtctctgggcccccttactgctctgcagctgatcccagagagcctctaggtttccaagtatgcattgcttactctttcctaagagctttgcctctaccaggacacacctttcacttgttccacctacccattttgacttggcataaaatcagcttctttgcatgtgaaaaagacatttccaaaacaaccatgacggctgtatttaaaatgcaaatatgcacattttttttttcggagatggagtctcactctgtcacccaggctagaatgcagtggtgccatcactgcaatctccgtctccaaggttcaagtgattctcctgactcagcctcctgagtagctgggattacaggcatgcgcaaccatgcctggctaatttttgtatttttagtagagatggggtttcaccatgttggtcaggctgtctcgaactcctgacctcaggtaatccacctgcctcagcctcccaaagtgctgggattacaggcatgagccactgtgcgctgccaaaatgcacatataatttaacacccagttctcctcccagtactctactgtgcagtgcagagggactcatgggctggcccattttatcagagctgtttggggcaatgaaatcatgaaaggcatttaaacgcccatcattagaggtctagttaaatgaattaggatatatcaatactatctagccgtaaaaaagatactgacaggtggccctaccctgctgaggttttaagagtgctaatcagagagccctcccattctacttccaaatcaatcaaaaagtgaatgcctgagtcagaatggaatcagctgctttgcttggggagaagctggtttggagccgagctgaactgaaatgggcctcctaacacttccccttgtgcttctgggaaagcttgaagaacagtgcatacgtggaacctgcagatgtgaaaactgaacaatggctttgaacgcatggaccctgttgcacagcaggctctcaccgggatggcacagagaagacgacagattcttccctgttcttccaggagagcagaagtacctacttcctaggcagtggcaaccacttggggaaaggaagaagatggccccctctacaaatgcgtttcaatttggaaacattgccttgatgtagcgttaagtcggaaagaagcaaattaataatgaaacgggagagttcccagatccccgtcgcaggacgtgagacaggggtgtggcttgcctgttgggtcgttgccactgctcaaacccctgaggggtgggggagcacgcagacagacaggtgcaggagcccgagtgggtgtgtgttgcagtgtgccgttttagccctgccatccacggatggctagagcgttaaccagctcaatggaccctctgcctttttgcaagagcagagagccaatgtgacagctttctgtatcccaagcttttgcccagcatccaagggaaaatcgggccacatgtgggcttgaaggatgaatgagggattttatcgagcggtggaggtggctctcagtgggctggatgaggagttgggagggggatggagtggggaaatgatcttcccctggagtttggctgtccagtggctgaactcaactccaaccgtttccacatgaattcctgtcagcattcagacgttccttctctctttctctgccgtgccattccatcgtccatctgcttgtctccttgtctcctcatctgcttttggagcctggggtttggggtttatacgactacaggatgggggatatggaggaccaaaaagcaacactttgggtgtaagaacagaaatgcctgttcccacttaaagcttcaggtcttcaggcttgatgggggggctctttgctcaggaccaccctcttctatccagtatttccctgtctcctgtccatatcaataagacgtatataatctcaattaaaaagtgtgtgcatatccgtgtgtgtgtccacacaaaatctcttaacagagattacttccaggcagcaggatgacaaaggggtttatgagattgggttcctactttaaatatttctgcagtgtttggagtttctaaagaaatattcctttagtaattaaagagagagaaaggaagaaaaaaagagaaaaaacaaatggataattatgttctcagagaatccatctggacataataaaaacagcagcagcagttgtattagtaggtagtatttattgagtgatttgctatgtatgccagactcttctaagcacattacttgaattgagtcatttaatccttgctgtaaccctgtgaggtagggattattattatgctcaatttacatatgaggaaacaggcccagagactttaagtaactttcccaggtcactaaacagtttcccaagatcggcgtttaaaattaaacctccgatgaaagataaaagctctttttgtgtgaaacaaagcaaagcaaaacaagaggtccatagatgcctccactcagggtccctggctccattaagcactgtaggctcaggaaactttcagaaatgttttactttattttagaatcagagggataaaaggaacattcacagtcaaagaaaatgctttacttttgtagggcccatcaaagtgtaataaattttgcctgaaataaaaaaaaaaaagtaaacattgatgcatttaaagtaatatcaagaataatttttaggtatgagccacacagtcgctcctacctgcaatcccaatactcagcaggctcagatgggaggatcgcttgagccaggagatggaggctgcagtgagttacaattatgccgctgcattccggcctgggtgacagagtgagaccctgtgtctaaaacaataataaagaagaacttttaatattgaaaatattttatcatcgtagactcagagggtacctgtgcaggtttgttgcataatgatcaggtttgggctgccagtgtacccgtcaccccagaagtgaacattgtacccaataggtaacttttcaacactcatctccctcccaccctctccctctttggagtccctggtgtctgttattgtcataatattgataatgtttagtattataggaggggtccatgaagacaaaactgctgatggccaccctgtccttacctgcgttacccagcccacttaagtttcaatcatatcgaagtggcataaatgagctcaaaattgttcctaactctcaatcgtgttcagaagggcctgtttgcataaggactgggggcccagacagcactgcttctctaatgaagttgtcatcttggaatccctcacatggagtccctgagtgacccagcacttggagcataggaaatgaaagaacaatgactttgcaataatttaaagtgttacatgagcaatgacaacatacttgcggatatttgagctatttctttagaggaaaaaagaacagtttggagaaacctaactcttgtcatatggtttatttaatgatgatactaatttagagtaggttcccgctaatgaaaagctgtagcaaattatactaacgaatccttgctgtaaaattctttcttgtaattctttacgggaacacagggcagttttcaaatgaagatgtgatggacattcgttcttgagtttttaactgcccccaaaagggaactctgaattactgggacacatcgagggggagggatatcgtttatataataatcaggactgctttcattcagagtacagaaagcccaactcaaattagcatcaagagggacttcattgggtcttctaactgaatagtgtgaggatagatctcaagtgtggctggattcagaagtcaacccactttcctctgtgccggcttcatttacaaaagattctctccgcatggaggtgtggtcccccagattgagaaccagcaggaaaggaagtactgctttctcctggtggttcccaggaaattctgcaagtcttatttttcagaattggctcaggaacccatccctggaccactccttggggccagggggatgacgtgctccaaaaaagctttggggcttgcgtggcatgctcattaggtggttggtgtgggttgacttctcctgaatcctgtggatcaaaagtaaggagggggatccacttcataagacaattgaaaccaaggtgttgtcaatcaagggaaacagcaatggacacaggggaaagaaaggaaaatgtctactgcaatatgtaattaatagtatggagggttaagtttcagtttttgttgatttatggagtttttcaatgtcttacaaacaatcaaaacaccgaaaaacttttaaataaaatttcaaatagctacaaatctagctaccttaggtttaagtcactggagattactggttgaaagtttgttaacagtttcttgttcatgccttgaaaatttcatgcaaaattgtaccttttggctctctctgaagaaacatgacaatttggagtctggattagtccttgaaaaaagctggtccctgaattccttctgctgctgcacctggatgcttcgttacaactagagctaataggaaccacccagcactcgtcaatgcctgaactgggctgactgcatggctgattaaacccacagcaaaaagtgtttaaagtttaattaatcagtcaacaagaaaaattgaactctataccatgggtaaagcgaggctgcacacacacacacgagagacagagagagagaaagagagagagagagaaatttgatggtgaagtatttcctatagaaacaacctctctttctttggtgacaacattatttgggacaccattaagaatttaataaactaattggacttttttttttttttgcaatttcatgccaatgaacactgataaaccaacttcatggttgctcttcacacttgagatttgaatagtacctttataaaacaaagccattatgaaatggccctgtcaccgtgacttctaaagggtaagactgtgcctcctgacaataagtccagcctgactttgtaacatctcttggctcccttgtctggaaggatgattaaaatcaacaactatttcctgagtgcctcttcaatataggacattgtgctaagtacaatatagtagtaggtgctggcggggaggtcacatacacagataaaccataggtgtcggccttacattgcttcaaattcagtgtgaaaacacaaaactcacacgataaagtacagtgtaaagtgacatatggtaagtagcccaaatcaaatgaaattatttaaattgatgtaattaaatatttattgaaatacttacacctacataacaggcttagttcaaggtcttgaggaaataacaatgagcaaaacatacaagatccctgatctcttagagtttatgttacgggggtggcagggggagagggagcggatgatggacgattgaacaaataagtataaaatatgtcagattattaaatgctgtgcaagaaaaatgaagccgagcaagggcttagttggaggtggaggaaagtgcactttcctaagactggtatgggaaggggcttttaagaagacagtgttgcgagggctcacgcctgtaacctcaacactttgggaggctgaggccggcagatcacttgaactggccaatatcgtggccaagacaaacctggccaatattgtgaaaccatgtctctactaataatataaaaaatagccaggcatggtggcacgtgcctttaatctcagctacctgggaggattaggcaagagaattgcttgaacccgggaggtggaggccgaggtgaccagagatcatgccactgcattgcactccaacctgggtgacagagcaagactgtctcaaaatgaaaagaagaagaagacaatgtgagcagagaaaggaatgaagcagaaggaagggagggtgtgtagagtgtccagtgcctgcctgtgcttagtaagcactcaatcaataaacactattattattataattaatctaagaaggagcccgtaaacctgagaggagagtgtcattgcaatgagcttgattgaagcaagatttgtgaaggatgtggcatttaaaaggttgagataagagttcatggggagatgagggaagggccatctgagggaaaaggaaggataaaaaatccaatggacactgagatcgggcacaccagtgggcgggacccataggctaatgtcctcctgcagaaatgcagtttgggtttgtttttgcagggaggttgtttgtttgagttttttttaaagattatctcatcaaaacctgaatttcaggctactgtgagaaaaagtagaaaatctaacagcactgagcccacttttccacgtggcaaacactggtctaagtccttacagccctgccacatcatcccaagatcacaacaccacttcccgggattccagtatattgcggtggtttttaagagcaaaatagcagcattttgagagctgcctgtcatatgaaaagcgttctcaccacacccttccactgtctaaccatgccacagtatcttgtttctcttttggttctcatttcctggtatatgggagaggttgagtggcttttgccagacatttgctttctttccagagctccttcagctatggtctacagtcagagttccatcatggaggcatcctagattttttttttgcctttgggaggggagaagtgaggaagagactatattaaaaatgtaagaaaggctgggcacggtggctcacacatgtaatcccaccactttgagaggccaaggcaggtggatcacctgaggtcgggagttcgagaccagcctgaccaacatggagagaaaccccatctctactaaaaatacaaaattagccgggcatggtggcacatgcctgtaattccagctactcaggaggctgaggcaggagcatagcttgaactcaggaagcggaggttgtggtgagccgaggtcgcgccattgcactccagcctgggcaacaggagcaaaactccgtctcaaaaaaaaaaaaaaaaaatttaaaaaatggtttcatagggatgggaaaagaggggtcccaggcctaattcccagtctttctcctagggttgagctcctgccctttttcccctaaggccaaacacctgtctctgatgtctgattcctcttctcccagaattcttcattttggccaagaccttcttccccagtcaaattcccagagactcatatctggaggacagaaaggcacgaccttagctcttcctcagaatgaggaatagaaaacagtggggggccagctcactttttaataagacactagtatttcagcattctatgaagtcaacacccaaggaatgtccctgtcatctgttctcaccttgcaattgctggtcctgttgtcttccccagccctctccacacctcacttcaccagccaagccattgttggctcctaagcatttcagttcctgatggaggagtaagacaggtagtcaggtaaagctggagtgaggacaaatgggactggggtggcggaatccctggcagaaagtcaaggacgtgaacatacaaggaaaaataggccacagccagagcactgaaggccacaaatgtgaacccctagctaggatatgtcattttatgccaggcaaaatcaggacaacaaagggttctcaagcataggtgcgacccaaccaacccttcaccagccaggaacattttctggtgttaatgccatcttagaaaatgctgtgaaaagctccttgcactgagctagtttctcatcccctgatgtttacacctctcaaaggtgcatggagccccacaatgtgtcactctctgatttgtcacctggagaacacagcgcagacatgtttggctgctttaatatttctctataaatcaatcctctttccccttaatcatgtgggttgttcttctctgaacttgctccaatttgtctacatcttgctgggactgagttgtctaaaagtgaacacacccttcaaatgcgggaactctccctgcagcccctggcagctcctggcgactcacttcaccgcccggagaattccgtgcagggctccagcggtgagcagagttggaaacggcccatccccagtttccaaagaggccgtgtctttctgttcctgagcgggcccgtttgttatttttagtgtctgattgtcaggctgcggcattagaaagtctgtggtcgcattacatattccagaaagtcacattgctggtgatgtgcggctgtatcgatggatgagtaattgctcgctgtcaggcccacccggtgaagctgtgtcctcccaagttgtgaaagggggatagtgcgagagccgcacctgccgcggccccacctgtctgcgcttggccgatgccagcacctgcagcctttcgtaccagcgccctctgctggtcggacgccccacttctgggcgctcagggagcagaaggggcctggcctcacccgacagccccctggctctaggcaagtgagatattattattcccattttaaagaccagataactgagccccaaagaagcgaatatgtggctcacaagcagaaagggataacagatggaagaacaacaataatcagaacagcaacgccagtgaaccgttgcacatcacttaatttgccaggggctgcaaacccacagacaaataatggcagaaagtgcagagagccaggcgcaatataaggagtggatggggaccatggcagatccctggtgctcagtctagaggaggcaaaagcggtaaagctctgccacgcaaccacacagggccagtaacgtcagaacttctcagaaggcatctatccttaagtgtgaaatttctctgattttgaaacaattcatgggccaaacaaaatatggctaagggctacatttgatccactgcccctgcttgtaacccctggtttacacagagttatctgacttactatctcatttaagtttcacataatcctgtgatatcattactggttttatcctcacctttgcaaacaaaaaaactaaggttgaaggaagttatgcaaatctaatttatgttagaaaggagagtcagacctaggctttcacatcccaaagcatagattctcctccctgaacaatacagacaagtattttactttgggagaaaggagactggctagcccaacaccctcctttttaagagtgagaaagccgaggctcctttgaaggagccgcaaatggcaggctgcactttacaaacagtctcaagtctggttctttcaagtcatgatgttgtcctttattctgcactaaatttgttttctaaagactacgcctataggctgagggcctctcacctgtgattagaacatttgctttgagtagctttcaaggaacagagctgtgtgtgtgctgcaccaaccacatggtctcagctggcacctattataattcaaattgagagatgggaaacattgagatgcattaagcaagatcaaactttacaacagttggcacaggggcaaatgaattcggcttgccgacttatttgttcggcccacacaaaccactaaataaatagataatcgtaataataatgtacacagcattgccaaaatttgtcaatcaggtgatttcgcataaaaattcaatttctcatattcttttgcaaaatccaaacatctaccgcattggttctatattcgcagatgacgagattagctggagctatgttgttgccacctctttccagcagggcattcactcagcaactctccccaatacctacctctttctattgtctccctgaggccaaacatcactagccatttatcattgtgtttgggtctttcttttcataaagaaaatgagttgtctcctatagtaatgtctctcaaaagtgagaaaacagactgagaattcgagaaaaataagagagagcatctttctttacagtgatgaagatattctaaaatattcatatttattgaacaatttagtgttactttccttgtctctggtcagcacctgagttttctacaccattttggagactttctaatacagtctagtatctgttagtctagtaatatgaactacctaatacagacttaatcagtgcagtttaatgaatcagctgattcaaaacaagattgggcaaaatgagaaccacagcttgctaagcccccagctgcactgtgggtagccatttccaacaagaaaacagttaggtaaaagaagcttttactgtgtctcccccttggaggccttttctcagtatttccatagaaagccaatttctcatttctccattggcccaagactttcaggtaaacacagagtctattgaaatgctgtgaattcccccataaaagctgatgtcctcatccatccatttctatggcccacccctggctttttaaacacgagaacaatcttaagcagtttagccaacaacaagaaataaaatttgtgaggcttaacatctccaaacaaaaagcaagtggcagtgttgcttttttcttctgcagttataaaagactgaaaatggaatattcatccctgtttctgcatcattttgtattaaatttgtaactactgcatagttagcactataactttctattggtatgattgagataattattgttattcatcttttaattgataaagctttggagatgttatgggctagcaatttgtgactgttacctttatttgaagagactaaaatcccagaagttgaaattatctgttccttgggtcacaaactccctcaaggacttctccagacaggtaatttgtgtgggcaaagtaaccttataaagagctccagcgatcaaagaagttacctatactcagccacagccaattatatacatggaagaatgcattccagtattactagatcctcaaatttttcaagaaaagccaataatctgattggtgacaccttttgatttcccaatgtcaataactaattcctattttgtttttaaatattctgagtcaaactaaatatgtatgtggatccacatttggttcaaatttaccagttagacacctctaatatagtgttgactcctcgattttgcaaaaggaaactggagatctgtcaagggatactcgaaaaacagagacagagagctagcattcacatccacaccattgaacaagctaaggtgaagcctgactgtgagataagacaagaaaaccactttcctctgaaatgaagaacaatgagggctctcagatttttccttaccatgacccttcattctcagtggaaaccccttcttaacctcattatcaaaataacgcatttagctaacttgccatgaaggaacagattttaaactttcatttttcttggaggaaagtctttggggtaattggagcaaaaagctactaagagtcagtgaatatttcagaatgaaaaaatgaagaaggagctaagtcacatacatacacacgttcatacacacacacttgtctaaaggtggggctttaagagtttgagcactgacttgggaagaattagcctcacatctattgaaagctccctgttgatgagaaaattcctctacagggttactgattaagggccagtttttttgtttgtttgtgttttttgtttttctcccatgtcagggttagctcatgggccaacctatttttatggacacaattttattgggacacagctgtgcccctttattgatgcattgtctatggctggtatcacgctaagacagcacagctgagtcgttgtaccagatgccgtatgtaccacaaagcctcaaatgtctactatgtggtccttcacagaaaaagcttgctgactgctcccggatgtgaggggccggtcatgcatcctgtggcaccttgtagggtattttgtgaatgaaggactaagaaaatgataatgggtaccaggaatcaaaaactcaaatgattatagaaagaagaaaaattaaacacagcaggccatgagaaaactgttgtgaactggagtgcttgttctgcatctcaaggtgacagcatctgctaagctcagagattgccatctggcaggaatgtagacccagtattcccaaaccttctgattcatgaatgatatggtttggctgtgtccccacccaatctcatcttgaatttcccataattcccacgtgttgtgggagggacccagtaggagataactgaatcataggggtggtttcccccattctgttctcgtggtagtgaataagtctcatgagatctgacggttttatatggggaaaccccttttgcttggctcttattctcaccttgccagcctccatgtaagacatccctttgctcttcctttgtcttctgccatgattgtgaggccccccccgccatgtagaactgtgagtccattaaacctccttcctttataaattacccagtctcaggtatgtctttatcagcagcatgagaatgagctaatacaatgagcactcatcaatctggattttcatgtgaaatctcaattttttaagtgttggtaactacatttaaaaataaatactgtgggtatctataggggccacctatttttgttatcttctgggtcagcagggaatgtccttatctttcttgtttctgatcaggctacaggaaaatggattgctagagaacagaggttttgtgacggagtggtataagaagaaatctgatggccaagggcttgttactgggtctgtttcaaatgccagcaccttctgtgtctgccttcagacaacaccaaacacctaaatcatcttggtaaacacagatagaaagagacagaaaggttaaaagtatactcataatcacttgctttttttcccctcctaaacgtgtttgagagcaatattgtttcgtaaaaacaaaatgaccccatttctaaagcaatattcatgctaagctactcagctgttaagtataaccagcagtttgcattatgatgaagctaagccagaatttcaattattttctggacacatttaaaattataatactttactgggttagtgttatagttcattcaaattactcacaaactatcatatcaatctcttgcaactgctaatgccttacagatgcgtgaagttaggcgaaataagaaactgaccagggtaatgactttcatactggcattgtattttaagggatacatgtccctaagtatttggatggctaatggtcaaaagctagctcttacttcttataatatttaggctaaaagatataaaaagaggatagagaccattctttttcctatttccaggaaaacatctgggtctgtacaaaaattcccagcagtccactctacccctcctccccacaaattttacctcttctgacaaatgactttagaattctgtctccaagtacccaagggtggcattgctttattttctccctctgggacactgttgccaccaacccttgaaatcttcaacattcttgcctctctacagacactcagctttcagtggtgtacctcaatgcagaccagcagtgagagcaaaattcatcaagtgcaggtccagttaatcgacaaagatttatgaatgtcaccaccagcaggtgcttaaaatgtggatcttcctgaagaaggcgtgccactctaagcctctcctaatcaatgggagcctttcatgcccttcgcaaagtctggaataccatgtgcaaaaatgcgttcaggttaatttatgactgcctctccaaaggttctgtcacttggccctgtgttctgagggacacggtgtcacttaaaaagcaggaaccatgggaacaagctgttttggacttgctctgaatgctaactgctaatgcagtgaagttagccaaatgcccagaatcagcaagggggcttggacagctaatatgaggcttagccacatgcaagcttacagacccaggtgggatccaatcaaataaatacattagaagcctatttaaaacactttttactattcagattgtctttgcattgacaaagaaactacagcaaaacaagaaatgtatcctttttttagtgtcttacccttcatatctagagttgcattgtccagaaaaaaagctacttggcacctgtggccatttatatgtcgatttgaatcaattaaaatgaaagaaaatgaaaaattcctttcttcattcgaacaagccaccttttaagtgttcagtatctacaggaggctggtggctatggacagcttgggtgtctaatatgtctatcatctagaaagttctgttgagaagtgctgacctagagatttttttttttggtcaaaagcatctttgtggctatattatctgtctgcttgtctatcaggttttattaccacctatggcaggatttcccaagtatgatataggcaccactcaagttaattttaacatgaatttttttaacttctaaaacgtatatagttatttcagggtgaattttaaaatatatgacaagaattatgccaagctttttaaaaagccagactcaaaaggttacttgctcaaaaactgacccactccatttatttatttatttgagacggggtcttgctctgtcacccaggctggaatgcagtggcatgatcatggctctctgtagcctagagctcctcggatcaagtgatcctcccacttctgcctcccagatagctgggactacagatatgtgccaccacttcaggctattttttaaaatttctttttgtagagacaggatcttgctatgttgcccaggctggtctcaaactcctgagccgaagtgatcctcctacctcggccttccaaagtgccgggattacagacatgagccactgcgcccagccccactccatttctatcacattcttgtaatgaccaaattatggagatgagaaaaggattgttacctaagggaaagaaagggggaggtagctgtggccataaagagtagtacaaggagtccttgtgatataactcatctgtggcattttggctgtggtggagagctcatgaatctacacatgtgaaaaaaatgttacaggactaaacacacacacacacacacacacacacacacacacccctaagtttaggtaaaactggtgaaacctgagtaggtcagtggatcatatcaacatctacttcttggggtgatattgcactttgattatgcaagatgttatcattgagggaaaacaggggaaggatatggaggatttctgtgtattatttcttatagctgcgtatgaatctacaatgatctcagaagaaaaagttgaaaaatacatatgaaaggtacatcaaacccaaaatgttttgagtataatgtctaggacaaagctaaagaaacaaatgtcattacaatctattattcaaggaaaaacattagccagcaaagaacagtaaaggggatatgcatgtgaaaataatgtatggagatgttacatgagagactgtttgagcaataaagtgtgaaaggctctgacattgtgattaggaaaacaagttggaatgaaacaaagctaggacccaatgacactaactatctgggtggttttgggcaaattactaaacttctctgttcctccattttcccatctacacaatgagaataagaacagaactgttctcatgatgttgttgtgaagctatgatgggagaataactgtgaaatgttagtgcattctccagttcctactaagaacttaagaaatgaggctgggtgcggtgactcatgcctgtaatcccagcactttgggaggctgaggcggatgaatcacctgaggtcaggagttcaagaccaacctggacaacatggtgaaaccccgtctctactaaaaatacaaaaattagctgggtgcggtggtggacacctgtaatcccagctactcaggaggctgaggcaggagaattgcttgaacttgggaggtggaggttgcagtgagaggagatcatgccacagcactccagcctgggtgacagagcaagactccatctcaaaaaaaaaaaaaaaaaaaaagaacttaataaatggttgttatcattgggttatgtgtaccctgtcccacaagaactggagatgattaattattcctgtaattgcttaaatcagagtcatcaaactttttctgtaaaaggcccaagagtaaatatttttgtctttgcaagcagtatggtttctgttgcaactgctccactctgcccttgtagcacaaaagcagccctaagtaaatgaatcagtatggcgatgttccaataagattttattagtgaaaacaggcagtgggtcagatttggcctgtgggccataggtggccaatcccaggcttaaaccatctcctgttattgacttcttaagggaaagagactattgaaggcagacccactcttctttctcttcccactcacctcctcccatacttacagaccattccattaggaagccaaccagaggttaagtcaaaatatgcctgctaattgtgtacttctattgacgagagcccatcatgggtcccctgggtcttgtacatagtaggctttcaataactattgagtgattgattgattgacccattaacggagagagctggattctgacgaaggttaacggagattggaaggccagagcttcccaggtgacttcgccctcagtgctggaagaagggaatgttcgtattgatgcaggcttcgcattgatttaacactgcagggtctgcaaagcattttattaggtatcatgtcatttaatcattcaaatcttcgcaactccgctatggcaactattggtagttttgttttacagccgaagaaactggtactcagaaaaaccaagcagttttcctaaaatcacaccgcttgttcattggcagaactgaggcttcaacccagttatctcaattccaaaagcaagtctctttccatgatgtccggagctctgctaaagaaatttctgacaaatgaaaagtggcctggttgctcctccaatattattacagctctaaattgtaacagggaaagagggaatcggtttaaatatactcaactttaagttatttggaaaataagtgaaaaattctactatggatgtatttatgtataattccacatttatcaaaggtttttgtaatgctataaagttatataataaggaatatatgtgacataaagaataaatatacatgtatatgataaagtatgtatacatagacattatcatgaaaaggatgaaaaccataagtttaaagaagatggctcacagactaaatttaacacacacacacacacacacacacacacacacacacacacatgcacacaaacacaatgctaactcagctactaataaacccagtggccatgggagctttggggacaggcctaggatttgggtctcagccttgccgtattctgtcagtaaccttgggcagtgtcccttcatctgtaaaaaagacacaacaaaaatatttcccctgcacagttgttataaaggtaaaatgaaatattgtatgcaaagcacctcttacctgctctgtgctcagtaaatagcagctgttattgtcatgaagtgtgtgggtcggtgtgtgtatgtgtgtgtgtgtgtgtatgtgtaactctctctcttaattagaatagtctgtggccagtaaccgtgtcaaatccttattctccaaaggacttagcattgtgagtttcacttagaagctctttaatagatgtgtgtgaaaccagggaatgatttggaagttaggataccatattaacaagggtattattattatcctaataaagctcaggtgttcaaatggtgtatttagaacaggatttctaaggctcggccatattaccatttgggataattatttaccgggtaccgtcctgtgttatcagtgtttagtggcctcctcagcctctacccactagatgccagtagcacccccattcctacctcatccagttggagacaaaaatgactccagatattgtgccctgggaggcaaaatccccccgttgagatctagatccagcggtgtctgaaaagtcctccttatgtgaaatttcaataaatagtagggttgttgttcggggaactgaaactccaagggttagaaaagtcaggtgagtttttgtggtcacggaagtatcagtttagaaaatgcaatttgctttcatatgcagaattttttacttcaacaaaggactttagggaagaaaatgctgatctcacaccggcttattgaatagcattttgcaaactccaggcctatttctgtaaaccttccaaaagagaaagccagcctctcggtgtcctgagcctcactagatgataatatatgtatgagatccggagaaacccatgcattcctaggaaatacttcaaagttattttttaacatcaaaacaaacaagggtcagtgggtctcccgtgcagcctctgtctatttataattatattttgtataaacatatttggtgactgtggaaaagacttcatgggcacacaatggcaagcgttcttcaaaactgtctttaattattcatttggctgtgctatattttatgtttcttttcataaatgttaatctttattattgccttagtaagtggggaggaaaacacacacacacacacacacacacacacacacacacagagtaatacctgttattaaatgacctatcagagtgacatggataaatgttgggagtgatttaattgtttcttatctgcagttttatacagtttctatcaaactgaagggtaattttttttagtagctgcttattttaaatgtacaaaacccttgtgtgtaattccattagctgccctacagcattgcaatctacagtttccctgaggctgttgtgaaatattgatgaaatccttgctttcgtggcttgctctgatacactaaacatttgtctgatgttagttgaacttgaatggatctgttcagagctatatcagtactgacttcaaagggagtgaggctgttacagtattttttcctcatttttctttctttcgttcttccttttttctctcctttttcttatttttaacgaactgaagtttcaaagttttaccacggtatactttataaaaacaaagtttatatcaaatgggcccaagtacgtagcaaactgctgatctttataatttcaaatggtgtttttttttttttttttttgattctggtttgttgctggtatcatttaagatattttgatacagaggtggatgctggcccccaaaacacacacacacacacacacacacacacacacacacacactcacagagacagaatgggagaaggatgtgaaacagaaaccctggttttgtgaagttagcctcaggactctgtgcctctggaagtcgaccacataggactctccctttcaacgttgatgaaaaggcaccatgaatgagaaaactcatctccaactgactttttccagctaaagttgtttgaatggaacttcacaactttcaggactagagctcacagttattcctgtgttttctgctcaggttgtgaattataactgctgagagttactaatttgtaaaaagcgatataacagtcttttaggagcttataagcagtaaaatagcttccaaagcagggtttctcaaccttggcgctattgagattcggggtccggtaattctctgttttggggctgtcctgggcattttgggaggcttagcagcacccctggcctctgcccattggatgccagtggcaccacctcccgagttgagacaaccaaaattgtcctctgcccattggatgccagtggcaccacctcccgagttgagacaaccaaaattgtcctctgcccattggatgccagtggcaccacctcccgagttgagacaaccaaaattgtcctctgcccattggatgccagtggcaccacctcccgagttgagacaaccaaaattgtctccagactttgtcacatgtccagttggggggaaaaatgccccccaactcctcctggttgagaatccgtgcccgaaagacacagcttccctccactgtaatagaagggtccctttatgtctcaacaggcgggatgaccttgcaaaattctccagatgagtgtctcacacgatcattcttcagatcagttttctagaatgattttgacccatactcgggagtcaacacactctttgcacctttgctttttagagttctctggaaacaggaatcagaacaggagcattttgtcttcactgaaacctctagaaacgggctgaaggggcttgaccctgagctggatggcattagtttgggaagcatcgattggctatgaaagctcagtaaattgtaatgaatgagccccaaagtgacttccatcaattttttcttccaatagccccaccccctagaggagcagctaacccagtacgtcacctttgccctgggtcagtacgtcacctttgccctgggtcacttagtacaacttttccaacagatcctccagcaatgccaccttgccattggcttcacgctcacagagagcaaaagcagccatgttttatatcaacaattggccctctgtcataactgtttcaaagacaggtgatttactgtatgcctattaaattgtgtgatcgtatttaattaatatcagccttgcctgcaaagttctaatcgtcatgagcctagaacacctatgtctccttgcagtggtgtctctgttgcccatcccagtacacacggtaggggctcagcttttcgaactaaatagttcattaattaagggtttagaagcctcttcaccctcattcccctcagctcccttcctctttgggagcagcactctcttctctgcctttcaacctggcaattgggagagaaaagaaagaagtgtggctgacagaatcgaaagaaaggagggggaaaggagggagagagggaggagggagggagggaggaaggaaggaaggaaaaaaagagggaggaagagaaagaaaagaaaaaaagaagaaatggaaagaaaagagggaggaagaaaggaaggaaaagagagagggaggggaaaaaaagagaaagaagaaggaagagaaagaaaagagaggaaggaagaaagagaaagaagaaggaagagaaagaaaagaaagaggaaggaagacagaaagagaggaagggaaaaaagagaaggaaggaaggaaagaaggaagggagggagggaggggagggggaggaggagagatagactgtagtctttcctgttctgtcctcccacctgttctagtatgaaccctcaaagaatggacattgttcactcatttgcttttttcatatatttatttattgatgatatctctctatactgtgctaaaagtagacacaggcaaatcccacattcaaaacaaccataatagaaataaatgaacagaatagaaagttcagaattatgattggatcatttcccctgaagtagattacataatttattatttgagggatactggctttatttcttctccttttccctctctccttccttctcctttccctcaaataaccattcacatcaacaaagcagccaccaggtggtggctgtgtctatctggcacacagacatcaactggaaggacactccctcttctttgtggcacagagaacacaaatgtcatgccacatgcacagagaagccaagagaatggagtcacggtgccccgttttctgtaagcaagaagggagaaaccaatgttggctaaatcaaaaagagtcaaatcattgccgggcatggtggctcacgcctgtaatcccagcactttgggaggctgaggcaggtggatcatgaggtcaggagtttgagaccagcctggtcaacatagtgaaccctcgtctttactaaaaatacaaaaaattagctgggcgtggtggtggccacttgtaatcccagctactcaggaggctgaggcaggagaatcgcttgaacctgggaagcagaggttgcagtgagccgagatcacaccactgcactccagcccaggtgagactccatctcaaaaaaaaaagaaaaaagaaaaaatattttcaagttcctaaaaacagccctgaagattaaaattaaattagccatagggatgcaaagtaaaagaggtttgaaaagtcctcaacttaatgtctccttcaagtgtggagaggctggactttctgtctgctttgctttcttgagggaaggagggtatttgtcaaagcagcagcaacttcactttgtctccactgtcagtgtatctggagttgaagaagcttattttctgcaaatgccttcagccctagacatgtctgcagtctatttatgtttggctaaaacaagcggaataaacagttgagaggatatcattcatattgtgacgggagacagaatatagggcattcttgacatcctgcatatacaaatcattgaatgtctttctaactagctgcacttgtaaatcaacccatgcgccccttcagaaagaatctactgtaaagtgacttgacttcaactggcaatagatgaattggaatattgaagagctgtttctcttaggttatctacaaagtcaacattagttcattgatgtggccacactgagaaatggccctggaagccactgaacccaagccatgaaaaggatttaaacactgggtggatgtccaggagagttgctggaggggagaagaggtcatcaatgggtagttgtggtctcagcaatgatcttgacactggtccttagtcattcaacatatatacacatatttactgagcatttactacgtgcctggaagtgcctggaagtctttttttttggtctttaagaaatcacccaacccacaaggaaaggagactcacagatagcatctttcctcaacctctacgggaacacacactcacacactatttgttgctcacctgtcgctaagacatgaaaagccttacactctgaaagccctgttgaatgttcctgagtttttaactcatttgcagtgaatccttgagagttggtactacaggccatacaaaacaatatttttttttctagaggagggtcttgctctgttgcccaggctggagtgcagtggcaccatcatagttcattgcagcctcaaactcctgggctcaagccatcctcccaccttagcctcccaaacagctgagactacgggcgcctgctaccacacctggctaatttatttttttatttttttgtagagatgggatcttgtttttttgcctaggctggtctcaaattcctggcctcaagcaatcctcctgcctcatcctcccaaagtgttggtattacaggcatgagccactgcacctggccaaaacaataattattgagcccacactgatactgaacaatgtctctatctctttataaaacaaacagagcattggaattctccatctacagtcttcctcactggatcctcatctaattcacacgtttatttttgcatttaatcatctaattttccttgagcctaccatcttgcaggctctgaggaaacagaaggacccagactgataagactgagctccaaggagtttaccattgggagggagacagaataataattgcaacatggatcacatttctgatcgaggctgattttactcaaacaaaacattcctctattagacatttctgcagaaacttagatgtgttgcaaggaaacccaaatcattaagtaagaacgttacagttgtgttaaatattgaattagccaggtcctcttcataatcataataatcatcatacacaatgctggaaggatggctggagcccaggagttagaggctgcaattagttactatggcaccactgcactccagcctgggcaacagagcgagaccccccctctagaaaaaaagaaaattattattgttctgtatggtctgttgtattgagcactttctctgtgccaagcaccgtgtgaagcacttttacctttttcatccattcaacaattactgtattttatctaagctaagaggccattcagcaagctgcactacttctagtttgcaccactgagaaaaaaaaatgcttataattaagccatgacacactgctctcctgctatcacttagaatttctattttatacttactgaaagactcttttagacttctttttaaaaaagatctttataatgtaacactcttgtgtttatataaaaagaaaaagataagcaaaataaattggttaaggcattcctgaaatagcttccaactgccccctggcagccattttaagataccattgattgtaagattcaccctaattcccaagatgttaaaatgtggaaggaagatcttggaatcaatgaaatgctatttgaaaagtgaatgctatgctgcaggctctgacaaaatgcagaagatactgcaatgcacaaggcacaaagtccctgccctcatggagtgtaaatggcagagtcaagaatttaacaattacacaaataattgtttaattgtaattttgatgggagcaatcgagaaaaatcccatgagactatgtaagaagagatcctgtctaataggggacagaaaagatcttctaagggtgagacctttacgctaaaactgggaagttgagcaggaggcagaaaaagaattaaaagaaagaagagaactgtagcattttctcatacatgtcctcagtggccatacagatttagtattataattatccttgctttacagatgaggaaactgagacttggagagtagaagtaacttgcctaagaacacatagctagcaagtgatagagctgggattttcctcatctcaaacaataaattatctgcttgttcaaatgggcagactcagttcttgctgcattagagacagagggagaaggaggaagaacttggagactctgtagtataaattcagacattattaaatagtttcagtactaacaaaaaaagaagagtatatgtcagactccctatatcctggaaccaaggattccagcctcataggaccagagacatggaagggtgcaataaaataacatgctttggattttcttccaagcaattaaaaactttttaaatgtctggcttaagtaactttaggaagcatattcaatagccctgatgtgtatcacttatagcccaggccctgcatggttgtggacacaacccggctgaaagcatgggcccagtaagtatttttctgattaagaagcatctctgcctttactgcaagtatttctgtatttctacccttaaattgacttctagatatagaaccagatgggttttgagaaaggctatcatactgagcaaatgttggaagtctgggaagcaagactagtccctgggacctatgttttattggaaaatagaaggtaggtgcaaacccacagccaacccagaaaaattctggtgagtgggtaagttttgctctcctttgggagttgaaaatgtcaaagattcatgaaattttcattgagtcattcaacaaatacttttttgagaacttaccaagcaccatgcacaggtgcctccatacagcatcaagccaaagagacaaagataccggttcttacaaagcttacaaactaacaaagaaagatcacaattaacaatagaaataataaagaagtaaattctgtagtaagctacaagttggtaagtatgaaggcaaaagaaaaatagaacagaagaagggaattgggagttctgaaagaatggggagactggttgcaacgttaaatagggtgactggagtaaagtgccatcaggaaatgatatttaggcaaagatttgaaggaagttaggaaaagtgcagagacagcagccagcgcaaaggcctaagatgggaatgttcctggcttatgggaaatagcaaagaggtcagtatggctggagcagaaaatccaggaagagggaaatagaagaaagcgttggagaccaagtggagagctaacatacatagaaatctgagggccatggtgagaacattgactttttctttgagtgggaagaatgtcccttgggaggttttgagcagggaagtgacaggatctgatgtatctttcattctgactgctaggagtgttaagcattgacagtaagccacaaggatgggatcaattcatggaggagtcaaggtggcatgagaggtgcccagttgagaccattgttcactttcagtcccctaggagcgcacctcgtcacttaatgtctcattgcagaaagttgaggtggaagatgcttgggtcttgggtctctgagcttggttttgttgggcggggcgggggggggggaatgggggagggcgtgtttgtttgtttgtttgtttttgagccaaagtctcactctgtcacccaggctggagtacagtgtcatgatcttggctcactgcaacctctgcctcttgggttcaagtgatcctcccacctcagcctcccaagtagctgggattacaggcgtggaccaccatacccagccaatttttttgtatttttagtagagacggggtttcaccatgttggccatgctggtctcaaactcctgacctcatgtgatccacccacctcagcctcccaaagtgctgggattacaggtgcgagccaccacccctggccaggacttgagttcatatcctgcttctgccagtgtgtaccagaaagccactttcatctcttctgctagcccgaaatccctcacataaatgtaaaaatatctacctcacaggattatttccaaaataaaatgtatattgcatactgtaccaggcacacagtaggtacttgaagaaataaaagggaagctctctctttatatatccccaataatgagagagattttatgagatgcaaattctgtcgcctggaagctatttagatttacaatctttattttaagttggtttgcctgagtaattaattcaaagttaagattttattggtgaggtgcccaggattttagcaattgagttagttgaacatgaaaggtctttaagaatgaaagataaaataaagtctgttccattgtagctcatcttcctgtgaagcagattagttcactcctgattggtaaataggttaatgatatgaatataatgagaacgtcacattgatgcacatgtaattttttccaacacgttattgtttagcaccactgagtaacagcagccaaatgcaaagttcaccaacacagctgaatccagcaaagaaagcagtcaattcataaaagtcaatcctcttagctcaggttaaccatgtaaatctgcctcagaagcctgactgtcacctctccctgatttttaaaaatttgacctgcctgtaacttcacaatctcactacctctttaaactcctttctatctaactaccatcacttctttatttacaaaggttaagtcttttatttgctctggcattcctttacttattatgaattgaacaagtgtatctaacccaaccagtaggtttattatgtttgttattgtttgcttactctctggatgctaagttgcttactttctaagtggtctatcctaaccttatttttcccataagtgctataattttaactgcaaagctgtgcaaaatgcaagatttgtctaggaacacacattgcattatagcagaaacacacgtgcctccactatacacattggtaatggcagggcatcatggaaaactgacatgccacaagtaagctagtacacagctgtgagagggcactgggtctggggtctaatgaactcacttcaaagctagattcaatcagtttctgggcatgtgactgtattagttcattctcacgctgctctaaagaactgcctgagactgggttatttataaaggaaagaggtttaattgactcacagttctgcattacttgagaagcctcaggaaacttacaatcatgacggaaggcaaaggagaagcaaacatgtccttcttcacatggcagcaggagagagaagtacagtatgaagtggggaaaagccccttataaaaccatcagatctcatgagaattcactcactattataagaacagcacaggggaactgcccccataatctaatcaattcctcccacaaggtcccacccctaacacgtagggcttacaattcaagatgaggtttgcatggggacacagagccagaccacatcagtgatctcaggaaagttgtttgacttctggaagcctaagattcctcatcttcaaaaatgaaactgataatatcacctccaccatgggagtgttgtgagactgatctaaaacaactcacatgagatccttactaagtgatagctattaggatattgtagatatagaagtcatttggaagcaaacagggttcttatgaagtgctgtagaataggttgtcttcacagcagaataaggtcagatggaggtctcaaaatcaatgcctctaattgacttaaacagaacagttttttgtgtgtgtttggagcccagcttagctctctgaatcacacacaactgagtgatggtagaaaccttcaaaccaaagaaaggagaatattattctctggtctttcactccctacaattgcacaactggttcaagcccagtttatttgtgcaagatgatattgaccatacatatatgccctgctctgtctctctctttctctgtgtgagtgtgtgtgtgtgtgtgtgtgtgcgcgtgcatctgaatttctttcttctacatacgaaaaatatagacaaaaaaagataatgctcccatgactggaaaaagatgagatcatttgtaagtggcttgttaaagtgcacatcattttcctgatcagcggtagcgaggctgcatctttaggagctgatgtgatttatcatgttattatatatttagagacattttgaaaatgctgctatttactcaaccgactgtgtatatggacgatttaaagcagatttttgacccagtagactgtaccagctctatctatcgtctcaatgagcatgtggggactcttaaatatgcagattattgacacaatagactacgagcactgcaaccgtactcgagacgggtacagtcaagtcattgggggatgatatgtttccagaaagcatttttaaggcaaatccacatatatagacttgctctatgaaaaaatatacatctggatagaggggactctggctttggaagggaatatttgctatctagaaatagggtattcttactaacatgcctttgtgttctgcccttttgtctatgaacatctaaataataatacctaccctctacttaatcccaagcaatgtaccaatggtttgagcttagtttactcaaacatgccaagaaaccattccgtttgggttagtataaatgcattctttgattcaaagtatgtattgagcaccatctatcgaacagtggggtctttgattgcaagcgataaatattatctttggcaaacaagtaaaaacaaggaatttgttgggaggaacatagtgtagttcaccaaaaggggaggaactagtatgtctgtgaggaccaagggggcagaatcaaaagacaatctctctatcatagaattgtgaaatggacctactccagcccatttccacctttgagtcataggttcagaattcacattccatggagcaagagtttggttggccaagctggtgttctgtgccatagtaaagcaaaaacaaaacaaaacaccaaaatgggaaagaagagagaaagttgtcatatgttcatttcacctccctgctccttaaacaaatgatcagatatttaaacacacagacataaacacacacaatgcacacacaggatgtctatattgtttttgctggaaaacagtccagatgcactggggtaccatgaaattaaactcccagagggccagaatctctgttctgttgtctcctttccaatgtgtctgtaagggagcagttttatacagcctggaccttatgatgctataagtcagtcccaagtcaatcttatatctaaaaaaaaaaaaaaaaaaaaaaaaagagctacgctacctactttaacatcaagggggaagggagggtgatgggtgatttcaattgttaattcatccaaactgcaaaattagaagtgcagagcactcccgccaagatggccaacagtaggaaatggatggtggttagacgtaaacaggaaagagttccctcaagacctgggcttgccactagggataaagcaatgaaccagacagataagtctctgtatttgttgcatgaaactgtcctgtgcattgtaggatgtttagcagcatcctgggtctctacccactagatgccagtagcaccttgtctcccagttgtgacaatcaaatgtctccagacattaacgaatgtccccaggagcaaaatcaccccagatgagtcattaagggtgtgttggacattaccaagtgtgtctctaatttagtgtcctctcaggaagctgggaccctctgggggtaaacatcatctctgttgtcctatttaagtaggattctggagttctggctatgtgcaagatcttatgtagtcacaggatacaaagcaagcaaggagaaagaagaacatttatagagtctttactgtatgctcaaaaactcctggtgctgggcatataaagataaacactcatagcccccttgttcttaaagagcttaccacctgggaggggaggtcaagaatcacagtttgatttgtccagcagtagagaagaccttggggaggagatgccatttgaagtggccttggaatttgaaatcgcaatggataaataacaatggatttggtgcttaactgcgagcagcaatcccaaattttacagtatcaaccagatcttcatgaaaaattaatggacagaatagcaaaaaattacctcatattttatcaaacaaaaaattataatattttgctatcataattgttagggactgaagaatatatacaccaaggaacgaaacaatgtgtaacatgaaaaatatcagggcacagcaaggctaatttgtacacatttataaaaatgtatctaatttgtaaagtaacggctatacaaaactataaaatgtgcgcatacaaattagatatattatgaagctctcagttgcaaggaactatgttaagcagtaaagggtattatttgttcatgaaatttcaaagtacaaagacaaaatcttcaggtagagtttgatcaaggttgaaattttcttggctccgtgatgtcatatatgttggcttggttctccagccaccattcctcatactagcaaagctcctaaaagtttatgagattatatgttcttatatgaaaataggaaaaacaaatggtaaaaacccttactttcttaaccatcaaatcaaactgagaatgccaatcaccaattggcttagatccagcctgaataacctaaataggatgctacggcaaggtgattaggtttgatgattcagcgcccacacatagacctgggatgggaccaacctcagccacacttattgggaagcaaccatagtgtctcctatgatgtaccctagaacactagtgatctcttcagcattgctcaagaattagcacatttcatttttaaatgcttataagtaactaccaatgtcctctttgaatctccatttttaggtacaactgcaaattccctttgtacctcctaagggtcactcaaaggtgttagaagctgcatataaggagatgcttttccaggaactcagcccatgcctaataatcctcctccaggtcagaaagaaagatctgggttttgtttttggtaatttctccaagaaaagaaaaactatcatttactcccagaagcaaataaaacaataaactcgactgtgcattaaaatagatagatagatgatagatagatagatagatagatagatagatagatagatagatagatagatatggttttttaggggagtttgacttctataagtgtggtctgagaactggctgaaaactaacatcagaataattaaaaagcaagggaaaataacccccaaaaggagaatgaaacagagacaaaaagccagaaagaatatcaagaacaagacaatggctgtcttaggaaccatttattggtgttcaccactggagaatattaaatcaccagatagtgctgtcttccccaactttcctgtcctgggacaacagccaatttggtactattaggaggatgctgataaagtgacctaaagcctcttcctatttacccattttctctataggtagggacaaagaaaagatgacagctcttggaaatatcattcttaaactagccctaacctaagtcgaagggtcaaaaaaccctggagagttttccattagattctccaaactgtccattcaaaaatatcgaagacctatatattgaaaacctatgtatctcccagaattttggtcttttccaagtactgcttcatgtaactatgtgttgtgggtttggcccagctcagactcgctgttccatataatttggctcatttaaaagctaacctagttaattaagaactgaaataggtcaggatttatttggtggagttactggagtagtttagaaatgctaatcccttttatcattaacttttttattcgtttgtttcttgtaatataaaaatactcaatctgataaggggatttaaatgaatccagaatgaattgattgagaataatgttaggagcctgatgaacatttttttcagccaaaacttgaaaaagtatatacaaaaaatcctgagaaatccagctccataacatgattcttcatgactaggtttttgttcttgtgatggtaatgagaggagacatactgagtgctgatttttaccaggcattctgacttctttccagttatctcacttaattttcaaaatgatctttgaggcaggtactattattatctccaattgatagatggagagaccgagccccacacaagttgttagtttgctcaagatgataatgcaggacatggcagagatgagatttgaacccaggtgggcttgctgtagaccttgttctcttccatcctgtaacacctatgagggtggtacacacactttctcctctattaggctgatgcaaaagtaattgctgtttttgccattaaaagtaattacttttacttttgaaccactctcttttaataatagagtgttcttctctgtgcagacccttgcttcattgacaactagaaagagcatgaatgtcacacttacttgtcgtcaattcccaaagctttagctgactttgactttgcagcatttctaagctattgacatattgaggctgtataattctttgagtaaggaccgtcctgtgcattgtaggatgtttagctgcatccctggcctctacctgccagataccagcaacaccgcttctctaggtatagcaaccaaaaatgtcctcaaacgttgtcccatgtcccctggggaacaaaaaccacccccagaactactaagagtattatggtgacccagctgactcctggagtcccattttcttctctagaagaaaccagctgccaaaaataatgatctaattaactcattcaccctgaagtgcaaaggtgagataagagattaggtttttatatttttataggggatgagttcttggtccacctcatgtcagatgaacataagccaagttgtagggtttaaggcaagaagaagcagagagtaagaggtgtcacaattgcgggctcctgagttcacatcacacttgtacctgattcatctacttcccatagggagtaacccaccctgtgagtttaaacccatgtgcacacttcaaccatccaaagcaatattctgtttaaaagataccttgttgttgttctctatggcttgaaagcaaattgggaccagtgagtaaaatctaagttttgaacagaatctaagtgttggatagaaaagcatacttcactgatgcaatcattcattcacttatgggtccaatcattcatttatttattcatatatccaacaaacacttgaacaaggtgggctgggtatagcaatgggatacagtggtaaacaagatagatttgacctgccctctgggagcttacagtcttatctagaggacaatcaagtacatagtaagtacaattgcaaactgaaataaggtatacaaaagaaaaatgggggactgagatagaaaataactttggttgttggtaatttcggaggagtaagtgggggagggtacagtgatcagagatgacccatccgacgaaaggcattggagctgaaactaaaagaattagactaaaaggaaagacttagatatagggaaagggggaatcttttatacatagggaatggaatttcaagggccttaaagaaggaaagaatttgatgaatttagggaacaaggagaagaattttcgctttcaagtcctaaacaaaatgaacagtgatagggtagttctgagatggaaactgggcaggtcattgcactctatgagtcatcactgcatgcatgttcaagtatatgctgagcagtacctgacagaagtgttgatgaagagatgaaagcatatcataaaagcttaaactgaaagttctccccaatcctttgattcgatcaaattgtaccatgatggaaacacggctcaactcctaagtgtgaggaatggaaatggttcccattcagtgtggtcctcatagcaggctagtaacaatgactgtgctggtggagagtccaacatgaagaagagggttggaaagtcaagcatctgagccatttaaggataccaaggccaggaagccctttcctgaatgagaaattggcccaatgacatgaaaattctttccacttcgggcttctgtgattcttctagagacagcaaagacttttcaccagaaaactaaagtccagcctgctttctgatagtgccaatgtagcttttctgagagaacagtgggtttcttgcttgcttgcttgctttttttttttttctttctttctttcttcttaatgggtagtggtcacagccatgaacttagcaaaagaagcaagttaaaatttgtccattcttggctaatgcagttagacatttttgagaaaaggcaatgagaagtggtcattatccattatctgcatgaaatatttcagagaaagaagcagcatttgccaaaaaaaggaaaagatgtttgacttcaagccaggcaaaaaggaaacaagatcaccttctagctctgtgggatggctgtgctaatgatgttatttcaagtaaaattggaatatatatctgaaaaaatacagatggtgcagcagcttcatatactttctgaaggtcattttggacaatgattcactgtccctttacttgggaaaaaaaaaacctctccagtcttggaaggaactatatgtgtgtgagtgtgtttatatatccttatgcggaataaacgtatagaaaataagcatgcatgacttgctgaaaatatttgttaccacttgaaaagtcaacacctaaaaatcttaatttgataggagagtctcagttctattgtgtagtttctttgttcctgtttcgtttcactttgttttctcctctgttcctgatttgtgactctctgggtgtaaggataatgtaaggataatgatttctaaactggagctaccaaaaagcttataaagtggtccccttctcacccttctccatgaatattttctcactctgcttttttaaattgtcaccaagacacgtcgcaataataatatacgctggactgaaattccaggtagctgaatataaagcatttttcttggagaccttctgctttaaacatttgtcacctctctcagtgcaaagcccgaggcctctaacaaagaccttttttctcagatggtgggttgctttatttcttgaggattgcagacattaccattatggctaatgacctaataacttgctatttgatgtttgtacatcactttctacggaagttcccggcacacataccactggctccttgtacaagtgatttaatattaaataacaaaccccaaactggaggaagctcttttcttatgcattcttatggatgacacataaacaaagctggttcttatctattgtgaataccatctaaaagctgttggcttggaataagatttagggataacacagaatgccagactcaactgatttcagccatctgtgggttcaggttgaagatcagatgtacagtggttggaaagtgcctagaaccagcactgagaagttgggaggtaaccctgcattcttggtgtttcacatactttatcacatgctatactctaaagcatcttaagaagcagatactattattattcctattttatagatgaggaagctgtgcctttgaaagttttcagtaattttcccaagattgtcttgtccttcccaagacattacacagtacaccaaggtctgcctgatcctaaggctgaggggccatcttatctaccctgttaactgatcagttcttgaatcagcaatttatttctctcttggttggtgttttccagtataaactgggagcaaccatctaagccataggcatttagtctcttggtctctggagaggacaggggctgaaagtcctcaaagttgtatgatcttttcacaaagctggttcccacatacactggtgaacataggcatagagaagtagattgctaaatatctctctactaattaactgttttgcaatttacatccaaacttctcaaacttcctggcacataggaatcctctagagaccttgttaaatgatttctattctgtaggcttggggtggggctgagagcctgcatttctaacaagctcccaggtgatgccaacaccattcatcaaccctacttgaatagtatgggtttacaatacacttcctcttttgtcctgataggaccctttcagtcagtcaggcttgggatagtcactcctatttgaggttgacagatgaagaaataggtcaaagagctgataggagagagaaccagaaaagcacaccagattctctaacccctggttcctgcggttcagaggttgcaaatggttgggtctcagatgtatttagttttgtccacacagttgggcccaaacaaaatacctggcaatcccaaactccatgaaagtccttcagtagcagctgtgcttttctttctttctttctttctttttttttttttgtttgagacagagtcttgctatcttggacaggctggaatgcagtggcgtgatctcagctctctgcaacctccgcctcccatgttcaagtgattctcctgcctctcagcctcccaagtagctgagattacaggcatgcaccaccacacccagctaattttttgtatttttagtagagatgggttttcaccatgttggccaggctggtctcaaactcctgacctcatgtgatctgcccacttctgcctcccaaagtgctgggattacaggcgtgagccactgcacctggtgcactgtgcttttgatgtgccataaactttcctcttactcacagccctcggtgtcctccagacaagtgtccagtctagctgagtatacatgattacttaccttcacaactgagaacggattttcctccacctggcccgcttcgcccattttcattacctgccttccatcagtaatgtgtgaccttttcatgacctctctctccaaaacctcagcatccaacttctctccataactcacctctctacttgccttggccttggaagacccactgtgacgaaagtcctagtgaaactccactaaagtgtcttgcatgtggtaactgcagaataaatatttcttgattaaatgaataaacagatgaaccacaaagggatgacagaatatccacttctcctgacttaaactagcttagccgtttttttgctgatgaccaagatgtggagaaattcacaaaatgtgattagaaaacgttttacagtccaaagagctgtaacgatggcccaggaaagaagcaacaagcgtacattaagtgtttagacggaccccacctggtatgcaagcgcggtacatgtaaagcattccaattacccgaaccatcttcaggaaattgaaaaaaatagagagagattgttgttttgatgaccaccagaaacctccccatttatctccgcagagtactcatgggctcaggatggccccccatcactgtacccacgccatctccagcagtgctttaaacaaagaattctatttgtttggttctgactttcagacagaggagggagcaaactcttctctctcgatccgtatatatcagtaacacttatgttatatgtggcatgacagggataaaaatccacgcaccataaatgtcacatttctttttgaacatttttctgtttaaaaatgtgcatgaacgtagatcacttctccagccagcaaacacactgggccctggcctgtggtacctggattctctgtaaatgaagtctgtgctcaggaatggtgcaaggatcccacagctctctagacttcctctctcctgaaacaaaaagcagagggatccctccacatggccctccaagaggccctcactccaggcctggctacccttgagaatagctcagcttccttgaacactgaatcctatatctctttactcagcctgccaacatgcatgccaattagtgccaataataacatacatactaacagacttttagaccacagtcacccaaacactagagactcatgacagggagctctcattccgagtcatcattttttgtacctactgggtacacgctgagaaattctcacgatctcctcatttacgtctgccttgaaccctgtggcatcttcctgtgactttaaacagtcatttagtgcggtagattggcgaaaacgatcctgtcaccatcggatatgtttttaaatgaggtcttggttgaattctggtttagtttttaaaaatcagccttcttgagttttaaattgttcttatgttatgattccacttctgctgccatttttaaaactgtcagtgtttttactgtaaacactattgtggactttcaaggtgactacagaaacgtatacctagcaaaagtctgatatgtaactccataccacccatgaattattttgcacaatttcatttaaatcattctgactagaggtttggaaaaaattgaggtggtatagttttaaaaataattgttttcctccttctgttgttgtttttttgggacagggtcttgctgtgtcacccagactgcagggcagtggcgtgatcacagctcactgcagcctcaaccttctgggctcaagtgatcctcccaccacagccacccaagtagctgggaccataggcatgcaccattatgcctggctattttttttttattttttttgtagaaacggtctagctatgtggcacaggctggtctccaactcctgggctcaagtaatcctcatgcctcagtttcccacaagtactgagattacaggtgtgagccaccatgcccagccattaacttttcatatgaaagaaaatttctctaagaagaaaataaaatataagggtttatttctaatttttacccacatactattagggtaaaacaaatgcagcatataaaatattcttctccaataatatttctccttttttaaatgaagaattcaggggaaggctactctaatatgtatgtctgctaatacatatgtaatgttgtttatagtagaccagctaatggactttatccatgataaaattagtccatactttcaaagttcccatgtgtgaatctttgttgaatcaaagtctgttcacattaagagcatagattctgatgctttgaggtcttgttgcttatttgcagcctttatacttaggagtgtaaatccacagctcaaagaagttgggcagcaaggaagttggtagctgggttgttctgaaaagatgatttatggggatgctctggtattatttcatttcatttcatttcattttagacagagttgcactctgtcgcccaggctggagtgcagtggcagaatctcagctcattacaacctccatctcccacttcaagtggttctcctgcctcagcctcccgagtagctgggattacaagcgtgtgccaccacacctggctgattttctttttttttttagtcgaaactgggtttcaccatgttggccaggctggtcttgaactcctgacctcgggtgatctgcctgcctcagcctcccaaaatgctggaattacaagtgtgagcctcggcacacagccgatactctggttttatcattgagtgaagttgattagcatgattgtaattcacatctatctacatgggctgagggtgggcagatctttacccaccagaagtaccaatttcactgctgaggaatggagccaaagtttgcagctggaataatcctttttactgtgtaatctattcattcattaactcaaatagtttgtggacatcactctgtgccaggatgtgaactgagcactggggaggagcattctgactgcatggggatagatattctaaccttacatccagtagaagaagacatcaatcaataaacaaatgggtttatttcagagtctggtaagtgctccagggatttcaggcagtagggtgatgtgatggatagttacacagagcaggggagacatcagcaaaggcctcactgagaagggcccattggagctgagacttgatggaacctgctatgtgatggtgcagacaaagaacttttcggtcagaaaaatctgcaaaggcagaaagcctcagtcaggagaaggattggcggggtcaaggaggggcaagtagattattgtttcctaggcatgaagagaaggccgtgggtgatgagagaggggcagggaggttggcctagggcacatcctgcaggctcttgtagaccatgctaagggttgagattttattgcaagtgcaacagaaagacactgcaggagttaaaagagagggctgtcatgacctaatcccttttacaaagaatcttctagcagttcactgaagagcagactgtgggaagtagaagcaggaagctcattgtccaacctaggggacaaaacggtggcccaggctagagcagtggccatggagtgggagaaaaatggtctcttgagtcagtagttcagtcaaagaatggaccggatttgctcgtgaatcagctgttccaggaatggggacatctcatgtggccagagtcaagctggggaaatggatgaaactggaaattgaggttggaaaaggaaatttttgccactatgaagtttgatcttcgacccccaatcaacaaggaagttctatagagaacagttcttttgtcctgtgctttggcataactgtgatagttttctttcattaaataagtattcataagagtaaacttgccactcatccacttatcctaagacttacacaagatgcaatcttattaaacaagtcatcaatacagagagagacactgatactcattattcactcagatcacccctgttctggctgcctttcctctcttgccccaactgctggtggcaaacaaaatcacttaagtcaagtgaacagttttagatgtataatattgaaaggtgtttttttaaaaaaaactccttggaaccctcagccattgttaaaatacactcactttgacagatgtttggcactttttgtatgaggcttttcaatgccttaccttatccagtgcatgagatttagtcggctctgcagaggaaaacagacaaaaagggtctctcagcacgagttactcttctgtaaaggttatagtaaacatgtcaatgcctaattaagcagaaaattttatctgtattgtgggggaggcgtttgctgtctctgacttttcttctggggaatccatttagaaggacaaagtagattgtgaggttgagctggtccggaaagctctgcttccaaatgtcagtgggaaaaaaaaaaaaaaaagaacacttcttttctcctagtttgaaaatgactatactgggtgggcagattgtgtgtgtgtgtgtgtgtgtgtgtgtgtatgcacaggtgcacgcattagagtgcatgtatgtatatttcatcaatgtacacacaaaataacatgaattacttcccaacttcttgctagatgtcaggcacggtgctaggcactgaaaatactgagatgaatgaaacccagaaatgcccttagccaattgtgatgacagaaagtcctcatggccaccaaatccccagatttctttacttgcttctttgttgctgtgattacgttacccacaggtgttgtcacatgtcttagttggcctggaacatcctgctgactacctgttgacccagcgtatgttccagagtaatagcaccccttcattctccaagtgaccctatttgattgatgaaatttgtctgattctctgatgtatgttacttggctcagtaacaacttattttatcatttgttatttagtttattaattttataacagagactttctctttgaatggtatatctattttttgcaaacatacaagttaatccaggaaaaaggaaatgggatgataccgacaggaataatctaattcggccatatggtcattttaaactacagttttcctgcaagttgtgaccgcttattaatggttttttgactagattgagtagttgttgtttttttcaaaccaatctttgaagctagagaccagtaacgccaatttaataaaaaatccacctgtcaatttgctaggaaggtaaaacacaccacaccaatagcagtaaaataactaacacaaccataaaactcatggctagactgaatttatacatttcatcttgttttacggtattctgtcactaaaatcatgggctcttgtctccagttttcccacagttttcccctgtgatgtggttatctatttagtgacatttcaatgaaattccactgcttaacctttagcctttgggtctcatcaaagggttcttcttcattaggttggcaatacaaagatagcagcatctcctgtattcgggcattctcccatcaggcagacttgggtgtctgtcctcactctgcaacgctagctgtgtggccttgggtgaatttccttaccttaaagcctcagtttccccctctgtgaaatgaaagtaatagtggctacttcatgcagatattagacaaaatgaaagaatgcatttgcagtgtttagcttacttcctaggagacagcaattgctcaataaatattctttatcttcagcagcagcagcagcggcagcctttggagttgctgattgtagctgctttatcctagcaaatccccttctcttctaattctccgtgcctgcctcacaggatggacctccagcgcatgaccactccttttccaagctttgtccttagtgactggaaataacagagcctgctctaaggttttccccacgtcgctacctgccacagagagaggagacagaagttcataaagaaaatattgcattaagattgtgcaggccttgcaaacctaaaactggatctccttttctttgggacttctttggttgcatgttatctgcatggttctgaaaaggccaggtgaagaaaatgagcccataggcataatgtcacattccccatctccattgatggatatttgcccattaattccctttgcactggctcactcatgtcttcattttccctatgtaattactggtcctaaatcctttcagagaagggaaagcatgcatccccaatagcattttgcatctacaaatcaaatatataattggcatctcatgacgggtacccacaaatcacagtgcatttgaaattacaggcacaagatcgagagggcattttcaaccttgtctggaaaggtcttcacaaacctgttttagaataataagatagtcgccaaatctcccattctagcaccatttgcgattattttcaagtcattatatttgctgagcttatataatttttcaactatcaacagaagattttatttgcataccccatcatctctcttcctgctgtgtgattccctacaaataaaaatgttatagcaaaaagacaggggctatcaaaaaatataatggctgtgtatccaaattacttctgagcactcaaaaatgatttatttatatggttatatgccaatatatccaagtgtcttggtaaactttaccatctagatgccaagagtcaagtcttagtctccctatgagccaacattcttccctgtagacacgtgactttaatgggatatgaatttcaatccagatttcctaaaagtcatacacatgaatttagcaactatcccatcacaggaatattagaaagatattccttaaacctgaaaattattaacttgggatcctaggcatttataaagaattatgactcctgccaattgaaaaaaaaaaaaaaaaaaacactagatggcacgaaagacaccatttggcttttcctgtgtccactgctcacagtgcataaaaatgtagattaaatcaccgttcagttcggcatgggaagcacttagtctatgtgaggaaattggaatggaatatggagcctgttactgtcgtttcatctcttcttcttctcttgcaggctacgcccaggaggaacagctgaaagaagaggaggaaataaaagaagaggaggaggaggaggacagcggttcagtagctcaactgcagggtggcaatgacacagggacggacgaggagctagaaacgggcccagagcaaaaaggctgcttcagctaccagaactctccaggaagtcatttgtccaatcaggatgccgagaacgagtctctgctgagtgacgccagtgatcaggtgtcggacatcaagagtgtctgcggcagagatgcctcagacaagaaagcacacactcacgtcaggcttccaaacgaagcacacaattgcatggataaaatgaccgctgtctacgccaacatcctgtcggattcctactggtcaggcctgggccttggcttcaagctgtccaatagtgagaggaggaactgtgacacccgaaacggcagcaacaagagtgattttgattggcaccaagacgctctgtccaaaagcctgcagcagaacttgccttctcggtccgtctcgaaacccagcctgttcagctcggtgcagttgtaccgacagagcagcaagatgtgcgggactgtgttcacaggggccagcagattccgatgccgacagtgcagcgcggcctatgacaccctagtcgagctgactgtgcacatgaatgaaacgggccactatcaagatgacaaccgcaaaaaggacaagctcagacccacgagctattcaaagcccaggaaaagggctttccaggatatggacaaagaggatgctcaaaaggttctgaaatgtatgttttgtggcgactcctttgattccctccaagatttgagcgtccacatgattaaaacaaaacattaccaaaaagtgcctttgaaggagccagtcccaaccatttcctcgaaaatggtcaccccggctaagaaacgcgtttttgatgtcaatcggccgtgttcccccgattcaaccacaggatcttttgcagattctttttcttctcagaagaacgccaacttgcagttgtcctccaacaaccgctatggctaccaaaatggagccagctacacctggcagtttgaggcctgcaagtcccagatcttaaagtgcatggagtgtgggagctcccatgacaccttgcagcagctcaccacccacatgatggtcacaggtcactttctcaaggtcaccagctctgcctccaagaaagggaagcagctggtattagacccgttagcagtggagaaaatgcagtcgttgtctgaggccccaaacagtgattctctggctcccaagccatccagtaactcagcatcagattgtacagcctctacaactgagttaaagaaagagagtaaaaaagaaaggccagaggaaaccagcaaggatgagaaagtcgtgaaaagcgaggactatgaagatcctctacaaaaacctttagaccctacaatcaaatatcaatacctaagggaggaagacttggaagatggctcaaagggtggaggggacattttgaaatctttggaaaatactgtcaccacagccatcaacaaagcccaaaacggggcccccagctggagtgcctaccccagcatccacgcagcctaccagctgtctgagggcaccaagccgcctttgcctatgggatcccaggtactgcagatccggcctaatctcaccaacaagctgaggcccattgcaccaaagtggaaagtgatgccactggtttctatgcccacacacctggccccttacactcaagtcaagaaagagtcagaagacaaagatgaagcggtgaaggagtgtgggaaagaaagtccccacgaagaggcctcatctttcagccacagtgagggcgattctttccgcaaaagtgaaacacctccagaagccaaaaagaccgagctgggtcccctgaaggaggaggagaagctgatgaaagagggcagcgagaaggagaaaccccagcccctggagcccacatctgctctgagcaatgggtgcgccctcgccaaccacgccccggccctgccatgcatcaacccactcagcgccctgcagtccgtcctgaacaatcacttgggcaaagccacggagcccttgcgctcaccttcctgctccagcccaagttcaagcacaatttccatgttccacaagtcgaatctcaatgtcatggacaagccggtcttgagtcctgcctccacaaggtcagccagcgtgtccaggcgctacctgtttgagaacagcgatcagcccattgacctgaccaagtccaaaagcaagaaagccgagtcctcgcaagcacaatcttgtatgtccccacctcagaagcacgctctgtctgacatcgccgacatggtcaaagtcctccccaaagccaccaccccaaagccagcctcctcctccagggtcccccccatgaagctggaaatggatgtcaggcgctttgaggatgtctccagtgaagtctcaactttgcataaaagaaaaggccggcagtccaactggaatcctcagcatcttctgattctacaagcccagtttgcctcgagcctcttccagacatcagagggcaaatacctgctgtctgatctgggcccacaagagcgtatgcaaatctctaagtttacgggactctcaatgaccactatcagtcactggctggccaacgtcaagtaccagcttaggaaaacgggcgggacaaaatttctgaaaaacatggacaaaggccaccccatcttttattgcagtgactgtgcctcccagttcagaaccccttctacctacatcagtcacttagaatctcacctgggtttccaaatgaaggacatgacccgcttgtcagtggaccagcaaagcaaggtggagcaagagatctcccgggtatcgtcggctcagaggtctccagaaacaatagctgccgaagaggacacagactctaaattcaagtgtaagttgtgctgtcggacatttgtgagcaaacatgcggtaaaactccacctaagcaaaacgcacagcaagtcacccgaacaccattcacagtttgtaacagacgtggatgaagaatagctctgcaggtatgggtttgctctgaggcattgcgattagcctggtgaggagctttcttacagggagatgggtctgcttagaggcagctagcatctcccaatgccaagcaggatagtagcttgctggagtaggatttattttaatgaaagaccagaacatgaaaactaagtcctaatcattctcttaagtcctctagtttagagctgggaactagaataaaacgggtttagagagataaagttcacagattactactgctttttttaggccttcatcatccataatcctgaattacccaaggcaagctccagtgtccagccaaggctatctttcattttaattattagatactaacttctgtcaccattccatttcaccaccccacctttccatagcaatgccaatgacttataaagtgacaaaaagttgagcaatggaagaaagattggagagtgctagaagtagttactatatagagattccttaatcagctcatgaatagcttaaagttgtctttatgattgttacttgtaatgaatgcttttttgcagcttacttttagtaattgccaccttccacctcttccctttggttattttctacattaagtgtcctatgaatgagcatgtgcccttaacaggttggtagaaaaatattcttctttgcagaacattgagatgaaaagaagcttattttcttctttcatcttttggttttcttgtggatagaccagtattagagcccacctttaacaaagatagaggcaatgtgtgcccttgaggtttcatttcacataaagaaacaaatggctttctgtacacttatgttaatgtgcatggagtcccatagcttgaagataatgtgcatcatgtgtcatagaagttccatgccttatatagtcaaccatgcccagaccatttgtgtcatttttaggaaacagggcagagaccaaggtcaaatgctttggcagattagtttcaccagccattttcaaatgttgaggataagcaaggctgggtcttaaccaatctctttcatttgcccatttgtgttttctctacttctttttctctcccttccagcatgatgcccgcatacactaagggccctcctatgtgttcaggtggtcctccaccttcggccattccccaagatgggaacccaacctgaactaaaccttctgtgctgaccaatccagttgacgtcatgttaagttacggatttgctcctagttaattagctcttaattcacgatcgaatatgaaaaactaataacatataatcgctcaccacaccctattgtcagagcattggtttacaaatagaagactttcagaacaagctagaaaggtaggacactaggagagttccaggtagagagcggtatttacatggcatggctttgggcttgcctcacatcagacagaggggtttactgggtgtgaagatggccaagatgaaataaaaagttaaaatatctgacctgggactttcccctgagtgaggcgatctacgcttctgatggagaggagtcctcctataactctaattgctatctagacccaaatgaagactatctttttggtttgcatgtttttatcatgatgattgaatgtgttattggcagattcttctcattctttccaagcatgatttgttcagctcacggaattgaaagaaaagccaaaatgcatccattgaattcacacctgagcttggggttcaacagcgtcctatttatttgctgcataacattttaaatcttaaataacttgccattatgttttcctggttcttaaaaaaaaagagggggggcatacagagaatacttagagagaagaaagatatttcaaatccaatagtggtgggttgaaaccatggtgaagaggacaaataggtaatatttatttgtactataacaaagaccacttttccacctgttaggtttgtaatcttttttagaaaattaatataattgccaaaacactctgatatgtagatagggagaggtaaggaaaagaaagcttgatccatcgtcagtcagaatctggagtgtatgatacctgttctagggattcaaaggtgaaccaataatttggaaaaacatatacaaaaggtacttccaaatccattaaatacatagataagatagccattttggcacttctctgcatttgtacaggatgagtatatctaatttggacctcgaaagcaccgtattggtgttttcattatacaaaaccaaagctccatccttacaagcaccattaggctgtggttctgagaggattgcagaaaaacaggtttgagtgtttgggactcactcaaagccatgggcgtgtatgtatgttttgtaaacagaaaagatggtgcaggtactggctgtgtttgtgttcatcgtaaaaatactcctatctgcctgaatgtttcccccatctgtacaaaggtcgattcttggtgctttggtcaccttagaaaaaaatgcctccacccccggggtcctcttttagaacaatatttatgcaataccttgcccattgcttagaatgatgcatgtaaggtttctaaatggtcatgaaatgacatcactgttgtctggaactctaatcttagttgtaatgcatagtagcacaaattgtgcaaagtgacatgatattttagaaagtatgatcaagatttcttggaaactatgagagctttaacctatcaatgttttttgaaagacacaacttttgatctgaattttctttcctttaccagatatatcttaaatcctgcaaaatgctctgccaaatattaaatgcaacttttcgttaaaaatttcattagaaaatattaagtgtgcatctctattttaggtcataagtaatctaaaacaatttcaatatgtatttgtatatagctttaaaagccacatgctcttgactaatagaaattaaacagagagcaaatcaatgagtctgaaatgcataaaggcttgaaattatagtcatcactgtgtaatatagtgtacaagcttaacagcacacctagccttgaaattgttggcaggaaagtattctagtccaatgagctgccacttctgttgtgggcggcttgataaaaacacatattcagggtgaaaagcgcgtaaggttgccagacaaaatacagaacggatgtccagttaaatgtgtatttcagataaatgacaaataggttttgagtataagcctggcccaaatattgcatgggccatacttatatttttaaaatattcattgtttatcagaattcaaatttaactgggcatcctgtatttttattagctaaatctggcaaccctaacagcatagattatatggcagttgggaagaacaaaatagcctggacaaattaatatctattaatggcatcaaccattccttcctccattaaataaatattccttcctttcatcctcttttccctcctttgttccttcattccttcctctttcccttctttccttccttccttttttcttctttccttccttcttttcttccctccctgcattcctttcatccttcaacaaatactggttgtgcttttactatgcaccggactctattatatttaacaatggaagtataatactgaaccagaagttctaccaattgtaatagcaaaacatgccaagccttgcagcaagcactttgcaaacattattttgctttattctcacaaacagccgtatgaagtagaggttgattcactcatgatagggaagagaaaatggaggcagagagattctgcctgaattccccaaggtcctacaatctctgagcctcactcattcattatgacatatctagaaagccatcgttccacagcaagcactgtgctaattcccagggagtaagccataaccaggacaagagtctgcctttgaggctagtggcagacaaatagatgaaaaactctaggggaaatgctgaaaggagcacacaggaggtggctctgcctggttctgggggaagccgggatggggaacagtggtctcagaggcagtgtttggaaaagaatgctggatttaacccccaactcacttgctttcatgaagacatgccccacttctacatctttatgatgtggacataatatccttctcataggaaggttgtaagaattaaatgtatgtaattattttccttaaagcccatagtaggtttacaagaaagcacatagtaggtctataagaaaagcaagttctaggtagagccactacatgctcttaccatgctctgtagcctcacctgcagcgtagagaacttgcagcaacttctcaactctaactaattaataatcctgcaaaatctcaacctgctgtttgattcagataacaatgacagtgaaactaccgttgactggcctctttttataactcaggcataattattcatattatcctcattttgcagagaggtaaaccaaagctcaaagagtttcatgatttgtccaagaagacaaaactaaacctggaggtaggttttgaacccaggactgtccaatgctcatcaactttctcctgctccttggtttcctcctccttgcctgatggtttctaggtaatactcatggctggatgtacctccaacagcccagagagaaagctgtaaaatgtggcctaagagctgagaggagaaaggacactttcctgggccttttggaggctccagctatcaaacattgcaactcaggggcccaggactgacccgcagggtgaagcagaacatccttgttctctttcttttaatgctcttgttcaatcaggcaattatacatttgccatatggtgtctaaccaagaaatgacccaaattccagtgaaaatacatacacctaatattaaaaaagaacatcctcattctgaccctcaggaattcattttagggaaaggaaatgagaactgaggaaacagggtcaagtacaataatctagcatctctcaagcagcaagaaacaaatgcatcgtcttccttaacgtttgcattttttcaaaaatatttggcttaactccgtctatgcatctcagcctccattgcaccttcccccctcatttggacttttgaatgctcaatcctgacgtgtataatttggtgctttaatatagagtaacattatttttcatttactccaatctgccatcagtatcatcttttcatttaaccagatgcaattcttttttctttcgctaaattgaaaatccatgagcgacagggagtgcaatgttttaattagctcatattttttatatggatttatgtctttaaaatacatttgtgtaattcttcagctaaattaaaaacgtctttgcgaaagtgaggaggggaaaataaagagctaaattgtgtcattagcttaggtggttgcagatgaggagcagaatctggtggagggacacacaatcgccagagctgctctctgtgaggatcttgaacttgcccttcctgcagagaagtctttctccataaagatctctcaaaaatggcttggggaggatttttttttaaggcctctagtaagtaaacaagcagttaccttcactgagctaatttgaaacccaacctgccaccaaacaaacagagaaaaagaagtcataatgataaacagttttccttgcatttctctttgtctttttctttttttaactatcaagtttaaagctttccacgatgcttttttctactttctaggagacaagtgacattctgtggtaaatgggagaaaaagccatgcagaactgaaatctctctaacgcattgacactaacttgccctctattgttggaaatgagcaggcgttcatgattgttcatcaaacggctcctaatgcagttaaagcattcagctataatttctccttgcatttataattactgtcatagactgcacacctcggtgagcagattaaagctataaactatttagcctcggctctaagacgaggaacttgatttgtctggcaggagttatttgttagggagcttgacacttcacataaaaatgactcaacttgatgaagaacaatgcagttttagcaatgtggggattttaaatcagtcatgatgccacgccctgcaagaatcgcagggcagtttgttaaatgatatgtaggccagggagataagggaatgtgttaagggtaccaaaatagaagaggatttggtgtgcagttgctttctttcccgactctctcctggaagatcaggagtttgttgaaaatcagtgcatgtcatgttctcctattaaatccagtgtaaatgttatgtgaggctcacctggagggaaaagggatgccagcagccacaggcacatgtcacatttgggggttttacagaactctgtgtagctgttgagaacattcgcctccagaagcgaagttctggagtatatggaaaagccaggagtatatggaaaatagttgtttggtttggtttgtttcctggaacatgttcatgtatttctttgtgtatttgtttgtttacttgcaggaggcatagaatatatttaggcacagaaggtgtttccatggggctgattctataccttttatctgtgaaaataaacaaaaaatagatactttccaactcagacatcttctgattgttgagacacagtgatcaagagctttttctcaatgaattttgggcaagtttgacttgccatggaatcatctcccacctacccacacttcatagccataaatagacacaaatttcccttaaaactggcattcagcatcaagactgttgaatgtttatttgccgcaaacagtggataccggtgcccaaatattagggatcatgaatacaagtgctcccaggactgggcgatgacctggaggaccctagcatgccggcaggggccgtcacggggaagctaggaggccttgcacagcaccagtggtttccaaagaagtagcaaatccagatctttgtgtgagccccccagtgttctagtcgagagggtttttttaatggatgtgttttggtttagttcggattttagtttgttttgttgtttttgttctgaacacccttcaagccaaacaaagtacatcaaagaccagattcaactcctaggctgctagctcgcagcccctggatctggtggcaggtcaggtggagacactggacctgtttcttggtgttctttgtcccctctcccccaaggtaaccccactaggactttgggctctaacatgagtgccacttttccgcatctcagaggatactgggctgttctttaggaaactctacttccttctgaagatttcgtcaagttgctgctactcagaggaggggggcaggctgggctcccctggagaggagccaatcattcaggcttacccaggacttggccgggagggttccagggatttgagaatgaaaccagaaaattccaggcaaatcaggtgagttggtcaccctgctctcctgatatactctggtttcttttcagattatataaatcttttgccttctactaatacatctcttgccttagggcacaatactcattgccggcgtagcttgtgaaatggtgtgtgttctctaatccttatgatatttagtcaatgctgttacccagcacatttgacctatggtatttgtctaatcctcacagcaaaactgcaaagtaaatattatacccattttagagatgagaaagctgaggctcagagaaggcatttcaggtgcaggtagcaggtagcaggtagcacacagcagtagcacagcagcaggtagtggagctgagactccaggccacagccatcagaatcggagcacagggctccttatgcagcactgggccaccagtgctcaacttcagtgtatatggaacagacaatgtttcaaagcatggtgcctttaaagtgcatagtcttaatgagctgatttttgaacatgtgtaacggtgccttggctgtatttgctacaaagagtggaatcttcttgcatgccaaaaaccccagcccaaaggatgcatgtccagaatgagcaagtgtttctaaagttttaccaactttagcccaaatatatgccttgcaagctacccagcactcatgccagtaggcaaaggactatggctaaaggagattttgttcaatgaagttagccttcaagttattgttccgtgatatgtgttgatttttttttatacaaagcttctccctttattcacttgggtgctctacagggagcactcactgtaggttaggagctggcattcctgtcggggagatgggcagacaaaaagtgtcataatgatggaaaacatggcagtgtggagggccagagggcaccatggcttacagggaactcagggaaggcctcattgggagaatctgtttatgttgagactggccaagaagcacttagagagaggggttcccaagaagcggtaagagtacctgctcctctccaaccaccgaaggcgagagcaggcctggtggatctgcagatgtatcaggggtcaggggagacacagcttggggagcaaggggagagcattgaaaatgaaaactggagaaagaggccagggccagagcgttcaggggtgggggagatggggagaaataaggcctagagaggttcagtgacttaacccaggccacacagctaacagacttcacatatccaaagaaagtcccagtgagaacattcaaatgcattgagccagacagggaaggcacacttaggggcttggaagatattaaatttcacattttcaatgccacaaaggctgagacaagggagagactggcaagcatgagaggggcttgaggggtgttggaggtgagcagggacaggcgggggtgcagcaagtcatggcaggggagttaggaaggaggaaaggaggtctgttggctgccaggtacaacacaggggaagctgctgttcctttcctcctccagccccgcagcgttaacctactccgtgggggctcagcccacctctgtgagctggactttctttttctgttgtataataggcgccatggcagtaaatgccacctccctggctccctcggggaagccccacgccttgattattcctgagaattggtgacattctgtggctgctccttgtgggggaggcacaggtctggcccacctgatggtttttgttcacttcttgctgtcacttttgaaagagaggaaggttttacatacacataagtaattaattttgttctttcttattctgaacgtcccacacatcagcagaaaaccagaaagacttcttcaggacagagaggcacaggagagcaatctaagagaaatgtgttttcccttcctccctccctcctttcttccctcccttcctttctttctttttaccaatatttgtcagacacttcttacaggcactgagactataacagggaaaaatgcgagctccctgcccttgggaagcttagagtctgaccctccactttagactgaggctcgagagaagatatttggccacagctacaccagttttacctgcagtgggataagatctaagcagttagacttactgggttttatgggaacaccaaggagaaacatctaacccaggatgggggtcaagggtggaggaggacacagggagtccgggagggcttcctgcatgggagccctgattctgagacttgcaagatgagcagaaagaagtcaggagtaaagagatgaaggagggacacagcatgaaaagagaataacagaaaaggaaatcttctggaaacaagaagttcaatttgaaagtatttgtgcgctctgccccacgcccagaaattgttttctcattttcactaatttgatgtaaataactgtacactcaagctctgacaatgctgggaccctgtgttttcacccctccacttacaggatcactttctagttcaaggcaacacagtttgttctctcaatgcacctatgcactctcacctcaaataagaaaccaattaccttggcttttctgaaataccaaaaataattctcattgtcccatcattactactagtaagaataatatggctataataatagttaattgtaccattcataaatccaaaagtgtttgtgtgcatgtacttttttctcaagccctatacaaggctctagggatagagtggaatcacaaacaatgacacttcttggccttgtggagttctagtctagcaggggaggccgatcgacgatttttttttttttttttttttttgagacagagcctcactctgtcgcccaggctggagtgcagtggcacgatctcggctcactgcaaccttcacctcccaggttcaagcaattctcctgcctcagcctcctgagtagctgagcttacgggtgccaccaccacactcagctaattttctgtgtttttagtacagaaggtgtttcaccatgttggccaggctgatctcaaactcctgacctcaggtgatttgcctgcctcagcctcccaaagtgctgggattacaggcatgagccaccacgcccggcctcgatgatgattatataaccacacaggtaaacgttgatggcactggtaagagtaccacctatgaggctgcaagggccacaaagtctctagcagaggctttgacctggcactgagatcaggataggcctcgagggaagatgggaagggcctcagagctagtgagctgaaacaagaagtgtgtcccaggcagagggcagagcctgtgtcgaggctccgaggccagtaagaagagggacaagtacaggtgcctgaaagaaagccagtgagctggaagggagagggagagcatggatggtgtgaaatgaggctccagtgatgcagtttcttttaatatttcagcctctgctcagatccttaaaggcgctattcacatctttcaataatctcacaggatgggtgatagtcatccattttacataagaggaaactgaggtttagaaataatgaaaagccccagcctcacagtccatggcagagagaggatgggagtccagcttagaccctacacatgtgttccttctaccacatgactcttgtagtcatgtcatctcctgtctgtacctacaaagggctgtttaaagatgcccagtgtatgttagatgcttgcaatagtcaaggtcagatactcacaaacacttagtaaataaaactaagtaaggaataaatgagtgctgacatactcatcaacactgatatttattgaatgcctcatatgtgctaagctcaggctaagcacttttcacatagtatccttcttaattcttgcaacaactttttgaaataggcatttttattactattccccctgtgctgctgagaaaactggagctttaagagctctagtgattgtccaaggtcacgcagctggtgagggttgaaggtgggactcaaactcccagccagagcctgaatcttaaccctccctggactgcttctggtgaagcaaagcaaagtccatggaggctcagtgtgcaagacagttggcttggccacttggggatggagccttcggaggccttttcaggagaaagtgtggatttgaactgaagaattgcataaaaaaggcagggggcgggcatttggaagtcctttggtcaaaaacacctttccattttcatgttggagcctccaatacattatatgttccatgcagaatacgaaagaagtctgtgcaagatacagacccagattgaattacttactattcatttcgtgtcacgtcaacaaagatgggaaccagttaaggaatgggggtggatctttataattgagaaattcagatgttctgaactttgggacctgagatgatctacaaatccagacatgggccgagacatggcaatacgagggaagaactcaagcaggaggagaaaagactgcctatccaggcaatagcgtgacttagaaacaggatttgagtaccacttcatggctaagcatgtgcgggatggaaccggtcttcctgggcttacatctttgctttgcctcttctttccctgtgatgagtcttggggtaggcctcaaaggctgaatcttcaatataaatacaacagtgaatgaacaacaaatggttattttaaagatctatcttggatggctatttaatttcactaaaccccaggttgctcacctgttgactggaacaaacaatagtcccttcttcatgcgggcatggtgagggttttaaccccgcattgtccacaaagaccacttaaattatagtagatgctcagcaaatctgagctattatttttatcacgactgtcagaggtcagatcaggcttcggggtcagacacacctgggttcaaatcccagcagggccacttactgttggagccggggcaagtcagttattctccctgagggtcagttttctcatccctaaaattccaactaataatactcatctttcagtgatgccgtgaggtcttaaaaataatataggttcagattgataaaacaggctggcacaaattggatggcagcaaatgtccttgcagccctgtgtctcctgccttagtttgtgttgaggattaggtcagatagtgtacaggggtgggggctgtcagcgtggatctggcacacacagcaagtgcctgaggaactgctttcctctcaattcccttcccctcaacccccagcccttgatcacctaaagaaaaaaaccctttcatttacttaaggtttaaattaagatgtgaaatggatggtgccactttatttgaaggaataaagagagattgtaagtatagatttatctaaaacagctctgggaggggtgggggggataaaagatatgcccctgagaaaaaatggaatgtagcattaacctgcatttccttccctccaactttcccattctcttcctgccaccagccaccttgcaaagccccacttgttacaacacacatttgctggtggctaagccatgcttgggaagaactgcactggagttttcagtgaaggtgatgatgatggtgatgatcatgatgatatgatgatggtgatgaggaggaggaggaggaggatctgatgatgaggatatgatgatgattaaatgttgtaacacacgaacttagaatagtgcctggcacagtatccattatcagaaaatccatgtcattcacattagtgggtgcagcgcaccagcatggcacatgtatacatatgtaactaacctgcacaatgtgcacatgtaccctaaaacttagagtataataaaaaaaaaagaaaagaaaatccatgtcattgatattgacagagaactaacatttattgagcactgtttgaatcaccacataggttaattatattatcagtaacaatgaagtgaaaggaacctcttcttttaatccttttttatataaaataatatattctcatatcatctctgagaggtagatggagaccctaccttcatttactaatttacctttaaggaaactgaggcatttttcaataaaactgggagctatgtaggaatctggccacagtgaaatgcacctgtagagggtatggtggagatgcctttggatgtctgatactatatccttgtgcccacgcctggcttctgcttgttttcccctctaatagatgcacctgcagctctcttctgaggacatctcccagctcctggagctactctgcttgcacacacagagcacccttggtgcctgcaagtgtgtgcccctggctggccttgagttaatgactgatgtggagtaccagagcccaattcttgcctcccgagaggccaagctctgagtcctaagctgctagggccttatgtatcctatctcaattaatctttctcctaaattctataaagaaggaactatgattgcacccagcttacaggtgaagaaaccagccctcagagatgtgaagtgaccaggaaggccacacagctagtaagtagcagagctggaaactaagtatagacaaatggaggatttgcctgaagccagaattttggctgaaatgtcagcaccattctggcatcccttggtgaaattctgtgcatagtacaccaaagcgtgagatgcagacacaccacttatttgaaggagagaacagatgaatgcctcccccccaaaaaaagcttaaatatccccaaaattcaaatctttgaccaaggcaactttctaccactcggggccttcagcaaattgacacttcaaatgtgcatggttttatttggtatttttttatcgatggagaaaaaaatgatgtttcaggttatgcttttttcaatgctacatttctcaatttcacagtcaaataattctatttttgttcaccagaggattttgtcatctttaattgtttatgactaccccctccccctgtacttgcgggagcctccacttttccccctgctgcctttcgttagactctcccgtgagcagtaaccatggagatgggtccctattggatagtctctgctctggcttagaagtcaaagagccaatcaggacctcgtcatcccagaaatgtaagaggatgaaaaatgcgaggcctttgtaagtggaggggagacctgatatgcagtctccagagacagggagttcctgatgcctagaaatcctgggaaggaaacacacagcagctaagctcagtggggaaaaacatgggtcctggaactgctggagtctggccccagggctgagtctcctcttcctggctgagggacctgggtcagggcacaccacttctttgaacctcagctgtctcttctatcaagcagcagcaggaaggctgagctcacatactgttataaagataaaattaaatacaacccactaagcacctgcctagccctgtatcaggcatgtagaagtcctcaattaacaagagctactctcataataactaaaaatatagcaaccctagaattgaggctgggtgaacaggtctaacagccctgccctcagaatgtttgctgcccatcacggaaggaagacaatgaaaccacaaggcttagcctctgctcactgctagcacaacagaagtacggagccagtggggaaaagaggggtcaaagaagtctaaccaaatgagaagagatctaggctgagtctggaatgatgaaaaggagctagccaggaggataagagggaaaagtgttgcggaaagaaggaacggcaagagtaaagtcttgttaagtgagagagagggtgtggttcattccagaaaatgcatgtggctcagtatgattgcagagagcccagttttggggagcagatggcagagagaggaggctgaacagacaggtggctggtggatgtgcatacaatggcttctccttgggtgcacaaactttgtcttttcatgatcatagagacagatattcaattgaggtttgctttatgaaatattggagcattgtttccatgaaattgactttgcagggctgggaagtgagtggagaagtggatttttttttttcttttgtgacggagtcttgttctgttgccaggctggagtgcagtggtgcgatttcggctcactgcaacctccacctccctggttcaagtgattctccagcctcagcctcctgagtagctgggattacaggcacgcaccaccacacctggctaatttttgtatatttagtagagataaggtttcaccatgttagtcaggctggtcttgaactcttaacttcatggtctgcctgcctcggcctcccaaagtgctaggattacaggcatgaaccaccgtgcccggccgagaagtggacttttaactgagcctccagttgacattggatacaaggtcgacctccacctcgaagctctgggagggcaggggctgcatctgactggcttcctgttgtattccttggaacccagactctacaaatattggataaaagaaaggaaggaaggagaagagagagggagaaagggacatgctatctaggaagtgattatacttccttttgccatcctccatgggcgaaatgacaataatacttacgtctctcatccgtgaggcagatcaaatacataaaagtacacaaaacatgaagcacagtccccagcatctaacataagcccagtgcaaatgaatcttcaggctttgcacagccagaaaagtatgaggatgtaagaaacatttccagcctgccgtagaaaggactaacactctgccaggatgtttttgcatccggggtaagaaatgtctatgctaactcttggaggaactgctgtgtgccaggctctgttctgagtcctgggctacaccagagaataagagaaacaggggatgcaggttgataataatactaagggctaacatctattgagcacataaatacaagtaacaatttctgagaatgaggggctaccaaggaaatatggggtagtgcaagggactgtgacagggccacctactttaaatagaggagattgaaaagacaggagtcaggtggcaacttggaagcagaacatcccaggcaggagaaacaggagcagggctgatatgtttgattcagagaaaggccggagtgtcatgagctgggcatccagtggtgggacatgaattgtgggatgagcatgggacaactcagggctttgtagaacatgctaagaactttggattttttgagaccatgctaactgggtggggaaataaaagaacgttggatttgtttttcattaggtccactgggaagccattgaagcagcttgaacaggcatgtggcatgatctactttctttctttttttgagacagagtttcactcttcttgcccaggctggagtgcaatggtgcgatcttggctcactgcaacctctgcctcctgggttcaagtgattctccttcctcagcgtcctgagtaactggaattacaggcatgtgccaccacgcctaattttgtatttttagtggagacagggtttcactatgttggccagactgctctcgaactcctgacctcaggtgatccacctgcctcgactttccaaagtgctgggattataggaatgagccaccacgcccagcctactttcatttttataagatcactctggctactgggtgtggaatggacaagagggtcaggagtgaaagcaggaggccagcaaggaggctgttgggagaccgggaacagatggccttggttggagcctcagtggaggcggtgagcatgggaaggaatgcgtggacctgggagaattctggatcactcaggaccatgcttgcctagggaggagaagggacttcaaacaaagaagacacgtgttcatggggacagattctctcagcttcacactgtggggccccgggtgggctctagaggaccaggatacaactgctcttcccgaatctcccctggaccacccggactcccaagcatgccatcactgcccatctcccaagaggaatccattccgataaaagtaaaccactagtggccgggcgcagtgactcacacctgtaatcccagcactttgggaggccaaggcgggcagatcacaaggtcaggagatcgagaccatcctggtgagacctcatatctactaaaaatacaaaaattagctgggtgtggtggcgcgtgcctgtaatcccagctactcaggaagctgaggcaggagaattgcttgaacctgggagacggagattgcagtgagccgagatcgcaccgctgcgctccagcctggcgacagagtgagactccatctcaaaataaataaataaataagtaaaccactattttcatgcttctccaggaattacgaagtgtaaagacaaaaggtcccgctgtgctcgccttcctatttttcaatcctaatttcattcctctctccattctgtaattcagctccccctcctctgagcctccacagtaggtggtcctgacttctgtgggagatttactggagagatgacatggaggaacacattgtctttttcaaaatgatttagtgacctttttggcatccccgtgattactgaaatcttgcgtaattattcagtttgccagcagagagttctgttgatcaggggaaagctgaggtagatgtcagatgacagtaaatttgcaatccataattgtaaccacttgatgctggagcagaccagggaacaaggacttggtcacaaggccatggatggttgaaccaatacgagcaccaaattatctcacgcatcacacatgcagaaacgttgcctatctttctttcctcgctagcgctctttctctttctttgcctctttttctctatctctatcactgtcttcatccccttccctagagatgggcacgttgaatactctgctctaagtcttctaggtccatttccacccagagccagtgatgccgtaaatacagccacaggtttttcccccaagaattcccataagctctttctggtcttactgttctggtctgtttggcccctgctggagctcaagcattgatttttttctgctttgcttgctttctgacagcacggcttatattggaaaggtctgtgtcaggaattagagaacattcctaacaatggggaaaagtaccctaatataaatataccatttgtggacttgcactttgacaagtgcaaatgaactggaagacactggaaaagctctgaagtcatggaaacatgtaacagaggcatttacttaataactcatctcattccttgagctcaccttatcaagctttaacctctgagtctctaagttcctagttcaaaaatgcagagtctcctctgtcctcatgttaatttttaaattatatatcattgtagagaggcccttatgttgaatattatgagccattttcatatctgaaatggggaattataactgaacattagcaattgcctataaatctcagcaagcaaagtggcatctataatacatggcattaactggggagaaatgtggtgcacaaaaagggggatttagaggggtggaggtgattttcaagaggaaaggctgcaggtcgatgagcacaagccccctgtgtgctgtataattcctaaaatcttagtggacctgggtggaagtttgttgacacttttggaagcaatggttaaaactgttcagcatgttgcctgggcacgctggctcatgcctataattccaacactttgggaggccaaggtggatggatcacctgaggtcgggagttcaagaccagtctgaccaacatggagaaaccccatctctactaaaagtacaaaattagccaggcgcggtggcacatgcctgtaatcccagctactcaggagactgaggcaggagaatcgcttgaaccaggaaggtggaggttgtggtgagccgagatcgcaccattgcactgcagcctgggtaacaagagcgaaactccgtctcaaaaacaaacaaacaaacaaaactattcagcatgttaagtctacattgtgtatatcaaaatctcttatttacaattcactgcaaaccacatcaaagttaagtaaaataagaaatgtaccgtctcatccaaggagagagttggattcatacatggaggaatccttggttcaaaggatgtatgccgtcagaactttgtctttctccacctttccactcagatgttccttgtgttgtctcattattaggcaaatggcaagattacctggaccagctccagggtctaaagctaggatttagctccaggcctggctctttcatttttttttttttggaaccacttttttaggtggaaacttccttggaagttgagaaatttgtcctaaggcttactaggaattggcaaaagggcaataggatatgtcattccaggacagtgtgtctgccagccaactggaatgcgaacagggcactctgcctgggaatatgagcagctgcgtagatctatccacttttgctggggatcaccagtgaggaaccatggtcaggctgcctgggtttaaatttagggtccactactcactagcagtaagagcaaatattctaacgctctcagacacagtttcttcatctataagatggggataactgttctacctcaggaattgatagagttaaaagaaataatccagataatgctttaagccagtggttctcaaacttgactgtacatcgcaatcacctggaggtttgttaaaacccaaaggactgagcgccatcccccgagtgtcagattcaataggtccagggtggagcgagaccttgtgaatgtctaacatgcacccagatgataccagtggtgttggtccggggaccacacgttgagaaccattgctttaagtacctgggcatgttgtaagtgctccagatagtttgcttttagcagctttcctcctgtctttgagcctgtctgacactctgtcctttgtgagatcttagcttactgcacaaaatcaagtcaaaccaacataggggtccatcaggatgacctattacaggggctaaacagagagcaggagctgaaatagagaagcaaaacaaggagaggcccaaaatctagaaaaggagtgggtagccaggaagtttgcttgagtctgctgagatcgcttaaagaggtggacaacctcagctcagttgcttgtactgtattaagaggaatttctcacctgatgcacatgaccggctatcaagggaagaggtcttcctcttgacttagcttaataccttccttaattctgaattaattggccctaaaagtattttggaagcaatggttaaaactgttcagcatattagctctatattgtgtttatcaaaatcttttatttataattcactgcaaagcaaatcaaaattagttaagtaaaacaagaaatgtggcttctctgtctatgaagttgccatcctattgtttctttgcttctctactaaacttgctttcactttgcaaaaaaaaccaaaaaactaaaaaacaggaaaaaaaaaaacaaggaatataacagctcatccaaggacagagttggactcatgcacagagcaatccttggttcagaggatgtatgccatcaaaactttgtttttctccacctttcagctcaggtgttctatgtgttatctcattctcaggcaaatggcaaacgtggaccagctccagggttatatcctatcagtttagatgcaccagtagatagagggcctgtttcccaagggtaccaagaaaatatggacatttggtttaatcagccgggaataaggaaagcacatacccttaaagcaatgcctgcaacttggagaattggatgctgtctttggcctgggttcaagtctctcctgtggaagcagtgagcagactcagcactgcacaacttgggctgagattggtccacccagaggagttttgatgtcattgttgcttggggaagaatgacctcaaatccaactaacacgctcctcctgccaggactgatgcagtagccaccttcaggtcttctcatctctacttactaccctgtcccagtttggccagcacagaacttccagattaagtcataattcaaagctcatatcacaatgagaagagctaccatttcacgagtgtttattctgtctcaggtgcttcagttatagtccttctgatccttatattagcctttctcatcatttaaatctcagcttaaacatcgtcttctttaaggattcttgcctgaaagcctatctaaatcagttgttgtctgtaaaagcccagatagatagctggagcttggcctaagccatcttctcactttcctgatattttctaattctgaaatggtaggtagccttactcttctcatgatgtctcagcttaggatctatggaccttccttttttctgtcatctctcctcacactcttcatttattccatcactcatttttcttgattggacctccatgatgcttttcccatgtcacttccacttccatttccacaggagccatgtcatttgaagtataccctcctgttgccaggactgatgcagtagccaccttcagttctcatctctacttactaccctgccctagttttcccagtacagaactgccagactaagtcataattcacagctcatatcacaataagctaacatttcatgagtgcttattctgcctcaggtactttaattatagtccttctgatccttatattaatctttcttatcatttaaatatcaacttaaacatcatcttctttaaggactcttccatgaaagcctatctaaatgaggagtcatcaatttctttctacaaagggccagatagtaaatattttcagcattgtgggccatgcagtctgtgtcacaactacagctgacccttgaacaatgagggagttagcagtgctgatcctctgcataatcaaaaatccacagataacttttgacttcacgaaaacttaactacttatagcctattgttgaccagaagccttaccaacaacataaagtcaattaacacatattttgtatgttatatgcgttatatacaatgttcttacaataaagtaagctagagaaaagaaaacgttgtcaggaaaatcataagaaagagaaaacatattaactattaagtgaaagtggatcatcataaaggtcttcatccttgtcatcttcacattgagtaggctgagaagaagaagtaagtagaggggttggtttgctttctcagaggtggcagaggcagaagaaaatccatgtataagtgacccacacagttcaagctcatgttgttcaagggacagctgtattcaatcttccattgtagcataaaagcaatgatagattatatcccagtgaatggtagtgactatgatccaatacaactttatcaaaggacactgaaatttgaatttcttgtcatttttgtgtgtcataaaacatcattcttcttctgatttttcaaccatttaaaaatataaaaaccactcttactttgttggccctatgaaagcagatggcaggctggatcaggcccacaggcaacagttcaccaacccctgatccaaagcaatccagctctctcacttttctctttctcgtcaccctgttttatttccttcataaaattacaactatctgatatcatgttgtttatgtattttctcatatctagcactgtgctaggctccaaggatacagcaatgaacaaaatgacattttcctttccttcacagatcttacattcttgttggaggaaatagacacaaaattaaaaaataaataaggccatttaggatcccatgaagggaatagagcattatgggcctgggtagcagtggtgctaatttactttgggtgctccaggaagactcctttgaggggcagcttctgacatatgaaggactgagggagccacaaatgagaagaagaggatttcagacagggacagcaagtgcaaaggccctgaggcaagtaggagctgggctcgttgtggggaactgaaagaaagccagtgtccctggaatgctgtgagctcaaggtgacagactcaattgtgcaggccatggtaatgagttcagattactctgaatacattgagaggctttaaatagggaaagagcatgacccaatgggcatttttgaagatgactctgctcctgtgtgcaggaatggattgcacacaggacatgtatgtgtgtgtgaatgtacctttccttccttatcaggaagctccttgaagacctcaggcatatgaaggcctcaacaaaaactttataaacttaatgcatcaattaaaaccattaacacagccacataactttttcttaacctcctcactagcaatcctttttatagcctggttcccaaagcaggtcaatttatatcataaaactcaaaaattacagcttatagcataaaatgacctcccatgatataatgtggcaaaataagcgaattaataccagaggtagtaaatgtctgggcactaatgtgacttgagtatgaaatatgtttccatcgcattaggagtaaggatccaaaatgagagggggatcggtgacctggcaccacctacatggagctagctatgctaagtcctggtttagaagatccacttggtatgaatgcaaccacttaggtatttttgattcttctcatcatttagtcaacaagtcgtttttttgtttgtttgtttgtttgttttttgttgttgttgttgttgtgtgtgggggtttttttgtgtgtttttttgagatggagtctagctgtcgtccaggctggagtacagtggcgcgatctcagctcactgcaacctccgcctcctgggttcaagcgattctcctgtctcaacctcccgagtagctgggactagaggtgcgtgccacgacacccagctaattttttctatttttagtaaagatagggtttccctgtgttaaccagggtggtctcgatctcctgacctcgtgatccgcccactcatcctcccaaaatgctgggattacaggcgtgagccaccacgcccggccagtcagcaagtattcctaaaagtaaactgtatttagatactatgccaggcttgtatccagaaatgagcaaggcaaagaaagcctctggcctcatgcagtttatgtgctgttgctgtcatggagcaaacaatttaatcaaagagaataatttcagtgctgttagttgtaagaatgctgagccaaaaaatggggaaatggaaggctactttagatgggtggtcagaaaagtcttttctgagaaactgacatttttgctgagacctaaataatgagaagcagccaggcatccactgagtcaaggaatgagggctccaggcagaaggaacagcacatgcaaagttcttgaggtcaaaaaaagcttggtgtatttaaagcattatctagtacagaggtttgtaaacctcttttgtcaaaaggccagatagtaaatgtctgaggctttgtaggccatacagtgtctactacaaatcttcaactctgccattgtatcacaaaagcagccataggtgatatgtaaatgattaagcatggctgagttccaataaaactttatttatgaaaataagtggagggccagatttggcccacaggctagagtttaccagcctatggtctagtaggatagtgtctcatgtgggggtcctagaagcagatcctgacatcagggttcctgggctattaaacctattgaatccctggtttctcaggaatgtgctcccaggaagaaccagtaagggagtagggaagcaggacagggaaggaaagaaagccaagcaagtcctagcctctgcctgatcccatggggagcctcagagttccacctgtctgtaagcaagggctgggctaccttggctaatgactgattgactccacatcaatcagtcattggctcaaggatagccaggggtacacacttgaaggcagcaagggcactctgtgtgtactggcagagcagcttcagcgaccaggggacatccccagaagagagctgcaggtgcacctattagaaagtaaaacactcagaagccagacgtgggcacaaggatatagtatccaaaatccaaaggcatccctactgtgtcctctacagatgcatttccctgtggccaggttcttatctagctctcacttgcatagaaaaatgtctcagtttccccaaagttacctttgtgaataaaggtagactctccacctacctctcagagctgatgttaaaatatatcaagttcttttgtccaaaaaaaggatcaaaagaagaggtgactttcacctgattgtcactgataaaataattaatttacatagcaattcaaaatagtgcaaatatacaggaatcacgtttttgaaagtgatcagagaagcctggcctctggcttagcctttcatatgcagatcagtgagggagagggaactggcattgactgagtacctgctgtgtgcattgtgtcaagagcttttctatcttttttctgatttaacccttaccacacgctttaagtagcgatattacccccattttatggatggggaaaccgaggttcaggtataagcccctcaagggcagaacaggggctgtaaaatttaaaatccttaactcatattcaccgaatggacctcagaaaggtctgtaacatactgagggtgaccatgactgacaggtgacagagttaggatttaaggccggttctgacactgaagtctgtgcatttttctagtggcacctttcagactggtgattcgaaggaataaatacaaaatggctagccagtggcgtcatgcagtgctctttgtataaggaggtggcattcctgtgccaagcatgtgatttgtgtcaattgcttgctgtcgtgaggaggccttgccgagactccttcacacattctcactgtgccactcccagatcagaacagacacatgcagtcctcttatcctgttccctggacaaatctttcccaagacggaacctgggacatgcctaataatgatctgacttgctggttcaatcaacaaatatttattcagcatttattatgtaccaggcaccatcaaagccctgaagacacaaacttttatgacaatcataattaacatggagttagcgccctaccagtgttatctcattattcccttcccacatcctccaaagtaggatcatgggtccccatgttgtagaagaaaaagctaagccttaaagaggttaagtaagtggcccattatcatacagttaggaagcagcagaacaagaattcaaatgcaaatttgccaaacttcattatcactgccagaactcatgccctgtcctgattcttgcaaaaaatcagggctaatagttattgaatgcttactatgtccgaggcactctttaaaactctttacatacatcatgccattttatctttcctgccatcacaccagataggtccctgtcatcacccctattttacagatgaagtacctaaagtcaacagaaattaagcgccttgaccatcaccacacagctttcagctggtggagcttggatttaaaccccagctctgctggactttagggcttgctgggaagcagagttataattttttaattaccaaaaaaaggaaaaaataaaatagtaagaagaataaacatatactgaaagcttacttatgtgccaaacactgggtttagtacttctttgttttagcttattcaagcttccgtgctctgggaagtaggtgattttcttattcctattttacagttgaaggaatggaggtatagcaaagtgaggtcatcctacccagtcacacaaatgttttgtgatgagggcaaaattcaattacagattggtctgactctccaagataaacagattaaccctatttttatccagggaagattttcctgcatgcttggtctgtgacctgggtttatgaagaatgaatagaaacctgtgctcgcctgctccatccaattgactgcaatatgcaaaagaggcttgaatgtagagcttcgaggagtttggggtgaaagaaggtggcagaaggaaagtaaaaacgggtacagtaattcccagggctctttgtcaagttcctgaccaaatgcccggcaggggctttcttcctcttcttccacttcttccttcattcataagagttttaccgcctcgaacaacgtgaaatgtgtagcttgggcttgttgagaatggagtgtgtctgttaagtgttgcttcttgaatgctggaccgccacctccatcttagttacgcacgcccatctttttcaatctaatgaactccaaccatcagtgcaacttaagttcggctgtctgttcgtgcatagttaatattaaaaatgtactaacagtgtggctgagaaatcaaattatgcacataaatatgctggcatagcacaggcggcggcagaagctgaagttagcaacactgatgccagttcacatttgcaaatctcccgtcaatctgtcattaaacatgttatcaaatgatgataagtgtatgcttcttgcttgcattggtgagccgattcccgatgttgatgcacattaatgggataatacgcattaacatagttgtgcttggatgaacacaaaacattttttatctgtctccgtttgtttccccctgtggccccgaagtaagtgttttgtgttatcaaattgccaaaaacacgggaaaacatattacttttaattagcaaatcttgttgggattttcccccctacacgcccgtcccccccacccccattgtgtgatggcaataagagagagaaagagagaggagagagaaatagagagaggaagagagagaggaactctactgtcttctttcagtaaaacgattaatgtcagcaactcagaagctggcaattatgttctgtcttaatgcactggcctttcatctggggcccttactcttgacaggcctgatcgtttcagttcagtgatatgaaaggcagcagaggaaatgatcgtagacatcccgggtctgtcacgagggccggcgctgcaattcggatccagctccacgttctgaagctgttcagcagagtcagaagcacaggagacagatggtggccccaggcattgcccagactttgggtgtcactgtgctgagtggggaagttgtagctaccaccatttcccaaacttaagaactgggaaaatgtgcaagcccccacaaagtgagaaacacggtattaaaaagttaaatgtccttttgcgttgatcacagagcaccagctcaacgcaaggataaacgtgaatgcgggcagtgatttcatacagcagtgtttggataggagtctcttctcctgaggatccaggagaggattggattcatttttcaccaaaatgaaaataaaatttagatattcttgattgaaaattcagaactttatgaaatttttttgcagatgttgggtcagtacaatatctgagaaatggggccaggtgcggtggctcacgcttgtatcccagcattctgggaggacaaggcaggcagatcacttgaggtcaggagttcaacaccagcctggccaacatggtgaaaccccatctctactaaaaagacagaaattagctgggcatggtggtgcctgcctataattccagctacttgggaggctgaggcaggagaattgcttgaacccaggaggtggaggttgcagtgagccaagatggtgccactgcatttcagcctggggccgcagagcaagactccgtctccatctcaagagaaaaaaaaaagaaagaaagaaagaaaaagaaatggtagtggtgcccagcttcctttgtgaagtgatgttctgagccattagggttatatatgtttccacaaaggatctgtcaggacatctttgagattggattgattcattcattcaacacagatggattgaatatctactatatgccagaattactgtagcatcagggagtaggacagaaatgattcctaccctcatgaagctttgggtatttggggaagggaaaacagaggtttttttttaaattgctacataataatcaatttatttttattatgaaaagtgaaggtagaggtatatggagtgcagttgttgtagcatttacttctcgagctcagtggaaaatgttttctgccattaataatgccaaaaggttatgtgtttggccttcctggattcttgtttacatgtgttttaaaattaacattgacttcttgccatttgtgtttgttcctaagcggagtgagcggcttattaatgattagaattattgttgctattatgaatgcactaattaaaagaaaattctgtcatgaggctttgtgaggcaacacaagactttacagttagagacgtcaggtctggaagtgtggagacaaaagtgtgaaataagaaaacagagttcaggatgaggaaaagagttctcaagatgtctacagtccttcattagagattctttttcagggcattttccctagtaagggtatgatgaaaatccagttgttttttgattggaggtgtcacctttattgtttttctttttttttggtcttagggcagaaatagccggcttctctccaacttgaattctaagaacattttatcttctacagctttattcaaatatgtaaaaacaggcacagtagctcacacctgtaatcccagcactttgggtgactaaagtaggaacatcaacggcttgagcccaggagtttgagaccagcctgaacaacacagtgaggtcctttctctacaaaaataatttatttttacttagtcaggtagggtagtgtgcacctgtagtcccagctacttgggaggatcacttaatcccaggagttcaaggctgcagtgagctatgattgtaccaatatacttcagcatgggtaacagagcaagaccctgtctcaaaaatacacacacacacacacacacacacacacacacacacacacgtaacacttctgaattgatgaccagatgccagaccaaggatgccagaccaggacacagttcctccccgaggttcatcatctaggggacaaggaagtgaagcgaatgcacaatcgtagtgcctggacacattgctgtgatgggaaagatacaggtgcacaaaagaggggcacccagtcttgtccttcgtagtaggaacaaattatttctttatattgtgaataagtatttatttaacatactcaatatactgaactttttcaaggagacaaaaatagacataataatgatacgagcttatatttattgaaaaattacatggcacttctctaattgttcatttgaattgtctgttctctaattgtctgttctcttgctggtctttcccactctaccttgagcctcaccagggcagacactgtgtttatcagaactcatctccagggtctggtccacaaggggtgggcattttcatgtgcattgacttacttttcaggagttacagtttagatgttggaggttaaaaggtgattgcaatacaagtgcagtataagtaacatgtgtaccctaagatctgtcatgggttcagaggaatgaaactgaacccaccgcatcccacagagtgagcagctgttacttatctgttgagtatccccagaagaggaagtgttgcttgactgtctaagaggttagtaaacttgcatggagactgagattggaaaaagcttgggaaataattagttacagtgagtgccagggtagtggtattttggatttcttgtccttctaaaattgtttttctgtggttaatatcaccttgaaaacaaacaaaaatcatggtagatgaaagtagaagtcattttttaggagttaatatttttcttattcaacctgaatttcttgagtttttaaaacttttaatgactcagctttttttcccctccaagagtatttcaaaatggaaaattttatattctataaaaatatttttcaaatctcttcctgacatttattggagaagattaaagtctttaatcctcaagctaatttctatgtggtcctcataaaattccactataattccattatcgggaggctggccatagaggaaacttgagtcttcaacctaatgtaaaaatctgcctttagacagatgtgtagatttttcttaatgtcaaaaactagttaccggtaggccaggtgcagtggctcacacctgtaatccctcctgcactttgggaggccaagatgggcagatcacttgaggtcaggagttcgagaccagcctagctaacatggtaaaaccctgtctggactaaaaatacaaaaattagccaggtgtggtggcagatgcctgtagtcccagctactcaggaggctgaggcaggagaattgcttgaacccgggaggtggaggttgcagtgagccgagatcacaccactgcacactgcactccagcctgggtgacagagcaagactccgtttcaaaaaaaaaaaaaaaaactagctactgttcaataagttttaggtttatattgacattaaaatttgttaatagaagtctagttttctcacatctgtgtttttttgccaaagtcttggagaatgaatagtcttggcatcccatcaacagtgattgggaggaccgctcatttattcattcaacatatttttaggtgcctaccattgccagacactgtagtaggttctggaagcttaggactgaacagagacaatatttctgctctcaaggagttgtcattctagtgggaaagacagatcctacacaaatgaaaatataatatgcctgatgctaataagtgctaagaagagaaaaagaagagcaatagagaggaaggctattttatttattcatgttttaatattttattttattttaatttaattcaatggttttggggaaacaggtggtttttggtaaaacggataagtcatttaatggtgatttccaagatttcagtgcacccatcacctgagcaaagtacatggtacccaatgtgtagtcttttatccctcaccaccccccaccctttgccctgagtccccaaagtccattatatcattcttatgcctttgagtcctcataacttagctcccacttaaaagtgaaaacatacaatatttggttttccattcctgagttacgtcacttagaataatggtctccaactcatccagatagctgcaaattccatgatttcactcctttttatggctgagtagtattcagtggtgtatatataccacattttctttatccactctttggttgatgggcatttagactggctccatatttttataactgcaaattgtgctgctataaacacgcatgtgcaagtgtcttttacatataatcacttcttttcccctgggtagataccgaatagtgggattgcctcattaaatggtagttctatttttagttctttaaggaatctccacactgttttccatagaagttgtgctagtttacattcccaccagcagtgttaaagtgttccctttctaccgcatccacaccaacatctatttttttttattttttaattatggccatacttgcaggaataaggtggaatctcattgaggttttatgttgcattcccttaataattagtgatgctgagcatttttccgtatgtttgttggccatttgtttatttccttttgagaattatctattcatgtcctttggaggaaggctattttagagacatggtttagggaaagcttgtctgagaaagggatgtctgagctgagacctgaatgaatcaaaaaaggaagacatgcaaatatctgggaagttgaaataaatcagcttctaattctgatggcaattagctaagtcataaaaagaataaaaccatgatcaaacaatcattgaaaattgaaatgattgaaattttgcaatgagtgcaaaagactattaattatagccaggggatcaaaagacaatgaaatctaaacattttctacattgctattatttcaatgataactttcatttctgttcccagaaattgcatgaagagttgtaaatggcctgagaatgagatttagtggtttttaattcagaggattagttgtcaatatttaaaatcagagaaatttacattaaactccatattttcagcttctcttgaaaaactagaaaaattgtcaatggcgttccaccttcctatgtggagtcagttggagctaagggatattttcccctttcaacaggacgtgctctcttcaggttaccacaatccccaccacctcctactaccctaccccaagcccccaccctcgtttatattttctgcttggcccctatatgcactgcaatttgtgatcacaacttcaaaggtttatagggttaatacttcactgttcattttggtggattcatgatcatccaaaccttagcttacatctatcactaatttaaaaagtactctaaatcaaaaactaagtaattttttttaattgagcaaacatttatacaatgtctactatatgaaaggcaaactactagaaaaaaaaggattagagttaaaagacacaggttctcatctccaggagttcactgtttattggggaataaaagtatcattctaacaatgtcccccatatttttaaacacttttaatatagtcaaagcactctgagatctgttacttcgtttggtctatccagaattctaggtaagaggaaacacaactattattggtttcattatgggtattacgtgcaaagacaggtatagagaggtaaatgtatttgtccaaagtgacaaggctgccagtattaaggccaaggctagacctgtagtcagtgtccactctcaaaagttctattttaccaactataatctccaaagtgctacctatgtcaagggttggcaaatccagcctaccacctgtttctgtaaataaagtttttttggaaacagccttgccatttgtttacatattgtctatggctgcttttgtgctataatgtcatatttgaggggttgcaatggagactgttatgatctacagaatctgaaatatttactacctagtcctttacaggaaaaatttgccgacccatggcctatgcagtagctgcttagtgagggtagatgtgagcgtaggggagaaagccatattcccatgtctcctcaagaacatgaaaactgaaggaaaggtcaccaattcacggtgaggggtgctagtcagttccaaataccctggtcaaaaatatcaagagcaggctgggagcggtggctcacgcctgtaatcccagcaccttgggaggccgagatgggtggattgcttgaggtcaggagttcgagaccagcccggccaacatggtgaaacccagtctctactaaaaatacacaaaattagctggatatggtggcacacacctgtattcgcagctactcaggaagctgaggcaggagaatctattgaacctgggcggtggaggctgcagtgagctgagatcaggccactgcactctggcctggacgatagagcaagactctgtctcaaaaaaaaaaaaaaaaaaagatcaagagcaaaattgtgggttcagttaggattctcaattacacatcacagaatctacaccagctaacagaaaaaaagtttcatcaaatgttattatatagttcatgggaccacccagagatccagagaatcagatttgaaggctacacagtcaagagttttgccaggactgtgctggtgggaccactcttgcactggctgtgctggacgtttgactttcctattaggagttctgaaacagctccctctgcagggcagatggctttcacccaggtcatgataaaatccgcctggcacctgcctcctcacagcacactcttctgaatcaaagccctacgttggtacatttggtacatcaaggcaaaccttaatttctgccttgaggaatgtccttccttccagtcaagttattgggatactgacaccatggtacagatgatattagtaatttctgaagggaaaaaatatagatatcacagaaagatagtcaggatagcatttaaaaaaaaaaaaaaagaacagatagggaatttcgttaaggggaattccaaaattgcccatgggaaaaggacatctttggttatggaacatttagtgtctggcctatgatggggaaggtctcacatataataatcttaataataatgactaattattgaggcttcggtccattcatctaggaggagagcatgattctgtccacatgttttctataccaaaactgctgcatggtgaactggtaatcctgacccttacaggggtagagagttaatctgagaccatctgtgccttaaacttccacactggaaatgagaggatttttgactgcttgtctggaacatttctgaatccagtagcaaagcaatcctagtagcctctctagccttccaagaactctttctgaagttcattagaatttcaccctcctggccagtaaatgcacacaaaccacctattttttttttttttttttgagacagggtcttgctctgctgcccaggctgaagtgcagtggtgcaatcatagctcactgcagccttgaactcccaggttcaaaccatcctcctgcctcagtctcccgagtagttgggactacacatgtgcaccaccatggccagattttttttaatatttttttgtagagatggggtctcactatgttgcccagtctataaaccaccttctggctacaatttccttttccatgctgcatgtgtactaacagtaactgcattacccagaatagaagctaacaatctgttgagagtttgctcactgtcaggctccagagcaatggctcctttaatccccctcaatggccctgttatcattttccaattcagacagtcagagagttgaagtaacttgactaaggtcacagatccagtgagtagcaaggctcagataaaagtcacatgcatctaacactacatgcttcttatatgtcccctcaggaatatggaataatcagagaagactcaatctcatcattggtccattcacagtcaatagtttaattaggtgggtagggagttttgatgatataagggtcgccattgaaaacaagagcaagaatttgaaacccaccaccattagcacaaaggccacgctcttaagcacagattgtatgagttatcttttaaaatctccgtggcatttctatactttttagtataaattaatacatgagccaagtgcagtggctcacacctgtaatcccagcactttgggaggccaaggtaggaggatcacttaagcccaggagtttgagaccagcctggccaacatggcaaaaccctgtccctactaaaaatacaaaaattagccaggcctggtggtgcaggcctgtaatcccagccactcgggaggctgaggcacgagaattgcttgaacacaggaggcagagattgcagtgagctgagatcatgccactgcactccagcctgggaaagagagtgagactctgtctccacctcaaaaacaaaaacaattaatacatgagaattccaggttattcttcaggccccctcactcttcaggcaacagaaggctgaccagtcttggatgttgtccagagggcatggacactttgagaagggggaaggcaaacaacagtgtggcaccagacagactggttatggatgctgctctgtcaattaccaggcatgtacccagtgctgtgctggtaaattttaacaactggctctcaaaaaaaaaaaaaaaaaagaaaagaaacaggtcctggccaggcatggtggctcacacctgtaatcccagcactttgggaagccaaggctggcagatcacgaggtcaggagatggagaccatcctggacaacatggtgaaaccccatctctactaaaaatacaaaaattagctgggcgcagtggtgcatgtctgtaatcccagctactcgggaggctgaggcaggagaattgcttgaaaaagggagtcggaggttgcaatgggccgagagatcatgccactgcactccagcctggcgacagagcgagactccatctcaaaaaaaatagataaataaaataaaataacaggtcctgatttgccgtgttgaccaatttctgtggtgtaaatacttccacagtgggaagaggcgcacacaggcagctgtcatgagctcttgtgagctaggaggggctggatcttggcaggtcgcttaatcgctctagcctccagagactgagcaaaaggcaggtacctccctcaaaggttgttaggcagattaataacaaaacatggtaaagcagttagtgccgaacctagcactgtggtagacgtttgctaaatggcttgatttactagttgagattccattaggtaaagtcctaatgtcttatgcctcaaatgttttaatcttaaaaatagtcataaaatactttccccacctcttgctcaggataattggaatgattgagtgagatcatctgcatcaactgctttggaagtccacaagcttataaaaaaaaaagagagagagagagacagagagtattttattaaagtcaagtcaaacccagagaataaatttttgctgggcaaaaattatacaactgagtcataagtttttagttcttctgtcatcattttttcctgagctttcaggttctcctcagctcctgatacttaaataattcccatttaaaaagcatttaattgagaggagcctggaaactcaccagctcagagaaaaattcagtccatcaagaggttctgagagtctttgggtttaagtctttctgatcttttactcctcaatcctctaatcctttttgtgaggaatctttcacaatccttgtttttagttcttatttctcaagtttccctttgaaaagcaggattcccatcacatctcaaaggtgaaggcagcataaagcctgcttccaacaacactactgcggttacataaagacacgagtcatttctgctgctggaggctccagtggagtgttcccttggatttgctcatttctttgcttggtcctccctgtgatcttagaggattgcagtatttatgaacatcatcttgttactttccatttagtacatttctgcctagtcattggtttttaattttgtcctcgtaccctccatttacaaacagaaatgtttaactaatgcttcaacaacccaggttcatggattgacactaattgctcaccatactcatttccatttgcaggcaaagccagacctcctggttgcaggatagcacagttataaaaaatttgcgttctgtggtccaaaaccctcctgttcaaatcttggccttgcagctttctagatgtgaattctgggcaaattacttaaactctctgtatgtccgtttttcctataaaaacatggataataataagacctatctcaaggggtagtaaagaaagttaaatgagtttatgtatacgtgtgtgtgtgtgtgtgcacgtgtatgacttaaatagctcctgataatcactaaaaacaaagaaatgttagctattatcatcataaagcggtgtttccctaattgtattcacatgatatttgtactttttgccatatctgcaaacccctgtgcttttatttacttatgataaatacttgtattaaagaggaaactttaatcactagactaaatggaaaccagtataacttaacaaaaaaaggagcaaatgacaaaagatacataaagtgaccacaaaacaatgttttcatatctggccagatcctgatgcttgcctaagtcttggagctgagctctggtttctctttgttgggacaagaggttaaaaagtgttagtgggatgttaaaaccttgaacttgaatttgaacttgacactttgagattttcttttttggagcatagaagaaaatttaaaacagccatctttcactttatagttctgtgttttttgttttttgcttgtattgctgcctctatggacctcctaaaagtttctctcatatatctaatgttctgcacctcatgctttagctaaggtgaagttgaaggattcattactatccaggtctgtaatgactgcaaaaaaaaaaaaaaaaaaaatccaggcagtttgatgcatattattcttgaagactgtttctcctctcagccttagttctgttatctatccgtcccatctccaaaattttttttaatggtgtgcttccttcataaatttttcagatctaggtctgcgtttttgtctcctctgaagtccagaaattgatgtctcattgaggaatttgcaatttgctctgggcttcacaatgctgagctgcccacttcctgacttaaggaaaagaccagatgtcagtgtttattagtgtgatcatgcagtttagttgctgtaaggttttattcttaaaagattgcaatctatcctattgcatgatcacccaacattcaatatgctggcaatttccaatatgtaacctccttcaaattaggctcagtgttatctccctcatccatcagtacagcaagatgggtgaaaagtgctgtcgaaaacagctggtcagctgggctagcatttccagggttgtttcatctcaagccctttcactcccacacactttatctttttcttaaaacacagtctctggactatctttgtcctttatcataacttgagtttgttctgttcttccttggtctgaggtcaaagccatcttcctagaaacttctttatatttttggtccaaggctaaggttagggtgatacaaacccagaaatacatctcttatcttttccctgttcaaggcagttgacagttttgcatagtcactcatatttttcatgcaagctttggaaattttccccaagcaaagagactgagatgaaaccaagttttagaatttctgcaggtctagggacgccatcacaaaatggactttggagtctgcttatgctgcagatggaatgaatgaagtagaaagggaaatgatctgcccaaagtgaatccaggatctttgatttccaatccatttaccccagacaacttcaaggtagagaaagtcacatgatatttacatcccctcacagtaccctgtcccatgacccctggtgatctggccatgctggcaagtcatatcaccttattccaagttattatagtcttgtaatctctaactgcaaaggattttagtataccttaagaaatagcaatgggaaccaggtcaggaaataagctcagtgtcaatgataaaggctgaaatgcaggggaaattgatccaatgagagaaatctcagaatcttttttttttttttttttttgagaccagttccggctttgttactcaggcttgagtgcagtgatgcaatcaggctcactgcagccttgacctcccaggatcaggcgatcctcctgcctcagcctccagagtagctgggaccacaggtgtgcaccaccacgcccagctaatgctttaattagcgtgccgtcttacccaaggtagtcttgaacacttgggctcaagctatcctcctgccttggtttctgcgattataggcatgagcctataaaatgctgcgattataggcatgagccactgcacctggccatagagacttgatatgacttataacctatcaaccagtgtattatcttgggcaacctgggggtaggacacagttagtagcaggaactctgcagtctcactaacttggtttgaatctgggctccatcatttattaactctatgaccttaagcaagacttaacttgtccaagccccactttccttgtgtatacaatggagaaagtaatagtaacacttctaaggctgcttgaggattaaatgttataattaggcccatgcctgacacactgaaacactagataaatattgcctgtaattatcatgtgacctatttgaatatccctcaaccctggaaggtttactgcagaatttagtggcctcttacagatatcaaagaattggctatgaaattgtacaaaatgtcgaaacttattctctcctttccaggtgggtgagcaggggagataatgtatccataaaggagcttcttggatgggtggtgtctccaacttctttcggtcacctacctattatgggtgatcctcttcatgaggcatgtccttcttgacccaaaatctgtaaccccaccctttttgttctaattagaaaaacactcatgcattcatttagataaatattcattgaaaacccactatacgccaggtactctgctgtacacggagacatcaattgtaactatgatatgttctcctggcccttacattctagaggagaggggcagagaacaaacacgtaaacaaaaataaacacaaaataatttctaacgcagtgtgaaaggatacaaaccatcgcactgggtctgagaacagtgagagaatcagattggagtgtaagttggatggatggactatgtggacggggtcatcaaggaccccactctgaagaggtgaacttttttgctgacacatgaataatgagaaagaactggcttcagagatctggggaaacagtgtttcagggaaaggcaaaaggatgtttcacatacgagaaggagcttggcttgtttgggaaacagcaagggggatagtactgaggcagggagcgggaggttggcttgctgtgcagaagccagggtgcaggggatcttgtcagctgtctcagagaggaccttgagaagtcactggaggcgggtaaacccaggagtggcagcatcgatttaccctttgagagaacatactgggatgctactgagtgaggaaaacaatagcatagaagagtgtgaaatctagtctccctccttcttaatcaagtaaattgtatattgcagtccttaaaagagattggtcacaaataattttcaacacacctgataactgtgcaaaacttctttttgtctcatttttgagaagtgctctggtaaaatatgaagtgcctctgtgaaggtgtgagcctctgtcccaaaagggcttgtgggagttgttttggagcttatagatgagactctgctttccagctcctgtgaatttcacaatcccaagagtcagtagtgacatagtcccagggtaggtggagaagattagagcctgggaattgtcttcttcctgggcaaacccccaacttaacagatgatgtatagctaactagaccccatctgttctataaaagagaggaagccgcaccctgtcttatagcagcactagaatgtttgaacacagtttggaacagtcccaccaacaaggtcaagaaagaattgaggcaactaattggataattcatcaattagttgaaatcctctgccccaaagattttatgtaaaacaacttgaactgctcttttccccattaaattacaatgactcctcagctcaccactgcgtttttgtggatatgattgtctttacaaaaaatattttattataatatgggtaaagactttttcccttgttttgcccatttataaatgtgtacttttaaaactgttctgtcccaagtataactgctctctttacttattttgtcattaacgtcatcttttttgtttgtttgtaattctaagtccgattattctctgccccatgcctttccaattttgctgtcttattctcccaattgctaaataattagtcaatatggcttcaccatatgtacagagctccacagataagcaattggcctttgacactactcagccagtaagctctcaatgcagaagtttgaattttgaccacatgtccctacttgctggtgaacacctaagaatgtaattagatgactacagtttggttgttcttccttggacaattcattttgcaacttaattcccaggttctcagagacaccaacttctaaacattatacagagcccatcagaggatgacatattcccccacatgatagcatattttttatctttaaaacttaaaaagtaaaataaaataaaaaagtaaaacttcagcacgtttttcctctccagggtttatcttatttacttccctcgtgctgttcagctaattccctgccagggacttattgctgtaactaagccatcacacagaggcatgccaaagacacttgtgaacaaagtgtttatttctcttaacagagccagcaattttcagattttctgaagtgcagcccccagcaaaccctcactacctgttttagtaacttcccacagacgttcacattttcataggttctgtggtattgtttcgtaatgatctttaggagagagggaaaaaaaactgcagcaaatgtcaaaccttaggatgtattcaagaggccttcaagtcactgcagattcaggatctgcaagataactaaagcacttacatctcaatatatggcttttaaggtcagaagtatcataaaatcactcaggacatcttgttctgttcaagttccttttcattttcccgccctaatggtagttgctcaaacttcttgagaaaggcaatttctgatgttcccctggaagagattttcttgacaaaggatttgaagggttagtattttctttctccttcttctctctcctgttttaatctgaaacgtaatatttattatctccaatagataaaatacaacagttattcccccttccccctccatgtcatccttttcttttaaaatgagtagtgtctgcctatgtcaggatgattttggtgagtgaatggatataatttgcctcagatcagcccaacacatcagtcaacatcactaagtggtcaaacactccagtttcaaatatgtttctgagaatctaactgctgaaaccagggagctttgactaaatttctttggaactttggagaggaagcagggaggagaaaaggggtcgcaattggcaatgtgtttcctttttgcccagtggaaggtgttgcatatttgtttatatggatcaaatagcttcaagggtaggaggacttacagacagagtgatttcttttcttttctttctttcttttttattttctttttgaggcagagtctccctctgtcacccaggctggaggctggagtgcagtggcaagatctcggctcactgcaaccttcacgtccccggttcaagcaatcctccctcccacctcagcctcccaagtagcaggtgtgagccactaggcccagctaattttcatatttttagtagagacaaggtttcaccatgttggccaggctggtcttgaactcctgacctcaagtgatcctcccacctcagcctcccaaagtgctgggataaaaggcatgagccactgcgcctagcccccagagtgatttctaaaagggaaaaagaaatacatgttagtaacaaagtgaggtagcagaaagaatatgccactttgaaatcaaggagactgaagttcagattctgtctttctcaatgactgtgtgacctcagacaggccatttaatctctgggttttattttcctcaactgcaaaatgaagatttaaaaatatgtttatctaccctgctcctttgccagggaaattaaacagttgctaatggtattaggatgtagtaaactctctgaatgttggtgtctgcccatcccctaagccgaactaagcctttaatatttatacattagaatacctcaaccaaacgacgtaggagcaagaaggtaaaaggaaaagcatagagaacgacagatacacgtttgcaaaaagcaatacttctgttcagtagataccctcttctccttttattgttacttggttgcttggcaactttaacccgctcatccctaaaagcacagtgccacctgcaacccccaactttcaggtttttaaaaaaggaaccttctattaggagaaaattcaccttcgtggcagcgccatttgacgggagaaaagtatatgtttgaaaaggcaccccagccaacatgaatacatctcgcatttagcactcggagatgagaatatcataatatttaaatcagttttgagaactttccttgaaaaggaaaagtggggggaaaatccactagttgaatacccagggaggccgcggggagtggttaccatagcgatttcgcactggcaagtggtattggggagcagattggcatcgcttaatcctttttatttgtaatttatgtatgttggctcattctctgtgccagtccagatttttctgtttacctgccattccgcttgatatgagtgaggagcgatgatgccaggttgcagccatttcttcaatttgtcaacatcggggttcagaaggacagccgagagtacatgggggtgtcctagcactcggttttgcccgatgttagcaaagcgttgaggaaaattttgtgggaattgctgggagtgagggagaaagccatgaaattctctatgataatccagaaacggattgagacccattttggccttataaatctggatttcatcgaaccttgttagtgaataatttttattctctagtgaatgcaaaagaaaaggagatggaacacttttggtcttatctcatcatcctgtggcaaacatgatccttgaaaataaatattctgttgcctaacctgctaagtaattgtctttctaaccgtgtgtgggtgctgggttcccgggagaatgggtattaacagtgtttctcgaaccctcttcacacttcctcaggattaggccacaggaaaatgtcagtttcactgacaattaaatggagtaagttccttattctcaagaaaggaggaaggagatgaacattttctagacaccttcctttagtctcagtgagccttggactaagaaaggcaagccttcaaaatgggcttcagtagatgtcaactaataaatgttcatttccataaaatttaaatgaaccccgtaaaatctacctcttgctgtgccagagccctatctcattactcaaaatagcagcaatgtaatcattggaaaccacaccctccacggccaaggtggctggtaggaaagaaagtcatagctaatttccacacgcttgcccacaaaggtggtgaaaataagtagctagacctcttccagttctttctgctgtaggccatatctccttccaaccacatgtaccttataaattaataattttcagatgtagcgctgcattttgattaaccaagaggcagagcaaggatttctttttctctcagtacacacaggcaacagtccaaatatctaaatacttaaaaactgcacgtgctctttaagaaaatttcaaaactttagacaccccccaagacagggaccgatttactgctctagatgagttctgcgccctctttgcattttaagtgacctttaagcaatgatgacgtctatcttgttgagacttaattgcttaatcagagaaactgtttttcagttacacaaatatttcctttaaggcccatcttttaagtttaaaaagccttcatttaaatttagacacattgagatattccatattttcatcatcaacagcacaactggaaggtggtttacagaaacactgagataagcagtattcttctatgaacggtatcacagacagcgattacatgaagttttcaagtgattaaaaggcttgcagcctgtgcagatatgctcaaactcccacccatcttgaaatccagtgccctcttgacgtttctgtgagttcccagaaattgtatttttcttaatagggaaggcaatctggggttgtggataagaacttagatgctagaattcgactacctagtttcaattattgtatgtctatggacaagagaagcagcctctctgttcttcagtttccccatctgtgaaatggagaaaataataggtctgtcttataggttcttgagtagattaaaaatgttaaacttttaagcactttgaaccagggctcaccatgttgtaagtacccaatacacatttactgtaattattttttgtttcttcagaattcttttttctcaccttacctttgtagcaattcttttatcacttccctagagttaacccaaggtggacccagccctttcaccttaatcattgaccatccccaaccttcacacatcattcaaacaacagattctttattattattattattattatactttaagttttagggtacatgtgcacaatgtgcaggtaagttacatatgtatacatgtgccatgctggtgtgctgcacccattaactcgtcacttagcattaggtatatctcctaaagctaaccctcccccctccccccaccccacaacagtccccagagtgtgatgttccccttcctgtgtccatgtgttctcattcaaacaacagattcttgtagtaaacttttattggaaggtagaggtgagtacagcaaacaatctaatatttagttttagagctcccggtacttatggcatatggcattgcaccatgacatgccctgcttgtagcatatcgtactgtggggtaattcaaaagtccagtcttggtctaggctgccatgatgcttgtttccttcctcaccattctaccaccccaagaaaaagcaaaacaaacgaacaacaacaacagcaaaaaaagcacctcctccttaattagcagacttataaaattgcctgccccaaacctaaactcagcccacaacttatttcacatagcaaagaactattaatgaagttttttgtttgtttccttgtttgtttgtttgtttgtttgagacacagtctagctctgttgccaggctggaatgcagtggcgcaatcttggctcactgcaacctctgcctcccgggttcaagtgattctcctgcctcagcctcctgagtagctgggattacaggcacgcaccaccacgcccagctaatttttgtattgttagtagagacggggtttcgccatgttagccaaaatggtctcgatctcctgacctcgtgatctgcctgccttggcctcccaaagtgctgggattacaggcatgagccactacacacggccttaatgaactttttttttttttttgagacggagtcttgctctgtcgcccaggctgaagtgcagtggtgcgatctcggcccactgcaagctccgcctcccaggttcacgccattctcctgcctcagcctcccaagtagctgggactgcaggtgccctccaccacgcctgactaatttttttttgtatttttagtagagatggggtttcaccgtgttagccaggatgatctcggtctcctgacctcgtgatctgcctgcctcggcctcccaaagtgctgggattacaggcatgagccaccgcgcctggcccttaatgaactctttaaatgctgaaaacacctcgtggatattattcttttctgcccccatccatctaggtaagaaacaatggaatggatggagctacatttattatgctgtagcccggtagaaggcacagtcagctctggttttggatagccaagtttttttctttcttttttttttcttttctggtacaatggtcattcagcttactaggcagagaagtgcctgcactgggacacgccaagctatatcccagacaagtgaatgactggacttataaaaaacgctccttatacaaatgtctgacaatcacagggtctcttcatttcctgctccaatgagtttggctctggttttaagttggctacaaggaggtgctttgatctcaccttgaacatgcttattttcagtgtctggctctttctgggcaccacggatgtacaatataaaaatgtgtttggctggccgggtgcggtggctcactccggtaatcccagcactttgggaggcctaggcaggtggatcatgaggtcagaatttcgagaccatcctggccaacatggtgaaaccccatctctactaaaaatacaaaaattagccaggcatggcggtgtgcacctgtagtcccagctacctgggaggctgaggcaggagaattgcttgaacccgggaggcggaggctgcagtgagctgagatagtgccactacactccggcctgggcagcagagcaagactctgtgaaaaaaaaaaaaaaaatacgtttggctgcaagtaacagagagcccagccctcactggtctcagaccacagaaactggcttttctcactgaataagaggcatctgctctggtggttctgctcactcatcttggggtctccatggctcttttggcctcatcccttgtgcttgcaccacggtcataccatcatcctttctccgtgagcgtggcaaccgtgtgcaagacaagaggactgggtagagccaccacccagctcatctgctcttcttgccaaaaaagcaaacactttcttggaccacccctccctcttggcaggattccattagcatcttattcaccaaaattgtgtactcagccacacctagatgaaagtgaggctgtgaaaaacgtgtattttgcttctccagcccctacagtagaggaagcacagcagagagaggtgacagtgctggaggtggtgtttgctctagaattagccacccagtagctatagccacccaaaaggaaggaaagtctgagatgtacagatttgaaggggttaggattttgctgctgcgtctcaatgcttatcagctacacaatgctaagagcctgcatgaaacctcgcggaggaaaaaaaaatagttaaatatttaaatgatttgccgacatggggaacttgccattggcagcaaagatttattaagcaggctgcaaaacaagatgtcgttaaacagtttgaaggcacgccctcataattaagaaaggagaagttttctaatttgggtaatgaaatctgtggctcagatgaacatttattttattaatatttatcgtgtgcctactgtgtgccaggcacctcatgaactaatcccattaaacaacagaaaagtttccctaatgccaaatctactggtaataatagctgccattagttggacaccgacatgctaccaagcaatgtgctaagcattttacctaacagtttatcctcacaggaattctaagaagtaggtataattgctgtcaatttatacatagagtgaggaaccaccccaagtttgtccggactgaggcatttcccaggacacaggactttaagtgttaagccagagacgtctcaggcaaagtactgggaaatgaacaaagtgaggctgagtgcgggtaaatgaccaatccagggtcacagaatcggcaggtgacgctcctggaatgcaacgcaatgccacctgttacctgctcctcccaggctgcaacttgattcccaaacctccccttgaacccagaacactgaccacttcccttccctgccacttccatcccaccatctgctcttccaagtacaaaagagctgacccaaacccaaaagagctgaccctctctctgagctatagagctgtcaagaaaaatcctggtccccattggatgggcttgggtggtctttcaggggcaacagcactgcatcatagcagctgtttcgacccttcaccacagaggcctgcatgctccctccagccccttctccaggccattagaacttaattgcctgcagactgtttctcagccctggtcgcacattagtgtcacctggggagcttttgcaacatactgaagccagcaccatccatagcagaatctgtaagagtgggcctggatgtagggctttttttctaactttttaaaaaattcaggttatcttttctgcagccaagttcataaatattagtaaagttcaatggattttacataggttcacacccatttaaccacccgccagatcaaaatatgaactatttccagcccttgggaaattccattatggccacggatatggttttaaacccccagaggtgattctaatgtgatctgggcggctctaaaccagtagaatgaccctggataggtcctttaccccaactcagactcaatcagattggaacgctactggtttagagcccagatcctctgtagccagagaggatgcatttttccaaagatggcagtggctacaaattcctctctcactggacagagaagggagaaaaaaataatcctcagtagtgcatcccgctgtgtttatttgcacatattcttctcccacgacatagtgaacatcttgaaggcagaaactgcatctttccgagagcctgacaaagggcgtttgcatagtaaatatttatcaaatggagaaaaataaagaagaaatagacatgtgtactggggagtcatgtttggtctccagttaggttcctcaagtttctctgagaagacagacagagagcagcattcagtcctttttgcagtctctgctttctttctttgacctcaaaagggcgagttcaggaaaatgttgattctgggtcttgttcttctgtagagttcacacgcggtctgtgcataggtgacaccagtgacttgtagtgtaatcctgccgtgttgaaagctgatgtcaactgctaaatgggggaaagcagggcgtctcgatggtgatgtgtatgtatgtacacgtgcagccggaaaataagcaaaggactcaggaaatggatgttgtaccagcaaaaggccaccgacacttaggaatgatccatgtcgaatgcacgttgagctgccctgggtcaccgggggaggcatttcttttttaatgtataaaacttacaagtttgaaaaatacgtatttagcctggagggcagttaaaaagactttattgtgtcagcatccccagatcatttatacatttttgtgcccacatattttattcataatgtctattttattcttctttattttgtcaacttggtgttcgacattactgtttctcttagaaaacaaccccgttatcggaaccaggccacatgactgtggataaaggcgagagcattgtcgggcaaggttaaaaatcagcacggtgttaagcacctgggagggcttcatggtttgggcttgagtttattgttatatggttcctgaggccttgcatcggggcagcagttggggaagagggctgcggttttaacaatgacagagaactcagggggcaaaagactgaaggccattcaggttcttcacatgaagggaggaccaaggtttgttcgccaacaggcaagacagagcagagtgctcacatcacaccacccccgaaaatggcaaatagagcaagatacaaatcactggcttctcaggaattatctggacagcccaagaggtcttgggaaatgactgccatgagctgagggctcaaaaccttatatttattcaaagaacgactgccctgttgctgtcaggtcacacagattgttgggctacttcaagaagtgtttcttctgaaatcaggttctgggctgaagatgtgagaattttaggatattagctcttgtttctgccctcccaccccacttctataccaaagcatgcaaagcctttcactgaatgcaatgaaaaaagaatttatcaaaaaggaagagaagcaaagagaaaggagaaagaaaagaaagagaagaggaaaagaaaggaaggaaaggaagataaaaggaagaaagagaagaaaccactgtacattagacaagtgttaatgggagagttcaggagaaggagttttacaaataagaagaagacattttattctccagggcaacaagcatgatgtgtatttccagtatatgtcatgtacatctcccaaattagcatgctaccaatggagtgatatcaccatattaatattgctgcttcttcaactgtgtcagcctggcttttgcaacacacgtctgtcagccatgagatgttggatctcagtgcatctaaccttcctgtcattcaaagtcatttgaaagtggaaagagtaggaacccttctgacttggaagggcatttgcagaccttcctttagtgtgctctgtgtaacatgaatcccaaaaccgaggaaacaaaagcaaggagggctcatgatcaaatgagtatggataatgcttttaactccatctcgttattggacattcccagtggaagtgagcaaatgaatagctctgaaagccactgaaataaagaaaattgttgagcatctaacatagtacctcccaactctctctgaccatggaatgttttttctccacctggaattcttttaaacaagtattctaaagaacatgctttgaaataaaagcaagagcccaggagacaggagacctgactaaagactaaattgcctttgcaggtcagctagtccaacgtttcattttagagataagaaaatgaagaaacagaagttgtatggtcagtggagggtcacagaggcagaattagaaccaaatgacccagaacaaatgcatttacctctgtgggcctcagtttccctgtccctattggactagatcagaggatatcaactagtaggccttgaaacagtcttagatgtgtcacctaattctgaataatgcgtgtatttgtagtctgctgctgtgaaactaattaccccaaacttaatggctttaaacaacatgtttattatttcacagtttctgtgcataaggagtccaggcaccagttaggtgagccctctgcatcaggatttcacaagattgcaatccaggctttggccagggctgcagtctcatcagaggtttgactggggaaagacccacttccaagctctcacacatcgatggtaaaattcatttcctttcagctctaggattgagggctctggtttcttgctggctgttgactgatggctaccttcaactcctagaggccatctagtattagacctccaccatgtgggattccccaacatgaccatttacctcatcaaagccagcaagggagaaagagtctctttcaagatggaggtcaccatccagtgcattataattatgaaagtgacatcccataaccttgccgtattctattggttaaaagcaagttacaagtcccacacacactcaaggagaagggactacacaagaaaaacatgcacatcaagaaatggggattataggaccactgtaagagcctggctgccaaaatgtgcaaaatttatttttgctgaaaatgagtataccattacagagatatttggtggggtagaccattgtgctgagatgatcatctgatgtgctgtaaagcaaggtataccttgcaataagctaaaagtaagaattatagcacagagcagaattgcatctcacaaggtgtaaacttctaaaagcagctcataagaggaaaattgcctatagtcaaaattaccattaaaaatcttttaagccattcataaagtacagtgcacttattttgtgtattactacattgtacattaccttgaactgtaattcttatgcagctgaagtttaaaaattattcagccagactgaaggcatgtctatacccagaatctgggcattcaaaccatcctgcctcaatataaacttctaacagtaaagcaaatatggatgaagaatattaaagcatctagcctccagagattatttcattctgttttaaaagtatgcttcagaaaccttataacatgctaataggtttgtttggttggtgagagttaaacaagataaaacacatgaaacaaatcagccctcagcctggcacacacagtgggcagtgaatttttgcagactgtgaacgtgcatcttgatcagacactcagacacacgtacactgccttttgaagagctgcagaaaacaacttggccacatgtgtcctgcttgtccaagatggcattttcctctgtagtttcccagcagtttccactctcatgagcactgtgcccatcttcatgaggagaagattctatagtcaatgccttatttgaatgagcaaacaggacatcttacctgtagtcaggcatggtggctcacacctgtaatcccaacactttgggaggcggaggtgggatgatcacttaaacccaagagtttgagaccagccttggaaacatagggagatattgtctctacaaaaaataaaagattagctgggtatggtggcacatgcctgtagtcctagctactcatgaggctgaggtgggaggatcatttgagcccaggaagttgaggctgcagtgaactatgatcctgccactgcactctagcctgggtgacagagggagatcctggctcagaaaaataaaaatttttttaaaaaaaatcttacctgtaatgatgcaactgcactcacatgacaagcctacagtaagggaagatgcggcggagtgcaataaatatgtctcatagatatataagcacataaggacagggcagtagagcatcctacttagcagggtagcgcagtcaccctgaactcttttacaaatatcaagagacgtggagacattgtaacggaggctgcctggtaactaatcgctaacttgttcagtttgggtgaaatctgccaccagcatgtctgtcttttgacgatatgtcacacacacaccaaaagggtgcaaaaccctgaatggcagtgattgttcccttatctttccttccctaaaaagaattagggttctaagtctggtgtcaaaaattcaaaagcgacaggagccaggcaggtaatgtatatgagaagaggagacaatagagagggaaatggagtaggtgaaatggcaccagtcgctctatctctctaaaagaattcaaatttggagatttttccaagcaccgcgtgggtgagacataacaggcttacagctggattcagccaatgagcacgctgttccgagttcttaattaagggcctgcaggtggcaaggtctgtttatattgtccccaaaatcctagattttaaaaaaggaaaatatgatgaccctgtgtggaaacaaaatagtagattttttgttgatctgaccacactgaattattagagatttggggtgataccacattcattcttgaacttgtagccaaacacctctgagcaaggctaggaggagataagatttttattttcattttctttccatgaaggactgtctctcagcaactctcactactgttatcccatctggttgtaagtgaaatacagatttggaatatcatttttatctgcacatatttaaaatgtaatgtccaaatattatgctgtttgaaaagagacacctgtccaaaaaattcccgggaaggtttcagagagtgcacttaagctcagatttagacacaagtaaagctcatttttcatttagcagaaaccttcagactagccaagacttggaatacatgctgaacattttgcaaatacagcaatgcctcatttatttgacgtggactgttccatgtaaatgcattttccacataactgaagcttatcccattgcacatcaaatcatacatttattttagccattttgcatgggaatatttctgagagtgcattacacacttccctacctccttaaatagaatatgagaaacataatttaatctttgctatctgactcagggtcatagtcatgaatatcaagtattgggctgctttaggctgaaataaagggatgccctggggtccctacagcataaaaggagttgtttgacttcactttgcaggagctgaggtttccacacttttgagagtgtgcctgccagctctccatctcatccttcagtgctctcattatacctaaaagtccttttgttccaaacctctttaaatttgtctcgtctatggaataggaaggtaaagtgaagtgccttacttggctgaccagaaaccctgggttattttcccatttttaatacattcttgtactttgttaacctgcacaagctacttgaccctcttggcctctgttccacaatctagaagtgagagaattaaacacattgtctaaaatccaccgaatctgcttccatttgcataattttatgtgatctttggctctgaaatgaacaaacttgttaaaattgtgcttaaacatagagatcgtgggtcccaagtgagcacttcaacatccctgttagaagcagaattcactggctgtgtattaccttatttgtttattggttccattatattctacattgttgaagctgtcaaagaagtgaccactcgataaattgaaatacgatgctggccaggcacggaggcactttgggaggctgaggtgggcagatcacttgaggtcaggagttcaaaaccagcccggccaacatggtgaaaccccatctctactaaaaatacaaaaatcagtcagatgtggtgatgggtgcctatagtcccaactacttgggaggctgaaacaagagaatcgcttgaacctgggaggcggtggttgcagtgagccaagatcacaccactgcgctccagcctgggcaacagagcaagactctgtctcaaaaaaaaaaaaaagaaagaaagaaatatgatgcagtttcagttatctattgctgtgtaactaatcgaccccaaacctagcagcttcaagcagcaaaggtttgttatttctttgatttctttcattctgtgggtcaggaattcaggcaacattctgaaacagcttggtggggcatgatctggagaagcttccttaatttcatccacctgcaaatgggctgaactaggaggtcaaagaagtcctcagccacatacctggtgctccatgctcctccacctgattgctctccttccaatctccttacgaacagtcttatttcataatgtagtcctagctttttttttttttttttttgagacagagtctcactgtctcccaggctgaagtgtagtggcatgatctcagttcattgccaccttcccctcccgggttcaagttattctcctgcctcagcctctcaagcagcagggattacaggtgcctgccaccacgcctggctaatttttgtatttttagtagaaacagggtctcgccatgttggccaggctggtcttgaactcctgacctcaagtgatcagcctgcctcagcctcccaaagtcctgggattacaggcgtgagccaccacacccggcctagttctagcttttttgcaacatgaaggcaggcttccccaagggaaagcaaaagctgctaagcctttaaaggatatacaagaattgacacaatattacctctgccatgttttattggtcaagtcacaactcaaggagattcaaaaaaaggagatgcagaccctacttcttgatgggtgcagttccacgcatgtgtatgaagaagaggaattagtagctgccatctttggaaatcgctacactcttaagacatcttcacattatactttagaagactaaaggttttctttcaacatcaaaactattaattagttttgatgtgtgtgcctaatcattttcttaagtagtgtagatttggtaaataacacttttcctctgggaaaggaataaaaagacaatccacacttttaattggatccttctcttgaagtgaattccaagtctgtattttctcttgtaaacatacagcaaactttccacgttttgatcctgtacttcatgaatcaaagtgaaatcttgggaaagaaaacattacctctttctgaactttgtgtataggcgtgcttgcctttggttgttgtcaaaattctttgaaagtgtttgcccaacaaaccaaattaaataactgcgatattctatgtgctctcttgtcaaaggaagataggttcctttctcctttaggtttttgtggattcccgttttttgtttgccctgttgttcatttgttcagttacttatgcagattgtctcagcatattctatgtgccaggtttttaaaacaggcagtgaacaagatagacatcacggcgctctcatggagctgatgttctagcatggaaaacagataataaataaataactaatccattataattgcaacgaatgctatgaaggaaaagcagaaagggtagaagctagattttaggggcctacgttggtatgagaaatacacagaggcctcctagaggacgtgatgtttcagctgagctctggaggtgggtgggtgttccataggtgaaagaaccatggaaaaaggagccgaggaggacattccaagcagagggaagaacacataataagaccccttggaagggaatggaagctagtgggttcaaggaagtgataaaatccagtaacagaagccaggatgaagatgtgtgtgatatttaaactaaagtagccatttaaaagttgtgcaaactaaggcatagtactcaaactctttgagtcttggggtaaggaagagaaaggaaaatgatgtcaaccctcagtcatccccactcacaaagaggcacaaacggaaatctcactcatcacttggttcattgttgttgagcttgtaaatgtattgataacttctcctaagtgccaggcattgtattacatgctgggagcacaaagatgaataataacaataggttcacagaaaagatgaattgattgagagaaaaagaaccctccaggagccctcagcgtagtagggggttggtgttggagggtggaggaatggaaaaggccctgaaatgcaggcagagaaatgatgaaacaattcaggggctgtggtgaggttaaatgaatatctttacagcagcctcgaagactgatcaggttactataccctctcttctgtccacgtgcatttcaaaatagtattttatgtttaaaaatgacaaaaaaaaaaaaggatgtacactggaaataaaagaactttctaggttttttgtgaaatatgtaattttgggtaagttcatcaaagctgaactcattttgttactcatttacttatttatgtagagattttgggtgagtcatgctctcactgcaaagttaagtagttgctacaggacccgtatcacccacaaggctgacactatttactatctggcactttgcagaaaaaggttgccaatccctgcttttttggtgcattcatccttttcataaggagaaattgctccaggtaaaagtcatcacaataaatggtttcttttatttttttttaataacaccctgtttcaatgagctgcctacaatcccaccattaatgcttcagtgttttggcttaatgctggcttcaagtagttcttttcaagaagcaaatacccctgagagcagtagctcattatttagctaataacagtgtgagaaagcagtgtggtgtttagcaaaaggcagtggtccaaggaaaaggccaccaatattcccaaatgcaacaatgtctagttttccagtctgatttcccagagtgaaagaagctcgtgtagtccaggccacaggaccaaaaggctcctgccaggctgaactccctagtcttgggcaaaatatgctggggacttacttatcctatttgctggatcccaaagaatcaaagataaggattagaatggttgagttcacacagagaattgttgattatgttttatccttttaaatatgtgtaagtcatagaaagctctgcagtcaaaaatattgattgcattgatctctgccaaccacagaagcatggggctcatgtgggctgcagtggaaaggctgtgaaatacttaaaataaagacgttatctgatggaagatgctttcctcctcctctcccccaccccagaagcaagtttgaactgaaaatgcacaaatgccagtcagcaaaaggaaaaagtacttttgcagctccatttaaacatcagcatgcaggcctcgagtccagcagcacgttccagggcagcaagaatacaaatttctgcagcatgcatggattttacaagaagagtgtcggcgtgaattgtattacaaggcctgatgagcaatgttggttttcttacagagagcagcccctttatcattcaaaggacattgccgatcaaaaaccctctttttgcacacacagcccatgttctggagcaaagtatttacgcatcattcccttactcggttaatcagccctctgttctgcagggtggagtccctactttgggtcagcccctgtgctgaatgttggcaacaatgtctatggcctcaacaagtctgtgaggaaagatggacatcaatttgaaggttctttggtggcaaaaattttcatcttgttggtcattctaagagcacaaggccagacatgtagtaggggttcagccagtatgtgttaaacaaatgactagatgaacaggtcgaatgtaatacaaggaagagaaaataagcttggatcagaaaaataaacaactaacagccagggaggctgggaagcctccagagaccaggtgagatttgatgtgggccttgaagaatgcctaaaagttcaggaggtagagagagaaaagggcatcttagaaagatccttctggtaggagagggcaaaggatgggttttcccaacccctttctggaaacaggcactttataaatcaatacagctaaggctccccataaatgcacccaaaccttccagaattccacgcggaaacactccccaaaggcattcagaatgcaccagagcttcatcctgctgccttttgcatgatttctcagggcctggcaattaagacaattgtttcatcttgtgtgatgatgtgaagaggatccaaggagtggcagcatatcactcccaaactagcttaggacagggcaagcaggtacagcacaaatgttgcacagaattttccaggtggagggacagaggaagatagaaaaagttggcatcgtgggcaggaacacaatgtagcttccctgggagaagaagggacagttgctaggctcaattctgctcagcctttactgaaccccaccaggctgggcaccatgcttggcaaagggcataaaacaaggaagtcagcagagggggcagcttggtacagttagtgagaacataggctttggaggtaaatattctgtatcaacccattttcatactgctttgaagaaatacccaagactggataatttataaagaaaaagaggtttaatggactcacagttccacatggctggaaaggcctcaaaatcatggagaaaggcaaaggaggagcaaaggcacatcttacatggcagcaggcaagagagagtgtgcaggaaactgccctttataaaaccttcagatctcatgagacttactcactaccatgagaatagcacgggcaaggctctcccccatgatttaattacctctcaccaggtccctcccatgacatgtgcaaattatgggagctacaattcaagatgagatttgggtggggacacggccaaaccatatcatatgcattcactcatttcgttcagctaatatttattgatcacctgttatgctgtaggcactgagtacagttgtaaaaaagccaagtataagtgctgctcttgtagaatttatgttccaggagagaaatgcaataaatattagtgcttactacaggccaggcattatctccagtactttgtatatgcattaaatgttactcacaagaaacctttaagttactatgacactcccattttacagatgaggaaactgagtttcagagagtttaaacaagagttagaacacagatacaaggattggccttcagagtctggccgttaaccactaggttgtcccatcacaggacagagagtggacagggtttgggaaagggacagaatgacccaggaagccccctctgagcagtgacatttgggctgtacccaaatgagaaagagccagccatggctagagtttcatgacaaggctgagagtggaatggagcaaagcagaggggacggctgtccggatctcatgtgggctctgtcacttactgcttcatgcacttaagctatttaacttctctgagtctcagtttagtcatctaaaaaatggggacaaaatctttaagagaatgaatgcaatgcactcacccaaagcctagagcggagcaagcactcaacacatgtggccattattcctgttaacaggacaattgcttctctgcagaatgtcacagctgagagagagactgattattactctacagtgtggctagataccaaatgtttctcatttcccggactcactgacattctgggtgtggtgcacttctagcatttgctttcccttcttcatgagaaagcccaatcaccctttctgggccatcaacctaaacctcaatggccaagcatctttctgagcctatgcactaccatcatcatcactgccaacactgccatcatcatcattatcatcgttacggtcattatcttcattgtgaacctcagcaaagcacgtactgtgtgccaggctttgtcctgagtgcttgacccttgttctcattcactcatcatagtggcttctaaggttggtgtattattttccctgttttttcaaatgaggaaactgaggcatagggaggttgagtaacttgcccacagtcacacagctaggaggtgcatctgaactgaggcagtctggatctgctggtcctgtctagaaacactatgtttcccatcttcaggatttttgcctctgggcaatattttcctgccactatttgcatcagttcttttcattgcctcaattcacacttttacttaaatgaacactttgtaaaaccacatcctagatgaaaatcagtcatatttgtcattaaaaagggagcactataacaatgaaaatgcaataacaagaaaactgtagcatcaaaatcctttctagaagtgttgctggtagaaggctcagagcccacggccagctctttctttgcagaaaggggagataacaagtgttagggggtgttaaaaacacatcagcacaaagctcaccctttgactcaacagaaaaaataaaaaagaattaaaaaaggaattgtcctactcaactacctgtcttcctccagcattccctcccactttgggagagactgaagtagaaggggtttggggcctgtggtcgggggacatgtctgtaacaagctgtgtgtgcttaagcaagaccttgtgcctcctctgagtgatgaagacatcgttccagtttagggtcatcatcatcaagaagcaattagctggccagtgcccatgtacgataaacttttctctagacaaattagaaacataagtcccagtagaaatgagatttccataaagttacttttagtgaatttaatagactctttcttggtctgaaattcacccaacaacatgcattccacaatttttgtggagcaaccacaatacaccatcactctagggcgcaacaggttttcaataatgaaattgttccttcttactttagaaaaatgaaaatatcctccatttttattacacaatgttcatagtaattcatctttcttcttttgtgtgtccatctttagcaaaattaaagtttggtcccttatatcattccttcatattttttttctggaaatttcgctggtctgtctcttatatccccaaatctgagaactcctggactaagtgggtccctctgggctcaagtatgttggcatccatttgtgtgatgctttatagaaattccttgtcaggtgcggtggctcacgcctgtaatcccagcactttgggcagccgaagcaggcggatcacgaggtcaggagttcaagaccagcctagccaacatagtgaaaccccatctctactaaaaatacaaaaattagccaggcatggtggcacatgcctgtaatcccagctacttgggaggctgaggcaggagaatcacttgaacccgggaggcggaggttgtggtgagcagagatcataccactgcactccagcctgggcaacagggcgagactccatctcaaaaaaaaaaaaaaaaagaaagacattcctaagccagcagatgacaaattgagtgaagggaggtggagacaccaagcaaattgaagtctgatgcctcatctaaaggagtggctgcttctcacctctggggaattgttgtcatggacagtgtggacccggtgatgcctgatctcatgtggtctcaagagaaggcacaagcctgattttcatggggagtccctgtgagctggatctggtggatgtgccacaagagggccgccatcccctgctttttttcattaactggcttaagtcatgtcacagagacaggtggtaaaaggaggcagcagggatgtcatggagaaagcttggactttgggccggtggatctcagcaccttgccattcatagctgggtgaccttgggcagaaaggacaacctctctgggactctattttcctatctgtaaatcagagatttttattctacttcctcaattttattcgagatcagaaataacatctagtgttacaaggcagaggacagtgattttattttgtaagtaaaagacttgagtctgagccaggcacctgtaatcctagcactttgggacgccaaggcgggtggatcacttgaggtcaagagttcaagaccagcctggccaacagggcaaaaccccatctctaccaaaaatagaaaaattagctaggcgtggtggcaggcgcctgtaatcccagctactcaggaggctgaagcaggagaattgcttgaactcaagaggtggaggttgcaatgagccaagatggcaccaccacattccagcctgggcaacagagcaagaccctgtctcaaaaaaaaaaaagaaaaaaaaaacatgactttagtcccgctcttctgttctcattccccatgatcatttctgggtgccactggctgacctttttctagctttctgcctcctcttgagccagtgacaaagcccctgaccagtgactatccaaggctttccaagcccaagctgccactggggagggccctgatgcaaatgcagggagctgggccttgtgtttctaggcctggctcctcttgagcccagaattcagtataaagccatcttcttggcaagaaggcaaacacccacgtaaaacgctagcctacaggaaatcatgactgcctcctgcccaccacggaagtaaaacatcaccctgttctcttcctggagcctctgtgtttggtgctcatggaaaccagtatctttggggctgtgagtgaataagctcaactcttagcagatttgcctccagggtgggttgtagaagaaggtaaccagccttcccagtttatctgggactaagggacttactgagatgccagacttttctgtttaaagccacaaaagtcccaagcaaatgggacaagtcggtcaccctgctccagatcttgatatggaaaaagcatgttggcctgggagaagattctttccagctctaaaatgtcagtgctgtgagtccaggtgtgttcttggaccccaagccactccttggggctgaggcacctatctgagctgctaagccagtgcctgagagccagaggctggcacacatctgccaaaacagacagtactccgggtgactcttataaaatgaccttccttggttcacaaggtgacatcgatttgctatcttggcttgagtctctaccttctaccgtgtgaagtctgtagaaagtgccctggaaatacttgtttgatgaatgaatgaatgaatgatgtagttaaagtttaaagttttaatggaaaaagaaataggtgaataaataaataagtgaaaggatgacttggtttcagttctaaggattctttcttcccatcaaagccacccgttttcattgccttggagggcttttttttttttttttttttttttttttttttgacagagtcatgctctgtcatccaggctggagtgctgtggtgcaatctctggtcactgcaacctccgactcccaggttcaagcgattatcttgcctcaccctcctgagtagctgggattacaggcgcacaccaccacacccagctaatttttttgtctttttagtagagacaggttttcaccatgttggccaggctggtctcaaactcctaaccttaggtgatccacccgccccggcctcccaaagtgctgggattataggcctgagccaccatgcccgggctcctcggagggctttattacatcctcttgatcacatcatttaagaccaactgacttggagtaaatcctgggctacaggggcagacgggtagggcaagtcctggctcttgtggtccctcctgacctctctggacgccctgttcatctgtacacagagctgcaggggaacttcccagtctccttcactaacatgcgacggccatccctcaaactgggctcctgtcactcccttccacagcaaacattttctttttagctccggcgtttttgagagaatgcctccactcacaggaatggttccagtggcgggatgctcgggtcctaagatagagatatatgagtgaggtttttgtgtctcggaatcatcagagagcaggcagccatctccactgggcacagcactcatggtccaacagcaggcgggtccagtgtagaagccctaggtaggatgagggagaaggaggcagtttccttttctactttttgtttttggttttgttttgttttgctttgttttttgagacaaggtgttactctatcacccaggctggagtacagtgatgcaataggagctcactgcaggctcaaactcctgggctcaagcaatcctcccaactcagcctccccagtagcagggagcacaggtatgcatcactatgtctaactctttggtattttttgcagagatggggtttcaccgtgttgcttaggctggtctcgaactcttgagctcaagtgatccacccacctcagcctcccaaagtgctggacagattccttttcatcctcaaagcctctgatcacatcacctcctccgtgaagaccttgctgacctcaggaagagctagtagctctttctcctgtaatcctgtggcactttgcccatctgctatgattttgatgcattacaaaatgtattgcccctactattctcctctattagatcaagagcacccgggatcaggaattgtgtgcccaggcttcaaccctgtgtcgggacagccagttttgtgctcaacaaaattggctagttatatttgtaagctaacaaatagccaaagtaataataaacagagtgacaacagtcaatgcaggtctagccaccgccaaatgcatgaatctggcagaattcctgaggcctaattatcagggaaaagacttggcaagtggcatggaataatccagaagcagtgtttggtcttggttaaactgtcttacgaacacagggactgtgaaaatggagatccatgtttttccaccagaagcattttatttttctatgtttttcttggttttttgattcttatgttgtcatttccctgagttgagatctccagcagttcctgaattttcttggagcactgctctgtgcaatttcacctgacctccttacatctctgaggggagggcttgatttaactagggtattgatttaacagggactttccctgaaaatctagatctaaaaagtcatcatcttaatcattagtaaagaggaaggtggagaggcagtgatgggttgagagccctggggaagaagctgcatgtgtggacattgaagcaggcctgggagagcagctggccgttgcgtgtggacaccactgccttccagtgaaacacagggcagttcagctcagggagagtcactcctcccctgggcgggacttcagtgatgggccaggagtgtccacacctgggttcctgccatgaactgccttctagaagctctccttaaggtctacacatcgtataatggaggcaagttgctgcatgagggggaactgctttgtttgttgtttgtttgtttgtttgtttgtttttaactgtgtgaagtttttgtaccaatggaaataggaggaagtaaagcaaattaaggccctcccggctactttagtatcttttttttgttttgttttgttttttgagatggagtctcacactgtctcccgggctggagtgcagtggcacgatctcggctcactgcaaactccgcctcccaggttcaagcgattctcctgccccagcctcccaagtagctgggattacaggcatctgccaccacgcccagctaattttttgtatttttagttgagacaggattttaccatgttggctaggctggtatcaaacttctgacctcgtgattcccccctcctcagcctcccaaagtgctgggactacaggcctgagccaccgcgccccacccaaccttggtatcttaaagcaagtgtcttacacctgcaccacccctgctgcctctttctcggctttatgctttgagaatgggagagaggactgtgcttgtcacaagagaatgcattgctaatggtggaattttagatattagaggaacaatgacttttgtcggatttgtccccatccattcacatcagcaaatattccatgattgcctgtgatatgtctaagcaaaggaacttggagtgctgagcaaaggaagacaagacagggacttctatcctggttgagttgcactattaatagataagacatctcaggccatagatagttaagatctcagtatttacaaacttatcacttgtaatttagtctattcctcagcaacgcccatgatagaggtgcagtaacttatcttttagctgtacatgaatttgatttgagctgcaatattaatgggaaggggtgattcaattggtcactaagcgcctctagaaagcccccccggcaaccacctcccaataaggctttgcctccctccatgcatcactgtgtgcgccatcatgctgatgatgtggtataactgtttggtagtggagatgtgccatcgttggaggaggaaatattattagtaagagctgaaatatcttattgcagaaaggtatttataggaaatgtgtgactcttgaagaaagtaagaattaggagaaacccaggagcctatatcagcaaacctctgttcacaattttagtaatctgggaaaatcttacactacctgccttgcaaactggcgaaaattagcaggtctacaattatgatgatcggattctccgagatgaaaattaggtcccgtgatacataagttcagatgtccctggaaagatccaaggaggaaatatttgaaatagagcttgttctggaaaatatttgaaattgagaaggttgtggaaaccgtacatgcagcactgtgcatgcagcaggatgtgtataaagtctgatgaggacatagatgagagtgcttgtgagcccacattctcaaaccacaccaagtacacagcccctgatagcgagaccaagcttgaccatccacatttgttcattctgttgggtagaatttatcaaaccagaacatacaggtcacaagttgttccttcaatcaaggaagatcccctcgtcatctggacactagctgtgggatgtcaaagagttctcaggcccctgagtaactaatgacgtacagccattaactctattatttactagaaatgacagatgcgtggtggcgggtgcctgtagtcccagctactcgggaggctgaggcaggagaatggcatgaacccgggaggcgtagattgcagtgagccaaaatggcgccattgcactccagcttgggcgacagagcaagacgtctcaaaaaaagaaaaaagaaatgacaaatgcattggtccaaaacctacagtgcttcctggaagaccttccaagtgatgtaacaagggttatcttccagagatgcgatattagtcctgtgattgcctgtttactcattcattgatacaataaatattgaccgagtgcttgctatgtgacaagcactgagctagggctgggaaatcatcagtgaatagtcagagaaagtccttgtttgcaagagcatagactctagttcgaggagagaaaatgaacaagaccacttcagggtacgataagagctttgaaggcatcaaaacaggctagggagcctgggtggaaactagtgtaaagaggatgacaaggaagtcctgaccaatgtgagacctgtgcagtgaggagtcagccacacggagagcagcaagggccagcagcccaaggcgagagtgcactttgcatttgaggaacagaaaggtttcgtgactgcagacttgtgaatttggaagcaagtgggaagaggccaaccagggcctgacccttggtaaagatatgcaaagtgaagccttgggagtcatttaaagcagggggctgggatgtgtgctggttatacattgagggacgataaacctgacaatggtgctcacccttagagtccaacacactcttccatcatgaccagtaggaggaaatgtgtgccgagattgctaaatttccaagattgcatgtaactcccagcatgcttcatctgtgctgtattttataaaatatctgcataaacagaaatatttgaaatagagcctattctggaaaatactggaaattgagaaggtcgtggaaatcgtacatgcagcactgtgcaagcagcaggatatgtataaatccaactctgtttgtaagtagttggaatctcagcatttacagacttatcatttgtaatttggactctttattcctgagctactcacattatagaggcatagtaatttgtcctctctgcaatgctgatcagaaacagtgatgtgaaccgtccggaacatctgtgcactagccaataaatgattgaatattgataagccattgataattgattattcaacatacagaatcagtagcaaagcattttcttgtctaatttgatgaggaattagcatctttctattctaatcataagagcattaaaaattatattgttcctttttcccagtggttgccaggaagctcatatacgaagtgaatggttaatcacagtagccattctaatttttatcattaagatatttgctttatcctcctttttaagctttttttatttatttccattatatatcaccttaaatctttttgtagctaaaggtggaatatcaatttttttaattgcatgtttaaagccataaccctggcctgcttgatagatactttagaaatgttatatccaccagtggcagggtgtgaatagttaattgaatcagcaattaaatacatcattatagataatttctagaaaatgttaagcttcaggactttagccaagaatgtatcacccaggcaagtaacatttctactagaaaatcaggttctaccataaattcaaggtctgactattgccatcggaagggtttcaagcttaatataaaccaggaatgtttctcatcactcgaatgcatttgccaaagaacttcaacttctgtctcctttcctgttgaactttaaaaaccggagaggcaactgtctgtcgagactgttttgtctagagcagggctggaggcaggaatccagcattataagtttcaattcttggtcctcaactcaaagctttgggaagcaccttcattgtaccctgttaatcacaaaattaacttaaaactaaaagagtctgtcttctctttgcttcctacaaagcaggatgtatgggggcggtgattatacacagaccccaggactgtatttctgtgatctagcatcgaaaaccatttatggctgaatttaactccggaaagccctgctttctcttttcttctgatcctccatatcaatatcagtctgatgactctggcatttactggcacagctgaccgtaaacacactgcagccattaaccagaaatcacccacatgtgggatttggtcataaacatgggccttgcgtctagactaattatatggataatggttgtggggggcgggggagggcgtaaaaagaggaagaatgccaaaatctggaagatattctaggtagttttccgtaacttttctaaaaacaaagaaatcagctaaaaacagcaagcactttattttttaataatataactaataggcatccactggaggaaaagaaagagaaagagagagagagagagacagggaggacagagccaggccaatgttaatttgtatcactaacattttgggacactttaaggtttactacaaaaattctagatcagggttgatacactgaaaccctcaggccaaatccaacccactgcctgttttataaataaagttttattggaacacagccatgtccatttgtttacatgttatctatggctaatttcacgatacaatggcagagttacagagaccatatggtatgcaaagcctaaaatatttctttattatctgcccctttccagaataagtttgccagctcctgatctagacttttttgtctctacatatttatcttttacatagtctttcaactttttttttaaccttttggcttgaaataattatagattcataagaagtgcaaggaaatgtaagaagaagcccagtgcaccctttccgaagcttcccccagtgcttgcataactatagggcaataacaaagccaaagctagttcagatttcaccagttcacctgccatcatttgaggtgatatgtaggctttttaaacataaaaggggtatgaaatacaatgcctttaacgttaagagtgataataatgagaagccttcaattgacagactgaagagaaagaaacgtgaatacggttagtgcagcctgagaatctcctaagagtccgatatgatccaacagtcctaagaaaaccagaactatttcctctgtaccagtagtcactcctaagtcataacagccaggacatttaggtggagattgtatgttttattttctcctaaacttataatcctctctactttccttcttctgcatccccatcatcttgacactaaaaaaagaaaaagaaagacagaaaatgtgtgcatgaaatgtgaccagggaatcaaagatgacagagctttgataaggtccagaaagtctcagcccctccaaagcaagcgattaaagagaaaggtgacgttcggtttattcaaatatgtttatctgacatctgtctgggtttcatctgaagtgtgtaggctccttctggatccttccccacaagagcctggcttcagtatcatacactttgcgtgggatgaagttctcaagcctcaacagctaaggaaatctgccagggtgtctggcaaactgtgtaagagggagaaacaccccagctctgaattcagcctgctgtgaattatattataaccaactggttataatatatggacagagttaccaggtgtctatgcgggatttggatgtactaatgtttgcttgtgttgagtgaggctgggctaatgagcctcggttacaggtgtttgggagaagtatgaatacagttggtagggcatagtgataaagctttgctctgttttgtttttaacaaaggctacttaagaagctggaattataaagcattgtggtctgagaaatttatagggcagcttgaacggaaggtagtaactaaccagggagaagccacggaaagctctgaatcctctcctggacaccagagggtgtgccagaaaagcaggcaaaaaccgaggtgcttggttcttcttccgggacctggtgggggccaggagatttaatgtgagggagcacagccgggccagggggaaccaaaatcctgataccaggtggcaccgccaaccatgcacgacctctgaggggagaggggagagggccaacaggaaagccaggcaggagccagaagaatgaggagcacaaaagagccaggcgtagagaatggacagtaggtgtcagaccctggtgtgtgtgggagaagtgaccaccatggctcaacggaagtcagtccctcagccagatgatgaatattcactgaattcctgctgcattagtcagagtcccctaaggagacagatggcaaactcagattaggaaaagggttatgacaagcagaatgttttcctgggtggagtcggggcatgtgagagaaccacagggacagggcaggaaccccttcctggtggcggcagagctcttgacacctctgggcttgatgggccaaggggaatggatgatgtttggaatctgcaaatagaaagtcatttggagagaagggacagtgactctcggtcaggggttggaacaagcttgagggaagtgtgcagggatggagccaggaggacagagactccatcttcactgccctcctctggggtcccattcactgaatacatctgaagccagagggcaaggaggcctcctgtgcagaaggcagggtggggaagggcagatgaactggagcgcaccccactgaagattctggcatggctaccacatgccaggcactgtgctgagcctgggactcaccctgccgaagcctgaaggcaaaacaaatcatcatgactgagctaaagccatgaagaggccccagtgctctggaatcacctaacaaaaacagctcctagcctagtcttggaggtccagaaagatgcctctaaggcttgggcattagctatggaaagaacaaagaagaatgtcaaaggcaaaggcaacagcatgttcaaaggtcctggggtgcaacacagcatgtttcaagtcagaggggaaaaggcaagaagaatgaaaaagacgatggcagaacacagggcctgatcacacgaggccctgtggctttttaaggaattcacacatgatcctgtgggggatgaggagaacccaaagtattttaaatgcagaatggattttaaagggtttgtgtgtgtatgtgcacatacatgcaggcacgcatgtgtttggagtggtgtgtgaagctgaaagccaaatggaatgacgaggcgaaactggagatgtctaagaagcccgagtgtgctaagctagttcaggctagattcaggaggaatcagcttgtgtaccaactttttccttttcttgtgtagtttgcactgagagatctttagctgcaagatgagaaggcgcagagacctgatgcctattttcaaatcctggcagatgcattataagaaagggggactcaatttgttttgtacagactgttccttcaagaacactggcatgcaaaacctactgcatctggtgccagcccagccactaccacctcttcttttactccttctgacaggccgagatccttccttctttcagctcctgcattaactacactggtgtgtgtgattctctctcccagatcttcctggggctgcctccttctcagaactcagatctcaactcagaaggtatctccctcttctatcccataagctccatgacatcaagcatgtcatttgtcctgctcactcttatattaccctcagtatctagaaaagagacacctatgttgtggattctcattattttgttgattgaacaaatatttatttagagctttgcaaaatctgattaaactacctaggaaatactgagtttcctaaacttggaggtaaagaagtagggacaagttggttagagagagcattgagttataaaagaggctagatcgcagattgaaaacacaattagaggcctttgaagaacaatctattaagcagattttgaagtggagagaaggagatgtcctggttgaatgggagttgggaggcccagagcactcctccagatctctctgccaagcatggtttctttttttttttttttagatggagtctcgctctgtcacccaggctggagtgcagtggcacgatctcagctcactgcaagctccgcctcccgggttcacgccattatcctgcctcagcctcccaagtagctgggactataggcacccaccaccacgcctggctaatttttttgtatttttagtagagacggggtttcaccatgttagccaggatggtctcgatctcctgacctcatgatccacccgccttggcctcccaaagtgctgggattacaggcgtgagccactgcgcccggcctgccaagcgtggtttcaaacccttgagctacatagctcttatgtttccttcctcctaggatgcagcgactgcatctctagcatgggcaggaaggtgactcttgcatctccacttggtaacagacaaaagcctgcatctcaagggccagatcactgggagacaaatctctaggctggagacttcaaaatggcagtctagataattcagaccacagattggtgcacatgatatttgcaatgttctggaattagtggccaaagtctgttgactacatgcagatattcccacacatcagaacatctgttcatcctgggcccacattctctcattcttccatgtattcattcattgtgttgatataatggagagcaaagtagacaccaatgttgccctaaggagcttgtgttctaagggtaagacacagataaaaagtaagtcatggaatgtatcagatagtaagccctgagaaaaataaagagagaaaaaaacaacagctcgtgggagggggttaggggaggtcaagggatacagtgtttcccaggatggttggagagggcctcactgtgaaaggagtcatctgagctaaggtctgaggaggtgaaagtgaaagccacacagacattggggaaggagcattctaagtgggggaacagcaagtgcacaggccctgaggtgggagcatgcctggtatgttctaaatgggggaaccctaagggggtctgcatggctgaagcaggatgggggaggcagggcactgcggtcaaagagaaaatgtggggagtgaagggtccgaccggcaattgcacttccagtgtgcggccaaggggagaagcactgatttggggccttgtagagatagtataaagaacttgccttctactaagtgaaatggattttgaacagaggagtgacgtggatttactttttttttttctaatttaaaaaaaatttttttttgaggcagagtctcgctctgtcgcccaggctggagtgcagtggcgcactgcaacctccgcctcctgggttcaagcgattctcttgcctcagcctcccgagtggctgggactacaggcatgcaccaccacgcctggctaatttttgtatttttagtagagactgggtttcaccatattagccaggctggtctcgaactcctgaccttatgatccaccagcctcggcctctcaaagggctgggattacaggtgtgagccaccacgcccagccagatgtactatttttaaagaatcctgtgttgagaataaactatgagtaggcacgagtatttgcccagaggccagttaggaggctgttgcaataacccaggtgagagacgaccatgccttggaccagtggttctcaaaacggggttcttaagcaagcagcgtcagcatcgcctggacagttttcttaaagcaaactttttggcctcaccagagacctactaaaccagaaactctgaggatggagccagcaacctgtgttcaaatcaagccttgagttggttctgatgcacagtgagatttgagatccaccactgccttggacaaagatggtcatcatggaagtggtgaaagggcttggttctgtatgttttaaaggtagacttggacaatagggaaaggctaaatagactgggtccctaaagacaggatcagacttctccagtttgccactggccccactcagtcctttctgttcctctctggaccctgtaggcatttgtctttgccctctgccccagactcctggatgagagaggtagaaaactcaatggtgggaatcccacaaacttctgttaggaaaattgccttgggtcatttccttttgcatatcggaagaatcatctcaatcattcgtttgcaagtgtgacaagggaaaagtgaaatgtctgtactgaggctttggggaagggtgagaagggtgttgaggaagggaaggaacaaatgagctcatggtttcctttttccaatctggctctcctttcccagagggaatactcagggaacctgctgttacttctcacaagcactagaaaaaaatcacttcccaacctcatctgccaggcggcaaaatcttagctgtgaactgcagttccaaaatgtgactcttattaaacatcgctatcacattaagcccagacagtgacctactctgtcgcctgaaagaatccgcaattaacatggggagtctaatcaggatattaacgagtctggttttgaattcctataatattttcatcagttttttaaaaaactcatttcaacctgcattaagcttggcaagtggattctgtggggtgaaaagcgacaggatttgggaaagcttatattttctcatcaggtaaaatgcaagcatatggaagattcagtttgttttaaaagaaaccttcattaagaaatgaaaggttgagcctgtgaccactttgttacagggtggctgagctgcaggagagaaggtgagggcatcaggaagagaaagtacactgccaagaaaggctgagaaattctaccacgtctcctttccaggactggttatttcatagcttcacgcccagggaaatcacacatgcaaatcggacactccaaaatacacagcagattaaatcaagtcaatatttggtctgtagctagtatattttattaaacctaagaagctgcagattataagatgtgtcattatttaggaccctttccatgaataaaacaaaaagaagaatgccctgaattcattgtaagatctcattgattggaagatgcattctgattttagtgatattaagatgtctgaggatggagcatccaagctggtgggtaagcacagtgaggccaacacacacccatgttctttccacctctttctgctccgtcagccttagcttccatgtcttgttcttgtgtctgtgttacgatggtagatacaacttcatgcctcacgtgcactgtgcaagaggaaggagagtgtaatcagccaggactttaacagagaaggcacaggaccagttgaagatatcttctcgctttctctctatatatatgcatatgtatataatgtattatatatatgaatagatgtgtgcatatacgtatatgtgtgtatacatacacacactcatacattccacacttgagtaaatacatacaagtgcatatgcatatttatataatgtattatatatatgaatagatgtgtgcatatacctatatatgtgtatacatacactcatacattccacacttgagtaaatacatacaagtgtgtatacatatatacagaaagcaagagagagaatgagatttatactgttgtgcagcatggctgggcaaggctgacacctgcagggctggccagcaaggtggaagctcacagataggagctgaacttgtcaatccacaggcagaatgtcttcctcaggaaaagctccgtttgggccttattcaacggattgaattctccctgcatgcattgttgaagataatctcctttgcttaaagtcaatttcttatggactttcatcacatctagaaaacacgttcacagcaacacctagataattactggttgaatactgtgggactgttgccttgccatgttgacacataaaaccaaccatcacaaagggtgccatgatttttttaaaaagtcccttctaacaaggttttgcctttttcattagagaaggacccattctctgtatgtttcattggacggaactgtcacatgaccacccctggttaccacagaggctggagctggagtatgttgttcctcagccactctaggagggatatacccagggatgtcagctgtgagtggatgctgagtgagccaatccataggatcttccatgacctagttactgaacatctaatgagtacaagaggctgaacaaccacgtgtggctcagattcgattcttgttaatcattaccaaagataattaaataacattgactcccaacgtgaaaaactcatttcccttccatgcgtggcagctgaaactgctttttgatgtagagtagggctataaaatgccttttaaagtgtttaagctaaaatggaaaccctgttaaagaaaaatatttagaaagtgccttggtactaattgtacgctagagcagacattgggaaactgtcatgtgagttgcttagtcatgaatcactgattggaatatggttcttcagtgcttcccctggctaaagcacaggctcaaagctatgttgtccatgtccctggccaggcagcatgagacgtgttcatgaggaagttagaaaacctctctgaccctccatctcctcacctgcagagcagggacacaccatagtgtgtccatgaagtcaaacgtggtcctgcaaactctttgcaaggtgctggcctgtcgcaggcattcaccagccatgaggttattgttactattccacctcataatttatctgagcagagagaatgtcttcataattctttccacataaaattgaagggttttagtataaaaagagtgatgggctgggttggaggaggatttaaccctgccaaaccatcatgctctctatctaacgtgggatggtgagaacaatggaaacatcggtgaagcccattcgcctctccaaggagggtctcctatgatgactgcctgggtcctccctactagaaaaagtaacacaattagtattctctcttccaaaaggagtaattcaggcactttatgattaaataacttgtcccaggtcaaacaagtagtaactgcccacactaacttgaaatcgacaaggtgactttgccttctaggggacagttgacaatgcctagagacatggttgatcatgacttggagggctggggtggtactggcatctggcagatagacaccagggaagctgtggaatgtcctacagtgcctgggacagcccaccccctacaagaaaggagcacccagctccaaatgttaagagtactcagctctaaatgtcaggagtactcagctccaaatgtcaggagtactcagctccaaatgtcaggagtactcagctccaaatgtcaggagtactgagggcgagaagtcctgctccagagtccctgtgagcctttcctcacaggttttcatgagggtcagatgaggccagcactgcgtcagcgttctgtaaacctcaggcaggagccaggcatgcattgcagtgatgggaagcactgatgaagccttcttagcaaagcacagacgtgttggccaatgcatacatttaagaaagtgggttccaaattttctctctctgaatcattggcaaataacaacaaatgacaaagaattaagctcagcattgtcaccaaactagccatgtcacacctgtaacagttaaatacctcagtccacaagcttgggtgcagaagaaatctaacattctcttattttcttcacctgaacttaatttatatttccagtccctaatcttagtggcagatacttcatcttagtcaactcaggactccttcctcttccaagagatacagctaataccaggccctatgcagggagtggtgggcacattcaggccagggaaagagggttcattggccaaggtggctgcggaggcctgagttgtccccagcctcaagctctcatagtattttctggtggtcaagggccagggcattactggctgttcctgagccactttgaaccctgaaaggcctcatcatggcgtattctgccctcaaacttgggagacagctccgtccttctcacactggggcacgtgggagctctgtaaggtggccacagccagctacatgattttcagggcccagtaaaaaatgagcattcaggatcccctgttcaaatattaataggaatttcaagatggcaaagtgcatgaagccaagcacaggacgctatgcagttgcacaggtcaaatgcccatgaagctggccctggaatgaccttcaggcccatctgctgagatgctcctctcagccactgtgctgccaatcctcccctcctgcactggagcccaggaaagctgggggactcgctgctctcctgggcactgctggaggaagggatgcaggttattgctactcctaaatccacgcaaaacttttaggatttgtatcatctccccttcctctggaacaccaggcagcatctcacttcccagcccacctgcagctctcatctgccccccaaatcccaatgtgtgtctgctcaggcccagcagggaacacctgtgctttactcatgccttttcctttgtctgagttgtctcaagaatcttgcttttgcaaaaattgcatctgttcaactcaaattccttttctttgatttttggtgtgatcatctctttccagaagcaataaatgccaatgcctggtggggggaagagcagccaatgcaggaatgctaggataaaacaaggtgacttttctttcttttttcttttttttttttttttgagatggagtctcgctctgtcacccaggctggagtgcagtggcacaatctcggctcactgcaaactccgcctcccaagttcacgtcattctcctgcctcagcctccgagtagctgggactacaggcgcccgccaccatgcccagctaattttttgtatattttttagtagagacggggtttcaccgtgttagtcaggatggtctctaactcctgacctcgtgatccgcctgccttggcctcccaaagtgctgggattacaggcgtgagccactgcacctggctgctaaaacaaggtgatttttcaaaaaattattgcacaatgtgcaatgagccctatatcatcatcctttcaaaatattctacacaggttatttccaaagacaaagaaactcagtggggattgcatgggagaaactgtgttgcgcactcctatgaaggatccccatgtagccttcacagtttcacttagattctgtctcttccaggacgtcctctcttatttcacctaacttgggctagttcgtccttctgaagctcctgtaatgtaacagctgtgcctctagccctctctttctctcttctttgtcttgtagacatgagagacagcagtgagtaatgggacaatcaccaagcatgggagagggacaaaggtggggtaggccctgcatctgtgttcgcttggacaagctgcctgagttctccagacatcaactcctcaatctgaaaaaaattgagcgcaattattcctacctgctggcttgttggtggctgtgcttgccattgtcattttaatttttgttattactgttgtataagttttaggtctgctattagatttaggatccttcaggccaagactttattgacctttgtgttcctagcccccttctatgccagcatagaggacagtccctggcacatagtagatgctcaatagtatttgtcggggcagtgagtaaattccctgcctcagtttgcttgtccttgaggaggtagatacaaaatcagaactcacagcttcccttatccacctccgatcgccagccttccagagcatttgctgagctcaccaccagggaacgaatacaacaacattgattgcgatgctgagttgtgccagactctgtgctaaggttggagtgaccaataatcccagtttgcctgagactgagggatttcctgggacataaaattgtcagtcctaaaactgggataatcacagaaggaggaacaggttggccacccttgctaaggcttttcatgcattatctctttctgtcttttttctttatttttttttttaatagagatggggtccttactatgttgaccaggctagtctcgaactgctgacctcaagcaatcctcccatctcagcctcccaaagtgctggaattacaggcttaaaccgccatacccggccgaattatctcttatctattttaaatatgcttcatttcttagaacagttttttatttatgtatgtatagatatatttgctttgtggggcaggggggtgcgggctggggggacagagctgctctgttgcccaggctggagtgcaatgatgtgacctcaactcactgcaacctccacctcccgggttcaagcgattctcctgtctcagcctcccaagtagctgggattacaggcgtgtgccaccacacccagctaatttttgtatttttagtagagaaggggcttcaccacgttgaccagactggtctcgaactcctgagctcagttgatccacccacctcggcctcctaaagttctgggattataggcgtgagcaatcatgcccagccagaacaattttaaatatacagaaaaattgagatgcttgtccaaagagcccccacatgccccacacccagtttcccctatttgtaacaccttacgttagtaccgtaaatttgtcacaacaaatgaaccagcacggatacgttattatgaaccaaaatccatactctattcagatttccttagtgtttccctgcgtcattttcctgctccaggctcacactcggaataccacaacacatctactttccatgtctccttgggctcttgttggcagtaatatcttctcaggcttttttttttttttttttttaatgatgaccttgactgttttaaggcgtactggtcaggtatactgtagtatctcatttaatcctcatataaaccttaaagaatgaacactattgttccattttaccaatggggttgctgacgcttacgtccggtataaccagtaaagggttgaatggtaatttgagtttccactgggggcaatgattccttaataacatcaattcatagtaagtattatcttcagtgcttgttctgtctcaagtaccctgcaaagaagcccgtccctattgtattctttcatcctcataagcacagcactgtagacactcacgtatgcccattttacagataaggaaaccaaggccaagaaaggttaagtctctggctcaagtcatgaaactgatggaagaatgtagaccccaatccagggcctctgcaatctttatgctctgtctttctaggaaatactttctccctattaaagattgacccgtttggaggaatattttctcccttctgctgtggaacatctacagcagggtttctcagacttaactgtacctactcatcacctgaggatcttgttaaaaatgcaggttccgtaggtctgggatgaggcctaagaacccgtatttcttttcttttcttttcttttctttttttttttttttttttttttttttttgagaccaagtctcaccccgtcacccaggctggagtgcagtggcacaatctcagctcactgcaatctccgcctcccgggttcaagcgattctcctgcctcagcctcccaagtagctgggattacaggcgtgtgccaccaagcccagctaatttttgtatttttagtagagatggggtttcactttcctggccaggttggtcttgaactcctgacctcaaatgatctgcccatctcagcctcccaaagtgctgggattacaggcgtgagccaccgcaccgggccaggacccgtatttctaacaagacggcaggtgcggccacactgggagtagcgaggctggacactgactcctacctcacattttcctttctttccggaacaaacacggtaactgctgtgtgggcacacaaggcagtggccagaattctcaggtcacttcctgactctctggagctccaactgtcggcagataaaaagaaatctaggcactgagaaatcccaggcactaacattccggacgaccaattggcaactccaacctctccagcagggtttgtaaagaaaacgtaatgagcccaggtgaggctcattagagccagcctggaattctgccagtgctaccatgagctttatgccaacccttgattttcatatcagtggcagtactgacaaggaagctggaaggcaggctgggaggaagctttgtacccatggagtcctctccctcctccccatccagtagctctcgccacgaggtgaggcagttggcttcatcaaatcagaaccagctcatgagtaattttcactgtcttccctttctaacaggctgggccccaggtgatcctaaaaattaaatgaagctcagaaaatgagacacttaggagagccaggcatgaatagcctatccccggctctagcggaactctttacttcccttgtcaatttccttggacttcctttgggcctttgactagtggcaaagtttcactccagaatctcacagctctggagtatttctgccagagggtcccagtcccctgtgtgttttcttgttctcaagcaaaatttaaaatgggcaatggtagccaatgctgtcttttctccttgtaaattgagatatttatgctgatgcaatattttcagaataggactctaggctgcctccaagcttccaggtacttcccagattccagcaaaaaattcttactaccatcaccctcctcctcctcatcatcatcatcatcatcatccccattatcatcactgtcattactgggaatttattgcatgttaagcaccaggcttgcattttgcttgtattttctcaattaatacaagcattgaggaaggtcatattgttattcccacattaccaaggataaaacaggcttaggtaaaatagcttcccaaggccaccctaccgctgaattgaccatactgtctgcttggccactgaagttgagaccaaagatgtttttcactatgcacatcccccaaagatttttggataaaaactgattgacttacagttctggccaaaagtcaagctgatcattggtttttatatgagagagcgaatgacaaagagagaagaaaagaagagaaaaatcactgaattcacaaaatagtgccctagtggtttataaatgaggggaaaaatggcaccagtgacactgtatttatactaatcactaaaagcaaatgaattccaactgggtatgttaaaaatagatgcatgttgatatgtatatattaacctaatatgagaaaaagtaaccccattgagaaaagttagagataaagtttacaaccttcactttctcccctgcacaatagaacttatgccatgataaaatcccacaacttagtcatttgtttatttaaaatgcatttgttgagcacctcctatgagccaagaagtaaagattgtgtaaaaaaataaaatacgtgggtagatggacaattcaactagcaaatgcaatgcactgtgattgacaagtttgagtgtttgtgttagaattatttgtgtgcaagcaacagaagctgactctggtgaatcctagcaagttcagcatctcatgagaaaaaaagagcatctaacacagacagaagggaagtggtcagggaagcctcctggaggaagtgacatttcagttgagacttgaggaagaggcagaggaacctgtgccaaagtgtggatgtgtgtttttgtggatatggagcagggcagagaggctggttggcaagtgtcctcagcaggggacagcacaggtgagatgacagggaactaggcacagaaaattctctcacaaggcagtcactggaaccacccccaccattgcctgttagacacctggaaatagctcttggtggttgggagaaatggggctaggtgggaaacaacgtcagggaataacacacacagaggacttgtctggtcccccgtcccccagtgtagaccgccataggaaagctatgttgtaagaaatcatagaggaaggagacagcacaaattaaaactcctactatcataagcatctagcaagcattttatgaagctgccttgtgaggaactacttcactctaggaaaaaccctcctggttaccatgactcagagaacgatctgcaaaataattcaccaaattagagtttgccgagtgcacatttgtaaatctgatcccgcctgcccgcccccccattctgttgattatatctttcatccccaagaatgaggccaagagcctcctccctgcccctcctcccctccctctgtaatcctcacccctcatttctctcccctccccacttctcagcatcctgccacccctaaggcggtggcgtgatcacgtgctgatttcagggagttcattaaaaaccaccaccctccccgctgaccacgaggcaccggcagcagcccctggggccatggcgctggcaagagcatgccggtcactcaagaggggccgacccactccgaggacagggacccccttgcacaaatgagaagagccagcaaacagttaatggttgaatcctttgcagaaaaagtcaaggcagacttgtgattcttgatgttaatgaaggtgtcacacattgtctagagaaagttgtgcctggcaatcttccctgtttcggatgcctaccccagtgacatttcatctcacatccaccttaatgaaatgcataattaacatattctaattgtgctgagcgctgcgatgattttgacagaactcactttccatgtctaatttgatgctaatttaatctgttcctctcccgctgacatgacctttcttgattgagtttcactgaggaaattttttgatggattgatttatcagcattgcagagacaacaaaggctcagggtgcacgacagaaaataggaagggaacggccctcgaagccagcacgctctgaacttgccggctggaatgtcctctttccagagacggcttgtctgacctactgatggaatttgagaaatgtgacatctgtgcgtgggtttgatctctccgataaagacagtaaatatcttattgtggttgtgaagctttgcatggaaaacttctctagggctattcgaaggaagcttaggctcctcctgttgaccaaaaccctaagcgtgtgaggccaggccacaggttgagggccccgtctagggtagagtgtttgctcattagctttaaccaggagaaagcacgaagaggtggaagtgtccgtctcaaattaaaacagagaaacgtcgcaactgcgtaggtcattgagcatggatttcctacttttagatattctgtagacatctacaaaaaggggagttaaacctagatcttatggaagcgtctgtggaatgtcctccaatacctgcccccacagatacacagagtctcaaagctattaatataaacatctctttgtccagttcctggtctttgtagaagtaggtgctcaggatactgatgacagtcttggagtgtcccagttctcacaggattaagtggctgagggcattagactccctcatcctgaagatacaggggtcaaaaccagaaccatagctgaatgggctcctgggaaagcagtccctcaccctaccttatacaaaagtggctgcttttcaacagctgtgaaggcttggattccaaggggcttgatcaaaatttctcaggtttggcactattgtcatttgaggctggatcattcttcgttggggtgggaggggtctcctgtgcactgtaagttgttgagaagcatctctagcctccacccactaaaagccagtagcactcccattcctgagttgtggtgactaaatttgcctcagattttgccagatgtgtcctggggaggcaaaatcaccactggctgataaccactgaggtagagggccaagtgataatgcctgtgacccccacatgtctgcattgctcaacaccccctacttcctctgcccagtgtcacctccccagctagacgttgtccaatggagcagacaagtccttatccaccccccaactccttattcaacttctcccttttccaaatcatatatgactacactgtattaaatattgatttatttattgtctgtctctactcaataaaccataagctacataaggctgagatgttgtccatcttttttactttttttttttccaacttttactttaagtttgagggtgcatgttcagaatgtgcaagtttgttgcataggtaaacatgtgccatcattgtttgctgtacagatcaatccattgcctaggtattaagcccagaatccgttagctattcctcctgatgctctttttttactttaattatggtaaaatatacataacataaaattcaccgttttaagtatcataaagtatgcaattcagtggcttttagtacattgacaatgtgtgcacctatgccactatcgagtttcagaatattttcatgaccccgaaaagaaactcccatacccgtaacgtggtaaccctactctttccctcctcccagcccctgataaccgctaatctgtgtctactgatctgcctattctgtacatttcacttaaatggaatcatacaataagtgaacctttgtgtctggtggttcctcaataagataaacatgaagtgaccacaggacccagcaattccattcctaggcatacatacaaaaaacatgggagacaagtgttctaacgaaaacttttatatgagtgttcctagaagcactctttgcaatagccaaaaggtgtccatatgctcatgaatggataaacaaaatgtggtatatccatacaatggaatagccataaaagggaatgaagtgtggatacatggtgcaacatggatgaaccttgcctgtcttttcatcgttacatcctcagtagtgaaaatactgcctggcatgtagtaggtgctcagtaaatacaagtggaataaatgaaaggcatataaaagtaaatgaattgaggatagtcaagaaccatggataactagttagaagggccattcacattaactgtgtttcttttaatttagaaaaaaaaagaaaagaaaaaaaatagacccccccaaaagaaacaaagaaacaaaaatgaacctgatattgagccggaaattttggaggcggggaggatcgctgtatgtgaaaaatagttgaatcatggaggggagctggtaatgaaagtgtcatgacagaatactaaaacttccctgctttctgttctattttgttttgtttcaatgtcaagctctacttcttcttcccaaatgtttctttcagaagcagatacttaagctatccatagtaaatagatattttccttcaaagtactctcctgggaggatgaaacatttattccaaagtagttgccctgactgcaaagatttttgcaaaatttcttcaggagctgccttccgagccccgcaaggataccaagctaacgagattatcatcattatgattacacttcatcatagatcaaaagcagtttaactcggcaaaatgacctggcctgcttcactagtctttattctaaggggctgctggctttgttcaaaggctaaaatctctctgcaaagcccagttgaacagtgtccaggtgtgcccccaaggcaggggcaaagtggagcatggtctaaggggtcaagctacttaggtctcaatccttgctctaccactaactgggaaagtgtgcctcagtttcctcatctgttaaaactgcatagtaatagtcctacctcaaagagttctcttgaggattaacttagttaataatacataagccaagcattagaaacaatgcccaccacatagcaaagtcttttaggtataagctcttcttataagatatgtgtctgagccttttcagtaattgtgtagtggccaagtgaggtggcccatgcctataatcctagcactttaagaggctgaggaaggcagatcacttgagtcctggagttctagaccagcctgggtgacacggtgagaccccatctctacaaacaatatgaaaactacctgggcatggtggcatgcacttgtagtcccagctactctggaggctgaggcgggaggatcacttgagtctgggaggtagaggttgcagtgagccaagatcatgccactgcactccagcctgggtgacagagtgagaccccacctcaaaaaaaaaaaaaaaagaagtgtagcttccccaggtgaagtctgaaagtggtacacttactatttttaaaaataattattaagaaatcaggcgtgcagttttaatgcaatcttcagtggtatattcattcttatattcttattactgttgtaacaagttagcacaaacagtggcttaaaagaaaacaaattcattatctttcagttccagaagtcagaagtctatgtcagcttcgtagagaaaaaattaaggtgtcagcagaattggttccttctggaagtcccaggggattgttttcttgcctgttcagcttttagaagctgcctgcattacttggctcaggggcctcttccttgaattactccaacctcttctgccatcatatcctactaatgactgatcctcctccctcccttgtataaggacccctgtgattacattgggtctgcctgaataatctaaaccaaggttcccatcttgagatcctgaatttaatcacatctgcaaagtcccacttactatagaaagtcacatattcactggttctagggactcgaatgtagacatctcagggacatttattcagcctatcacatatgacttcattttaggtggaaagtggttctcagtggaggatatcaattcctttctatctctcagtgcaactctgttgtgccattttgaggacagaaaaacaatgtggagttagccactggaatccaaggttggatggacctctaggacggtgaagtctcctgtagttctcttcctcagtggctttgtaaggattttgttatgtttgaccagcaaccccaggactggagttattcaaggggtctaaccccaaacacatgtcacatgagagaataccaatttggctgtaagtttcattgtgaccttgtatcctacttgataggtttaagatagcacagtcctccagtgcacctggctaaagtcattcttacatagcctccatcaggtcatgatttttgttctgttctcgtatgtttttgcagcaccaaaagaagtccccagcaccttacaggattgatattgagagcttttacagtgtttaaaggtaactgtttttcacaaagatgaaacactttttgtctgtttcaccaatatcccacctggaatatcctgtatttctctgaatattatagtaacctgtggctatcttgaaacttccaggttttcccatatgaaactagaagacagacttggaaggcaatgttgcttagagcaatgcttgctcaccaaatctttttcattagaatagttcacttagatactgggcagttttgataaaccagcattcagggaacaaagcttttatgaaggttccagccataatttttggcctcagaatattgctgggtgttttttcctctgtcaatctaaaatgaaaatgtaacatttcaattgcaattcgttaggaagaagcaaagaaggggatatttgcatttgatcaccaaattggacgagactaactttcatccgcatctgatctgccaatatcagcttttttctgaaatataaaatagtcattaattcactgttttcccttattgagtgaatagatttttttttctgtcacctgtgtttttatccaaaatcagcaatagaatattttgcatggttaaaaactggggaggtgggaattgacatttcctttgaactccaaacaaatggcaaacttcaaaaaatgtttgatgaaatactgcagtattataacccaaagaatctatgatggagaaaaatatgaagaaaataaagaatttttttaacgaatggattatgatacttaccttcagtaggttagctttagtgtttacaagtattaattgattttttgtcaaaaaaagttacataaaaaattaactcaattatcatcaatccaaaattttgaaagataaaatgtggcaggtggaattctaaaaatggcctctgagattcctgtcccatgtttattcaaacactaacctaggtacagcttgtgaagggatttcacagatgtgactaaagtgtcaagtcagttcactttaaaatacagagatgaccatatcacacgagtctcatccaaacatgaaatccctttaaaatcaaagcttcttccccaggtggtagcaaaaacagacatcttcctcaaggaggaaaacaggaagagaatcaaggtcagagagatttgagttcaaattttccacttattggttttatgaccttttgaaaagtttcctcataccttgtgcttcctttcctaatttgtactgctagtcactccctaaatttatgggaaggaattaagagacagaatgtacacaaaatacttagtcatgtgtcagacacatactatgtgcaccataaaagataactattattactttagaaattgttcactctataagattatccttcactgactcttgcaaactgtattctgattctaaaaccatgtgagttcacacaaaatgacactgaaaagcataatgcaagtgtggagcatcccaccatgtgcaaagtttggttggggccagctctttaccccactgcattccgttttggcccctctcctaagctctttttttttttttttttttttttttttgctctatttactgcatatctgaccaacaccatgaatttccagaaccccagtcctttatcaccaacatcattctccacaaaatttaagtaggctgtgcactattcttacagggtccaatgaggaaatagtcttataaactaagttaggctaaattgttaatagctaatgatgacttagcttcccatatgcacttcatcaaagggatttgaagccttacccctaagaaataaggtgggaagtctgggggcggtggctcactctctcagcactttgggaggccaaggtgagcgggtcacgtgaggtcaggacttcaagatcagcctggccaacatggtgaaaccttgtctctactgaaaatacaaaaattaaccaggcaaggtggcacgcccctgtaatcccagctactcaagaggctgaggcacaggaatggcttgaacttgggaggcggaggctgcagtgagcagagatcgtgccactgcaccccagcctgggcgacaaagtgaggatctgtctcaaacaaaaaaaaaaaaaaaaagaaagaaataagatgagaattttaggcatcaacttcggagaggaaagaaaaattatttggaggtgcaaattcctttggtattagtaaaaattgactcacatgggccgtagtctccaccatgtccagtaaatgtcatcttcctctgttgctaatccttctgcttatatatatttgcttaatttttgccctgaccaccaggaaaagatttcccaagttccttttttctcatgtaaacaatttgtattacttagaataaggatagtgcatgcttatttataaaggactagaaaacagggaaaatgaaaatagaaaaattaaaaatcatctatagtctcacccttcgtagaaaatgatagtccaggatatcagttaaggaggggtttaaggttggtaaatcaggttggaagatggcctggaagatttcccctgaggctgtgactgcatagcaaacacccagtgatacctgagagtgtgagcgggttgctgatggagattaagggaggaatgaagtcttggcccctagctattcaagaccatctgcaactgcccattctcaatattttgtttgtatttctcatatgtgtgtacacatacatgtcatagaattatttaatttttggtaaaaactgaagtcatacctacataatgttttataaatcgattcttcctagcctaaaattgtgaatgtcattcccgtgccattaagcattttcttctacattcatttttaaaggccatacaagaatattccatagaccaaatacgtattttttcattggcctagggttgtatatttaggttgtttccaactctgattctaattaacagcatacaactgagcacctttgtaaccaaacttttacacatatacgtgattaattccttaaattcctataagtaaaattgctgggtcaaggagttacatattttaagacttttctgaaataactatgtcattcagtttatctcagatttatcatcaggcagttgaaacaagggtattagaaatcattttagaccaatatgaaagacgaatggacattaagcatcagtagtctttaacatgaacttttcatagataccaaagagtagggggatcaactgtttctatttgcccaggactgaggggcttcctggcatgtgggtcttttagtgctaaaaccaagacaatatcaggcacattgggacagttggtcaccctatcagagaagaccagggactgactgaccataatggaaggattcagtgtaatgccgtcgtaggcaccattgccagaaccatggtcagaacaaggtgaaagtttaactacatcattagccctaacatggtagaaggcaagtaatgagtttcagaagccatgttcaagaactttgaagtgtaacgacgtagaattatggggtagagagcatagactagagaaaatgcaagcttctaagagtccaatgacaatttcgggaaacatgaggagacatggtgctcttgtggtggcctgtattggaatctggtttgcccctcaagtgaatagtgttgatttgaaaacttctaatattctttcttttaggagatcttcttgatagttgcagaaattctgactggaatagattaatgtcttgctatttggcttgtatagtagcagcataaaattccacttcttcttaactgaagaaagcatttaatttaagcacaagaagatgactcaaactgagccactgcaaagcaggtgaagggctcaaaacattatagtggtttctcaatttgagtcatattttcattctcttgaatcaaagggtcacttaacaaacatgatttaattatatatgtcttgcctgatttttagtcacagagaaattccgagatgaaaactctggaaaggtgtcattaactcaaggaagacaagggcagagttaggctagcaactagacactctgtgtacagtttcatatacaagcaagactttcctttaatattgataaagaattgagtatcatgtatgcattcccttttatgatatacaattaattgtaagttatttccccttgtatgcaaccatccacatttttcttctgaccttttcctcaagtcttacaactacttttaatgactgcattttggaggtggtcccaggagaacagatgttgccttataatggtgtttttccatttttttctttgattgggcaagggggttggaagtattatttagtcattatatggattcctctaaaaattgttcaatagaatatgtattcatttattcacttacttattgtttatttattgcctagagtatacccaacactgaggatacaataatgatcaagacaggtctaatttctgtcccatagagcttaaattgtaattagaaagaatttttttaaataagcaaaaaggaaaagaaaaaataactacaaatgataagtgttctgagggaaattaacattctaagagaacacctgggagacaagagccctcctttgggcagtatggccaagaaagtcctttctacttgcatgaaatgttctcagtagcatcgttcataaatatccaaaaagaggaaacatccaaatatccttcagctagtgagtggacaaataaaatatgatgtattcataccatggaatgctaaagagcaattaataaaagatgaattacttgttcatactattataatgataaacttcaaaaacattaagctaagtgaaagaatccagacataaaacatactttatgtgattccatttatatgaaatatccagaaaaggcaaatctatagagatataaaataagtaagtggttcctaaggactaggagtgggaatgaagagtgactgcaaatgggcactagttttctttttgggaagaaaaaaatgttctaaattagattgtggtgaaggttgaacaactgaaattatactaagaaccactgaattgtaccttttaaacaaatgaattttatgacatgcaaattctatctcaatgaagctgttaacaaaacaaaaagaaggatgaaagaataagcacaaagaagaaaggatttcctaaggaggtgacatttgaactgacataggacttatgcaaagagaggtcttggctgggactgggagagaacactccaggcagggagagtctgtgcaaagatcctgagatgagcgagcatttggcatgcataacaaactagtggaaggcaaggatggcttgagtatgttgagcaaagtttagaggtagtgagaaaagaaattggagaggcagatagcagcaaattcacacaggacattgcattgcaggcctgatactgagggtgcttcatgtgctacgaagacattgagagattttaattgatgctatgatgtatacttgacaacattctaccttaataagaataaagtcagccaatactgttgacttactattctatgaattttacacatactaccctatgaggtaggtacccttattattatgagtaaggaaagtgagatacaaaataatttactcaagaaatctgagggataattatgatctgaactcagttagtccagcaccagagcttgaaatcttaaccactgccctacccttgaaagtaggactagcttcataggcatacaacctatgcagtcacacagggccccatgcttagaagagtcccacacttgctttaacagcctgctgtcaccatcttgaaatgcttaaaaagtttttaataaagagacctcacattttcattttgcactgcatctcacaaattatgcagctagtactgcttgaacagtcttttagacattttactaccagaggaattattaatccattgaagatcatagataaaagctggccagggaggagaggcaaacccttagaattaacatcctatgtcttatgcatgtccattttgggacagaactctcaaaaggatccataagtccaaaagggttaagactccttgatttaccagcagccaccattctgatatttaggaatagctagataatgaagtagacttactattcagcttcctgttgtcctacatctattgataaagggttgcattggcaacactctttccagaaaacaggaaaataataataataataataataaggatgaatgaaaataaatggaaaagaataaattctaagcaaaatattttctttagtgtgtgtgaatgtgtgtgtgcgcatgtgtgtgtgcatttttctcaagggacctaaagtttgtctttttcactatcataataattttttaaatccctaaaacacaaaaatcaaaaccaaagggacagttcttctgaatttatactaatgaatttggtcaaatatatcactcattttccgctagtttgcataaattccatttctcttgtttcagaggctgacttgggttataggagaacttttaataatcactattacataggacaatattctgcatgcaataattccacaataaattcatgtcacgtgttaattttgacattataattaatgtatcaataatttgttactattattttcttataatctgggcttacttgtaaccagaagaaaactaaagtttaatggcaagttttcaattgcatttaaaatacccccaggccaggcttagtggctcacgcctgtaattctaacactttgggaggctgaagtgggagaatcacttgagcccaggagttcaagaccagcctgggcaacttagtgagacgctgtctctattttattaaaaaaaaaataaaattaaataaaataacccccaattaatttctaagctagtaaaggcaaataataaaaaatgtgagctcttgatacaaaattttttagaatttttttgtgctcaagaaacaattacgtactcatgaaaatgtgattatccactttaagaataatagggattaaaataggcctctgaatttgatatcgtgaaatgattaattgttcttcgtcactgaggtgctgctttctttgtatgcttcattgttcaacccatgaagtccctagatctttgagctaccagacaagtgatatttgtgcctcctggggctctcccagtgtgaccccacaaggagaccttctgactctgtttattcttagagtgagcaactgcatacaaatagaagatgttatgacacaggccaccagaaccaaatacagagacaagaagatatttctatgaaaacaaaatactaattctaccctaaactaaggctagactttcccaagtggaaaactattcctggaaagaaccagggagagatggtataatttcattttcacatggacgaccgcaaactcaagcttctttaaaagtgccataatgaacccagcacacgaacactctggctctgagacaaaagcaaggattttctcatttgccacctaacatccttgtaatttcccagttttagcctgtgtctttatggggggaagcaaaaaaagcaaaaccagctttgtattgttttcatgcagttactgagcctgggtaaactgggacaaaatcctagcaactgagaccaggcagaaaaaaaaaaaaagtttctgtggttctttttttttttttttttttttttttttcccaaacagagtctcattctgtcacccaggctggagtgcagtggcaggatctcgactcacggcaacttccgccactcaggttcaagcagttctcgtgcctcagcctccccagtacctgggactacaggcgtgcaccaccatgcctggctacttttttttgttttttttagtagagatggggtttcaccatgttggccaggctggtctcgatctcctggcctcagttgatcaacccaccccggcctcccaaagtgctgggattacaggcgtgagccactgcacccagccgttcttcatctttttgaaaaaaaatttacttccaattatttgatggtaaaatccaccaatttatgcataaaataaaatggcaagttagatttatttggagaaataaattgtagaaaccattcatccgttagggttttttaaacggtcttgtgccacttgatgaagcaaaaataaaacttcactcagctgacagataatctaggtgacaaaatcttttgtctctcccttatgaagtgaccgctttgaatatttttcttattttaaaaaccaaaaatcctttgaatgctatttattattttaggaatcaaaaaccaaatgtctattgtgaacacaagtctaagaaagagtaatatgaaccagtctttttcaagatggcctgctttttctgcttgaaaacattcccatgttaacgtttttcttcctggttgctctgttagccttaatctgtaagtactatttttttggagggcctactctaatccagttgttttatagacattatttcatcattcgatcctaccaacaactttatgaattaggagttacaaatttgcttttgtagataaagaagctcaacatcacagaccttcattcataaaaagggtgaaaactgtctagggtcaggcagactggggccaaacctgttctggctctttcttgctgtgtgatcttagccaagttatttaacctctctgtgcctcaatttcttatctgtaaaatgaaagagagtaatacatgcctacaattccttagccgtgattctcaaatcaaaaaatctctgaaaattaaagtgttttcataaataggacagcagggaacatacttaaacaaaaatattacacgttgtttatctgaaactcacatttaactgggtttgctgtattttcatttgctaaatctggcaacactagtttggcgccaacattcatttggcataaagattaaactgtgctggcaagaggctattacaatctttatttgtcccacgtggtgaagatctgagcagcggggccagcaaatacaacagctctgagccatgtggttggtatgttcgaggacagagagaaggccactgtggctggaacagaaagatggctagacaaaagagggaaaggagatcaagtcagaaaggcaggcaggagtcagaccgtggagggcttcgagccaggctaaagatggtgagaggtaagcccaagatcacaccgatggtgagcaacaaaaccaggattcaaccctaagtcagtcttattagtgcattggtcagtctgtcaacaaacatcgtgggggaaagtcatccttaagacatcgttataaagatgtcttcaggctctggaactaattgaaagattatcaacttggcagccaatcagctcctacattgactttagtactagaaagaggtacaactgaaatggacttttcagtccaaggtgataacattgatgcccatttcatagcccttgctgagtttctgtgcaataggaaagcatcttaatgaaaaaatcaagatttccaagtgaagggggaaatgatacactttgtaaatgtagtataaataaatctaacatataagacagtgtaataatgataattcagtataagacagcatatgtcattttgtcacctaccttgcacacttatggttacacatatcacctccttttatgtcctaaggtgtaatttacacagtactagaattggtggaacgtgctcatctggtcagcctactttaagtactctgcccgtgacttttacttttgttaaccgaagtcaataaatatttcgagcttctactccatatgaagcacagtgctgggcataagagacatagaagcagacaaggtctactcttgaattcaccaagtttgtagtgactatatatttttttgtttctagaatgcacaacgagtgatatttcatggttccaagatggtgtgatttttgtcagggttttaataataacatcacagttagacagtcttacaatgtgctaggcactgtgctaagcgtttatggggattatcttacctaattcttagaaagcccaaaaatgtagcattatccccatttttcagatggggaaaccagagattaagtatcttatacaaggtacagagcttgtaaacaatagacctggagtatcaaacccaggcagtttgacttcaaagtcagttcttttaatataaagttgtgctatgacaaaccttatattaaaaacttttgtgttcaggataatgccagaagccaagctctcttctattttagctaagatgagatggtttctcgcacagcaggacttcctcaagcctcttctttttctccctctggggggctagttcgggcttttcttttgaaccagtgaagcacaggaaaaatccacacgtgctgaattctccacattggctctgtacccgctgcccgcccagcccccaggatttgccccagcgtggctgtgctcactggccccatcctctctgtcaacactgaggcatcagtaaataaagaacaccccccaaagcttgtcagattcttctgcactggtgcacacaccccagtgatgagcaaactcctctatcatttgcccaggatctttgaatttagatgctgggtcaagaaagaatgacacttttgcaggaagctgttctttgggagaaatgatattttttagcttcttcctcaggcctgcaacataataggcaggtattgtcctggtgataaatgatagctcctctggaagaaattacaacactgtgtgtcataagccgaggcttctccaacattcctctctgctgtggagtgggtatagatctggccacaaaatcagaagtacctgcaaaacaaactcttttttataactcaacttaaattttttgtttcaaattcccattgatctcaattaatggcatattgtgtctgagtcactcttgaggccttccttccaccctttcttttgatcaatagtttataaatgggaataatatcgcccttagtcagctttccagaaattattttgggggatcggttgtcacaaagattgagaggtgacaccgacatttatttggtggtcagaggccagaggtgctaaatgtcccgtaatgcacaagacagtcccacaccatgaagaattgtctggcatcccaacttttcaatgtccagtagacattcatgcaggtgaaacattggtttctaactctctgagccatgcacacaaagcatccttcacatagttggttttcttttgttgttgttgttgtttgtgttgttgttgttgttttgtgttttttttttttctggagacagagtctcactctgtcacccaggctgtcgtgcgatggcgccatctcggctcactgcaacctccacctcccagattcaagcgattcctctgcctcagtctcccgagtagctggggtttcaccatgtttgccaggctggtctcgaactcccaacctcaggtgatccaccacccgcctgggcctcccgaagtgctggcattacaggcgtgagccaccgtgcccagcctcttcacacagtttgttgtttttttgttttttttttgagatggagtctcgctctgttgcccaggccggagcgcagtggcaggatctcggctcactgcaagctccgcctcccaggttcacaccattctcctgcctcagcctccagagtagctgggactacagacgcccgccaccacgcctgactaattttttgtatttttggtagagacggggtttcgctgtgttagccaggatggtctcaatctcctgacctcctgatctgcccacctcggcctcccaaagtgctggaattacaggcctgagccaccgtgcccggcccacacagtttttatatgctctgaactgtatagaaatgtaagtaccctgtaaattgagggaagactgtacttcgttctaactgtacagaaacttgttcagcatatcaaaaactcatgtcatgaaggcaatattatgagaggcattcgattctctgacacaacacaccagtccagatctgtatttgtgctgtcacattcagtgtttctatgtataatggtaagaatctgattgctttaccatatgttctagtatgtcatgccgaagtatttaaatgttggaatgtacattaatttattataaatacttcccttgtatttgccccttaaaaattgtgcttgtaaataagggatttcaggtgtggacaggagtatttagcagactatgtgcatagcccactcattcctctgaacactcatctccacacatcaaaaggtgtcctccgccaacacctgccaccctcaggtgctgctattcttggcctcaggacgttttcctggctttgggatcacactcacagccatgcagcatcataggatttaacgaatgccccagaagcagcccttgaccaatggtgcacagtgagtgggtggacaatatgcctgtcaccccgtaggaggggtatacccgaggcatgtgctgcacgtctcccggaggtccccagtgggaatgagcctctgctgcccatggtgggccctgccttgatctcacatcctggattggcttctggccttttcctatcttgctataccatcaccctagctgtgcttcctgggatcatcttctgcatcagctacttaaattgatgactttgtctcaaggtcaacttcttagaagcccaacctaacgtgggccattaccaagaatttgcttccaagagggacattgagtgtaacagggttcaaagccagtgctccagacaccgtcaagatttggaattttgttcaatgccaaggagcatatcattgggatatggattacccctttccatgtggccccttcaggactgagatctcctgattttgaacctagcttgagataaagtcaattctccaacatggagtctgtgaatccatctctggtctccaggggatgcagaggagattcatcaaaataaagcagataaatgagtgagtggagctgtctgggtgcatggaaagtcatgcagatagaaacatcttttgtgactgggcgtggtggctcatgcctgtaatcccaactacttgggaggctgaggtgggaagattgcttgagcctgcgaagtcaaggtcgcagtaagccaagatcatactactgtgctccagcctgagtaacaagcgagaccctgtctcaacaacaacatcaacaacaaaaatttgtttcccactgtaaatagaaacctgattcatagaatctcattcttttatttgagaaagatttatggagcatctattctatatcacgtactgggcatagagtggtgaacaaaacagacaaaattattttttctatcaagttgggagagactgataataataaaaacatatggatggtgttaaatagtaataaatacctttgagaaaaaaagaaacaggagaggggaagaaggaggactggagatgagggtggtgagtttttaaaagatagatcagggataaatggcaacagacactcagcattaaggtcgagggttcgactccttgcagggcatggttatgctggcaaggtctgcctgggaggaaggtgcttctgctcagctcaacaaggaccgccgtgtgggaagacaaagcccagctggcaggtattctcattttccagaggaaacttatagacataccacctgcccggagagctgctagcaacaaggcaaagctctccatatttttaagagttcaaacttgccttcccgctcagcatgttcaaacaagagtcagggagtcgcgctggtgccctctcctctctatcctgccccatgcctcccctgaagccatcactttctgcctgaatgacaggaagggaaggagaggggaagaatgtagaaagaaaacaaatcacagattaggattacccagccccacttgtccagccagttttctcttcttctggatgcaaactgaatgttggaagcattgccttgcaaagtcagtagtcaacagggaaggttcagatttgtttcttccttgaaagctgcagaatgggatgttgctagagatcccagtgggaaatttcccagatagaaaagccatgttggcttgtggagtgccggggcttggcatgggggcactgccttggcagagctgtcttgatgtttctggaaggcattgccaacaccagcggaacttgcagcaggagttttatgaccctttttcatccaagccactatttgggcagatgcctgattacttctaatgactccatttctgtgataatggccaagtcctctgtcatcctgctgtggcctggaatggccctggttttagaaacgagatgctccttgtaacgcgtggaggcactaatggctgctctccaggatcctggcctcctgtgccaacaggcagaacagccaaaagcaacaatgcaagtgtgcagaaaccattcttgagacagggggatcattggtctgcccattactaaagatgcccaactctacactagtcaagaaaatctttgtcccttgaaattttatgtatttctctaacttctgaggaagccaagatctgagaatgaaggaaacttttgtcatgaggactgatggttgggcaaaaatgattggcctgttttctggtgctaaaacatgctcctaagtggccaattggcttctagtcataggctcttggcatgatgaatgcatgtgtgatggtgtctgtaacagctatcccagcttgggggggtcgggggaggctctagcttattcacttagtatgtacccttaaaatacacatgccagggtttctaaactgccatctccctaggaccccactccactactatttggggatgggggaggtcatactatctgaagttttgcaagtggagattttttacttacagtaagtgaaatggaaactgaccaataccttaggacatggttagatgccgtttacgctaagaggtgaccagctagatgctggatcctgacaaagcaaaggtgtggtcccccacctcaggtgacaggcagtggtcattgaagtgaatgctgagttaccagctggcaatgcttactctaccatgtggcttccaggctttcaacaaatgttcttccctgctcttctcagccaaatccacccatctcactacttccaaaccttggtctctcttctggaaaagtctctccagctcccagatgtcaaggacctcctgggaatccacttccttctccactgactcaaatccctgctagtctgatggtccagagatccttctttttccagagagcacttcctcctgttgcctccagcacaaaaagcctttcaccctcattgttctttgatcttttataatcctcaaccttggagattgtttaggctcaaagccagaatcaaccaaaattcagttccctttcctcaaaggcagagagggcttagctttcaaaccttccagtgtcagaagaaaaagaagggggaatacaaacagctcagtctctgtgttgaaatagtctgagtgcctagtcacctgaaaaagagagttatttggatcattctccagggctgttattttggagtaagtcacaacttacttggtccgggattcactgcccactgtggagacaaagtttctcaaattcctttatcagcatcaggaaccaagctattcagtcccactgtccacagttttgctgagaatttttctgtagagtttataagttattgtcattctgcctgtctgtatgtctgtccacctatcgtaaaagttaggtagtgggaaaggtgtttagtctatttaaggaaataattactcaaaaactagtttttgccttttgtgtgtgccaatacgcagcttgattccaaacatgatgataccatttcggtgcctaattccatctgcctgggatctaacaccacctctgcctcttactacctttgtggaaagcgggtcaacctctgcaagtctgttctcttcgcccaacgcagagtgcaagaggctttcccttgtaaggctgctgtagacattaaatgagagaggctaggtcaagagcatggcaaagaggaaggccccactgcgtattagacagggctattgttattattaaggtgggacaaatagaccacactctgttccatatttcccccctttggcctctaatgtttgctcctgcacattcttgaaagtaacagaaccacatgtcttttcaaacagtaataatgatagatatcagtattcagttctgactctatgcgaggcaatttgcatgcattatttcattcaaacctggcaacagttccatgaggtgccacttctatcagttcaactttgtaaaggaaaggcttgggctgtgcgacttaatcgagggcattgccgttttcagtgtagacgctaggatccaagcctggttcaaactccatagctgatactcttaactagccctgcatagtgcctcattattcaaatgccaaataattcagaattttgctaactctgcaagaactttattctcagccgggcgtggtgactcatgcctgtaatcccagcactttgggaggctgaggtgagcggatcacttgaggtccagagttcaagagcagcctggtcaacatggtgaaaccctgtctctactaaaaaaaaaaaaatacaaaaattagccaggcatggtggctcgtgcctgtaatctcagctactcaggagactgaggcacaagaatctattgaacctgggaggcggaggctgcagtgagccgagatcaggccactgcactccagcctgggtgataaaatgagactctgtctcaaaaaaataaaataataaaataaatttttaaattttttaaaaaacaactttactctcctgagtccagatggggttgactttactgatcctgtgcatttactttgtgtagcaaccctagatagtaggtactgctgaaaacaaagttacagaagtttttcttctcccattttcttattcttttttttctttttgagtctcactctgtcacccaggctggagtgcagtggcgcgatctcggctcactgcaagctccgccttctgggttcaagccattctcctgcctcagcctcccgaggagctgggactacaggcgcctgccaccacgccttgctaagttttttgtatttttagtagagacggggtttcatcgtgttagccaggatggtctcaatctcctgacctcgtgatccacccacctcggcctcccaaagtgctgggattacaggcatgagccaccacgcccagccttcttattcttcttttaaataagcccgtaactagtaatgaaaaccaaggataaatctatttatttgtattgtttcaggaacttcagatattaaaaagcaataaaacactaatccaataaagtaatttctgcacacttgtttatacgtgacgtagcgccgatttcacagcttggactcatgaaattgttttcctcccgcgctgggacaaagacccatgacagcagcttgtagaagctgccacaaggactgccatctgatgattcatttgcttcttggtttttcgggggcttgtgtttttttacttggaggtagggtttctttcaggggaagttcagtaaccgacagctacgagatctttacacagaacgatcactgctaaaccaaaccaaaataccaacggggttttggactcgatggtaattttttgtttgtttgtttgtttggtttgtttggttttgatacggaagctccccctgtcacccaggctggtgtgcagtggtgtgacttcggctcatggcaacctctgcctcctggactcaagcgattctcctgccttcagagtagctgggattacaggtgcctgccacaacccccagctaatttttttattttatttttttagtagagctggggtttcaccatgttggccaagctggtcttgaactcctgacctcaagtgatccaccctcctaggcctcccaaagtgctgggattacaggcgtgagcctgtgcacctggcccccatgataatttttatcacatgatgttatccaaggatgacgccataaactgatagcaatatagggtaacatttacacctttcatgagcaaaatgaggggaaataaagatgctctgggaggttttcaacaagtgaaatttactcagtatgaagtattgaactttatttgatccagatcaataaaatttattgagcacattctgtgtgccaggcactcttctaggcattgatgaaaacagaatagttgttctcagagagttcttattatagtggggatagacagacaataaacaaataaacatgaactgggttcagtagcaacaagggccgtaagaagagcctgcatgagggcataaaggattcagtagaggcctagcatcgtggctcatgcctgtaatcccagcactttgggaggccgaggtgggcagatcacttgagttcaggagttcaagaccagcctgggcaacatggcgaaaccccgtctctacaaaatgaaatacaaacattaactgggtgtggtggtgcacacctgtagtcccagctactcaggaggctgaggtgggaggatcacctgatcccaggaggtcatgactgtaatgagcctagattgtgccactgcactccagccttggtgacaaagccagaccttgtctcaaagaaaaagaagagagaatgcagtagagttagggaagtccatgccaaggaggtgacaatttagcagagggttgcatgaatagaggaggaggtaagccttgactatatctggggaagaatgttacagggaaagggaatagtcattgaaagtccctgaggaggccgagcgctgtggctcccgcctgtaatctcagcacctcgggaggccaaagcaggcggatcacctgaggccaggagttcaagaccagccgggccagcatggtgaaaccccatctttactaaaaatacaaaaaaaaattagctgggcatggtggtgcatgcctgtaatctcagctactcgggaggctgaggcagaagaatcacttgaacctgggaggcagagtttgcagtgggcggagatggaactactgcaccccagcctgggtgacagagcgagactctgtctcaaaaaaaagaaaaaagtccctgaggaaaaaacgacctcatgtattcaaatatgacaaggaggccagtgtgcagagatgagggagagtagaagaaaggcaatgaggttttcaacgacctcatgaaaagcttgttagggccagcatagtttttatttgtactctgagcttgtgtgttttccactacactggtgatagaaacgcctttctttaatgcaaagatggtaaggcagtgttctttgtgttggaaagttattgtgtcgattccttgaaattttttttaatctgatctgtgaaatccagaagtctgggaatgtcaggagacgtctggtggcattctgtaggtgggagtgtcacggtgtcgtaggaagttcaggaatctgaagtctgtgtcccagccatcctctgttccagacatgctgggtgacagtaggcaaggaatttctatttctgggtttcacttttctagtctctaaaattcagagagcagctttaaagaatcctgagccgacgagggcatgaaggacatggaaagcctgagaggaaagccaaggagtcaggcaggtggacttcccggaggaggggacctggggagctgctctgggcaggctctttgtgaagggagagcagccctgctcagtttctccgtggaaagtctcagggttaccatctccgcctcaaatttttcaaaaagaaacagaaatcatggtttttatgttaaatctctccgttcataaatattagcaaccgctttaattaaaaactaaacaaggccaggcattgtggctcacacctgtgatcccagcactttggaagaccgaggcagacggatagattgagcccaggagtttgagaccagcctgggcaacatagcaagaccccatctctacaaaaaaatttttaaaaattagccaggcatggtggcatgcatctgtggtcccagatactcagggggctgaggtgggaagatcggttgaggccaggagttcaaggctgcagtgagccgtgatgatgacactgcactccagcctgggcgacagggcaagaccttatctcaaaaaacaaaacaaaaccacgtgagcccataaaacacatttgtgggttgggtttggctgagggatggcacgttcatttcctggagctgctataacaaattactacaaactcagtggcttaaaacagcagaaattaattctctcgcagttgtggacgctggaggttggaaatcaaggtgaaggcaaggccacactccctctgaagatgctagggatgagcccatcctggcctcttccagcttctggtgttccttgggttgcggccgcatcgctccagcttctgcttccttgttcaaacagctttctccatgggtctccgtcctctcttcttataggactgtcagtcattgcttttcgggcctacctcatcttaactgaattacacctgcaaagactccatttccaaataaggtcccattcacaggtaggaggggtcaggacttgagcctgtgttcttgggaggacagaattcaagccaccatgatggatatgacctctattataaattattcagtatagagactctggcctaggaatctgggaaccaccgaatgattaaaagctgctctgtaaagtttacaaaatctgtctctccaggaagtgaatgatgaatgtgagagagttcatacgggtttccaaacaggattgtcctggctgcaagacccaggtcaagtcagacacattctagtcttcagaacagtgttaggcggtgtatttgtttcctgggatggctgtatgaaggaccacacactgggtgacacagggcaacagaaatgtgctctctcacagttctgaaggacagagtctgccatcaaaagtcagcaggagctggggaggagggggtggctcacgcctataatcccagcactttgggaggccgaagtgggcggatcacttgagaccaggagtttcagaccagcctggccaacatgatgaaaccccatctctactaaaaatataaaagttagcggggcatggtggcacatgcctgtagtcccagctactccagaggctgaggtacaagaattgcttgaacccaggaggcgggtgttgcagtgagctggatcatgccactgcactccaatctggactacagagagagactccgtctcaaaaaaaaaaaaaagaaaaaaaaaagagtcagcaggacatgctccctcagaaggctctagaaaaggagtcttcctgcctctaacttccccgtgactcccaacaatccctggtgcccctcggcttgtggcagcatcactcaatatctgcctccttctctgtgtttctgtgtcctcagtcattgaattagggcccaccctaattgagtctgacctcatcttaattacaaatgggaagaccctatttccaaataaggtcacattctgaggttccaaacggccatcaattttgaggtgactctcttcagtcagtactcagttcaggccgagtgcagtggctcatgccgtaatcctagcactttgggaagtcaaggcaggcggaccacttgaggtcagaagtttgcgaccagcctggccaacatggtgaaaccccatctctactgaaaaaagaaaaaattagccaggcgtagtgtcacgcacctgtagtcccagccactcgggaggctgagataggaaaatcgcctgaacccaagaagcagaggttgcagtgatcggagatcacaccactacactccagcctgggtgacagagtgagatcttgtctcaaaaaaataaagaaggaagaaaggaaggaaggaaagaaggaaggaagggagggaggaagggaaggaaggacccagtttattcacccaataccagttctcttgtctccaaggtctcttccatctgcctgtctctgtgactctaactttcctatctttccttgagagtctttgctggcctttccattcagccattttcttaaggaactttcatcaacttccaaacgcccccaccaatctaaagctcagcttcagctggaaaatgtcttagtggcaaaatggtttagggaggaaaaaaggctttatttcttctgatatttttaaacccgatagctcctcactttgagactttaagcttcattgaacctctctgaaaatctacctcctggaatcatgggatagaacatacaggggaggaaaagcaaaccgctttttcactttctatgtcccagggaataaaggacttcaagaaaactgcccttacctttccagccacattccacaatggccttttctaaccacagttctttatgaatctcctttccatcacatctctgatgagtctttctattgctttgcatgacaaaatacaccaaatcctaaacttgttcttgtgagaaaatggaaaagttcacaaggaaagaaaatgacctaagatgagtgagcaatggtattcaaaaataaggagattagataatgacgcaattagagtccatttctatggttttctataattctgaacatttgctgacgactttgactggtttggtatttattcttatagcacatcaatttaaaatcaccctctgtgctctaagaggaatgataaattatgaagaaaatatgttcggaagaattttttagtgggctatctgatgctgacctgagatgttattatgaggccatccaatcattctgggtttttttaattctatcatttgcattccaagcattttaaatatttaaatggcctttcttcttgctccttaatgagagtttgtttgcatttagcacataataactgactagaaatggctttcttcttcttgtgttctcaatccagtggaaatggggaaatcagtgaggaaaccaatgttgtcaacccaaagagagacggtgatgacttaaagttgggtggaagtgatgagaaatagttgcatttgggatgtatgttcaagttcaagccaacaggattttctggtggcttggctgtgaaatcttacaaaaagcaatgagtcaaacatgttattacaattctgaatgaggtttttataaagtcagagctacaggtcaaaggcaccaggttcctagggccaggatctgagtgggcttcagatggggcctatgtagaattcttcctagaccactgattaccattacagtaacaactccaggttggcttcctattaaaaacagaccagatcaccttggattatatgactgcttcccaaagtgtgatatacataatacatgtactaataggaagcttttatgttttacaaaaacctatttattttaacttttattttagattcaggggtacatgtgcaaatttgttggtttgttatataggtaaattgtgagtcacaggggtctggtgtacagattattatgtcacccaggtaataaacgtcgtatccaataggtagtttttgcatcctcaccctcctcccttcaccctccagtaggcctggtatctgttattcccttcttggtgtccataggcactcaatgtccagctcctacttatgtatgagaacacatggtattggtttttctgtttctgtgttacttcacttaagataatggcctccagctccatccatattgctgcaaaagacatgatctcattcttttgtatggctgtgtagtatttcatggtatatatatgccacattttcttcatctagtctaccactgataggcatttaggttgatcccatgtctttaccattgtgaatagtgctctgatgaacatatgtgtgtatgtgtctttatggtagaataatttatattcctttgggtatatacccagtaatggcattgctgggttgaataataatttcattatgagcactttgagaaatctccaaactgctttccacaatgactaatttacattcccaccagcggcatgtgaatattcccttttctctgcaagctcaccagaatctgtttttgttttgttttgttttggttcttaagagccatttgcactggtgtgagatggtatctgattttgggtttgatttgcgtttccctaatgatgagtgatgttgagcattttctcatatgcttcttggccacatgtatgtctttttttgaaaagtgactgttcatatcctttgcccactttttaatggggctgttttttgctcacctttgtcagatgcatagtttgcaaattttttcacccatgaggtaggttgtctgtatactctgttgatatgaaaaaaaaaaaaaaaacactatttttaaatagccttatcccaagtcataatccatgaaactatagtttttatgggcatatttttaaaatctattttgaggcatttatttcattgagaattacatatacacatgtgtacatacacacacacatgcacagaaacacacaccagcccatcaaacccaggagtgcatggattattgcctaagggtgagactaactttaaaaaacactggtcaattttttaaatcattaggagaataataataaaattgattctagaatgtggcaaaaattgtgaaggtggcctgcaaatgattgcagattgaaaaacacaaaattatatcaagtcttatctgcatgcatatgaaaatgacaggagaataaaattcaaattcagttagtgaaaaatccttctaatacacagtctatgtacttctacaaatcaaggcgacaaaccagcataaatgaggagatgaaatgacaggatgtgaggggtgatatgagtggtacttattccccaaatgaaataatgacttactaaaggaaagttgagtgaggaaaaacattgataattgtccaataaatctttccataacctcccattagtcatcagagcatttcagtcccttttttacctaggaagggaagtcagacgtaaagcacaagcaagcaattgctgaagccacaccagggaaccacagggctgctgcttttcccatctcggggtgcctatgggtgttctccttccctgtagcatcaagaccatcagatggcctataagcccattttaaattgccatttgccctttttagaactactgggaaacattcttgtgtgcatcaaaattattttttctcctctggccttgggacctcggtcaagttaagttagctcctcattaccaaaaggatttgaaaacagtagttctgggtactaactcctttgccagtttgccttcatttctttatttattatttcagcacagaactgtgaatctcatactctaacaggataggaaatacttatcagataaatacataaacatttgccaattcagtttggtgttaccaagaagtacaaaatgttgtaagggtctatattaatgaggaagccttgccttagaagtcctgggagtcagggaagaccaccctaagaaattgaagtttggggagaagttagccaagtgagaagagggaggaagaacattccagacagggataccaatttgcactaaagctctaaagcataacggacttggtgtgcttgaagaacagaaagaaatttgtcatgtcatgcatagggtggccaactgtcctggtttgctctggactaagaagtttcccaggatgtggggctttctgtgctaaaatcgggaaagtgttggcaaactggaacagatggaccatccttgtaataagcaataagtacagtgatgttaaaccaagctggagagatgagcaggggccatttatctgaatcaccacttgttactgctaggatcctgccatcttgtctgacttcttggggcctcaagataacaaagatattctcttctgcatatcttcccaaaacttagaggcttaaaaaataatttattagtatctctcacagcctaggagttgacctgactcagctaggatgtctcatttagggtctcttatgcagttgcttgggctagaatcacttgaagcctttacttccagttggatttctccactcatatctggtatctcacctagaatggctgaaacaactgagagctagctgggcatctccccttcacctcacttatgttgtgcacactcatgtgcatagccaccctatgcgactaatctggcttcctcacaacatggtggtctcaacacagtcagactccttacatgggccaactctccctagagcaagcactctcagaggcccacagaagttacaaagtctcttatgacctagcttcagaagttacctcttttgcattctatgggtcaaagtgaatcacaggcctaggccaaattcaaaaagagtggaaataggctcctctccatgggaggaatagcaaaaatcggtggccatctctcttcttctatagatgctgtgggtcagtgtgcctcacagaatcgtggtgtacttcactgacagcaagatatgcttggcctcatgaaaacaagcgaggagtcattgcaagtccaactcaaacatgtatagtttgaacaagacttgtgtaagtcaaggcctcattctgatactgcaacattttacagtccctttcaagaaccttacacttgctctctctactgcatcaaggaatactgcctgatgggctagagaaggaccaagcctaccagtgagaccgtcacctcagttcaaagctatctgccttaagtactttcttcttgtgacatgttggggagttctagattcccctgtgactttcttacagtccccaagcaaatcagagctctctcactcggtagcttggaagcaagactactccttggctctctcttgtttatccagaatctatcgactatcagatgtcagcaaactcattctttaaaggacttgatggtaaatatcttagactttcaaggctttgctgtctctgttacagatacacaacctgaggtttataaactttataaaaacaggccactgggccgggtatggtggctcacacctgcaatcccaacgttcttggaggccaaggagggcggatcactttagcccaagatttcgagagacgcctgagcaacacggcaaaaccccatatctataaaaaaaatacaaaaaattagctgggcatgatggtgcatgcctgtaatcccagttactcgagaggctgagatgggaagatcgcttgagctcagcaggtcgaggctgccgtgagccatgatcgggccactgcactccagcctgggtgacagagtgagaccttgtctcaaaaaaacaaaaggctactggccaagtcccgtggccagagtttgctggccctggattagatgcttgtctcaaggtctcagggataagtattctctctttccactacgggaaatgtgaagacaaaatatcctaagatgagagaaacttcagcttttactcggtggttctgttcaaaagataaaaataatagaacctaggccaggcacggtggttcacgcctgtaatcccagcacttcgggaggccgaggcgggcgatcacctgaggtcaggagttcaataccagcctggccaacatggtgaaaccccatctctaataaaaatacaaaacatagccaggtgtagtggtatgcgcctgtaatcccaactactcggaaagctgatgcaggggaatcgcttgaacccaggaggcaggggctgttgtgagccaagattgcgccactacactccagcctgggcgacaaagcaaaactttgtatcaaaataataataataataataataataataataataataatagaacctaatgcagagcacaagctaaatgactagccaaggaaaatgtcattcaaaatctcccacaccttaaactggaagccagaaaaaaaaactcttcaaatttgtactgaatttgtactttaaagccccaacaggttttccccctgtttcagtgtgtctctgaatattcataacaaatttaaaaccctgtgtagtgtttttcacatgacaggagttcaatggcttcatctgaaaattaaatcagtgttttccaaaatgggaaacatacatctctggtaataaatgaaatttgaggtaggatagctaatgaatactttttgtttgaattgtctatttattgatcacaaaacttattgtaatatgtctttaaaaaaaaactgccacatggaacctgttaccttacagatgttgcttaggacaagggaaagaagatatttacattttttaaaagtcagttgatgtaaataaaaccactaaagaaaaataatatgagagatgatatgaggatgtagaaaaaatttgtgagaacagtaaacaaattattctttctcgggaaacactggaataaatgtttcctatcccatcctggctgttcaaacactggcctaaccacttggttagcacaggtaccatgtgggatttttttgtttattttttattttatgttcttcatctctctcacctagcacagtgcttgctacataaaaggcccacagtaagccaggcatggtggcacatgcctgtaatcccggcactttgggaggccgaggtgggtgaatggcttgagcccaagagtttgagacaagcctcagcaacagggcgaaaccccgtctctataaaaaatacaaaaattagccagccgtggtgtcacgcgcctgtagtcctagctactcagcaggctgaggtgggaggatcacctgagcccgggaggtaaaagctgaaatgagccgtgattgtgccactgcattccagcctgggtgacagagtgaaaccctgtctcaaaaaataaataagtaaataaataaaggctcacaataaatgtagaatgagtggataaattaattaagttgtcactcagattattaggttaatttgagtcacggaaaataacctgacactaactcaaggatctagtatttcagatgttcttaagaacagtctgaagtttgcagagcggaagagatgagcttgtttaaaatcagtgaattagaagtggacagtctcttgggatgtctttgccaagcgaagcccaatggtgccataaatcaggatgtctaattgaagcaatgttttaggaattaaacagcaattaaatcaaatgggaaagtttctaagggacacctttgacaccatggggagaaaagtcaaaacaaccccaagagtctatgggaaaaaaaaatggctttcttccaaagggcttgctggttataattatcaaacatatctgtgattaaaaccctctttcttccaaagactttatgatcttaccatagatttccctcctgtaacatcgtgagccaaagcagaaaaatcaccgaagcatcacaaatgcaggaaaccatggaaaaaagacttggaaaggaaatgtgtagcaaaaactttcatcctgccaaaaactagttttgtgaaaccggttctcaaaatagatggtataacctgtatctgtttacccagcgaaagtaatttaaggcatttcagcctcaatgtcaccaacttcaagagaagcctaacttgagcttgaaggttgatggttggagagtgtgtgtgtgtgtgtgtgtgtgtgcacacgcatgtgtgttataaaaggtttatttaaaactgtggtaaattctttcataacagtgtttccaaaaatatgggactcctacctgcaatagaggtgattttaggtaaaatgtgaacaaaaaacaaaggctttcttattttagcagttacagagtcttatataaagcaaaataaaaatatactcaatacatccatgatagtatgaattattgcttagaatgaggtgaagtttttaaagtatgttaatttctctaaaaagaatattaaggaaataattgaacataggagtaactctcaaacatggcaaaatttgtaaaagttgcttcccaaatggctgaggattgtgaaacactgttctatagcacagctaggactctttctaacacacaatgcaaaaaggaggagcttgcatccttcatttaataaaatccaacaaagacagtaaaaagaataatggggcagaaggtagggatgaagaattcacttttcaagttcagattatcccagctgattatccaagtgatcactttgatgatgagattctggaaaaataaacttcactgccaatacttcaccttacaagcaggtgaacactcttctgcatatttaggaaatatttattttgtgagggttcaagagaatggcaattgtgtacatctcatttttaaaataataactattatcattatattatcgctagcattcatttcattagagaatcctctctatcccaaaaaactagaaaccacgtataagaaaatagatactatagtaatgactatgctggtctcatcaattcagactgtattgtgagtccatcctatgcagaatcctgcgtttgtgattctaattcaggatccagcattttgtagctctgtgattttgtgtgactcactcatccacgaaatcttggttgtaacatctgtaaaacagggatgatgattcccacctcagattgataattaaataagagaatgtataaaatatgtacaaaacaccaatcatgaagttagtccacagcacatgttaattactgctagttttctaggcctctccactttcttttcacccccatcactcactttagcagttctactgtacatcaggtctactgtacatcatccacaaagacctcacatacgaaaggtagaaaatgaacccatttgcttgccagtaaatgtctaccactgcctctaatatcatttgctggaatccaacttgtatttgcatcctgaatcattcatgccttcattcaacgaaaataaatggactgcctcctcatgccatgcaccatgcttgctccctggtaaggaaacaagcaattaaatgcatatgtcaggtacaattttcacacagcacaagctccagtgtgtgaaaaatataactggcttcatttttatcctataaattaatttctttcttggagccctcattatatctaaagtgaagaaaatacctcagttactgcagggtctctttggtaaattcagggatttcccacttgccttcacttggattgcttttatgacttaggtgactcaggtagggatgagtcaagggagaaattggcgatttgtctggtcctcagtgttcatttcctccccatgacttttggtgtctgtgtatggtccctactggcaggtagtagggactgctcttcctacactgcatccacagagatgtccccattcccaaatccacagggttacctgctgtcccatgtctctgtccctttgtgggcattgctttctctgccagctctttcttctctgttgagctctgtaccttttttggggacaaggaaaatgttggctgttgcaaaaagctattctaaacctatgaaaatggagacaggctggctcacaccctccttgcaggtggagctctgagggcttcccagtgctgcaagcatgggtctcctttgcccctcaaacttacctgcggaatctttccatgccctccctaggtctagccccacctaggggtaggaggtcaaacttcaaagttctttccagagatttatcccagtatcttactctcttgtgctcctaagaggctctttttcctccccaaatcccgacattccttccctgctggtgctggggtcagggctaagtaaggttacaggctggctcaggaaatgttcctccgaatctgttgtgatttggccatgcccttggcctttgactctccaaaacccaaagttccattcctctgccctcaggttcaggctcctccgtgactatctcccgtccaaacaaggaacggtcccagtggttaaaagaactggagaagggggaagaaatcaatgaagctgtcccaagattatcccaccatatgagccaatgcaacacagagtgaaaacagggacccaaagagagcacagagcagctgcaatgggaggtcagacaagaaatagaagcttcgggataatgacattcaaattgctcttcacgagccctggtggcctttctcaggcactccatggctccccccgggccacagtttcctgtctggattatatcactcagcactgcaggagaccaggatcatatagttctgaagatgaattaatagtaactgctgcacatgtgactgcaaaactgcagactttcatgaccaaagagacaacctggtgtgtggggaaggacagagtcctgtggcttgggtttgagacaggacttctctagctctcagttctatgaccttggccaagtcactgctcctctctgcgtgtttccttatctgcaaaatgggataccgatccctcttttacagggcttttgtgagactatctgtgaaactactttctcaccgggcacagtggctcacgcctgtaatcctaacactttgggaggccagggcaggtggatcacctgaggttcggaggtcgagaccagcctgggcaacatggtgaaaccccgtctctaataaaatacaaaagaaattagccgggggtggcggtgtgcacctgtagtcccagctactcgggaggctgaggtaggagaattgcctgaacctgggaggcagcggttgcagtgagccgagattgtgccactgcactcaagcctgggcaacaaagagaaactctgtctcaaaaaaaaaaagaaaaaaagaaaaagaaaatgctttatctaccagaaagactacacaaatattaggtatcatttttattggtagtctgtcattagcctgaatatatagccctaatcttgagatgtaccctagaagttcttacaaataccctagaagttccataggggtggataaatccatgacttttattttgtaactatttaattgttattaagggcctggtgcggtggctcatgcctgtaatctcagcactttgggaggctgaggagggtggatcacttgaggccatgaaatcaagaccagcctggccaatatggtgaaaccccatctctactaaaaaataataaaattagctgggcatgttggcccatgcttgtaatcccagctactcgggaggctgaagcaggagaatctcttgaaccctggaggtggaagttgcagtgagctcagattgcaccattgcactccagcctggtgacagagtgagactccgtctccaaaaaataataacaataataataataattgttattacaaaaaaaagcccggtttccatttcctcataaacgctccatctatttaagcttgctaattatttcaatcctggaaaattaccaggataaatgattaactgttcccttaatatgatttcaggaagtaaccaaaaagctaggcttcccaaagtaagccagatcctactttggcagtttaacttgttcccaaaccctcttccggatgacatgtgagttccacctggggctctgcatttcacctttttgctattttcgaaacccgaagacatcagaatggtgcccagggaaggcccccagagacaaaaatgcaagaccggggccaaggggaggtgtgagagccgaccagatttcccaggagctgggagaggcagagatttcttccagaaacagggaaatttatgtggggagcacacagttgggagccgtgagccagttcttgcttacaaatagcaggaagaaactagacggggaagaaaggaagacattcattactgaaggcgagggatttgactgggcctggaaactccaaaactgcagccccaaattgcttcatgaacgaagccattcacttttagccacacgcagacccgtttatttagatcaaattaagatccgaatacagcaatcttaatcatttaattgtttggtggggagagcatcatatagtctgtatcttctttgtttatggcttcaccttgacgagctgtgtctgtgactcatgcattgggtttgccatccactgtcctgacgtctagtccctgcctgaccacttcccagctgtgtgacttcagcaaggggcttgacctctttgggcctgtgttcaattttataaagtgattgtgaggcctgcttcacaatcacaattaaaacttgaagttgtaagtaaaaatgccccctgaccaaaaatgagataaagcaataatgatccaggtggtacctgcattacttagtatcctcagtggtttttttagacatcaatggaggatatgtctaagtctacaattaaatgacattgtactttctcattttaaaacataaaggagtcggctggacgcggtggctcacgcctgtaatcccagcactttgggaggccaaggcgggtgggtcacgaggtcaggagatcgagaccatcctggctaacacggtgaaaccccgtctctactaaaaatacaaaaattagccgggcatagtggcgggtgcctgtagtcccagctactcgggaggctgaggcaggagaatggcgtgaacccgggaggcggagcttgcagtgagctgagaccacaacactgcattccagcctggggacagggcaagactccgtctcaaaaaataaaaattaaaaaatgaaaaatcaaaaataaaacataaaggagtcaacccagatctagatatatggggaaagcatgccatgtatagtaggaataatataaaaacaggaggcggaaaagagttaagcctttcttaaaagggatttttttttctctttggaatgtcatattattgacttatgatatttcagtttctcagaattggaaaataaaggaaaactcagaagtgagtactgcacagacactggctaagtatatatttgcacccccacagaaagaaaaaggctaatggagatactggggcgccccaaaggatcactcacgcctccctcggtgtaggaaacgcagatcacagccatcagatggtgaaaggacaactctccatacttagcagtcatgggaagaatgggaataccattctcggtcgtggggcgtgacagccttcctcataattcttccttaagaatctttatcttatcctctgtcgccctggagatgtttttaaggtcgctgttagggctccagttttaacccagggttcccaagccaagctctaccccgttaggcagtacttggtccacggggagcttcattcattcattccatcaatttgatttaactccttctgagccagggaccagggataacaacgaggaacaaagcccaggccctgcctaaggcaagaaggagcctggaactttcgagaatctgaaaagaaagctggagaggctggaatctagtgagcaaagcaggagagtggcccagacaagcctggagagaaaagtagagaccagatcactccggacacaaagatgatgtcccacctgccacaccggacgagggtgttagacccatagtctcaaccgcaccttcatttttaagacagcattccaattggctattccccctgcctccaaatgagcctggctcctccactggagaaggccaggccctgggtctcacacagtatttagacagaactcacccctcacctcttagcgtggcctgagagcctcagctgcaatggcaaggctctgtatttatataacaagccctgctcaagtatttttaggcctactgtttagaaacacacagagggggcaagaaagagaataaatatggaaatcaaatgtaaaaacttctggctcttgcaaccggcttcctgggggaatattcctctgtgttctttccacttcttctactcagcggaatgactgctagtcattaaggaaatctgtgaggagctcacggtacaggaattgtacaccaatgctcccatcctcatttgcatatcccattttttgattggcagctgtacatgaaatgccatatcagttgaaagtatgttgtgagctggcactaatgatcctatggctccagggaagcctgccatattgtaatttggctatcaggcatgaaagaaataattctaagtgccaggaatgcaagactgaataaatgtttcactgctgcaggttgtcaagggcgacacttctgatttagtataaacgaatgccccgttgcctttggggtaccgggagtttgcattgtatctgagctgtgtgtataaaacattagtctaagaaaatggcttcggtgtaagatgggaaacagaggcctgctcccagaaggcggcggaatgtttacaactaatcactggatgaaaggattttgctaccttctataatgacaggcaaacaggatttgcttttcctgagatggagaataatggttatgttaactctgcctcacctagcctttttttttttaaatgaaatgctcttttgtaaagaaaatcacatctgtttccttttatatatgaaagggatataaattctttttctttccctccctctgtgtgaatagcccgtggtgtaccttggaattaaccctttctgatgtcctcgggtttcagaggtctggaaacatgaccaccacttccttctccctggctcctgacttcacacacctgcctagacagagagcgtctttagaagtggacagcgatcgttttcacttgaattttcactaagatcccaaagccaattcccggcataccgagctccacgggatctcactttccactaacaaacttcccgagcgttcactgtatgcaatgtagaaaacagtggtctaaaaagcagtgcctccctagaagaaatgccactggaagtttcttcctagctgtggcctctgttgaccatctgggacctggcttcaggatcatcttaagatctgttttattttcccttgattctatgtggggatattctttgaagatggtttccaccatgtacttccttgcttggatgtcactaaagtaaaggctcgggtacctgtttagacatgacagaacagcagtcacaggaaaagaccatttttccatttgttctctaggcaaaggccagctggggtaaatcaagactgggctggggagcacctggacctcttttgctctcaagtcttgatttgggaagaaaccaacctgacacttggactcccctcttgaagtgaaacttcattattgcctctcgcctacagttgaagtgaaactgcattgttgcctctcgcctgcagttgaggtgactctcaggtgggcttggcaagaatgggagtgaaaatgataacttaaaagataactaggcgggcatggtggttcacgcctgtaatcctagcactttgggaagctgaggtgggcagattgtctgagctcaggagttcgagaccagcctgggcaacatggtgaaaccctatctctactaaaatacaaaagaaattagccaggtgtggcagcatgcgcctgtagtcccagctactcaggaggctgagacaggagaattgcttgaacctgggaggcagaggttgcagtgagccaagatcatggcactgcactccagcctgggcaatagagcgagactccatctctacaaaaaaaaaaaaaaaggataactaagtgtatggtcagatggtcagatttactcatccctatcaaactgacgcaggagattcccatcatagcaatcccttcagccattccactgttgtagattgtgtcatagggttgtaatacaatacacagatcccataagagacagcatcttacaatgtttctcttcagtaggtgaagaatttttaaattgtaggtggaggacactgaagatactgttcattcaaactcacatttcttgctccttcacttaaatgacacacaaattattgggtattcgctctgtggtgggctttgggggtataaaaataaatgaggcaggtcctctgccctcgagtaagtcatagttaacaggaaatgcgcatcaaaacataaaagcaaccacatctactgtgatgatacaacactgaaggtgggtgaaacccacagtcgagagcctgacagtcacagtcgcaggagaaaatgccagttgaacatactcacctctttaactttcttcttctacttttcttttttttctttctttttttttttttttcttgagatggagtcttgctctgttgcccaggcgaccttggctcactgcaacctctgcctcccaggttcaagcaattctcgtacctcagcctcccaagtagtcggaattataggcgcccaccaccacacctgcctggctaattttgtatttttagtagagatggggtttttcaccatgttagccaggctggtctcaaactcctgacctcaagtgatctgcccgccttggcctcccaaagtgctgggattacaggcatgagccaccacacccggctgcctctgcaagtttcaagggccagcttaaatttaggtttaaattgtgtacccactacatgccaggtacaatatttagctactttcacttatattatgtagtttaattctcttccagtggatgattattcattgatattaagattacagaggttcaatattaagagaaaatgaagtaaaccttgcaggcaagcaggaacatactggaatgtgtgaccttttcctcatcagttatgggagattttccaaaagtatgaatgtctgaaaacccaaacatctacagatagggtcccctcctagtgttcctttcttccaggtaatccaaaacttctcagaacatcagcactcgtaaaaatgaccaaacagagttaactctgcaatatcattcataccacattcaaggggaatttcagagattttctaagtgtaactgggttatgtgtagttttcacttaagcccggactcgaagctcaactcctacacgattgtgtctctattgcttgttgaaagggtgatatatgttcagaggaaattgtgtctaagtccacattaggcctgaaagagggatggtcatggaagacttcattgaggtggtgattttccagaatgcatgaattaggagaggaaattccaggcagagtggccaagactagcaaatgctaggaggaggtgacagagtatggctggctttgggttgaaagactagaagaaaagtagtggcagaggtgaagttacaacagtaggcaggtggccatgctctgctggttgatgttattgtgttgcctacccgcttgctttgagatctccagacctgtggttttcaacagggagatgacttggcccccaggggacatttggcaatgtctagagacatgttggttgtcacagttaaggaaggggtgctactggcatctagtgagtagaggccaggaaagctgctaaatatcttacaatgcctgggactatccccgacaacaaagaattgtccggcctgaaatgtcaatagcgctgaggttgaaaaagccttttcgtctagaccatggccacttattttcatgctgttctggtgtcatggaggcaaatgcaaagcaagtttaaactttgtgtgttggaataaggatgtctcaggacaaatatttatttggaatccctgttccttttgagccagggaatagggtggggaggcagcagagagagcgactttagggagaaatattaaccttgcaaatgtgcgcattttcaattcacatcctagtgacaggctacaacttgtaatcagtataaaatgattttccgggagagtaaatgcttattttcactgtcttgatgttggcactggattacttggtattaatcccagggtgacagagtcacatttggaagccgtgagatttatttggatgtctcgcagggccaggggcagccttcattttacatccttgatcttggataatttaaataatagagctgcttttctgtatacactagtggtgtgaaaaggaagttatccacctaggacatattccaagagccacagaaagccagggaaggaagaagagaggataagaatgtctccatatttattgttatctccatgcttagcagcagcaactattattacaacaaacaatgaacacttattaaacaccgactgtgtgccttcttccctggcacaagagagcaagaaagtctttgctattgtgagcagtgctccaataaacatacatgtacatgtgtctttatagtagaatgatttgtaatcctttgggattataatggacccagtaatgggattgctgggtcaaatggtatttctggttctagatccttgaggaatcgccacactgtcttcaacaatcgttgaactaatttacactcccaccaacagtgtgaaagcattcctatttctccacatcctctccagcatctgttgtttcttgactttttaatgatcgacattctaactggcatgagatagtatctcattgtggttttgatttggccagcaaaatttgttaagggaccagagagtaaatatttttagctttgctagccatacagcttctttggcaactactcagctctgatgcaatgtgaagcagccatagataatatataaacaagggagtgggactgtgttccaataaatctttatttacaaaaacaggcagctgggccagatttgtcctggaggttctaattcatccgctcctgatcaacagcatatactacacttttgttttgttttgttttgttttgttttgttttgttttggtttggtttgagacagagtcttgctctgtcgcccaggctggagtgcagtggcacgatctcggctcactgcaagctccgcctcctgggttcacaccattctcctgcctcagcctcccgagtagctgggactacaggcacccgccaccacatccagctaatttttgtatttttaatagagacggggtttcaccgtgttagccaggatggtcttgatctcctgaccttgtgatacacctgcctcagcctcccaaagtgctgggattacaggtgtgagcgacagcaccaggccgttttttttgtttgtttgtttgttttttgtttttgtttttttttttttacaatcacagctcactgcagcctcaaactctggggctcaaacaatccttccacttcagcctcctaaagtgctggaattacaggcatgagccaccatgtccagcccagtgtactattttaaagacattccttctgaatatttaagcaatgatattaagaatggcaaaatagccgagcacagtggctctcgcctgtaatcccaacactttgggaggctgaggtgggtggatcacctgagatcaggagtttgagaacagtgtggccaacatggcgaaaccctgtctctactaaaaatacaaaaattagacagacgtggtggtgtgcacctgtgatcccagctagtggggatattgaggcacgagaattacttgaacctgggaggcagaggttgcagtgagccaagatggtgccactgcactccagcgtgggtgacagagagactttgtcttaaaaacaaaacaaacaaaaaaagaattagtaattttacatctctgaatctagtcctaagaatatctttggctttgcacatacaaatttttgcacaaatatgttcactgtggtaatacttagaataataaagacatggaggtaattttattggtcaatgatagggcatcagagaaatcttgctctgtgatggagcaatgaaatattgggcagtcttagaaagtgatcattctaggccaggtgcagtggctaacacctgtaatcccagcaccaaggcaggtggatcatctgaagttgggagttcaagaccagcctgaccaacatggtgaaaccccatctctactaaatacaaaaaattacctgggtgtggtggtgcatgcctgtaatcccagctacttgggaggctaaggcaggagaatcacttgaacctgggaggcagaggttgcagtgagctgagattgtgccactgcactccagcctgggcaacagagcgagactctgtctcaaaaacaaacaaaaaaaaatgaaagtgttcattctgaagggttttcatggtgtacttaagatgtaatattaagtcaggaaaagtgagatagaaattgtgccaacagttttgtagcaataagtataaatccacattgcatggaaaaagagtaggaggaaatataccaaattgttaaggatggtgaggctatggggtgacttttcttaaatttaattccaacatggattctttttagcattgtattcattcttttttattttttaaaaaaacttcatctatatttctttggggtacctatgcaggtttgttacatgggtaaattgtgtgtcttgggttttggtgtacagataattttgtcacccaggtaatcagcataataatgcaaaagtagtttttcttttttttcttgagacagagttttgctctgtcaaccaggctggagcacagcggcatgatctgggctcattcaacctccacctcccgatttcaagcaattcccctgcctcaacctcccgagtagctgggattaccgcatgcaccaccacgcccagatagtttttgtatttttagtagagaggtttcaccatgttgcccaggctagtcttaaactcctggcctcaagtgatccacccacctctgcctccccaggtgctgggattacaggcaagccaccacacctggcccaataggtagtttttcaatcttcaccctcctcctatcctccaccctcaaatatgcttcgatgtctattgtctccttctttgtgtccatgtgtactcaatgttcagctcccacttataagtgagaacatgcagtatttggttcccttgttcctgcattaatccgcttagtataatgaccttcagctctacccaccaacataaaattattaaaagagggcaagtgttggcatccaacagatttagctttgcagttctctggctaagcaggtgaccagtgcaaggtgacttaagctgtctgagcttcagctcacttctttgtaaaacacatgtagcatctgactttccagattgatgggaagattaaatgaagtaatgcacataaaacagccagcagagtgtttgtaacatagtaggtaccaaacacattgtacctgttaatatcattattctgtttgttccaagcagtctgtatcttagtttcggtggtgattacataaatctatgcaagggacaaagttgcatagaactacacacgcaaacacacacacacacacacacacacacaaattgtaaaaactaaggtctgtagtctagttaacagtattgtaccaatgtcggtatcccggctttgatattgtactccagctatttaagattgacgtctccacggggagaaactgggaggttacataggactctactatttttacagcttcctgtgaatctatgattatttcaaatgaaagagtttttaaagtacagtaaaacttttttaaaaattctaacgacttccataatttgcatctcatctattcaggtgaggtaggaaaagttaggaatggtttgttattatttataaaaggaaaaactgacagagtgactggttgctcttctccaggtcaatcagaaaataagaagaaaaagaaaagccatgtcactgaatgttcaggactttttaacggttgctgatcctgcctcaaaagttgtcctgtgtttaatgggatttatattccctcaataaggaatgtgacctctgaggtttaaggatagacctgctatctcattctttagatgtatgtaaaaggtggtcaatggacaaggatgtcagaacagaacatagaatcccatgaaccgatgtccccagttgaggtttggaataaggcaaagcaggaacaagtgactgtctcaaagaaaacaataattactcaagtgtttacatgtgcttatcagttttattatttttatgtgtactattaaaactgaaaataagttgtctataaattaagaaaactggcttaaggttgctacagttacaactctccttgcaaaaactcaagtcactaactcaccaaatatctgctaaatatctgccatgtgcagttactgttctggatgttggagatgtgataatgaactagacccatccagtcctgctcttcaggaatgtggtttaggtcaaaaggcaattgattagagcctgccttttcccacttgcttgccatgtgcttttaacagttgcctgggccttaatctccttttcctggccttatttatatagcaatgacaaacacacatgttcacttaccagccccacctcttgcattcaaagcaaacatcactaatcaatctgtctcaaaaaaaaaaaaaaaaaaactgttcttcaattgcctttacctatctgattctctcaaagctccactcatgaaatcccacctgtcccccagaactcaccaaaaaaaaaaaaaaaaaaaaaaaaaaagatccaaagtcccctccacatgcagcctccactggctctgttcctctttgccacttcccactcacctccttcttgccttcccatgtctctgctctttcttggatttaaacaacaaagcctagaagctgcgctagtcaagccaagttctcttcagcatgcggggaaggtagaggagctttaaagtggaggaaagtagaattcagtcatgtgaaatcaaaggtgaaatgataaaaagaataaggacagagcacaacccaccagatcaatgaaataatgtctgagaaagcacttcaaagagtgtccagcacaataaaaatagattgtcctggagaagcagtttctggagtaagaaaaatgtgacttttagatggatcttgaagaattaatggaacctggacctatggaattagagacgatgagtaagcaaagaagaaggaagttgagatggcagtaccagcaggagaaagattctgtgcaggaaagggttgggtgtgttcaaggagcctgcatcagtctctaaactgaggtttcctacgtttatttcctgtctgggacattctgtgacacatgtccaaatggaaaaatcattctccattgagctagccaaatatcttcaataaataatgcaaaaattattaagacattttccagaggaccacaccatttcctgtcttgacaatggagctggatttgacatcagctaattcaagaggttagaaataaaagctgtggccaattcaaacttcccttccaaatgtttttcaataatctgaaattggtccaagagacaggacttgtaatcaacttttttcaaaccatcttaacatctttcatgaagtcatgaacatgaccgtgcagacgtgccattgactaattattgtcctggattgtgggaataggaaggaacattgaaataaacgatgacttcactggtcaacctatggaatgttaaaagaagagggagctaaagggaagatgttccaatagcatgcaacatgaccttggggtaatgagatagacacacattggaaagttttaagcgtgtttgtttgtttgtttgtttgtttgagatggagtctcgctctgttgcccaggctggagtgcagtggcgcgatctcggctcactgcaggctcctcttcccaggtccaccgcattctcctgcctcagcctcccgagtagctgggaatacaggcgcctgccaccacgcctggctaattttttgtatttttttagtacagatggggtttcaccatgttagccaggatagtctctatctcctgacctcgtgatccacccgccttggcctcccagagtgctgggattacaggcgtgagccactgtgcccggccattttaagggttttaatgagaataatacaaaatatccagctcacatgtacgtatcgtggttctgatgcaccagctgctattctaagctgttgacatataccatgtagtttattcctgacaatgaccctgaaagaggcaggcacttattcccattgtacagatgaagaaactgaagtggaggaagttaagtaacttgtccaaggtcacaccatcaaaaaatgaaacagtcagcatacaggtactatctctccaaggaacctccagagacaccaatcaaaagagaatgcatattctccttgcaatcccatcagttaaaaaagagagagagaccaggtatgggtggctcgtgcctgtaatcccagtattctaggaagccgaggcaggtggatcacttgagctcaggagttcaagaccagcctgggcaacatggcaaaaccccatctctacaaaaaatacaaaaatcagccaggtatagtggctcatgcctgtagtcccagctactcgggaagctgaggtgagcggatcacttgagcctaggaagttgaaggctacagtgagccaagatggcgccactgcactccatccagtctgagtgacacagcaataccctgaaaaaaaaaaaaaaaacagagagagaatgctgagaaaatcctgccccaaatctctaaaaattaccaaggcaaacatgtagaaagctgaaactggatcccttccttacaccttatacaaaaattaattcaagatggattaaagacttaaatgttagacctaaaaccataaaaaccctagaagaaaacctaggcaataccatttaggacataggcacgggcaaggacttcatgtctaaaacaccaaaagcaatggcaacaaaagccaaaattgacaaatgggatctaattaaactaaagagcttctgcacagcaaaagaaactatcatcagagtgaacaggcaacctacagaatgggagaaaatttctgcaatctacccatctgacagagggctaatatccagaatctacaaagaacttaaacaaatttacaagaaaaaatcaaacaaccccatcaacaagtgggcgaaggatatgaacagacacttctcaaaagaagacatttatgcagccaacagacacatgaaaaaatgctcatcatcactggccatcagagaaatgcaaatcaaaaccacaatgagataccatctcacaccagttagaatggtgatcattaaaatgtcaagaaacaacaggtgctggagaggatgtggagaaataggaacacttttacactgttggtgggactgtaaactagttcaaccattgtggaagacagtgtggcaattcctcaaggatctagaactagaaataccatttgacccagccatcccattactgggtatatacccaaaggattataaatcatgctgctataaagacatatgcacatgtatgtttattgcggcactattcacaatagcaaagacttggaaccaatccaaatgtctaccaatgatagactggattaagaaaatttggcacatatacaccatggaatactacgtagccataaaaaaggatgagttcatgtcctttgtagggacatggatgaagctggaaaccatcattctgagcaaactatcgcaaggacagaaaaccaaacaccgcatgttctctctcgctcataggtgggaattgcacaatgagaacacttagacacaggatggggaacatcacacagaggggcctgtcatggagtggggggagggggaagggatagcattaggagatataccttatgaaaatgatgagttaatgggtgcagcacaccaacatgacacatatatacatatgtaacaaacctgcacgttgtgcacatgtaccctagaacttaaagtataataaaaaaatgaagaaaaaaaattacaaaggcaataatgcaaccacctcagcacatccaggaagactggatgacttgcccaagattaagtgaagtcaaaaccagtacttgaacaaggattttctcactcccaggtatcaagcaatcccctgagcattcatttctcatctggacatgagaaatgtgcactggacatccaaatacctgcttaccaaatcatcgattatctgccaaagctcttcagcaagtaatagcgttgtaaaaagtattttataattaggagtatctgaagtcagaccaactgatttgaatcagcattaccatttattaacagttctatcaggccaggcacggtggctcatgcctgtactcccatcatcttgggaggctgaagtgggcagattgcttgagcccaggagttccagaccagcttgggcaaaatagcaagacaccatctctacaaaaattgtttaaaacattagccagtgtgatggtgcatgcctgtagtcccagctactcaggaggctgaggtgggaggatcgcttgagcctggaaagtcaaggctgcagtgagccataattgcaccactgcactccagcctgggtcacaaagtgagaccctgtctcaaaaacacacaaaaaagttttatctgtggataatttagatcctgctcaaattatcagtttttttcaccagtaaaatgggaataatcatcatagctatttcatgggattccggaagattaaatattatgcatgcaatgcatacactgagcaccatcccttacacatagtaagtgctcaataaatattcaataataataataaggaaatcatagccacaacatgtgttatgctgtgttcattacaataagactgtgaaacctattttgatgaagcaggccattatagcttgagtaagaaataaaataggcaaacaccagaactttaacctaacaccatgaccactcccaaagtttagcatattactggaaatcgctaacggagcactgcccattattcatgatatgaacagtaaggaatcatgcataatggaacagagtccctgctaacagcagattcacacacgataatttaaacttgtttgtatggaaataaaggacgagtctttgaagtgagccttaatgagattctgcttgatctttggtgtatcctgggagaaagagttcaatttttcctccagcatctgactcatgttggtggcgtgcaggaaagaaagggctgacttaaattatgaatggcctttcttgtctttgtgatagcaggtgaggagggtggcactcatccgggggcactggggagatgcagggagacaatcacagttctccgaggtggcctctgcatctgaaacttagaggaaggcttggtgggctggagcctcggaaggcattcgtcatccagaaggatgctttacagactctgaagaagcaaaataagctggtgggctctggcaggagacgcagaggtactagtgtggccccgcaccttttcaaattctgcttgtgcatgaaagggattcagctccatcccaagctcatgctggaggagacctggcaagcagtcgccttgccagtcgctgctgacctggctgctgaccaactctgaagagggctcggtgtttgctcaacgtggcctggctgtcagaaggtcccaggaagtgggttgtgttttggttgccaaatgcaagagagtatgagttttgagtttttgaaatcagttcaagtcatgggacaggtctacctcattaagtggccattagatttatgatgaaaagatgacgactgtggagtgctgtgtacaggctggccactcactgtagagtgcagagtatagactggccactcactgtagagtcctgaccacaggctggccactcactgtggagtgctgagcacagtttggccacatactgtagagtgctgagcacaggctggccactcactgcggagtgctgagcacaggctggctactcactgtagagtactgagcacagcctggctgcacactgtaggatgctgagcacagcctggctgcacactgtagggtgctgaatacaggctagccacacgttgtagagccctcagtgcctgctagatgtcattttatttttctttttacctttatcactttgagggctttttcaagtctatggtctttcaggctcaattaattgtaactaagcctctgagacaaagtgcttgttgaatgtcttccactgttccgacacagaaacgcagcataagtcgaagttgcaatggacagcatacgtcgaaacttcctctgtgccagactccttgtggggactctcttctcatcgcctcctttagtcctcaccactgccctatgaggaagaatgtgctttttaacttcattttacagatgagaaaactgaggcccataaggcgaagttactctctcaagccagtaagcagtaggaattgggatttgcactcagcacccatttgatcccggagtccgctttcttgattgtactctctactgcctcaccttcaatggcttcctctaatggaaaagcctgccctcaccctaatgaatactctcagctgggcacagttaagggatgacctctgtgcatctaatgagttcatctcaatccctccccagggtacagatgtgttgtgtaacttgggcatcgggaagtccaggacggagcaaaacagaggagggtgctctcccagacctgtatcatccacctccgttatctcccctcacacagactcaagaattcagatcccacctatgttgccttggtattctaacaaacatctctcatgtttaagctaacatgtcctaagcattatgttaagagggtttcatgcattcaatcatgtagaacttttattcccatttgaccaatgaggctcctgaggctcctgcaagttaagtaaccagcccgagaacacacagcagctgcctggtgtgtcaggacattcctgcatcgttggtgtgatcgatgcatgcttacctctgtgtgcctgaggcggtgctctgtttggggacactgcagtgactgagacagatcaggtgactgccctcagggacctacactctggaggggagacacaggctaggaacaaatatacaaattagacaacacagtcatgtgtccagtagtgacatttcaatcaacaataggctgcacataggacagtggtcccataagattgtaattctatatttttactgtaccttttctatgtttttaattatactttcttttttattattttgttttttatttcaataggttttgggggaacaggtggtgtttggttacatgggtaagttctttagtggtgatttctgagattttggtgtacccatcacctgagcagtgtacactatacacaatgtgtggttccttacccctcactccttccaacccctcccccccgagtccccaaagtccattatgttgttcttatgctgttgtgtcctcatagcttagctcccacttataagtgagaacatacgatgtgtggttttccattcctgagttacttcacttagaataatggtctccaattcacaggtttctgtgaatgccatcatttcattcctttttatggctgagtagtattccatggtatatatacaacacattttctttttttttttttttttttttttcttcagacagagtcttgctctgttgccgaggctggagtgcagtggtgtgatcttggctcactgcaagttccgcctcccgggttcacgccattctcctgcctcagcctcccaagtagctgggactacaggcacccgccaccatgcctggctaattttttgtattttttagtacagatggggtttcatcgtgttaaccaggatggtctcgatctcctgacctcgtgatctgcccgccttggcctctcaaagtgccgggattacaggcgtgagccaccgtgcccagccatataccacattttctttatccacttggttgatggacatttgggctggtctatatttttgcaattgcgaattgtgctgctataaacatgagtgtgcaagtgtctttttcatataatgacttcttttcccctgtagtgggagtgctggatcaaatggtagatctacttttagttccttaatgaatctctacactgttttccataatggttgtactagtttacattcccactggcagcataagtcttttctatgtttagatgtatctagatacacaaatactcaccatgggtgttgcagttgtgtatggtactcagtacaggcccatgttgtacatacttgtagcctaggagccacaggatataccatgcagcctaggtgtgtaggaggctatgccatctaggtttgtgtagtatgctccctgatgttctcaaaataatgaaatcacctaaggatgcatttctcaaaatgtatccccatggtttagagatcatttctatgaaaaaaagcagcagaaagaggcaaaagaaggcactgaggggaaggatgtgttagtttcaatggggtaaccaaagagatcagcctgagaaagtgacattcgatgcctgacctgaatgagtggagggaggtggaggaaacacatgccaggcagtgggatgcttgtgtgcagagtccccggggcacaaacaagttggggaaacatcaggaaggtgcttctgccccaagtggggtggaggaagtgagtgagtcagaaaggagggttgcactcagccacatcaaaccgaactttgattctgcagcctgttctcctacccaccacactgttcagctcccagggctgcctcaaaaacatcaactcccaaatttcagcttttatttcagatacacggggtacatgtgtaggattgttacctgggtatattggaccaaggtagtggacgcagtacccaacaggtagtttgtcaacccacgctcccttccctcccgctctccagtagttcccagtgtctgtcattcccatgttaccaccgtacatgctcagtgtttagctcctagttatgagaacatgtaggatttggttttccattccttcattaattcgcttaggatgatggcctccagttccatccatgttgctgcaatggacaagatttcattcctttttatggctgcatagtattccatggtgtaaaataaaagctgaaatttaaaaacaactacctcaaatcacttttagattgaggctccataaataaatgaaattaacccagattacaacaaaaaatcaactcctgatgtccactttacctgaagtttctctcttctgcgggttccccaagtctctttctttttagattattaccaaatgtagataccctggaatccattctctttttaaataatttgaattaaactaagataaatgtccaccaagaagtgaggagtagagaactctgtgtgcagcatccacatctggtctgtgtcctccttcatgttcacggatggctctgctgatggaggccaccctgagtgtgtgtgcggtacacatgccatgagaaaggggtgccaatgtggctgctcacacacagaaacgcttccatctctgagagctgtcgaatgagagaatgtgctggtgcttttatactgaagcatatcaatagtggatttgtcaaactagccccgtattcaggtgcgagtcttcagtatttccagctgaaggtctgcggctcgtaggctctgggcatcttcccctcttctggcacagtttggcttcttccttctgctgaatggatgcattctttacacttttgattactaaccacagccgtgagccaaaacgttataattaaataaaataaacagatcctgggatgagtctttgaggaaaaagcagtcttttaataatcaaaatcttcatgcattttatttcatcattatgctaagatgttgagagaaatggatttctagaatatgacctggccctgactttgtgtctagtcaattacaagttcgagctaaccacctcaacatttcaaggatggccttttctttttctttttttaaaacagcaggactaaaatttcattgtattgaacataaatgggaaaacgtgcattgcagagtaaaatttaaaatgcttttatggaattttcattataaaactgcctgtaatggagttgaccttatattcacctaagatttctctggctccgagttcagatttcatgccaattaacatgttaatgacatatatcatttaaaaagcccatcataacttttatcacatcatgttacatctatttccttgtaattaaatcagaattacagggtgtaattacttttcttttcctgaatacccattccttttcagacatttaaattcaagtgcaagtactaaaagacacttgaaagtaacaacctaataaaaatattatcagttaatgaaagcgttgggtttctcctactctctggtttctttttgacaaattcctatctccccatgtactttgcatgacatgtaatgattggtcgtatccagtcaaatgcttcctaagctctttaaatcctcagggccctagtctctattaatatgcaacgttctcacacataaatataattacatacaattattagcggaaaaggatcagataaggtttattaacgaaatatcctataatcatccaagtccaagacttccccttacatgctaattcaatgaagggttagagtctgtaatcactacacctgcattgatcactgatggcaggatcaaagaaggggaacacctttgtttaaaagacttaaacaattattttgtagacaattctattatctgactgcttctgttcttccacgcactcttcgacatccaatttaaaacttaaagttggccgggcatggcagttcatccctgtaatctagcattttgggaggccgatgtgggtggatcacctgaggccagaagttcgaaaccagcctggccaccagggcgaaaacctgtctctacaaaaatacaaaaattagccagctgtggttgcgcgtacctatagtctcagctactcaggaggctggggcaggagaatcacttgaacccaggaggtggaggttgcagtgagctgagattgcaccatggcactccagcctgggcagcagagcaagactctgtctcaaaaaaaaaaacaaagttgcatcatacttaattttggaaacttgttgtaacttgaagtagtatctaagaactgggaagtaatcttacaggcgtgtgctgtcctatgatgatctattaggattgtgtgggcagaaccaccggggactgacatatattatttgaggaagtcagcacttgaaggtaggtagaaaacgaactcctttgctgtcaggaagttctgcatacatagatcaaatcactcattcatttggcaaatatttattgagtgcttataacagctaggtacttttttagtcctaggtactattttagtcctggtcaaggtcattgttgccaaggtgccaacattctagggaaagagaacagaccataaactagtaaacagaagaataaataagataattgcagctagtgatgagagacaagaggaaaagatagcagaacaaggtgataaaaagaaatagtggccaggtatggtggcttatgccagtaatgccagcatttcaggaggccaaggtgggtggattgcttgagctcaggaattcaagaccagcctgggcaacatggcgagaccctgtctgtatcaaagatacagaaaattagccaggcgtcatggtgtgtgcctgtggtcccagctactctggaggctgaggtgggaggatcacttgagcccagggggcagaggttgcaatgagcctatattgcaccactgcactccagcctgggtgacagagcaagaccctgtctcaaaaaaataaatacttttttttaaaaaaaagaaaataaatagtggtgaggtggatgattctagacagggtagatgatgaaggcatctctgaggtatctaacttttgagctgagacctaagtagtgtgaaagagcaagagaggatcagggggcacagaaccaccaactatcaaggttataagagggagagagctgatgttttggaagaaaaagagcaggtggatgtgtctagatcaaagggagcaggatcacaaagatggcggtaaaaagatggcaccatctatgtagactctccgggctgccaaaagcttacagattttgctctaagaatgacagaaagcagctagaaggttttaagccaggaggtgacattattcaaattacattttgaaaaggatattctgggtgtagaggctggatttggagaggcaggggtagaacatcagacatttaggaggctgttggtgccatctgggtgagcaaaggaaccagcttaacctcagcttgacctacctgtgccaggacacaggtagagtccctggtatggcaggtggacaagcaagggccactaaacaggcatgtggcagcttgcaggaacccccaattcctcctgaccatttcttgaacaaatatatcatatctaccatgtgccaggcattgttttaagctttgagaatgtagaagtgagcaaagcaggcaacatcttcttcttatgggtcccaaataatgacagaagagcaagtcaggcgatgaaaggtgtattggcaaaaactaaaacatggcgtggggattgggaagaacagggaaggagggagagacaggtactttagattccaggctcagggaaggccacatggaaggcatgatatctgcatagtcctgaatgaggtgacatcaaaatgcaacccaaatgtcaactggtcccacgtcttcctaatccctacattttgcctctgttttcctttgatgccaaccccaaactcagccccacttcagggtctctcactaaagcaccaatgagcaatggggatgtcagaaaatgttcaccagggaaacacagcagtgggggtaacatcatgtgtacagtgacccctgacgaagcctctcccacatttctctagaaaaatcctaaagatttcttttctcttccccgctgcatgtgacctccagctttcttcttgaattcctttcttcttgatttctcttgtttccacaatatctagtcctgctttctgctgcaatgcagagcaattcagcttggcccccaatccacccaccaagccctccagcatactcagcaaaacaatgctcttctgtgaaaaggtgacacagtggtcatttttgccccttagagtttcacctcctcattcctatcacaagtggctcaatatggtatttctccttaaaacactcagtgccctcactaagagaaattcttttgaatgcaattatcaccttgcaaatgggttatggacaggcatgtgcctagaagttccccacttattgagcccagagattcatttccatggaatctcgtggaaatgaagaggatcagaagccacctaagtttgcacagcttcttcctgtccatggttacctatgtttactctctctccacatataaagtcaggctgagatgagaaagtaagggaattcttgccatacatctatggactttggtttaaggcaggggttggcaaactacaaccagtgaaaaggtcttattagaacacaaccatggccttcacatgcaggttgcccatttctgctttttcactatggtgcagaacaaactcattatacagcacaaaagcagtgccatgtgatacacatgggtgtgactgcattccaataccactttacttctggacactgaaatctggctttcatgtaattctcacatatcatgaaatactattctttaattttttccaaccatttaaaaatgtaaaaacaattcttagcttgcagactttacaaaaacaggccacaggatgcatttggcctgtgggtcacagtttgccaccctgatttaaggggttgttaacaaacatgagaccctctgagttactgaatcaatctcagcatcacgaggtctcagcattctggggagaaagcagagctggtgtccggctgtgtctggactccccctgaatccgccaggtggccagtctccagaatgcctgtccttccacagaaatgctatccctttccgttctccaagtttggagtctgagccctttgaggaagggtcctccttcttcatcctgatgtccccagcgttcgacacagagtccagtaccaagcaggtactcaaaccacattagtggagaaaagcaacccaggaacatatgaaagacacagcatcttttgtgtggttctcaagccagtctctaatatcgttaatgcatttgataagataaaatcattacttactagcaaaatgaataattagccatttctcaaaacctagtaggataggcaagaaggaggaagacagggagctatgtgtacataagagtgatatgtctaagtgacttcttgaaatacagagcccattgtccccactctgcagtggaaatccatcgatttccaaatgagttgaggccatttcctgacagttgggaggaaaggggccaaaccgttgggctcctattcgtcttcagcattttacaattaagagctggccttgtttaaagcccaacctgtcattactgttaatattgagatcggacactttgatccgaatggaacctgactgcctgatacaacccaaagttaagctgcttccaaacgtatctttcactctgtatatcatcctagctggctgatgtctgtttcaactgagcagtggggtgatctcacgatggtgcaatggagaactgatgttgcatgaacttttctgctgttgtttcttttccaactgacagcttagccctgcaccctaggccagcctattcttctcgtagagacggtcactgattccctctcttctgattagcctgggcaatgattgggataatttaggacgtgcactgtttgatcatctgtacacttacaacaaataaaacattttaatatgagcagtcactgcatgtttactgtatcatattgctgagagctgaacaaatgccaaacgctataacagaaggggggatgtgaactccagaatgatgacactaataaggaaattacaaaaggcccaacaaatggcatttatgttaaatcaataatgctctgtttgttttttttaattctaatctttcttcagaaaaaaaaaattatctttctaaacagttggcgattcctattcttgttcgtcttcctgaacataattaaaaacatgttgtggcgcctacttaagacatcaactttcccaaggctgtcttgtccactgtgttttaaacaaagacacttgttttggcattgtgcccttaattaatcatttgaggctttattgctgtaccaaaaaaaaaaagtgtctttgtttaatgattcatcacaagcccaatttctgcagaacttaatcaaatacagaaccaactttctaatcagcttgaatattaaaaaaattgatgtagtccttgttttcaggatgttgtttgataaaagaaatattggtatgtgacactctgttcatattggctttctttcatggaattctttcatgaagatgagatgaacgctttgcttttggagtcgagaatggaagtccattgttgattgagaaaatagaaactttgacagcccagtgaatgtcatttagcatctgggccttgcagagctggggacaaagccttgaaaaaggtcttcagaattcacatctttgttttcttttcttttttttttttttttttttttttttttttgagacggagtcttgttccgtcgcccagactggagtgcagtggcgctatctcggctcactgcaaactctgcctcttgggttcaagagattattctgtctcagcctcttgagtacctgggattacaggtgcatgctaccacacctggctaatttttgtatttttagtagagacagggtttcaccatgttggccaggctggtcttgaactcctgacctcaggtgatccacccacctcggcctcccaaagtgctaggattacaggcgtaagccaccgtgcctggttttgtctgccatttttaatgttcactctgagaatcagagggcgcatcccaggatgaaggtgactctgggacatgctgaccgcagctaccctccctgacttaccacttacatagatcaggccatgggctctcccctactttcactcagccttcaaaccaccagctccaccagcttcctcatcaaacttgctttctccaggcacatccctgagcagaattcacttaaaagttactgatgtaagaaaaaacagagcaaatcaaggcacctgtaagttatgccaaggcacctgtaagttatgaaaaaggtctcagtacgataacaaaatcggtggaggaggaggcatagcatttgaattaaatcaacttacaaaacacataactctctgggcttggcatacataacaacctaagaagaagtttgggaattctgttattatcgtcacattattattattattattattattattattattattattagctgtgttatatttatgaaaatgtaaaatccatggtattgatcataagcaccttttttttttttttggcacggagtctcgctctgtcacccaggttggagtgcagtggaactatctaggctcactgcagcctctgcctcccaagttccagtgattctcctgcctcagccttttgagtagctgggattacaggcatgcaccaggacgcctgggtaacttttgtattttagtagagatggtgtttcaccattttggccaggctggtctagaacttttgacctcatgtgatccacctgccttggcctcccaaaatgctgggataacaggcatgagccaccatgcccggccattggtaccatttttaaagcactttaatatgagctgtaattcaatgttccctggatcctgctccttcaagtcaaatattagtgcaaatgccacttatgaaacactttcctgttcataactgtgaaccatgttcagcattttgggggtatcttcttctataagacgggaagtggggccttcatgtcacagaagagtgagtggaggctacgtttgacctgaagtttttctacagctaggaccatggccttggcctccctcaaccttcctgacatgatgtggagtcccaggggcctccagtctcaactcatcccagacttggcatgaacttatgtaaagggagaaaactgtgagcacttccctaaaatctaagggcagcctgcggactctgggtctccaagtgagctccatgtcttggcctggggcaattaggaaacagtggttaagagcagagctttagaatctgacagacctggcctcaaatcccaactcctactgtgagcccctaggacacttaacataagctctctgaacctgtttcctcaccttaaaaaaagtaacttaagagtacctaaggctgaggatgatggctcacatctgtaatcccagcacttcgagaggctaaattgggaggactgctcaaggccaggagtttgagaccaacctgggcaacatagtgagacctcgtctctataaaaaacttaaaaattggacaggtaggttggcacgtgcatgtaatcccagctgcatgggaggctgaggcaagaggatatcttcagcctaggaagtcaaggctgcagtgagctctgttcaagctactgcacttaagccaggatgacagagcaagaccctgcctcaaaaaataaaataaaataaaaaaaagagtacctatctcatagatggaattaaattagcctattcaagcaagaacatttaacaaagagtcccacacataatgagcattaaataaatgttaaaacatgcatacatgttgaataggcatgttgcctgaagggtgatcaaagcatcattttctttctttctttctttcaattctgttcagagggaataaacattcccctcccttgaataagacttcaggcaactcatgacttttctgctcactcttagcagggacgagcccatggtcccattaagactcagttcacagatccaattcagagtcagaaaagtcaggttaacacgtccggtcctgctctgggctggaggcacccagtgggaaattggagaagggctcgattcttctctatggctgctcctctggtctcctccccagcctgctgacaatagcttcaggatagttagaaaagggaatgggacaagaaaggtcccagccctggagcaaggctactggttcccagcctgtgtgctccaggagaatgatcaaagctgacccattgttggttttgtttttattgtggtaaattacacataggataaaatttacgcttttaaccatttttaagtgtacagttctgtggctttaagtgaatacaaactgttccacaaccatcaccaccatccatctccagggaaacaagctaactcttgatttctgggcactcacgggttctgtggacggttccctctgggccgccacttatgaagttccctgctccgggcagaggcctccgtctctcagggggtgcacagtgactctccacgctgcttccaaatgtcaagggtccaccttcagcccctgactaagggacagcctcattaaacacgcctcagcaccaccacccacaggctctctcccctgcagggcctgtaacaatcactccccactccttccctaaacaaactgtcagaggtcagctgatccaagcaagcggattcctcctgaaacccatgggagcagctagaagccttctgtttctggaaagacctccgatcccagtcctcaggttggagctagggaccagggctctctggctccctggcaggcctcgacatcttcttaacccacccccggtattcctgtcccaacaatactcgggtttgtcttggctcaggttcccccagaagcctcctctaaaacaaggattcctgatcccaggaacccccaataggggagagcggaagagggacagggaggggaagagcagctgatcatgcacgatgtcatcgtgggtaactggcccttgatcctttagagttctgggagcagatgtagaacatagtcctcagagagagctggggtgtttacaaaccaactcccgctgatcggtggctgaccgtggcaaggcgcggaagtgagggggaaggaggccaggtggagggatttcactttcagtcactttgctgcagatgtctccgccagtgggcgctggctgccagagaaagtccccagacaaaggatgcaggtgctggacttagaaatcctgcagtgtggccaggtgcggtggtgcacgcctgaatcccagcactttgcggggccagcgggagatcacgtgagctactagctttgaatcttagttctaccacttgcaagttgtgtgatgtcggggaagtcgcttcacttccctggctcagtttccccatctgataaatgggactactgaagtatctatttcatatggtgggtaggagatgacacgagttaatatgggtaaagcacttagagaatgtttgacacatagcaaggactactccattgtgaagtattttccatccattggaattgcataagcacattttagttttctatgccaggagacccagtgcagcctttcaaactaatgaaggaaattcttctatgctgatacagagcaattgcaagagttattacttagtggaaataccaagtgtctatagtattcacctttgtgttaaaaataatatctacattatatccaaaaaagttcttaaaaataatattaatatagccagtaatcccagtactttgggaggccaaggcaggaggatcacttgagtccaagagttggagaccagcctgggcaacatggcaaaaccccatctctactaaaactacaaaattagctgagcatagtggcacatgcctgtagtcccagctatttggacttgagcctgagaggtcaaggctgcagtgagccaagatcatgccactgcacttcagcctgggtgacagagcaagaccttatctcaaaaaataaaaatagaaataaaatttaaaaaatttaaaaagaataatatatacatatacacacactcatgtttatgtagagaacatttctggaaagatcagaaatgagccctcgggttacaggggtactttatatttttgtagtgtttgactttttactaagttcttgtactgttttttcccaggaaaacttttatttaaaagaataagccagtactggctcaacatagtggctcacacctgtaatcccagcactttgggaggccaacgcagaaggattgcttgagcccaggagtttgagaccagcctagacaatatagccagaccccatctctaccaaaaaataaaaggattagccaggcgtggtggcacacacatgtagttccagctactcaagaggctgaggtaggaggatcacttgagcccaggagttcaaggctacaggcatggatggcatgactcttttgccagcagcctgccaggagctaagatcataccactgcacttcagcctgggcaatagagcaagaccctatctcttaaaaaaaattttatttaattaaaaaatgaaaagaacaagccaggactattctcagtggtttaatagcactagacttaaaccaagggctcacgcaagcacatttccatgtgaatcttgctgattttcttgttaataaagctgctgagcttggtgaagtgaccagagtgaccaggctcctgagtgggcagacctgggtctgccgccttccagccacgtgacctaagataagccatgtcactgtctgcacctcattcttttttcagatggacaagaacagcttcttcagggtttttagaggattgattgagataatgtttgtaaaatgctgaggacagggcctgtcatatataaataggggttattattatacacggtggctgatttctaactgcgagctttacaaaggtggcagcgaatcaagatagtcactattgtcatttatgcaaattaagaagacaacacctagaaaagaaaatatctttcccctctctctttcatttgcctttaacatactccattattgaaaacccttaaggcttctgttgaaaacttacacaatcaacacattaaaaatcagcaaaatgccaggttggctattgtctaagattcatctttgtagtctaatgaatgtcttaagaaatgccagtgggagaaaaaaattaaatattgcaatgataaaatgatcagtacagatgattccagagaagcaggcactgtagctcctatcgctctgctctccactggggccccaggcccctcattgccccctacagtctctgctccttcctctgctccccaccccttcttcctcttcctccaggcaccccatgcaccccacacacacagcctcctactctacaggcctcccacctagcacactcttactatcctaaaactattacagataatttacctacctgtacttgcctatgcagctgcccccaaatctgtataatatcctaaccccataatataaatagtaaacaaaaagaaagtttattatagtaaaacgtgatgtatgtgtgtatatacatattatatgtgtgtatatacatattatatatgtgtgtgcctgtgtgtatatatgtgtatgcacacatgcatgcttgtgtactataaatgtatgtgtgtgtgtagatatacacacacacacacacacacacgcacacacaggcatgacagtgttaggagacgtaagaggaagtctagatttaagaaggtaatatttaatgtactgttatttcccccttttctttatattgacattttgaaacaaaagctaaataatgcctgtgtatagatgtgtgtatatgtacatcctggtgaatccggtaactgtcaggagggtcatggagctagaaaagaagggtttcagtggggactaacgcagtcagctctgcaatttaggagggttgctctggcacccacgtgaagggcaggtgggtggtggagacgagtggaggcagagaggccatgtgaggccactgccatgctgggcaactacagcaaggattagagggagatgagagagaaaggctcacagtgggcagaacacagaccccagagggcgatttgggtgttaggtacaggtcttagcggtcatcaggatgaaggcggtgggaagtggagcaacagagatccaaatatggaaagagcacgtgctgataccagaggcactggaaataatagcaatatccgaaagtctgctcaccctgcgtcattccttcagacagtagtcgggctctattcacttgttagttttcccacagggctgtgagcttgagagctagttcttcgccctttctaatctctgtagcctctaccaggaaaaagggtatcagcatgccaggaccagtgggctaaatcctacccagcacctgctataaagtttcagggcacagtcacacccatcgtttacatattgctgccttaactctgcaatggcttagttgagtacctgttacagaaaccctatggcctgcagatccaaaaatgtttaccatttgaccttttaagaaactgccaaccccatgatctcccatcatgctgagaacatagtagatgtcccacaaatatttacttagtgtgtaaatgcaaatcataacaacaggacttcttttcgtcacatagagaaataatccattgattctgttttgactggcacaccccttggattgcatccccaaatgtgaacctcttttttcccaagtcattcattctcccatttggttcaatcctttggagaattaattcttgaaaaaggctgatctcaggggagcccctgaagacagaagactaaaagttttggaatagaaaatgttttctcaaccttggcactactgacattgtaggcagacttgttctcttgtgggaggctgtcctgtgcattgtagaatgctgagcagcagtgctggcctgcaccctccctcctcccctgcatgactctcaaagctgtctcctaggagccaaagactccttccagtagaaaaccatgactctagagagagaaactgtaggtaagaactaagcaccatcttgcaaacatccctgaggatatctatatacagacacagacacacacagacacacacacacacacacacacacacacacacacacaccatagttttttttttttatttgtttgttttgttttgagaaggggtctcgctctgtcacccaggctggagtgcagtggcacaatcttggcttactgcaacctctgcctcccaggttcaagcgattctcctgccgcagcctcccaggtagctgagaatacaggtgcataccatcactcccggctaatttttgtatttttagtagagacagggtttcactatgttggccagactggtctccacctcctgacctcaggtaatctgccggccttggcctcccaatgtgctgggattacaggcatgaaccactgcacccggctgttcaccagcatcattttttagaataacgtgataggaatttgcacagcctcccttcataacctattctaatcactcaactcagcctatcagaaaatttctgatgtctaacctaattcctgcttgctgcatttgcttctcttttttttcttatcctatcttcaacaaaaactaaaaaatagggatgagctggtatagatgcttgccataataatcctccttctatggcagtctctttacaaagaaatctggagaatacataataaaagtaatcactcattcagcaaacactgaggacctcctcagctggtcctgctttgagtgctagagacacagcaaggaacaagagtgagcagggctctgagctcacagagctacattctagtaaaaggagcaaatcatcaaataaacaaaacaagataatagcacttattaatgagtgtttgacgccataagagtggctgtggctgaggttggaggggacccttagctaggatggtaaggaaaggtcttgctatggagggaatatttaagcagaggtctatatgattcaaaacagcctgctgagagagtaaaggggagaaatatctgctttccatgtgttccccattccaggttttccatctaaaatgggtgtgggatcctactacttcccaaggttcccttttttctgatgggaaggaaagaagcctctacgtggtcctggattctctgagcagcttcaaaaaacagccctcttgattagcctgatgcagcctgaggatgtcataggcgtattagtctgttttcacactgccgataaggatatacccgaggctgggcaacttacaaaagaaagagagatttattggacttccagtttcacatggctggtgacacctcacaatcatggcagacagtgaaaggcacgtctcacatggcgacagacgagaagagagcttgtgcgaggaaactccccttcttataaccatcagatctcgtgagacctattcactaacacgacaacagcacaggaaagacctgcccccatgatccaattaccaccccccaggtccttcccacaacatgtaggaattcaagatgagatttaggtggggacacagagtcaaaccgtatcaatagggatttcctaaatgagaagagtccatgccaaaagttagagactcccaggttctcaataagatcaacctgaacctgaagtactctcctccccactcgctcccagctcagtccaggccgccaaaggcctaacactaaggcaggccacccagacaggtgtgatcatagctaggatggtgtttgggtgggggagaccctctgactaactcctctaaagccaaaatgtaaacatccgggttcatccctctctctcctccagcctcctccactcagctcctgtctgtctttcaaagttcaagccatcctgtgcaatgaagcagctcttgttgggtgaattaacaacatgaggaaaagctagatccatcgggaagttggcgctaattgttagatctaagaggaaaaaagcaactgtctcagcattaagccgctttgtggaccaggttgttttgttctacttgtgactcgggctccccgtcaaaccgcctcagacacatggcaggtgtcactcagacccttctcactcactagggtcctgcagacattagctcacatctgggctacttttactaacagccagacgttggggaagccacttacactctttggactttcatctttttatcttcaaaatggaaggatctcctttggagggttgctatgaggatgagagataaggtatgtgttaataataataataatgccatcatgcagtgagtttctgctatgggttagacactgtgctaaactctttacacaaatatctcatgctcacaacagccctaagtggagggtccattatcactagctccattttacaggtaagaaaggtgaggtatagacattaaacaccatgcctaagtttgcccactctataaagagcaaagccaatatttgaactgaggtttattagactccagagcaggaggtcttaaccacaggccccttccacagcgggcagtcaataacaaatagtcttcattgcattatagctatgaccactgggagaatcagagtcaacaagtggcactactctaaccaccctcactcctgacaaacacgggacatgtgagagatctgtggccaccttgctggggcagaaggggcagctcattctgttaagggacactgatgtcacctattgatgtacagtgtcccagggcctgcatgacaccacgctgccgatctcctaatacgtcctgctgagccaggcagctgacataattatgcaaggaccatctgtcacttagcccctctctgtctctctgcaccgtatataaagcaggaattcagaaatttagtcattcactgttcaactaaccttcactaaatgtccactaagtgccaggcactgctctatacagaagtctacagatggacgtaaatgctgcactcctggtgttcacactggaaggaaagagtccagaaagtaaaatagataatatgtttagaacacagaaagaatcaaatgcctatggtggcagggtgggaaaacagggaaggccaggtacagggaggatgctcagttcaaaacagagtggtcagggaaggcgtctcagagaaggcggaaaaggtgtgtcagccgggcatgcagatatctaggaaaggacattccagacagaggaaaacagcaaaagcaatcaatgacccagaggtgaatttggattgttagagaaaagtttcacaaatttcattcctggaacaccaagctcataagacattcattgaaaaaaagtgggccaggcgcggtggctcacgcctgtaatcccagcacatgaggccaaagcgggcagatcacgaggccaggagatcgagaccatcctggctaacacggtgaaaccccatctctactaaaaatacaaaaaattagccgggcttagtggcgggcgcctgtagtcccagctacttgggactactgggagtagtagtcctgaggcaggagagtgggaggctgaggcaggagaatggcgtgaacccaggaggcagagcttgcagtgagccgagattgtgccactgcactctagcctgggcgacagagcaagactctgtctcaaaaacaaaaaagaaaaagtgtgtggggtccaataaatttttgttaatgcctcatgctgtacaccccacttttggagtttgtgttacccattagcataaaaagggacagaagatgggaagtcttgcagtaaagtcttgctcagctcaggctcactcactcaaacatatttgactacacagacatttcttcacataacacctgatggtatctcacagagctacgtttcaatggaaaccaatctgggaaactttggcataaactcaggaccctttccctaatacagtttcttgattctctgtcccgcattgggtcattcagcaaacgctcactgagcagcctcttactaaatgagagacactgagctagatttggctggagatggagcagagaataagactcactgactccatctaaaaagtcatggccacagccacggtcagccctaccatgttcaatatcaccgcagatggcgagcctttaggccatgtctccttcgagctatttgcagacaaagttccaaagacatcagaaaactttcatggtctgagcactggagagaaagtgctcctgcctttgcagaattattccattatgtacctgagtggtgacttcacacgacttaacggcagtggtggtaagcccatctacagggagaaattggatgatgagaacttcattctgaaacatgcaggtcctggcatcttgctggactcaacacaaatggttcccagtttttcatctgcactgccaaaatcgagtggctggatggcaagcgtgtgatgtttggcaaggtgcaagagggcatgaatcaatatcacagaagccagggagagctttgggccaggaatggcaagaccagcaagaagattgccattgccgactgtggaccactctaatgagtttatcttatgtttttggttttttttttttttttttttttttgagacggagctctgtcgcccaggctggagtgcagtggcgcgatcttggctcactgcaagctccgcctcccaggttcacgccattctcctgtctcagcctcccgagtagctgggactacaggcgcccgccaccatgcccggcgaatttttgtatttttagtagagacagggtttcaccatgttagccaggatggtctcgatctcctgaccttgtgatccacccgcctcggcctcccaaagtgctgggattacaggcatgagccaccgcacccggcctatcttatgttttatcttaaccagcagaccactgcttctgtagctcaggagagcaccccgccaccccatttctcacagtaccgtatcatattgtgctcttaatgcagttcgttgggtttcgtattttctttattcctgtctatggctagctggactgccgagttaaggttatgattatgaaataataactaaataacgaaaaaaaggtcatatccacaaagcaagccaatgtctgccagggaagattaaagtgtgtgcatgctgacccttcccttgaattcagtgacccaaactttccagtggacagttcttggaaatgaacggttaaggaccactcctaccccaaactcctcctcttgtcacttgtgagatttcagctgttggtctcacctgcattaggagggcactaagatgattcttatcagatccatgtggttttaagggaaaggagtggtggttgctattatagacgagacgaaaggaaaaactcacagcaatttatacgttctcaacaccttctcaagaagaagagagttgaaaaaaatctcagaaccacccccctcagatgcaatttcaaacatacacccacatacaacaccccaaccttaatcagcctttgagttagattaaattgacttccagcaccacaaacacacccgccggccaggcctctcattaccacctgcacaggattgcttttcaaaggctgggcttttctcattacaatctcgagtccaaaaaaataggaagcaatgctgggaggaggggagagaacaaaaccttatttattcacacataaaatatacttattctaatcacccctggatacactgatctccttcaatatacagtcaggacttcacgagcaacatgatgcagtgttaagaacatagaatgcaaataataataatatctatacttaacagtagtaatttgatttcctggtttgagaagctgctattaagggcattacctacttaactcctcaatgcgttcttagtccccattttatagatgagaaaacagagatctacaaagttgcagtaatttgcccaaaaaatcacaaagaaaggcgtctagccagatgagaaacccaacacctacactgtctcctggtaaaaggtatatgatatttgggttgggcgccgtggcttatggctgtaatcccagcactttgggaggctaaggcaggcggatatcttgaggtcaggagtttgagaacagcctggccaacatggcaaaaccccgtctctactaaaaaatatgaaaattagccatgtatggtgttggctttcaggaaggctgaggcaggagaatcacttgagcccaggaagcagaggttgtagtgagctgagatcatgccactgcactccagcctgggtgacagagcaaggttccatctcaaaaaaaacaaacaaacaaaaaaggctatgatatttgaaccttggtgtgcttgaatttcagcctgagcacttctgaggcaagataccttgcatggatcacatattttttctgaaactcaacttccttatctgctctctctgcaactctaggcaagagtgcccatttagcccagggtagggcctcaacaaactctattccctttccttcacccagagttttctctagactttgccaactgctttgtttaagacaatctcccaaagtcaatatgtgctggaaactgtgctgagaacttgcacatgtcacctcattccgcccatgcagcgttactgaaaaatgcattggttccccctctgtttgactggcgaggcaactgatgcttcaggatagtcaacaactggtccaaaatgaccacactgtcaagtaatcaactcatagtttaaaccaatggttctcaaagcaggtgagtttcgggggatatttgcaaggtctggagacatgtttagttgtcacgcccagggggtggtgctgttagcgcctacagactagagtccagggatgcagctaaacaccccgacgacgcgcaggacagcccagccccgctgcaaggaatcatccagcccaaatgtcaatagtgccaaagttgagaatcctttggtttaaaccagatttatctgacatcaaagtcgatgaacttgcactgttttgcttccctaactgagggtttctcagcagtactgacatttgcagtcagataattctgttatggcagctgtcctgtaggatatttgtaggttatgtgtaggatgtttgcagcatccctagtttctacccattggatgccagtagcacctcctctcaaatcgtgacaaccaaaaatgtctccagatattgccaaatgttcccagcactcgctcctctttcccctggggggcaagtcattcccgtttgagaatcattttcctaatttaaggaaatgagctatgaaatgagaataacaaaacagccctgaaaaatattaagagaatatcccggatgaccattatttgcatgtgtttttaaaaagtagatatgtctgtttaagtatacacacatgcacttacatatgtagccatgtatatatataatgtttcatacctgggcacatatggcaggaagaaatattgaccaacctcttttttttttaaatttttttaatttctggggtacatgtgcaagatgtgcaggtctgttaaatagataaacgtgtgccatggtggtttcctgcacctgtcaacccatcacctaggtattaagcccggcgtgcattagctatttttcctgatgctcttcctctcccagccaggcaggctccagtgtctgttgttccccttccacccatatgtccatgtgctctcattgttccactgccacttacaagtgagaacagtgtttggttttctgcttctgtattagtttgctgaggataatggcttccagctccatccatgtccctggaaaggacatgatctcattcctttttatagctgcatagtattccatggtgtatatataccacattttctttatccagtctatcattgatgggcatttgggttgactccatgtctttgctattgtgcatagtgctgcaatgaacatatgtgtgcatgtatctttataatagaatgatttctattcctttgggtatataactggtaatgggatttctgggtcaaatggtatttctggttctaaatctttgaggaaccaccacactatcttccaaaatggaccaccctctttctatccctgcatgtgagttctcacttctctcacttgggttccagagactacatagcagagcagaaatatagtgcagtgttccctttcttgttgtccatgttctggttttggaacctcattatcattccaaaatgaattagatcttaatttgaaacaaagctattcactcagagggacttccagccctcagacactggacagcagaagagtccacaaaagcatgagagggtccaaggtccagcatcagagtcaggtgctcatttccctgcaaggaagcccatccttctccagtaaactaaaaatttacatctgaaaaatttgatgcgtcttcacgggtgtatattgagaatttccatgtctgggaaaattgaggcacagccaagttctagcaagctctccgtgatgatataaaacagaggtaggcaaacttgttctctaaagagccagatggtaaacatttcaggtcttgcaggtgatgcaacctccattgcaactattgagctctgccattatagcatgaaaacagccacagacaatataataataggccaggccatgttccaataaaactttatttgtgaacactgaaatttgaattgcaggtagtgtttatgtcataaaacgttcttttgtttttttttttctcaccatctaaaaatataaacattattcttaacacctgggtcatacagaaacaggtagcaggctgaatttggtccatccctcccttacatagaacatgacaaaaaagggaattcctgctgtctccaaaaaaacccataaattcccacttttctatccttaagatgaaagaaattaccctcgatattgggaactcagttcagttaccactataggaattaatctaccaatatctgaacttctggaatgttctgtttacctagcccaggataaacaggggaggacaaactccgagtaactgagtgctggctttttttcttttcctgctatgacttcatgaaagggttgtttacggtaggaagtaaccaatgattttgattgcttcaggacttcctggttaaaaaataaaatggagaagaagaaagaggaaagtcctcaagttgtaagctttggaaatacaaagccctcaggtcctgtgtaaaattgaacatgaaaaataggcctctaatttctgtcctctctccctaagcagtcaaccattggagaaggtgactgggggagacccttggctcagaacttcttggtggttataaattctttatcaactatggcttatgtttttacagggaattttcttcttcctcttcttctttttttaagttacggtgatcacaattttcagatttttgactacttatcaaactttttttccctccccctcttaacagagaaggtcagtcacttttaagatataagagaatttgagaacagattaatgacaaagataaatgatgatttttattttagcggaagtttcagcgcgttttctgcccagcctgggtactgctaataaagtatacttgacatataactgcgtaagttctttgctttaaagttcaatgatggatcaaaagagagaattctctctttagaaagaaatgtcctggaaggaaaaataaaaggaaggtggaggggaagctcatacatcccttttgtctttttctcttctctttgtggcccagagacagagcattgagtgacttcttcagaaaagagatcagtgaaattgtcagttgattacttctccttgattagcatttataagagccctgtgatacagtatttgcattcctatttagccgtgatttttgtggggcaccaatgattaaacttgtcacagggcttgattgacggggtcagatcttcactttctactcttttgaaattaaaaacaaatgtgtcagctcccttcatgggctggagcgccgtgaagctcgcctgccttgtcattgcagataggtcaggaatgttttaattttagggatggattctgcttgtcaagtagagtgtgatggcgtgtggttctggagatgagatgtgaagggtgtagcacaaagaaggggaagaacaaagacaaagacactcacattattagacagatttaattagtctgaatggatattatgctagatgaagcagtgagctgtgaaattaacccttgattacggattggcggatcctactcataaagagaatcaaacctttgtggagagacgcgaggtatgatttcagtttctcctacccttccgggttgcatgccagatccccacccccaccacccacccctgtcgacttaaacaccagaatctgtagggggaaaaaaactgtggaagttcatctttaacttgagcaggcaggtatacctagaaaaggaattccacctggcttcctctcttcaactttagagaaagcaacaagcccagggtggttggatgtgaagctaagaggctcacaaagacacagatttctgaatccaaaatagagaacagaaatagctaagtttgaataagagccatgtattttgagggtctgaagtgaatagctctatccactgcagtagagggtcacctcccgggaatgtttgtccttcatacaatgtgccccccaacttactgctgcctttccatggtcttctccagtgaatcccagctgcatcctgacttccaagaacttcaagcatgttaagaaagggatggaaggcctagagccctcacccagcattgatggtcaactaagaaaagtctctcaaacattaatactaaggactctaacatggagggggacatgggcgagatgggtctgagatcatgtggccttccagaaatcctttaacttatccaaattatctgatttggcacactctggactctactgataaaggctttgtacaaagcttgcaccaactaacatctctatttttaagtgactcagtccaaatcattctccagcactgattccaggaatgagaagtctctgtgggggcatgatgtggaggagaagtatctgttaggctggcccaggtcatgtggaaagtcagcaaattaggaaatgcagaaatggagttagagaatttgctccgcagctctttcacaaactcagtcttctcgttggtgaatgagatgtgtagctccttctttaacaattgtgctgaaatcttaactgtgtactttaagtgccaagaaaggcactgtgtattattattatagctctctgtagaaaacatggcactaattctaagtcacttttctggctctgtctccatccagtcttccttatcacagtttcccactttgatgtataagtggcttcagtttggggaactcctggttgaggaattccctgaacaaacaatttccaagtgtggtcttgagactctgaatcaattgtcatgaattgcagataacttattcccaatcattgttgaaggatgagggtggtcaatgaactcattggcattacactttaattttctgaatggaacagacaaatgggaaattgtaatcctaaccctggctccatttatgaaaatgcaaattctctaactccatttctgcaattcctaatttgctgactttccacatgacctgggcgggcctaactgatactcctcttccacatcatgcccccacagagccgtctcattcctggaatcataaaaatgtcatgcatgtgaatgacaggcatcgcaggtcaggggagggaaactgttgagaatctctgctctatcaggaaatgccagtttcccttcactggcttgtgctttaggtgaccatactgtggaggtcacattgctccaggtagatggttgtatctcaaagtccttttgcttttgtctctggaaaatcagatgattctacaggtaaacacagctatagttactgctattcagaaatgagtattgtttccttcccaaagataggttttgtttctgaagaaatttctttcttagaactaagtgatacaagaaataacccactgcctccgatttgacttcactgaggtttagaggaggaaatctgcctttacgggacttgataagggaacacagagcaacctccaccacagagaattatgcagcccacagtgtcaatagtgccaaaacaaaagggacattgtgatcctaaccccagctccatttatgaagatgataaattccttaccagagaaatagagaaatctcttgatatggtttggctgtgtccccacccacatctcaccctgaattcccacgtgttgtggggggaacccagtgggaggtaatcgaatcatgggggcgggtctttcccgtgctgttctcgtgatagtgaataagtctcacgagacctgatggttttaaaaacgggagtttccctgcacaagtgcttttctcttgtctgccaccatgtgagacatgcctttcaccttttgccatgattgtgaggcctcctcagccaagtggaactgttaagttcattaaacctctttcttttgtaaattgcccagtctcaggtatgtcttcattagtagcgtgaaaacagactaatacacatctcttgtcaggagaatcaaaaaattctattaggggattcctggcacttgatacccttgaccctgaaggtacacagagtggtttagatggtacttgggtgagcttttctatggttatgtatttattttaaagcatattcaattgtgtgtgtgtgtgtcagggtgtcagggtttctcaggtctggcactactgacgttgtgagttgaataattctctggggtgggcagtcccacacattgcaggatgtagcagtatccttggtcctcatctgctggatgccaggactctcaccaggccaggtgggacagctaaaatatctccagatacttccaaatgttctctgagggacaaaatcactcccaattgaaaaaccctactatatatctatgattctatagacattattggacattattgcttaaggggataaggcttctttttttgagacagagtctcactctgtcacccaggctggagtacagtggccctgtgttggctcactgcaacctctgtctccagggttgaagcgattctcctgcctcagcctcccgagaagctgggactacaggctccctccaacacacccagctgatttttgtatttttagtagagacagggtttcaccacattgcccaggctggtctcaaactcctgacctcaagtgatccacccgccttggcctcccaaagtgctgggattacaggcatgagccactgcacccggccaaggataaagctttttaaagttacagaaattaaagaaaaatattatattaaaaaaatagagagagaatacaggtgatagtgctgtggcagaaatcaagaaatcagaaatcaagaaggttatatgtgagagaaagaagtttatgggccatatgcagtggctcacacctgtaatcctagcactttgggaggccgaggtgggaggctcacttgagcccaggaattcaagattaacctgggcaacatagtgagaccccatctcttctaaaaggaaaaagaaaaaataataaaagattttttaaataaagcgagaaatttaggaaacactgatttgatttagtttagtttagtttagttttgttttgtttttgttttgagatggagtcttgctttgtcgcccaggctggagtgcagtggcgtggtctcggctcactacctcctcctcccgagttcaactgattctcctgcctcagcctcccgactagctgggactacaggtatgcgtctccacgcccagctaatttttgtatttttagtagagacagtgtttcaccaggctggtctcgaactcctgacctcaggtgatccacctgcctcagcttcccaaagtgctgggattacaggcatgagccactgtgccaggcctgatttagtttttaattcacattttacgatgtggataactgaaatccagaacatgagatggacttgtccaaaatcatgaagctgtcactccctgtattaacatcactaagacaatgcaggaaaggcacttagggctgggtgcagtagctcatgcctgtaatcccagcactttgggaggccgaggcagatcacttgaggtcaggagtcctagaccagcctggccagcatggcgaaaccccatctctactaaaaatacaaaattagccagatgtggtggcacatgcctgtaatcccagctactcaggaggcagaggcaggaggatcacttgaacccaggaggcagaggttgtggtgagctgagatcacgccagtgcactccagcctgggtgatgagaatgaaactctgtctcaaaaaaaaaaaaaaagaagaagaagaagaaaagaaaggcacttagcacaccacctgccacctagtaataataacaatccctactacatattgagcacttgctatgggacaggtactgttttaggctctttacctgtagcaactcattgaatatttacaacaaccctgtgaggtaggaattattattattcccatttataaaaagagagaagaaaataagttaaacaaatccatggtgaaggtggaagagaataagccattttgtggagctggggatgggaatgtgtgatttattatttatgctttctttcatacctattttaagatatttctctaagtgtctactatgtgccaagtaatatgttgcatgtggcccagaaaatacacataataaaaacacgtaaataacagtcaattattaccattagctgttattcccatggttctgtgtgctgttactgagttagtaaaggaagcctatagctgtcacttcttgcatatcattcatgcaaatctggagaatttgtgggttttttatttaaatagctttaggggtatacacagattttggttacatggatgaattatatagtagtcaagtctgaaattttagtgcattggtcacccgagtagtgtacccaaaatgtagttttttcctcactcccttccaaccctccccacttctgagtctccagtgttcattacaccattctgcatgccttcactcacccataacttagctctcacttataagtgagaacatatggcatttggtttttccattcctgagttactttacttagaataatggcctccagttctgtctaagttgctgcaaaagacattatttcattctttgtatggctaagtagtattccatgctgtgtaaataccacattttctttatccactcatcagttgatgggcacttaggttggttccatatctttgcaattgtgaattatgctgtgataaacatacatgtgcaggtgccttttgatataacaatttattttcctatgagtagatacctagtagtgggattcttggattgaatagtagttctattattagttctttgagaaacctccatactattttccatagtgattgtactaatttacatttccatcagcagcatataagcattcccttttcactacatccatgccaacatctattgttttttgacttcttaataatagtcattctggctggggtaaggtgacaaaatgctcaacattgctaatcatcagggaaaagcaaattaaaaccacaatgagaattttgtttttttcagttgggcttctgaagttttgttacttaagaaaattctaagttaggaatgctttaggctgcaaataaaaggcagctttacttatagtgatttgaataaatcaagattttcttttctcaccatcccaacatccagaagtaggcaacaatggcattgagtcaatggattagtgatgttaatcactaattgacatctggattagaagatgtctctgtgagtcttttgatcattgccttacaactgcaagatggctgcatcatgtccacattcaaggtaggaaaaggagtgaaataacagtactagctacctttgcccctcttctcagaggagcaaatctttcttggaaacccagcagaattctacatgaacctcctcagccaaactgtgtaattttgtcatccttagctgcaagatgctgtgacatatttaactgggcacactgtcacagaaaacaaaactaggattttgtccgggcactgtggcttacacctatagtcccagcattttgaggcactaaggaaggaggatcacttgagcatgggggttctagactgcagtgagctatgatcatgccactgcattccaaacttggggacaaagagagaccctgtctctacaaaaagtttaaaacatacattaaatgggtgtcgtagcatgcacctgtagtcccagcaactcagaaggctgaggctggtggaggatcgcttgagcctaggagtttaaggctgcagtgagctatgttcatgccactgcactccagcttgggcaataaagcaagactctgtctataaaaagaagcagaacaaaccaacacagacacacagacacacagacacacacacacacacacacacacacacacacacacacagaattttattggcaaggaagaagagtgaaatggatattccgtaggtaactaatggtatctgtcccagggactaatccagtagcaagaatgttctgtcagtcctttttaccttttctccccagtcttttctcatcctgtaaccagcaattgactggaaatctgtttatctttctcaattgttaattgatcatcaaatgttgactagatacagtattggccaaaaatttcctaaataaaatgggctttatgaaatgcatttttttgagatgggatctcactctgttgcccaggctggagtgcagtggtgcaatcttggctcacggcaacctccacctcccgagttcaagcaattctcctgcctcagcctcccaagtagctgggactacaggcacatgccaccatgctcagctaatttttttggattgttggtagagatgagttttcaccatgttggctgggctgatcttgaactcctgacctcaggtgatttgcctactcggcctcccaaagtgctgggattacaggcacgagccaccacacccagctggaatgtattaataatgtaatcataatcatcattactgctactaccaccaccacaagaataacctgttgagtatttcccatgaattctaagtgtttcacatacattatctcatgtaatcatcacaatgaccctccaggtattatcatcattcaaatttaaggtcacccagcttggaagaggtggatctagaccttgaacccaagcccaagccactgtttttgcttttaaggtgctgacaatacaataagggagacaagagtaactcataagaagtagtctaccagtactgcaagacaaaataatactaagtactaaactatgtggtcctggaaataggttttggaagaatcataaggaagatcgttttcatgaaggccacatgtagtcaagaaagacacttgagttgtccgttagggggatattagacttgttttctacgtgtagtggttatcagggtcagttctgctctcccagctacaacaaacacacagaaccaaacagaacttaggaagtctggagagccgcaaagcaagcagacaccattagactctgcgtagatttgtttagagtttgtgggcattgttgaggtctctcagggtctgctgacagtcctgtgaccatctgcctggcagcaaggacttcagttgtttgcaatgctttggccaagccgagagcacgcggatctggatgcacagctgctgagcgtgtgctgacgggcctcagctcctcgagcgtgtttgttcagactggtctgcctaaatccactccaaaattcttccgagccagaaaaggagaacatgtgctttcttttcacatagtatttctgaatgcccatgaatataaaagagagaaaacaaaaccaaaaaagtctaagatacatgatattcccaaacaacaaaaaagacaggaagctttcggaatcagaaatctggccctttcttaagggaattccctgttggtttggagaccatgctggttgttagaaaatttagataaggaacaattttatttctttgcagcacagttcaaccattattttctgagtaccaattgtgtgcaaggtcctgtgtcagattctagagcaagatgctaatggatgcaaagacaagcaagaccatcaggaaactttttggcagaagaagcaataaagacttcactgagaccaggacaagagggtgatttggagcactgctaagatgactgtttccttctttgtttttcccccgccccgggtaatgagcacatattgcagaaagaactttacataaaagttgaaaacgtatctatgtgaaaaaacaaaataagggaaggcattatagcatggtaacagggaactttttttaaattaatttatttattttgagacagagtcttgctctgtcgcccaggctggagtgcagtggcgcgatcttggctcactgcaacctctgcctcccaggttcaagcaattctcctgcctcagcctcctgagtagctgggattacaggcgcgtgtcaccacgcctggctaattttttgtatttttagtagagacgtggattcaccatattggtcaggctggtgtcgaactcctgaccatgtgatctgcccacctcagccttccaaagtgctgggattacaggcatgagccaccacacctggctgtaagaacatttatttggaaagcagctttatgcaagctcaaggtcaagctctccctcttgctaagtgtgtgacttttagtaagttatttatcaccctgtgtctcagtttcctcgtgtctaagatgggcatgataataccccaacctcacaggactgagacaatgcaagaaaagcactgagcacagtgccttgcacgtaacaagtgctccgtcaatttttcttttcaatgatagcaataatgataacatattgttatgatcatcaggcgtagtgcagtatctggaatagagtgagcactcagtgatggtttctatggctgggctgttttttgtgcttccactgttgaagtatttaacacagtatctggcaacacctggtgactcaaagagcaagctatgatggttccaaagctggggctcagggtgaaactctctctatgggagatctctgggattctcctgttcaggcttaacgatgaaaggtaatgtgccttcttttcttttatctccaagaaactacgctagtcagtttgatcctgcccaaagtcgccataaagttaaaattcacaaaaccaaacccagaagctcagaggctgcccagggaaggacacacagtgccctgcggtgtgtctgtgtttctacatctgaagccgtggacgacgtacctagacagaagatgccacggatctggccccagggcttattttatttatttattattattattattattattattttttttttttttttagatggagccttgctctgtcatgcaggctggagtgcagtggtgggatcttggctcactgcaacctccgcctcccgggttcaagcacttctcctgcctcagcctccccagtagctgggattacagtcatcttccaccacgtccggctaattttttttttatagttttagtagagacacagcttcaccatgttggccaggctggcctaaaactcctgacctcaagtgatccacctgcctcggcctcccaaggtgctgggattacaggtgtgagccattccacccagcctcctttcctcctgttcacttactcttggccctagcaattctgtgtgattccaggataagcctcatgctttttttggaattccatcttcttgctcccattgtcctccttgtctctttcatatgaatgttttctatatttcaaagccctgctcaaacaccacctcctccagaaaggctcctggtatcctctttcttttctaacctagaaaagagtatgccctcctctgggcacctccagaatattctctcacgtcttatatgacatgtgtcaatctgtaccttgatttataatcacgtgtgtgttaggactatggattgcacatgacagaaaaatccactcaggccaggcacagtagctcacgcctgtaattccagcactttgggaggccgaggcagatggatcacttgaggtcaggagttcaagaccagcctggccaacatggtgaaaccctgtgtctactaaaaatacaaaaattaggcaggcatggtggcaggtgcctgtgatcccagctactctggaggctgagccaggagaattgcttgaacccgggggacagaggttgcagtgagccaagattgcaccactgcactgcagcctgggtgtcagagcaagactccatctaaaaggaaagaaaagaaaagaaaagaaaaaagaaaaatccactcaaaccagtttaagcacagagggattttactggctcctgggaaggtcaagggtgcaacagattcaggcaatgctagatccagtgcttaagtggtgtcactggaaatctggccttctccacccgacatggtttggatctttgtcccctccaaatctcatgttgaaatgtgatccccaatgttggaggtggggcccagtgggaggtgtttgggttatgggggcagatacctcgtgaatggctcagtgtcctccctgtggaaatgagtgagttcttactctgttggttcacaccacggctgactgtaaaaaaagtgtgacacctctccctctctctcttgttctctctcttgcgtgtgatgtgcctgctcctccttcaccttctgcagtgagtaaaagcttcctgagggctggccagaagcagatgccagcactatgcctcttgtacagtctgcagaactgtgagccaaaataaacctcttttctttctaaattacccagtctcgggtatccccttatagcaacgcaaaacagactaatacacagcctctcaaatctcctggaaggatgtacttgggtgtacttttctttcttttttttttttctttttttttttggagacagagtctcactctgtcacccaggctggagtgcagtggtgcagtctcggctcattgcaacctctgcttccagggttcaagcaattcttgtgcctcaacctcccaagtagctgggactacagatgcccgccacgacaccccgctaattttttgtactttagtagagatgggctttcaccatgttggccaggctggtctccaactcctgagctcaggcaatacccaagtgctaggattacaggtgtgagccaccaagcccagcctgcaagggcataattttcatgtggtggctcagaaacctccagcagccccaagttgagccgtcataataagaaaatttattttttaggaagaaatctctcattggactacctagggtcgtgtgctcatccctggaccaatcactgtggctaggagaatagaacatgctgattggccagacttgggtcacatgcccagccctgtagcttggaagtggggtgagccctatgggatcccctgacctaaaaatgagaaagcagtggatccccaaataaaaattagggctgggctgggtgcagtggctcacgcctgtaatcctagcattttgggaggccaaggcaggtggatcatctgaggtcaggagttcgagaccagcctgaccaacatgatgaaaccccgtctctacaaaaattacgaaattagccagacgtggtggcacacgcctgtaatcccaactactagggagactgaggctgcggaatcgcttgaccccaggaggcggaggttgcggtgagctgagatcgcgccattgcactccagcctgggcaacaagagtgaaactccatctctaaaaaaaaagaaaaattagggctgtcgcctgaaggaaacaacaattatttatggcagttatacagttcctgcctgttcatttcttggtaattcatagtgcctagcattttgttcatcataaagtacatgctcaacaaaattatcaaataaatgaataaacaaagagtatgactttaaaatgtacctactgactttgcacatgtcttcctctgacactcacagttatactgtatttggccaagcagagatcacacatcattttgagtatttctccagctcttttagggagtatcttaggaaaccagacatcacaaatccttccatctggagtcagtaataatgcagaagatactaatgtttaataatccaaagtgcctagctcactattaaaaaaaaaatttttaacctaataagagagaattggccgtgaccaagtccttgacctgtctgttggaatcctccctttctagccatttctggtcatgaaaattgggcaggatttctggcatcctttatgcttctttgttattaaaagcaggatcagttaataaataattatgatgctcagtttctagggaacaaggagataaggacaggaacacttgagtctcacaaattacatgctatagtatagattctcacccagagtgaagaatagcctagctttttttttccctgtggcataaattgttctaattatacgtgcaagatcctctattcccaaagatatgagttggaagcgctgtgtctgttcttttaattccaagaagactttgcagttgggtgtttccaccccccttgttttcaaactgaattgtttcagtggtagcttggtgtgtcagcttgtaagtctataaaacagttttataccagctggagattcaacatgctacatgaatacataacagtgcctaaccaagaaggtttgtaattcagtaattagctgtaattaatgaacacaaagtgaagactcatttacagtttaaattatcacattagctcctgtcaccctctatgtacacaaaacagcaggaattcaattatttttattcttcaaagctaatttaaaatttaagggatgccattacatgaaataataggtaggaaatgtaatcgaaatcactgggaacagttggccgtccttagaattaaaaaaaaaaaaatgtgatcactgacgatttggaaatgttttttcatctgtgaacagatgaaggattgaaatctctgctcttttcagtatatttaatttaaaaggagaagcgagtttggtggttgcgggatcttcacgcagggagaatcatggtgcgtaattgtaaaagcagctgataactgataatgctgttgatagtaacaagagggcagcctgggagacacacattccattatccctaatggagctgagccttctgcaattgcagggggttcctggaattgtcacccatttctgatgcatcatttcagcttgggagaccttacgtcattgtcacatttctgtcgtccttaattctttgttcgtatctatgataaatattctttcattcattcatcaaacattgacagagcacctcctcaggctcaggcattgttctaagttccaggaccacagcagtggggaagacaggccacattcctgatctcgtggagccaacactccagtggggagaaacggacaatagccaggggttctcaagtttggctgtgccgtagagttggggaggaagctttaaaaatacatgtgtatcaatgcctggtcccaacctcaattgattgaatcaaattattctcactcctttctttcattacaactctttaagtatgcaaacactttcttagctcaagagctgcacaaaaacaagctgtgaactacatttgacccactcaagccacgttgggaaaaaacaagaccagcaagtgcaaaggccctgaggcaggtttgggcatcagtatttttagcagctttctaggtgactcacatggtcaaccagggctgagaaccattgtcacagactaacaaatacaacaaatacatgtttattggtgatgagtgctgcaataaaaattaagcaattgagtgtagaaggtaactacaggctgctctggattgggtgttccccaatttcttagggaggtggcatgggagacctgagtggtgagaagccaatcttgagaagatctggaaagttgttctatctcagccatcagtaaaacttctgctgctttacttcttccttttttttccattataacccttatttatttgtttattttattttattttattttattttattttattttattttattttattttatttattttgagatggagtctcactctgttgcccaggctggagtgcagtggcacgatctcggctcactgcaagctccacctcctgggttcccgccattctcctgcctcagcctcccaagtagctgggactataggcacccgccaccaaaaccggctaggttttctttttgttttgttttgttttttgtatttttagtagaaatggggtttcacttgttagcaaggattgtctcaatctcctgacctcatgatccgcccacctcggcctcccaaagtgctggtattacaagcgtgagccaccacgcccagcctcgtattttatttttgagatggagtctcgctctgtcacccaggctggagtgtagtagtgcgatctcagctcactgcaacccctgcctcccaagttcaagcaatttttgtgcctcagcctccgagtagctgggattacaggcatgtgccaccttgcctggctaatttttgtattttcaatagaggcagggttttgccatgttggccaggctagtcttgaactcctgacctcaaatgatccacccgcctcagcctcccaaagtgctggtgttacaggcgtgagccatcactcccagccttttcattataaccctttaaatgtgcaaacattctctccactcgagggctgtgcagaaacaaattgcaagccgaatttgacctatccaagccatattctaaagaaaaggatcagcaggtgcaaagctcctgaggcaggcatgagttgagtgtgttgggttgggcagaaagaatgcctgcgtaggtggggcttagctggtaagaaggagtagatgaggttagaggaatgagcaggaatttagattttattttgtatttgttgaaaatataaaggaagattttaagcagggaatgtatgagtgtgtgtacgtgtgtgtaaaggagacagttctgtacccatactctccacagtatgtttccctgcaaccgccactaatctccttccatgccagttccaggaagaaaaggaaaagcaaaccccatgtcaaaagaatgctgtgtctgttgctttggacttctcttttctgcactttccccctcctcttcccatattcatttttctttttcctttaaataggccactcgaagctgcactgtctaatttttcataggtgatcgactgctgagcgggggcttaggtagacagagggaaggtgctgataagccagtgcacggattctattagggaaatgcggtggtaattaatgaatcctgccagtaatcgggaaggtgtgagtccccgtaatatcgtaatgatagtcatctgtctgcgaaccccccatcactctgagagatcgctcatcgctctgtgatctcagactcttagccatgcaaatctccctgacaggacgctatgtctctgtctccctaattgggcattctagagttgtttatggatattgccggcatttaggcctcagttggaggttgttcaaaaagcgttagcaaacttgccttaacaacattgtcaaatatgtattcccccgtttcgatatctgtttttaagccggcagaggtttgtgatgaaattaagtgatgcattgtgtgcacttgagctctgggcgtgattgttattaaaccgtttttgaagtaaaaaccaatttgcagtaatatctcatcccgcttaagatcaaacttcagtttgtgtgcaggaactggatgcttttttaatagcatgtcctcgtttctatagagaacactgagtatgttaatgccatcccaagacacaaccatttgcaaaaattacagttttgcattgagactggtttctaaacatccatcaccatttaattccaaagaagcgtctttactggaagcacttgccacattttcttgccagtatttttttttctgcatacaagtggtcaccctcttgtcttcccccaactggtgtgatcaattgcttgaaatgccatgaaatatatatattttaaaagcctttataactctgataagtgagcttaatatttctgccatgatgtttaagagggatcttttaaatatttagaaaacatgggaagtaccgttttaatgtataatcaacacactttaaaatattcaaatatgaactgggacagtttagactgcatcttgatcaactctaaataggagaaaaattcaagaaattctggcctccattttcttccacatgaaggaagaaagagatgtccatgcaaagggcaacatagatttagaatcctttaaccccgattcttccatccatgagccctgggtggccttgattaagctacctagcctctccgatcttcaggtatcatctgtctcacccatgctcaaatgtcattctaaggcttaaagcaagttaatggctgtgaatgtacatcatttccatgagggaaggggcttggcagtcacacccaagtagctctgctgggagaacttgaacaaatcactgaatgccctctgagccatagtttctgcatccgtaaaatgagccagttatacacactttgtagggtaggtctgaggagcagagataattagttgaaagtacccatgaagctggagacccagaagtctctccaccaatggtggctactgcctgttgaaacccgtggagagctaggcctggtgtgttccaagggcattcgcagagtggatgggggaaccaaggcaccatcaacactgaagagaggtttggagagagggaacgcgtccctgggaatcgtctctctagagtttaagtacggtggccagccatcatcgttttcccgggactgaggcatttcccaggacaagggactaaaaccaggatgagaagtcaccctatgtttgaacaaatctcctcttcagcccaagaaatggacaggtcatggttcactgaagccccagtttccctgagaaccttctccatcttccattctgagctctgtttgctgattagtcgtggttctctgtcgcacattctagcatattctggaaactctcaagaaacaaaagttgctgccagacaatgctctccctccacacacggctccatctcaactccacggacactagtgagagagccactggtggctacccctttcccaactgtgtctctattaggtgagtgccggggacaggggaggagtgggcaccgagggaacaggcaagaaaaggagagagtgagtcctccagtgccggtactgcagtgtgctgggaatcaccaggaagggattgagagaggcccacacatgtgggaggggagctagggaaatcaatttggcaggagttaatcacgagagccctgtcagcatttcaaggacaggcttgtgttttcctgttcatccgtaagtaaacactgaaagcctcctcaactgtgcaaacccgctgagtcttttctccgtggacattctagcccgggaagtttctagggtatgtcaaagtgtccacaagccctgtaacctttggtgtgtaaatcacaaacctcccagggtggtctgcttggacagctaggactttcctaccaaagtcttcattcatcccaagtggccaaccagctggagcatctttaaattaaaggttttattttgccacttggccccccagcccaacccctggctcctttttctattctaaatcactgtcccttgctcctccaagctctgaatgaattgcatgtaacgaacatgtctgctggtaggcctctgtcatgagcattgaggccgatgtggttcagtaacctgatgcctcaaacttgaataaaacacatgccagggcctcccatccttgaatgtgaatgtgctggcatttcacattattaaaaaaataaaggcaggagggatgagagggagaaacttgaagtgtaaggaacttttctgaatgcagcagctaccaatcctggatgcaaactgctgtgcagaataattgtcaaatgcttgcataaacacataaataagataaatttattttcatgattcatattgggtgctctttccttccacttatttatgctttaaacaacagttacggtaaatataacgatagaaaagtgcctacagtggacaggaagatgatcaagaagtcctgatatacagcaatccacgttgcttctttacaatcactaacgaatcttaactggagccatgttccgttcccatgtgagtgataagcaatgatttattatgaagtgtcatgaaaccggaatgccatacagtgagccatgagctagtggaaaatgttttccctgtttcccaacctcattactcaaagatgcagtgtccctttaccaagcctaatttaactgacttttttgagcactctactcattggcaatggaaagtggccaattcgaagatgtccaggaaagcctggtacccaatgccacagcactggtccatatggtgtctgagctggccgacaatgctggaactgtgcaaactggccagtctccagaagtacaatcccaagaatcagctcagctctctgccaaagcagcaaagacactaatgcactcaggaaatgaaacccaccaggggagagggaacccaaagagcaactttgttagctttggaccttgtattatctatatgtcatgccattgtcctacttggaacacgtgccttgatcatgtaagatgtatccaagggtacaagggagccagctgagcctagaggaagaccacaggcctcagaggcaagccaaacctggtttggtcccacctcttccacttacctccacaaccgctgtggtagatgcaccaacaaccccagtactttacccgctctgtattcatgcccttgatcatgtcactgtgtggtgtcctctcgtttggattctaggctcagctatgtgacttgctttctccaagcagatgtgatgcaggcagtggcttgaaaagagcttgaacctctgccattgttattacaacatacacagactagcctgctggaggatgaaagagctatccctccagttgtcccatccttgaaacaggaagtgaatagaaggtcagcttttggccaggcgcggtgacttacgcctgtaatcccagcactttgggaggccgaggcgggcagatcaagaggtcaggagattgagaccatcctggctaacacggtgaaaccccgtctctactaaaaatacaaaaaaaaaaaaaaaaaactagccgggtgtggtggcaggtacctgtagtccgtcccagctactcgggaggctgaggcaggagaatggcgtgaacccaggcggcagagcttgcagtgagtcaagatcgcaccactgcactccagtctgggtgacagagcgagactctgtcgcaaaaaaaaaaaaaaaaagagagagaaggaaaaacaaggtcagctttttcactcttctctacttcctccttttttacacctccttttccttggatgggtgttggtggaaagaaggacatgaattcataaattctcatattgatgaaatgctactgcaatcatctcttgccagtggatgcccctggtaaggcaggtatccagggactgactctctagtgggggcacaaatggggtctacagaagtcccagctcctaacatgggagatgagttccattcaggaagacttctaacttctaacctaaacagctgccccactcatggttcacccttcactctcttgcccctaagagccttcctcccctctagggctggaccccataagcaaaaagacagctcttgacctagtggaaacttacacattttttttcttgccacagcatggagcatgtaggaagctcaactgctttccctttttcactccatcaccttcctccaatagcctttgctccttctcaatagtcacagaatatagatcagagactgctgcataagcataacccaacaggaaattagatgccaatctcctcttcttgctggaactcaatcccttcaagtgtttttgtaggaccactcaccggacttcagtgttccccctccaagaattcctccacgaattcctccagtcttttcctaaacaggctggtgcaagaaggagaaactgattagtggcctgttcttctgccacttaataaatcccatggaaatgtgtctgattgctctcccttcccttttttacaccttttattttgaaatacttttagacttcaagatagttgcaaaaaatcgcagtttatgcatacccttaacccaacttcccctaatgtcttgcctaagcatggtacaattatcacaagcaggaaattaacactggctcaatactagtcaccaaaccacagatcttatctgaattttatccaaacgtccttacgctgtttcaggacctaacttgggctcttacattggatttagttcttgtgtgtccttccctttccatctgtgactgtccctcaatcattccatgtcttttatgagcttgacacttctgataaacactggttggtgattttgtgaaatgtctcccactttgggtttatctgatgtcctctcatgattggattgatgctatggatgtgtggcaagtttaccaatgatgtgctctctcctcggtgcctcatattgttactgaaacaccaggggttccatctgtgtcctgttgctcactgcaaattaaagccaaatcaccaagacagtgagtattgccagggaagaagaaatttttttttttttttttttgagacggagtctcactctgttgcccaggctggagtgcagaggcgtgatctcggctcacggcaagctctgcctccctggttcacgccattctcctgcctcagcctcccgagtagctgggactacaggcacctgccaccatgccccgctacttttttgtatttttagtagagatggggtttcaccgtgttagccaggatggtctcgatctgacctcgtgatccgcccacctcggcctcctggaagaagactttaatcgggtgctgcagctgaggaaaggggagatcagtctgaaatccatctccctgattgagtaaaattaggggtttatatagcagagaagaaatataactatgtgtaggaaaacaggagttaaggagggttaaggaagaggagttggtcaacaggaagcaggtagtcacttaggcaatcatgatgaatgaggtgtctggtgtctcattgtccagatgcagtgatctggtaagtttcagttcctggatactatcagggagtcctgagggttggtttcctgagaaaggaactcagataagacaaatgtaactttctcaagttttaagactgggagggtcaatttctgtgtttcctcaaaataaaccataaacatcagttctatcagataattgggctggtttccatatcaggagtttcttgatgttgatttatcttattactggtgatgtgaactttgatcacgtggttaaggtggtgtctgacagcttctgttaagtaggaggcatacagctcctttagtccttaactttgtgtcattccccaaaatgtcatgaaacaagaaggtttaactcagtatcctgttaccctagctgtgtgatttggggcatataatttgatgtttctctggaccacatatttctcttctggaaaaggagactaaaaataaccacctttcaagattgctgtaaagattagtgatcatccaggcaagatgacagatggcctggtaaaccctcaaaaaatggatacaaagaacatcttgagtaatttgcacacattatcaccaactctcccacacacaaaaaaaagatgtatataatcatcacctatttttagaaaagaaacctggaacttgaggctatgtgactcctccagtcatgtccctcccctgtatcagagtctctaatgactcatcaccccccaacactttactgtggtccttcccagatcactccagattacccttttaatattagtaaccactcttaacccctggaaggtatgattaacatgtggtccctggagtcagagagccctaggttcaaaccatacctgggatattttgtgcctgttctttagattctcttctcctttccaaagtttctaactcattgggttgttgtgagaattaaataagtaaataaaagttttcagcatagtgaatagcaagtagtaagcacacaataattatatatgaaatgggtggtaattaccatttactcattcaacaaatatttatgaggcacccactatgtgtcaggcaccgttgaaggctgtcaacagtgactgaacaaggcaagaaatgtccgtgtcctcattgagtttatgttacagtgggtaagatagacaaataagtaaacaagtaagtaatatactaccacatctcttaagcaatgtgttggttaaatgaactcaccaactattccccaaacaagactgtatccttctgcctggctgttctttccacacagaggactacctgttccatcttcacatattaaaatcctacccccttcttcaaggcttagctcagcctccatcagttaattaattattcatttattgattctttaattagactgactactatcttatgggtctgcttctcccaccattaagagtgtcccaatgctattatttatgtacacattaatcaccacccccatgagcctccagagcaccatttacttccctttggcaacattgatctactttttgttatgtgctttgcattctactttcttcaccagattttaagtttgttctctaaggtcagagaccacatctagctaatacacttactgggtgggaccctcttaatgggcctagggcctgatatgtataggtgctcaaatgtttattgattgaagaaatacatcaatgaatgaacatatcttaaccttcttgctgaattgtgattcatagaaggcactggctatgccttactcatttaatatttgtttaaatgaactgagacacagtagtattgaacatatttgctccactaattattttgcttgtgcttttggcctggtctctcttttgatgtccccatctccccctctttaaaatacatccttccatccttagatagttttttgctacattgcaagaattatgtgatggtaaaagaaagaatatgtgtaaagcattttgattgctttggcaatgaggtgctccaaaaatctcagggatcactttttgttgccagtatatagtccctaacttttcttgaactcatgcaggatccacaagaatgagccatttgcctttattctattattgtttatgatttcataaggcattatcactaattttactgtgaagaagactctaaagaccactatttttttgaggcagggccttgctctgtcacccaagctccaggatggagtgcagtggaacaaacatggctcacttcagagtccaccttctgtgctcaagcagtcttctcgcctcagcctcctgagtagctgggattacaggcatgtgccaccatacctggctttttgtttgtttgttttgagacaaggtctccccatgttgcccaggctggtcttgaactcctgtgctcaaccaattctcctgccttggcctctcaaagtgctgggattacagtcatgtaatccaccactcctggcccacatttttctttctagtacctatgcaggctgccaggaaaagaaaaacaaaaggtgccaagtagtggctttaaggatttatttagtttcctctttacagtgtccacttttctctacttaatactactttccagtctcagaagcccagagggaaaaaaaaaagaccatgaatcttcctctcccagattaaagtacacactttggaaaacagattggaaaacctttctgaaaaaagttgactgaaactccaaaccaacatgccatattgttgatgttgctcatgaaaattgttaaaaacctgttctagataaagaacagtctcaagtttttgtacagcctacacatagtacaagggtcccctatgatgattcttctgtaggacgaaataatgtaattttttcagtttctggtttataactctctcgatctcaaagttgactgattaaaacacctactcatgcaacagagaataaagcactcatatttttataaattatatggaccaaactattttggaaatcttatctattggagacacaatatgctggactaaagcaataattattttattctcaatgtctgtgctaacctcaatgacttagaatgctttgctatattttgcctctatgcctcaaccacactggctttcttttagctcttgaacaagccaaactgcttcctgcctcaggaccagatattttgggacttctcttaagaattctatttccttaattctttatctgggtaacttagttttatccaacacttcagatcctgccgtaaaaactcttcttatagaagcctgtcatgacactgtctctcttctccaacatactcaccagcacacatgtagactagattagaacctcctgtttttctttttcatacttttctctatcatgcttccctccattataatatttttattatgtgtgtgaatgtctgccccaagtcagtttcctcactaaactataaactccgtaaagctgggatccttccaattttgatcaccacttagtacagtaggaacacagtaaagattcaattggtatttgtggaatgaatgaatgaattgttttgctagtaaagtctgggggaacccaggtgagaagagcctagaaagcaggtcgaatccaaggctagatagacttagtgttactcaagaaagggtagcctgaaaataaaggttcaaattatagtcaagaatagtcaagacatgggcaagacaagagtgctgtcatcaagtgtgaagaacaaagggaagtcagtaaccccagatgactaatgaaggggacaggagcagcttcagctgcagttcatgcaatgggtctaggcaagtggcttagggctgaactgtgcacagtgtaaggggcttagaggacctactttatgtggcccaggggccagacttagagttcaagggagaatttgagcccatctcttattagttacaggaatttaacaccatctcttattacctacaagaactagagcaggccaagcgtggtggctcacgcctgtagtcccagcactttgggaggccgaggcaggtaaatcacttgaggtcaggagttcaagaccagcctggccaacgtggtgaaaccccatctgtactaaaaatacaaaaattagctgggcatggtaaagtgtacctgtaatcccagctactcgggaggctgaggcagagaattgcttgaacctgggaggtggagcctgcagtgagctaagattgagccaccgcactctagcctgggtgacacagtgagactctgtctcaaaaaaaaaaaaaaaaaggaactagaacaaatcaatcactgtatctctctgagcccactgagcccattgacttcacatgcaaaatggggttatatatcaacacgtacccctacaacaagatagcatagtataaaacaatattatgtgtgtgaaggaggtacatgtttcttccaagttctactcagttcttctaagaagcttctactcagacatgagttctgcctgttgtttgtgtttttctcaaggaacgtttagtgttgtattgctgttagattgctgccttacatatcctccattgactagaagcttcttgaagggaagaagcatgtcttattcaccgtaattttgtcgagcttctggtagcatgcaggttgagtcgggagataaaaatgccaggccttcaggggtttgatgtatgaatgaggaccatgagattataaatcagctacaaggctccatgtgatctctccataagcatccactccttggaagctgtctgactttattcgtctgtatggcacaaaagagacacttggtaaatattgaatgaactgatgaatgaatgaatgaattcgcctttggttaggcatagcaataaagaaaatgaaatttaactttgtcttctagactttgaatgcctctgccaacaactaaatatcttccagggagggcagatggcggcctgtacaatgaacaatttaatctttagaaactggaacaactttgccagcaaactccatttttctctacgaacacattgtcaataacatgtgctctcaaatatgtggtgaaattgatgactgggccctgatttatagaaacaacaacaaattaaatgtttacctttctctttcctagcttggggtccttcagaccagccatgaatttttttttcctgtgctctaataatagaggaggtttaattacaatgctccatcgtgtgattgtgtgtggagtggaagcaaagcaaaatgtccagggtatcttaatttaaaaccaggaggggaaaagccacttatgtgataatgaagattaacgtagggagccgctggctctcccttctcacataaaagcagatattgggggaatccttcatacaaacatttctgtgaccactcatttagcctcttgtaggaaatcttcttgattttggacaaactcgaagctttagatttgcttgaaaataggccagggtaggagagggatgcccagagaaatggaattctccaaacagtaatcaggctacatgtttgggactattcctgggaatgacagactggtttggaagaagtcaccatcctaggacctcttcttctagaatggtggctctgaactcctacttgggtcaagagcctttttgaaaatatcatgagagctacagattctctctccaggaaaatcaagtctacctataacttcatatacacacatgcaccaaaatgctaaattctgcttacaatgtcatctcttgtctttgccataaacttaaacaacttgagtgacaattgctactgaaaattccaggcttcaccaacctttctgtgatgctcatccaagattaagaactgctagacttagaggacccttggtttctttaggccacaaaactgcttaactgtcttaggctgtggacttctttggctgtctgatgaaacccgtggagccctttaaaatgtctttaaaggccaggcgtggtggctcacacctgtaatcccagcactttgggaggccaaggcaggcagatcacgaggtcaggattttgagaccagcctggccaatatggtgacaccccatctttactaaaaatacaaaaattagccgggcatggtggcacgtgcctgtagtcccagctactcgggaggctgagacagaagaatcacttgaacccaggaggtggaggttgcagtgagctgagatcgtaccactgcactccagcctgggtgacagagtgaaacttggtctcaaaaaaaaaaaaaaagtctttaaaaactaatgttaaatgtgttaatgtggctgtccctttcccatccttcaggtcttcattcagatgtcactccctcagagagggctccctctcccctttctcaaagtagccccatcagaactgaaaccctcccaattgtcccatagaatggatggttatggtttcttttgagtaaacatagaaattgactctcccagtcaatttgagaaagtttcatttgtcttatctgagctcctttctctggaaacctaccctcaggccttgcagacagtatcaaggaactgaaacttaccagatcaccacatctgaacaatgagacagaagacctctcacccattatgactgcctgagcgaccacccacttcatgttgaccaaattctctttcttaccactccctaattcctgttttccttcatgtagttatatttcttccctgctatataaaacccttatttcttgtcagttggagagatagatgagattgacctcccatctcctgagctgcagcacctgattaaagcctttttctctggcaatacttgttgtctcagtggttggcgttatgtgtggcgagcagtaggacctagaccaaacccctggcctttcagtaacgatgcccacacctgcaccactcagtcccatcaccctgcttacggtcttcacagcactcacctcatctgacgtggtcttgatggcttgcttgcttattgtcttctcctccctctggaatgcaaacttaccagaggcagaggtcctatctgtcttgttccttggtgtgtcctctgtatcaaagcggtacccagtaatgggcctgaagcaaatgttttcccaatatttactgaaggaatctatgttcactggtaagtcaagagcaaaaaatacacaaagttttgctacttcacctggtctagtggtcatcgggcattattatttcataaatgtatactaataattttagtagcagttgaatatgtttttctttttttattattattatactttaagttttagggtacatgtgcacattgtgcaggttagttacatacgtatacatgtgccatgctggtgtgctgcacccactaactcgtcatctagcattaggtatatctcccaatgctatccctcccccgccccaccccacaacagtccccagagtgtgatgttccccttcctgtgtccatgtgatctcattgttcaattcccacctatgagtgagaatatgcagtgtttggttttttgttcttgcgatagtttactgagaatgatggtttccaatttcatccatgtccctacaaaggacatgaactcatcattttttacggctgcatagtattccatggtgtatatgtgccacattttcttaatccagtctatcattgttggacatttgggttggttccaagtctttgctattgtgaataatgccacaataaacatatgtgtgcatgtgtctttatagcagcatgatttatagtcctttgggtacatacccagtaatgggatggctgggtcaaatggtatttctagttctagatccctgaggaatcgccacactgactcccacaatggttgaactagtttacagtcccaccaacagtgtaaaagtgttcctatttctccacatcctctccagcacctgttgtttcctgactttttaatgattgccattctaactggtgtgaaatggtatctcattgtggttttgatttgcatttctctgatggccagtgatgatgagcattttttcatgtgttttttggctgcataaatgtcttcttttgagaagtgtctgttcatgtccttcgcccactttttgatggggttgtttttttcttgtaaatttgtttgagttcattgtagattctggatattagccctttgtcagatgagtaggttgtgaaaattttctcccattttgtaggttgcctgttcactctgatggtagtttcttttgctgtgcagaagctctttagtttaattagatcccatttgtaaattttgtcttttgttgcctttgcttttggtgttttagacatgaagtccttgcccatgcctatgtcctgaatggtaaagcctaggttttcttctagggtttttatggttttaggtctaacgtttaagtctttaatccatcttgaattgatttttgtataaggtgtaaggaagggatccagtttcagctttctacatatggctagccagttttcccagcaccatttattaaacagggaatcctttccccattgcttgtttttctcaggtttgtcaaagatcagatagttgtagatatgcggcattatttctgagggctctgttctgttccattgatctatatctctgttttggtaccagtaccatgctgttttggttactgtagccttgtagtatagtttgaagtcaggtagtgtgatgcctccagctttgttcttttggcttaggattgccttggcgatgcgggctcttttttggttccatatgaactttaaagtagttttttccaattctgtgaagaaaggcattggtagcttgatggggatggcattgaatctgtaaattaccttgggcagtatggccattttcacgatattgattcttcctacccatgagcatggaatgttcttccagttgtttgtatcctcttttatttctttgagcagcagtttgtagttctccttgaagaggtccttcacatcccttgtaagttggattcctaggtattttattctctttgaagcaattgtgaatgggagttcactcatgatttggctctctgtttgtctgttgttggtgtataggaatgcttgtgatttttgcacattgattttgtatcctgagactttgctgaagttgcttatcagcttaaggagattttgggctgagacaatggggttttctagatatacaatcatgtcatctgcaaacagggacaatttgacttcctcttttcctaattgaataccctttatttccttctcctgcctaattgccctggccagaacttccaacactatgttgaataggagtggtgacagagggcatccctgtcttgtgccagttttcaaagggaatgcttccagtttttgcccattcagtatgatattggctgtgggtttgtcatagatagctcttattattttgaaatatgtcccatcaatacctaatttattgagagtttttagcatgaaaggttgttgaattttgtcaaaggccttctctgcatctattgagataatcatgtggtttttgtctttggctctgtttatatgctggattacacttattgatttgcctatattgaaccagccttgcatcccagggatgaagcccacttgatcatggtggataagctttttgatgtgctgctggattcgttttgccagtattttattgaggatttttgcatcaatgttcatcaaggatattggtctaaaattctcttttttggttgagtctctgcccggctttggtatcagaatgatgctggcctcataaaatgagttagggaggattccctgtttttctattgattggaatagtttcagaaggaatggtaccagttcctccttgtacctctggtagaattcggctgtgaatccatctggtcctggactctttttggttggtaagctattgattattgccacaatttcagctcctgttattggtctattcagagattcaacttcttcctggtttagtcttgggagagtgtatgtgtcgaggaatttatccatttcttctagattttctagtttatttgtgtagaggtgtttgtagtattctctgatggtagtttgtatttctgtgggatcagtggtgatatcccctttgtcattttttattacatctatttgattcttctctctttttttctttattagtcttgctagcagtctatcaattttgttgatcctttcaaaaaaccagctcctggattcactagttttttgaagggttttttgtgtctctattatttccttcagttctgctctgattttagttatttcttgccttctgctagcttttgaatgtgtttgctcttgcttttctagttcttttaattgtgatgttagggtgtcaattttggatctttcctgctttctcttgtgagcatttagtgctataaatttccctctacacactgctttgaatgcgtcccagagattctggtatgttgtgtctttgttctcgttggtttcaaagaacatcttcatttctgccttcatttcgttatgtacccagtagtcattcaggagcaggttgttcagtttccatgtagttgagcggttttgagtgagattcttaatcctgagttctagtttgattgcactgtggtctgagagatagtttgttacaatttctgttcttttacatttgctgaggagagctttacttccaagtatgtggtcaattttggaataggtgtggtgcggtgctgaaaaaaatatatattctgttgatttggggtggagagtcctgtagatgtctattaggtccgcttggtacagagctgagttcaattcctgggtgttgactttctgtctcattgatctgtctaatgttgacagtggggtgttaaagactcgcattattaacgtgtgggagtctaagtctctttgtaggtcactcaggacatgctttatgaatctgggtgctcctgtattgggtgcatatatatttaggatagttagctcttcttgttcaattgatccctttaccattatgtaatggccttctttgtctcttttgatctttgttggtttaaagtctgttttatcagagaccaggattgcaacccctgcctttttttgttttccatttgcttggtagatcttcctccatccttttattttgagcctatgtgtgtctctgcacttgagatgggtttcctgaatacagcacactgatgggtcttgactctttatccaatttgccagtctgtgtcttttaattggagcatttagtccatttacatttaaagttaatactgttatgtgtgaattttatcctgtcattatgatgttagctggtgattttgctcgttagttgatgcagtttcttcctagtctggatggtctttacattttggcatgattttgcagcggctggtaccggttgttcttttccatgtttagcgcttccttcaggagctcttttagggcaggcctggtggtgacaaaatctctcagcatttgcttgtctgtaaagtattttatttctccttcacttatgaagcttagtttggctggatatgaaattctgggttgaaaattcttttctttaagaatgttgaatattggcccccactctttctggcttgtagggtttctgccgagagatccactgttagtctgatgggcttccctttgagggtaacccgacctttctctctggctgcccttaacattttttccttcatttcaactctggtgaatctgacaattatgtgtcttggagttgctcttctcaaggagtatctttgtggcgttctctgtatttcctgaagctgaacgttggcctgccttgctagattggggaagttctcctggataatatcctgcagagtgttttccaacttggttccattctccccatcactttcaggtacaccaatcagacgtagatttggtcttttcgcatagtcccatatttcttggaggctgtgctcatttctttttattcttttttctctaaacttcccttctcgcttcatttcatcttccatcgctgataccctttcttccagttgatcgcatcggctcctgaggcttctgcattcttcacgtagttctccagccttggttttcagctccatcagctcctttaagcacttctctgtattggttattctagttatgcattcttctaaagttttttcaaagttttcaacttctttgcctttggtttgaatgtcctcccgtagctcagagtaatttgatcgtctgaagccttcttctctcagctcatcaaagtcattctccgtccagctttgttccgttgctggtgaggagctgcgttcctttggaggaggagaggcgctctgctttttagaatttccagtttttctgttctgttttttccccatctttgtggttttatctccttttggtctttgatgatggtgatgtacagatgggtttttggtgtggatgtcctttctgtttgttagttttccttctaacagacaggaccctcagccacaggtctgttggaataccctgccgtgtgaggtgtcagtgtgcccctgctggggggtgcctcccagttaggctgctcgggggtcagggacccacttgaggaggcaatctgcccgttctcagatctccagctgcgtactgggagaaccactgctctcttcaaagctgtcagacagggacatttaagtcttcagaggttactgctgtctttttgtttgtctgtgccctgcccccagaggtggagcctacagaggcaggcaggcctccttgagctgtggtgggctccacccagttcgagcttcccggctgctttgtttacctaagcaagcctgggcaatggcgggcgcccctcccccagcctcgctgccgccttgcagtttgatctcagactgctgtgctagcaatcagcgagactccatgggcgtaggaccctccgagccaggtgcgggatataatctcctggtgcgccgttttttaagcccgtcagaaaagcgctgtattcgggtgggagtgacccgatttccaggtgcgtccgtcacccttttctttgattaggaaagggaactccctgaccccttgcgcttcccaagtgaggcaatgcctcgccctgctttggctggcgcacggtgtgcgcacccactgacctgcgcccactgtctggcactccctagtgagatgaacccagtacctcagatggaaatgcagaaatcacccgtcttctgcgtcgctcaggctgggagctgtagaccggagctgttcctattcggccatcttggctcctccccctcctgtcacagttgaatatgtttttcagataaaatcttctacagtacccaatatataaaacagatgaatataaatgagagtaagaagttccaaaaagactctctcagacacacactcctgcatgcccttgttggaaatttctacatcccattctcttctgagaagctcttttaaagtccttcttctggtctaaaattaacatctgagattgctcttcttcattaattacttcatggttaccaggaagctagttctgctcagtaagagatgtaagttatggaggtgacaatttccaacaaactctttttgaaacatctaggggattttctttcccaaacacattggtaaacctattcaaaactgaattctaaaagagagctatggcccaggagcagtggctcatgcctgtaatcccaacactttgggaggccaaggaaggcggatcacttgaggtcaggagttcgagaccagcctggccaacataaagaaaccctgtctctactaaaaatacaaaaaaaaaagaaaaaaagaaaaaaaactagcagggcatggtggcgggcacctgtaatctcagctgcttgggaggttgaggtggaagaatcacttgaacctgggaggcggaggttgcagtgagccaagactgtgccattgtactccagcctgggtgacactgcaaaaccctgtctcaaaaacaaaacaaaacaaaaattcattttcttataaggacaccagtcagattggattagggcccatcttaacagcctcatgtttacttaattacttctttaaagattctgtgtccaggcagtcacattcagaggtgctggggcttagggcttcaatgtaagaattcggtggggacacaattcatacccacaacactggcctccacgctgttggtcaataaagcttttgttgttattcctttaccttccctactgccaccctgccccagccctggcttcagaaggagcagcttgtagctatgggaaccttctacgcaagcttcccattaacttcatttagcttcatttatggctgtgcttgggaggactgaacattttctagtaaatgttataaggaaagcatttaaaatacatatcatagctgctcaacagctgatttgggggtggaggaaagccttgaattactttgagaaagaaagcctggttccatgtttctgcagtgcacaaataggatggcagaacacatgcttggaagcttccaccaggaggtcacatgagccagtggttaaggggcaggggtgatgggagcaagtaaaaagggatccaaatccaggttccacctctaataaccatagtgaccccaactacttgtggtcccatgagccagttgacccttctgcataatggtcatgctgatcatccccatctcccttttgttgtgggggcctctctgttcatgtaaagtgcctcacacaatgcctggtataaggtaagtccacaataactgataacagctattgttgttatcactgaaatgcaaataaatcaacagagcccagggactcaaaggtcttgtacaactagaccactttggctctggattgtacataagatttgctgcctttatatgcagtggtgcactgcacttctaaaataaatatttgtgtatgcttgtgaaggaacttagtctatctagaaatgcagttttaggattgggtgcagtggctgatgcctgcaatcttagcactttgggtagagacaggagaatcacatgagcccatgagcctaggagtttgagactagcctggcaacatagggagacccctgtcttgaaagacagagagagagaggaaggaaggaaggaaggaaggaaggaaggaaggaaggaaggaaggaaggaaggagggagggagggaaggaaggaaggaaggttggcttagggggtagggagaggaaagaaagagagaaggaagagaggaatgtcgtagaattatagaagttatgtgttctaccatgtctctgaaagaaggattaactgattaaatggtagaaataagtgaataaatgaatcctatctgagagcagtagttctcaatcttggtagtgcattagaatcccctgaggaacttttaaaaaccccgggcccaagtcataccctggactagtcaaggcaaaaccttggggagtagggcccaggcatccacaggtgactcctacctggagtggggccaagtgacagaatctgcttagaggcgggagcctcagctggacatctctgagtcacttattaggtgtgaacttggtcaagttgcttaacatctctgagccttgatttcctcctctatcttgaggattaaataagatataattggtaaaacacaggctccctatcgacaatggaccgaagtgctgaatagcaggtgtttcccattattaccgccatcattgccatccagtgcgtaagcctgagcctccatgtcaccacccgcaaaatggtaggggagaaaggatgcctgaagaccctttactttcattctgatgattctatcaaggtagagcaatgggccaagtcaacagaaaagttcacctgtcttcaccaagtgacagccatggaccaggagccatggtggcaactctggagactgttgcacaaacagtcccacctctgctctcctagaacctgaatgctagtggggagacatgtcaaacagtgctcgtccagaccaatatattattcatgacaagagggatctaagagagaggaaatctgaggacctcatctggatcccaggagaagaaaagatctttctgacaacgagctctttaaaccaggggatgaatgtggagtaggaactgtctaggtggagttgtgagaagggcccttcaggcaggggtagaacaggagcaaaggctgtgaggagggaaggagcttggattttttttttctaagagacaaattctctctcattgcgcaggctagagtgcagtggtacaaccatggctccctgcagcctctacctcccagctcaagtgattctcctacctcagcctcccaagtagctggaactataggtgcacaccaccatgcccagctaacttttttactttttactttttgtagagacagggtcttgctatgttacccaggctggtgtcaaactcctgggctcaagagtcctcctgcctctgcttcccaaagtgctgggattacaggtgtcagccaccacgcccagtcagtatttttctttctaagagacacagtctcactctgtggcccagtctggagggcaacggtgtggttacagctcactgcagccttaaactcctgggctcaaatgatcctcctgcctcagccttgcaagtcactgggattacaggcatgagccaccacgctcagcttagaggtagacatatttgaggtgcttttacttaaaacatggatacttgaacttttaaaagcatctttttttcttagagcatcctgggcaacttgggttccccataacatacttcaggaaagggcaggggagcccagtgaggccagggttgagctccagacaaatcttgatttcattccagcttcactgggaaatggctgtgtgaatgcaggggacaatttaacctcccgaaacttcatccataaggagaaagtaagaactcatattttgccactcatttgtaaaaattggtaattattgataataatcaaattggtaaagggaaatagttattacttttgtgtgtgtgtgtgtgtgtgagacagagtctcgctctgtcacccaggctgaagtgcaatggcgcgatcttggctcacagcaacctctgcctcctgggttcaagagattctcctgtctcagcctcccgagaagctgggactacaggcacccaccaccacacccgactaatttttgtatttttagtaaagacgagttttcaccatgttggtcaggctggtcttgaactcctgacctcaagtgagccacctgcctcggccttccaaattgctaggattgtaggcatgagacaccgcacccagccagaaatctttattactatgaagcagcagggtacattggtgacagaaacctgagttcaaatcccagctctgctacttcccaggcatgtgctgttggtcctggtacttagatctctgaccctcagttttctgatctctcaaaaagaaaaaggagtttataagagctatctttaagggactattataacaattaaataaaacaatagcagtcaagcttcaggcaaaagatggaaactcaataaatgaaaactaccattaaaatgaatacaaactcttcttaggaagagggtttggctgaattatttaagtgtgtgttccaatctaccaaccctcttttccagtgtagacacaaccacaaacatcgccaccatgagcttagacatataatcacagtggttaaaaaaaaaaaaaaaaaagactgtaatcccagcactttggggggcccaaggcaggtgaatcacaagggtcaggagttcgagactagcctggccaagatggtgaaaccccgtctctactaaaaatacaaaaattagctgggtgtgatggcacatgcctgtaatcccagccacttgggtggctgaggcaggagaaatcacttgaaccggggaggcagaggttgcagtgagccgagatcgtgctgttgcactctagactgggcgacagagcaagactctgcctcgaaaaataaaaataaaaaaaaaaaaagaaagagaaaaaggaaaaaaaaaaaagtctaccttgtttatgtccatacttggagggcataccgttcttattaaatgccagcaactcacattttaggcagcagtaaagtcccctagctgtgtccatgcagtgaatctcgttgggctgtaagttagctgcaataaataacattggctctgcactccacttagagaagatgggttcactgtgaatcatgttgttggcggtttggactttaagctgtccaggttgtttatggtggtgtttgccagcatgtagacctctttcaaacaatttaagtgctcttttggagtatacgaatgtggctcaataaaaatgggtacaggaaaattgcctcctttctctcttctatggccataccccaaaagcaaccatatatgacaattgtcaagtgttaagtataattgctcaacatgaaattataattaacactgaagccaccagggacattttctctctccattgtcaggatgttgtcctgatctggatgttgtcctgatctttgtgacccttttaatttatcttttgaaaggatggcaacagctgggtagtttttcaatccttatcattttgcattatatagctttactgagcaatgtgcctttggaagattctagttagtttcattgacagcaataaatactggttagagaacaggctttgaagtcaggcagacctaagcccaaaggctggctctcccacttgctaactatctgatcttgattacatttcttagccaatccaaggctctctcttctcatcaacaaatacagacaatgaaatctactgtcaggtagtactgaggaaggcagagcttctaacaagcacttaataaaatggtagatattatgactgttttctgctttcttcttcttaatatccacatcaaatgttttgaaatgctattttctccttttttataaaaagggaaaaattttcttagcttcccttctgaattgacaactgatttcttttcaacatttgtttaatgcagcaacgaaagagctttttgacttcattttttaaatttccagaaggaaagagtggtctattttccaagacctaatgactacttatttgtaacacataagcagaattttatgcatgtatttttaatttattctacatctcattccacagcagttttaagatactgtactatatgcaatgcagcaaaattataaaagaaataatagaaatcattaaagatatctacatttcgttaagcacttattgaacgccaggcaacatttgtgaaaagtactatatattattatcctgattttgctgatgcggaaactgagattaagaaaaggtaagttatgtcccccaatatcacacagctagtaaatggcagagccaaactattaacacatataccaaaggaaaatggaaagagaatatcaaaagaagtttacaggtatagactgcagccttaggaggctacataattactaaagttgggccaccaatttgactctgagcttcctggtagtgaaagcaagaatgcaaacatgatccatcccaagaaccacctttccatgaggatatgtgtaccaggctttaaaagcaagcaacgtcttccctaatacgtagtgtctggaagagatttatgacataacttttgtgacatagtcaaatgcaacagagacgacaggaggttcccgtgatagaaccaaatatttgaaactaaaaaaaaacattctttctgtaaaagaaaaaaaaataacaccactccttcctgcaaaaatgttttacttaacactgggctccatctcttttttataattattcaatccaagctttgtcaaagcatcatactgagaagagattcatgttaaaaagctagtggaggggggtggagtagatagcagagaatgcctctctgtcttatcatttttatttagattgacatacctttgattataattagggataactgttcagcagttaagactccataatcccatcattagttgtcaggagattttcacagggcaaactctcatgccatttctctcatttctgtttcttaactacttgggcagcctgcagttgaagagtgtgctttatggaaaagattttctgctgccattgaaatcttctaagctgacacacagttaaggacacaaatgaaacctccactcttgggaggccccacatcttcttgcctgacatttttgttgttgttgttctccaagatatcgccctgtttctgctggttgcgttcaacagccattttgcacacactggtgaagagatcttaaaccatttcagaggtggcccataaaggaggcaaaaggggacttgccgtaaaaattatttccatagacatgcaaagttgattatataaggtagaggtcagttaagattctctggcatccattacgagacaaaaaaaaaaaaaaaaaaaaactaaaaaaactctcctccaacttgaaagctgaaggcagtgggtcgtctggtttgtgtcatgaaacatacatcatgcatttgagacacatattacaaattgtactttaaaagaggaagttcagaagttgggattttccagtgtgtcaattatgacccgaatgctatctatatttaaatgttccaagccgactatcatgatcatgtccccttattcttcaagggtctgatgaagtacccctttgacaaggaatgaatggtctcatcagtacagatccaactcaacatcaggaacaattagcttggcagttaaacctaaaggctctgaaatcgatattttatatatatatatatatatatatatatatatatatatatgtacatattctaattgaatgttagaatattcggtttcacttataattattcagataggtcacttcaagtctctaaacctagagaggtttttttctctgtaatattggataccttgttggattgttttaataattaacagaaataatgcatatgtggtggatcaaaaatgacaatcatggccagatgcagtggatcacacctgtaatccccacactctgggaggctgaggtgagtggatcacttgaggtcagaagttcaagaccagcctggccaacatggtgaaaccccatctctactaaaaatacaaaaattagctggacatggtggtgcacgcctgtagtcccagctacttgggaggctgaggcatgagaatcacttgaacccaggaggtggaggttgcagtgagccgagatcacgccactgcactccagcctgggtgagtgagactctgtcaagaaaagaaagaaggagggaaggaaggaaggaaggaaggaaggaaggaaggaaggaaggacccaagaaagatagatagagagggaggaagggagggaggaaggaaggaaggaaggaaggaaggaaggaaggaaggaaggaaggaaggacggacccaagaaagatagagaaagagagagggaggaagggagggaggaaggaaggaaggacccaagaaagatagagagggaggaagggagggagggagggaggaaggaaggaaggaaggacccaacaaagatagagaaagagagagggaggaagggagggagggaggaaggaaggaaggacccaagaaagaaaaaaaagagagagaggaaaggaggaaggaaggaaggaaggaaggcaggcaggcaggcaggcaggcagacacaacccagatattactgatatataactgttaaaatgttttcattaactcaaccgttctgaggtttgatagaagaagaaaaaaagagtccctcttgccatttggaaactcagccactttgttctttctggtttattttgtgacctccctttccgacagcaattagtctcagtctctgttgtcaacgctgggaaaactacatggaagaaaggaattaaggaaaggcaatacatcagaaagtgttttaaaatagtatccactcacccacatgaagctgtgtctggcatatcaaaagtaaagtattcaatatatttaagcaattacctgtattttattcactctaagaattgaaatttgtccactaaagttgaagggtttcctcacacagagatttctcttaggaaaaattaaatgaaacactaataatgaaattcagcaatgtagataagccaatttgcatttccaaattgtaattccatttgaaaaatattaactacaggtttctcccaggattacaccgctaagcatcatgtgtctccattgctcctttgcttccttgtcacagtctttttaaaataataacacttggccgggcgcggtggctcatgcctgtaatcccagtactttgggaggccggggtgggcagatcacttgaggccaggagttcaagaatcagcctggccaaaatagtgaaacccgcctcctaaaaatacaaaaattagtcaggtgtggtggtgcgcacctgtaaccccagccactcagaaggctaagacagagaatcgcttgaacccgggaggcagaggttgcagtgagcggagattgcgccactgcactccagcctggatgatagagcaaaaatccatctcaaaaaaaataaataaataaaacactaaatataggtttttcttttttcattttcaaccaaacagctttaagaagccctaaattaggagtcatgtgtcctgacctatcactgaatcaccctgagagcaagttacttaaactccctctgcttcaacttctttatctttggggtactaatatttatccaatatgtttcaaaagagaatgtatatgaatggtctttgaaaaaaatgtaaattgcttcaaaatgacagacaaaattattctttgaacttgaaagcaccaaatagatggcaaagcttctggagtccgcttgtgtttccttgggctatttttccagtctctttccatgctctaagttgtttctttcatagaattagagaaataggattctaggtacatctatttttttttcttttgtattgttttagtgataaatactttaaaacccttcatggtttccatgttagaaaagataggcttcaaattagtgtctttagaactccattcattcaacaagtatttatcaaggacccactctgtgacagatagtgggttttatacttgggactgtgctgtgctcaaactctcaccttcctggagtttacacaggcaggcactaaactcaaaattatatatgcgatgatgtgcttatacgctgcaataagtcttataaggacactgcaaaaggttcatgcaagatgataacaaaagaatgtagtcaagtcctatgggtaagaaaagacttatttgagaaagcaccatctgaactgagacttcaaggatgaaaaggtgctggccaaacaaagagtgggaagaagagcatgctaagcagagggagcagcacgtgcaaagaccctgaggccagtgttcttggtatatatcaagtggcagagggacccaggtgaaggcagagggatggcaagaccagatcaagcaggacattaaaacaagtttgtcttttttctaagtgccgtagacacttttcttttcttttttttttttttttttttgagatagagtttcactcttgttgcccaggctggagcacaatggcatgatctcggctcactacgacctccatctcccagttcaagcgattctcctgcctcagcctcccgagtagctgagattacaggcatgtgccaccacgcccagctaattttgtatttttagtagagacagggtttcttcatgttggtcaggctggtctcaaactcccgatgtcaggtgatctgcctgcctaggcctcccaaagtgctgggactacaggtgtgagcccgcgcccggccaggccattgacagattctaagctggaatgaggagtgacccaacttaatttgagattttataagctcactttgtttgctatatggaaagttatcagaaggacaccaagtggactaaaacagcccactgagcgaatgccacagccatccagggcagataggcgcaggcctgaattgtgtgcacaattgcaggtggccgtggaaatacagttcgggaggatttcatgactagggtcagggtgagccattggatgcgagggaggagtgagggcacagtcaaagacgaccgaactttctggctgaaagttgagtcatatgagttccatttcctgtgaagaggaatacagaggggtacagaataaggattgggggtgcaagcaccctgtttggggaaaggttttattgaagtagttgtgagatcttcacaaacagatgccaagatgccagctggatgttcagatctggaactcacagtcaccagcacgcagacgatatttcaagtttcagaactggaagatgctgcttagaaagagctcctcaggggggagggaggagccaagatggccgaataggaacagctccagtctacagctcccagcctgagcgacgcagaagacggtgatttctgcatttccatctgaggtaccaggttcatctcactagggagtggcagacagtgggcgcaggtcagtgggtgcgcgcaccgtgcgcgagccgaagcagggtgaggcattgcctcactcgggaagcgcaaggggtcagggagttccctttccgagtcaaagaaaggggtgacggacggcacctggaaatcgggtcactctcacccgaatactgcgcttttccgacgggcttaaaaaacggcgcaccacgagattatatcccgcacctggctgggagggtcctacgcccacggagtctcgctgattgctagcacagcagtctgagatcaaactgcaagatggcagtgaggctgggggaggggcgcccgccattgcccaggcttgcttaggtaaacaaagcagccgggaagctccaactgggcccagcccaccacagctcaaggagtcctgcctgcctctgtaggctccacctctgggggcagggcacagacaaacaaaaagacagcagtaacctctgcagacttaaatgtccctgtctgacagctttgaagagagcagtggttctcccagcacgcagctggagatctgagaacgggcagactgcctcctcaagtgggtccctgacccctgacccccgagcagcctaactggcaggcaccccccagcaggggcacactgacacctcacacggcagggtattccaacagacctgtggctgagggtcctgtctgttagaaggaaaactaacaaacagaatggacatccacaccaaaaacccatctgtacatcaccatcatcaaagaccaaaagtagataaaaccacaaagatggggaaaaaacagaacagaaaaactggaaactctaaaacgcagagcgcctctcctcctccaaaggaacgcagttcctcaccagcaacggaacaaagctggatggagaatgactttgacgagctgagagaaaaaggcttcagacgatcaaattactctgagctacgggaggacattcaaaccaaaggcaaagaagttgaaaactttgaaaaaactttagaagaatgtataactagaataaccaatacagagaagtgcttaaaggagctgatggagctgaaaaccaaggctggagaactacgtgaagaaggcagaaacctcaggaagcgatgcaatcaactggaagaaagggtatcagcgatggaagatgaaatgaatgaaatgaagcgagaagagaagtttagagaaaaaagaataaaaagaaatgagcaaagcctccaagaaatatgggactatgtgaaaagaccaaatctacgtctgattggggtacctgaaagcgatggagagaatggaaccaagttggaaaacactctgcaggatattatccaggagaacttccccaatctagcaaggcaggccaacgttcagattcaggaaatgcagagaacgccacaaagatactcctcgagaagagcaactccaagacacataattgtcagattcaccagagttgaaatgaaggaaaaaatgttaagggcagccagagagaaaggtcgggttaccctcaaagggaagcccatcagactaacagcggatctctcagcagaaaccctacaagccagaagagagtgggggccaatattcaacattcttaaagaaaagaattttcaacccagaatttcatatccagccaaactaagcttcataagtgaaggagaaataaaatactttacagacaagcaaatgctgagagattttgtcaccaccaggcctgccctaaaagagctcctgaaggaagcgctaaacatggaaaagaacaaccggtaccagccgctgcaaaatcatgccaaaatgtaaagaccatccagactaggaagaaactgcatcaactaacgagcaaaatcaccagctaacatcataatgacaggataaaattcacacataacagtattaactttaaatgtaaatggactaaatgctccaattaaaagacacagactggcaaattggataaagagtcaagacccatcagtgtgctgtattcaggaaacccatctcaagtgcagagacacacataggctcaaaataaaaggatggaggaagatctaccaagcaaatggaaaacaaaaaaaggcaggggttgcaatcctagtctcagataaaacagactttaaaccaacaaagatcaaaagagacaaagaaggccattacataatggtaaagggatcaattgaacaagaagagctaactatcctaaatatatatgcacccaatacaggagcacccagattcataaagcaagttctgagtgacctacaaagagacttagactcccacacattaataatgggagactttaacaccccactgtcaacattagacagatcaacgagacagaaagtcagcaaggatacccaggaattgaactcagctctgcaccaagtggacctaatggacatctacataactctccaccccaaatcaacagaatatacatttttttcagcaccacaccacacctattccaaaattgaccacatacttggaagtaaagctctcctcagcaaatgtaaaagaacagaaattataacaaactatctctcagaccacagtgcaatcaaactagaactcaggattaagaatctcactcaaaaccgctcaactacatggaaactgaacaacctgctcctgaatgactactgggtacataacgaaatgaaggcagaaatgaagatgttctttgaaaccaacgagaacaaagacacaacataccagaatctctgggacgcattcaaagcagtgtgtagagggaaatttatagcactaaatgcccacaagagaaagcaggaaagatccaaaattgacaccctaacatcacaattaaaagaactagaaaagcaagagcaaacacattcaaaagctagtagaaggcaagaaataactaaaatcagagcagaactgaaggaaatagagacacaaaaaacccttcaaaaaattaatgaatccaggagctggtttcttgaaaggatcaacaaaattgatagaccactagcaagactaataaagaagaaaagagagaagaatcaaatagacgcaataaaaaatgacaaaggggatatcaccaccgatcccacagaaatacaaactaccatcagagaatactacaaacacctctatgcaaataaactagaaaatctagaagaaatggataaattcctcgacacatacactctcccaagactaaaccaggaagaagttgaatctctgaatagaccaataacaggatctgaaattgtggcaataatcaatagcttaccaaccaaaaagagtccaggaccagatggattcacagccgaattctaccagaggtacaaggaggaactggtaccattccttctggaactattccaatcaatagaaaaagagagaatcctccctaactctttttatgaggccagcatcattctgataccaaagccaggcagagacacaacaaaaaaagagaattttagaccaatatccttgatgaacattgatgcaaaaatcctcaataaaatactggcaaaacgaatccagcagcacatcaaaaagcttatccaccatgatcaagtgggcttcatccctgggatgcaaggctggttcaatataggcaaatcaataagtgtaatccagcatataaacagagccaaagacaaaaaccacatgattatctcaatagatgcagagaaggcctttgacaaaattcaacaacacttcgtgctaaaaactctcaataaattaggtattgatgggacgtatttcaaaataataagagctatctatgacaaacccacagccaatatcatactgaatgggcaaaaactggaagcattccctttgaaaactggcacaagacagggatgccctctgtcaccactcctattcaacatagtgttggaagttctggccagggcaattaggcaggagaaggaaataaagggtattcaattaggaaaagaggaagtcaaattgtccctgtttgcagatgacatgattgtatatctagaaaaccccattgtctcaccccaaaatctccttaagctgataagcaacttcagcaaagtctcaggatacaaaatcaatgtgcaaaaatcacaagcattcttatacaccaacaacagacaaacagagagccaaatcatgagtgaactcccattcacaattgcttcaaagagaataaaatacctaggaatccaacttacaagggatgtgaaggacctcttcaaggagaactacaaaccgctgctcaaggaaataaaagaggatacaaacaaatggaagaacattccatgctcatgggtaggaagaatcaatatcgtgaaaatggccatactgcccaaggtaatttacagattcaatgccatccccatcaagctaccaatgcctttcttcacagaattggaaaaaactactttaaagttcatatggaaccaaaaaagagcccgcatcgccaaggcaatcctaagccaaaagaacaaagctggaggcatcacactacctgacttcaaactatactacaaggctacagtaaccaaaacagcatggtactggtaccaaaacagagatatagatcaatggaacagaacagagccctcagaaataatgccgcatatctacaactatctgatctttgacaaacctgagaaaaacaagcaatggggaaaggattccctgtttaataaatggtgctgggaaaactggctagccatatgtagaaagctgaaactggatcccttccttacaccttatacaaaaatcaattcaagatggattaaagacttaaacgttagacctaaaaccataaaaaccctagaagaaaacctaggctttaccattcaggacataggcatgggcaaggacttcatgtctaaaacaccaaaagcaatggcaacaaaagacaaaattgacaattgggatctaattaaactaaagagcttctgcacagcaaaagaaactaccatcagagtgaacaggcaacctacaaaatgggagaaaattttcacaacctactcatctgacaaagggctaatatccagaatctacaatgaactcaaacaaatttacaagaaaaaaacaaacaaccccatcaaaaagtgggcgaaggacatgaacagacacttctcaaaagaagacatttatgcagccaacagacacctgaaaaaatgctcatcatcactggccatcagagaaatgcaaatcaaaaccacaatgagatactatctcacactagttagaatggcaatcattaaaaagtcaggaaacaacaggtgctggagaggatggggagaaataggaacacttttacactgttggtgggactgtaaactagttcaaccattgtggaagtcagtgtggcgattcctcagggatctagaactggaaataccatttgacccagccatcccattactgggtatatacccaaaggactataaatcatgctgctataaagacacatgcacacatatgtttattgtggcattattcacaatagcaaagacttggaaccaacccaaatgtccaacaatgatagactggattaagaaaatgtggcacatatacaccatggaatactatgcagccatgaaaatggatgagttcatgtcctttgtagggacatggatgaaattggaagtcatcattctcagtaaactatcgcaagaacaaaaaaccaaacactgcatattctcactcataggtgggaattgaacaatgagatcacatggacacaggaaggggaatatcacactctggggactgttgtagggtggggggaggggggagggatagcattgggagatatacctaatgctagatgacgagttggtgggtgcagcgcaccagcatggcacatgtatacatatgtaactaacctacacaatgtgcacatgtaccctaaaactttaataaaaaataaataaaaaataaaaataaataaataaatttagttatcagattaaaaaaaagaaagagctcgtggggagcagaggtcctccgcctttgcagactcactgttgacattttaggacaagcattttataacttccttttaccatcctgaaataaaatttctagatcgggtggccagcctacacacaaaccgcaaaaagaaatcatctaataaaaaagaaaggggcctggcacagtgacttacacctataatcccagcactttaggaggcccaggtgggtggatcacttcggatcagggattccagaccagtctggtcaacatggtgaaaccccatctctactaaaaatacaaaaattagccgggtgtggtggcgcatgcctgtaatcccagctactcagtagactgaggcaggagaatcacttgaacccaggaggcggaggttgcagtgagccaagatcgcgccactgcactccagcctgggcaacagggcaagactctgtctcaatttaaaaaaaaaaaaaaaaaaaggagaaaattgagacatgaaaatgcaccagaacagggcttctcaaactcgagcatgtacaaaaattgcccaaacattctattaaaatgcaggttccaaatcagcagcttggggtgggccctgtattctgcatttctgacaagctctaggtgatcccagtactgctgttatatggaccaccctcagagtaacaacatcctagaagatgtaatgaggcagtcagatgtgcgccataggcagactcaccgtgaacatgtcagtggtaaacgcagagcaatatgggtggattgaatgggggtcttgaggatcatgaacagtaatacaaaggtgacttgattttctaaaatggcaaataactcccattaaattccaaataaagcaaaatacaggttctctttgtcagataagctttatttctggaaattacaatgtgtgttaaactgtgcagaaaagactttgtgtttatatgtaaaacagagttaagttctagcctcagataattataaaaaggttttgaaccaaagacaattttgtcctccacgcccaatgggcatttgacagtgtctagacacaacttcagttgtcacaactcaggggtaaagcagatgctgctggcatctagtgggtagaagccagggatgaggctgaatatctacaatgcatagacgggcggcccccaccaaaaggaagtatctatctggctgaaaatattaacagggccaagttagagaaaaactggcttgcagagatattttcaaaaatggtacagactgagagtaatggctcacacctataatcccaatactttgggaggacgaggcgggaggatcactcgagcccaggagttgaagaccagcatggacaacataacccaggtttttgttttttttttttttttgagatggagtttcactcttgttgcccaggctagagtgcaacgatgtgatctcgactcactgcaacctccacctgctgggttcaaatgattctcctgccccagcctcctgagtagctgggattacaggcgcctgccaccaccaccagctaatttttgtatttttaatagagactgggtttctccatgttggccaggctggtctttaactcctgacctcaggtgatccacctgcctcagcctcccaaagtgctgggattacaagcatgagccaccgtgcccagccaacccaggtgtttttgtagagactccatctctacaaaaaaatttaaaaattagcctactgtggtggcatgcgcctgtagtaccagctactcaggcagctgaatcaggaggttcacttgagcccaggagatcaaggctgcagtgaactatgatcgtgccactgcactccagcctgaatgacagagcaagaccctaccttctaaaaaaaaaaaaaagaaaaaaataaaaaatgggtgcaggatgatggacaacagcaccttgtgtgaaactgtctcacacattgcaaggagcctcacgttcccagcccctaaccactaaatgccagcagtgcccccttttagcaaccataagacatgccctaaaaatgggagtgtcgcataagaacaacagcagagagtgaagagagaagggggtaggcaggaggaaggcaagaagagtaggagccagccaaaatgctgtgccaggggatgagaaaggctggcatggccaaattaaagcatatgtcattctacgcatctgttggtggctctgtaattaatacaaaaataattacatctcttcgcctggctctccctcacaaactacttaatgaacactgccaagaactttttagatatgtaattaaattttttatttatttccattttatttttatagtagtagctcaatatattagaaaaaaaaatgcagcagcaaagcccagcctcaactaccatttgagaggcaactaacagtatccacttcctttttttctcaatctgttctatgcaattcattctgaacagcaggaaatactaacaacagttctcttattccccttcccttcatttttcaggtttaattatctgccaggatctcctctttaggcacagagagaaatgaggtttttactttacttttcttttaatataagaaataatttggctaggcacggtgcctcatgcctgtaatcccaacactttgggaggtcaaggcaataggattgcttgagttcaggagttcaagactagcctgggcaacgtggcgaaaccctgtctctacaaaaaatacaaaaaaattagccggatgtcctggtgcacacctgtggtcccagcttttcaggaggctgaggtgggaggatcacctgagcccaggaggcagaggttgcagtgaacaaagatcatgccactgtactcaagccactctgggtgacagagtgagaccctgtctcaaaaaaaatagaaaaaaaaaagaattttaaaaaaataatagtgtgttgtcccaaagtggtccaagatttggatcttctctttacccttcttcaagtataggaacactgacctttccaaaagcccccaccacttccatcagtcatggtgggatccaggagacttctccaatagaaatactcccatagctaagtttcataaaagacataggtatctgaaatttaaaagtaactatactcagataatggccgggtgcagtggcttacgcctgtactcccagcacttcaggaggccgaggtgggtggatctcctgaggtcgggagatcgagaccagcctgaccaacatggagaaagcttcatctctactaaaaatacaaaattagccaggcatggtggcgtatgcctgtaatcccagctactcgggaggctgaggcaggagaattgcttgaatccgggaggtagaagttgcagtgagtcgagatatcgtgccattgcactgcagcctgggcaacaagagcgaaactccatctcataaaaaaaaaaaaaaaaaaaaaaaaaagtaactatactcagatattcttgggaaaacgcctctaaatcactaataatgtcaatgttcagcacttgaaaacaataccaaattattacaagccgtataagaagcagtggttgaagagacaagaatgaccacaggcccaacatctttacatctcttaaccctctgtttcctaggttgaaagtgtagaaattatgatctcctgaactgcagcattgtgaagttgacacaaggtgaagcaatgtcacattgtcaccacaacaggatcctttcatgctgagatccaaaaaagccagataacctgagtcaagaatcacagaaagtcaataacaaaatcaggactgaggtcttgagaactggaaaacttccttggttttcacacaggaatctgtcatttgtgcttatttcacattgcatgcctgtatcaaaacatctcatgtacaccataactatatacacctactatgtgcacacaaaaattaaaaatagggctgcacatggtggctcacgcctgtaatcccagcactttgggaggccaaggcagggagaatggcttgagcccaggagttcaagaccagcctgggcaacgtggcgaaaccctgtctctacaaaaaatacaaaaaaattagccaggtgtgctggtgcacacctgtggtcccagtttttcaggaggctgaggtgggaagatcacctgagcccaggaggcagaggttgtagggagccaagatcaagccactatactcaagccggggcaacagagtgagactctgtctcaaaaaaaacagaaaaagaaaaagaaataatttttaaaaaataataatgtgttttcccaaagtggtccaagattcagatcttctctttacccttcttcaagtgtaggaacactgaccttaccaaaagcccaccagttccatcagtcatggtgggatccaggagacttctccaatagaaatactcccatagctaagttttataaaagacatagttatctgaaattttaaaataactatactcagataatggccaggtgcagtggctcacgcctgtaatctcagcactttgggaggccaaggcggggagaatggcttggcctgggcaacatggcaaaaccctgtctgtacaaaaaatacaaaagaataaaccaggtgtgctaatgcacacttgtcccagcttttcaggaggctgaggtgggaggatcccctgagcccaggaggctctacaaaatacaaaacttagccgggcatggtggcgcacctgtagtcccagctactcaggaggctaacgtgggaggatggattgagcccaggagatcgaggctgcagtcagctgtgattgcaccactgcactctagcgtgggtgacagaacaaaaccctgtcccccacctcccccatccccaaacaaaacaaaacaaatttttaattaaaaaattaaaaaacaaaaaggatctgtcatgaaggtatttttcagcaaacaacactcaggtatatttgtgaatcttaaatagggaagaaaagagttatcaaataaacctggcaagtactgagttaagtaaagacacactatgtttggtttgattttaattgcaggacttctcagagtctttaatatgttaatgtgtgttgtgaatttccaagacaggaactataataaaatcattattttctttctccttactttcattcccaggacaaactttgccctaagagaaactcagttagaaaagtctgggtgttgatttaatgtggagccacttcaaggaagtgataataaaacaaagttccatgaaattgatatcatattaatatcatggtcaaagaggagaaaatgacagcctgcagtaggcctggtgtgaaacagtccttcagccaggacttcactcttgtttcacagtgtaatgccattgcagtttccaaaagtccaccaatttgtggtctccacttttcctttgacccatctctcttcttccaaccacatgatcaccctcctttaagcttctagacctgccagaggatctcaaccaactcaaaacaaagattgccagggaccctttttctctcaagtgcacatctaatgtcaaagggaaatggttctctccactgatggtgatcaaggcattcacctgtaatctaggtagggtggtgcctgtcatgagcttggaagcttcagagtaggaaggactaaatttaaagccatcctctgctttttattagctgtgaaccctaggacaagtcacttacttttatctctctctttttttttttttttttttttaagacagagtctcactctgttgcccaagctggaatgcagtggtgcgatcttggctcactacaacctccgcctcccaggttcaagcgattctcatgcctcagcctcctgagtagctggaatttcagaggtgcaccaccatgcccagctaatttttgtgtttttagtagagacagagtttcgccatgcttactaggctggtcttgatctcatagcctcatgtgatccgcccgccgttgcctcccaaggtgctgggattacaggcgtgcaccaccatgctcgtcctttatctctcatttttaaaatgagattgtttcaagagttaacagtaatgtgtataaagtgactggaatttggtagatacataataactggttgctagtattccagtcatactattccttaccaaggaatagtttcaaatgtctgttatgattatcttgtgcatcatttctgtacacatatcaaatgtcatctgattttcaatttgtctttatccttccactagaaatttggaagctttccttttctaaaaagactaatcatatttaggttcagtgttttttctcactaaaatgaacattaccaccaaataacaagatgtaaacaagaaacttcactcagattgggctgaaggaaattgcatgctttccacacagtaatccagagcaaagttcttggaaagaaaaatcaccctgttattaagtagcacttctctaccgaaaacgttcctatcttttgacaggaattccacacttaagaatttaagcctatgaaaatattccagcatacagaaaagcttgaaacgcaaagatgttcatcatagtgttatgtattattgaataaaaattgcaaacattaaatgtccaatattacattatcgtagtatcataaactattataatgtatgtgatagaacttctacagctgtttatactgatgctttccagtgaagaaatacctccagacaggtgcctcatatagtcagcatatataactatgtaaacctaacgaaatgcatgggaaggccagacacagtggctcacacctgtaatcccagctctttgggaggctgaggcaggcggatcacttgaggtcaggagttcaagactagcctggccaacatggtgaaaccctgtctctactaaaaatacaaaaattagctgggcatggtgatgcatgtctgtaatcccagctactcgggaggctgaagcaggagaattacttgaacccaagaggcggaggttgtaatgaacccacatcgtgccactgcactccagcttgggtgacagagcaaggctccagcacaaaaaaaaaaagcatgggaaaagaaaagactagaaggaaatacagcagaacgtgaatgagagctttaagcctagtatgaccataggttaataggttgttttgtttttgtttttccaaaaagctttatagtgaaaaaaatcatacattatgtatatgtatttctaattgcagtaaaatacacacaacataaaatttatcattttcactattaagtgcacagttgagtggctttgagtacattcagattgttgtacaaacataacaatgtccatctacagaatttttcatcttacaaaagatgaaactgaaactgctctgagtgaacaagaattcttattgcttttcccacctcatccccagtccctggcaaccatcattcctctttctgtttctatgagtttgactacctctagatatgttatataggtataaccatataatatatttctttttgtgactggcttattttcacttagcataatattctcagggttcatccatgttgtagaacgtgtcagaatttcttccatttttagggctaatattccgtcgcatgtacatatcacatttgcttatccactcatccgttggacacttgggttgcttctgagttttggctattgtgaatagtgttgctatgaacacgggtgttcaaatatcctttccatacattatattaaaaatattttttttcttaaagttgcaactttttggccagtctaggtggctcaagcctgtaatctcagcaccttgagaggctgaggtgggaggattgcttgagcccaggaatctgagataggctctgcaaaataaaaaataaacctagtcaggcatgatggagtgtgcctgcggttccagccactcaggaggctgaggtgggaggatcacttgggcctggcaggttgaggttgccgtgagccgtgatgatgccactgcacaagtatagcgacaaagcgagactctgtctcaaaaggaaaagaataagaaaattgcaactttctttttagatacagagggtacatgtgcagtttgttgcatgggaatattgcatgatggtgagctgtggggtatggatctcatcacccaggcagtgagcatagtacctgataggcagtttttcaaaccatttcctccttcctccctccccagccccagtagaccctagcgtctgttgttcgcatgtttacatccatctgtgctcagtgtttagctcccacttatgagtgagaacatacagtatttaaatagtttttttctcaaagttgactcctccttttcatgtttcacagtctggttatataactaggactctactcagaacatttggacaaataaagtagtggaggtgggcaaggtgatcaccctggggaaaaaatcacctgggctacacctcagaaaataatgcatctttctgttgttctgattcccattacaggacgaatgccttagtttccactttccagcctggatcccctcacactgaacccttcttcgttgcaccatcctgcttctgacattgaactcattgaactcctcctgacaccctggctctgagaagactgccaaaaaaaaaaaaaaaaaaaaatcaccccagccatttctcttcatcctcactaacaatttggtaatgaagtattgatttccacttctctgcttatgggcggtattagattttcattgataaattgcaatggggctgtctcgtctccacagtacccttttcactgtcacaagaaaacaaagtgccaccgaagaaaagtaatgactgagagcattgatgtacttattttgtcagtttgtaacaggaaagtgggggggagtctaagtcttcatagtctaatgtccaagtgggttgcactagatgtagacacttggaggcttacttttcatggtaatgtccatttcctatttataacccctctgggaacgtttgtctaaaggaaatgtttctgttcagtgtaacaattacagttgcacctggattgcccagtcctgcccctgcactaggggaccattaatcactgcaaagtagaagaattattaagttaaaccagagtttgagccaagaaaacccctgaacaatgttcatcttctgtgaaacttgctcaaatagttaagcttaaccatgttgctgccaaagacttttcctatgcagtggtggggcaccttgatcatcatcattatcttgattggctgaaaaaaaaatagttttaagcacacaccactgtctatgagaactgcaaattgggagaataggtgaaatgcagaatctgagagaacgcgagaagatgagatcattacagggtggaaagttctgcagcagccttttctggtaatccctttctgcagaacctgatgtttatgggctctaaaacgcagcttagctttagaagcaacagaaagcatgaaatagggtgtccattttaaatgtgttcctgcaacttttttcattaaaactttgagggcccaattttaatttgtggaatattcccgttaataatgagatctaattaagacatccattaaaagcccgttaaagttaatttaacgtaaaaattccaatagaactgtattagattttctccattaaattaacgttatggatttttaacggatgtcttaattatacgttattattaacgggaatactgtattacacagattaaaatcaggtcctaagtcaacttggaagagctaagagcatgttttaatattaaaagtcttgcatacctagtgcacagtttggagacgcaaggatagatctgtttactctagttgaacattttctatacaattgaaagcaacctataatagataaatccatcattgcatttaaacaatgaatttccttattctcaaaggacaaatacgtctggattatgtggtaaattgctactcagctatggtgaaatatttatactattctaggcacaacactaggaactaggtgattctgaaacaaaaggaatattttctgttgttgctttaattaccaaggttatttttttttaatctcaacactgacaaaatgaaaccaaatatctcttcctcaccatttctcaaggaggctgcctgttggaattgttttggaaattttgacatgatccctaaattcaacattgggattaaaaaaaaaaaaaaacttcttatttacctcctagggaaagtgttgcccttatgccacatataatagcaaattgctttttttatggcatgcataacctagatgggaaaaaatatggcgcttcggggaaggagggaaaaagtaaatgaagttccaggaatgtcattctgaagtaatgaggcatggacagaaaatatacccctcacatcatcggattgagatggcagtcgaaatagcttcattgaagtgtcagcactcatccatcaatcaatcacccacaaggaaaaatagcaacagtacaacggggtggcttttatgggatttactcatgggcatagggaatagcggctcaaatgtagttctgacatgaaaagcaaggtgctgatattattttttatgatgggaggatcataaagtgaattgagaacagtgaggtctgtctttgcttaacctattcaaccagaaatgaatggagctcgactggaaaggaacagtcttcagatgggttaagattgaagggtggactggactctactgagcaccgtccttcaacaaggaaattctattaaaggaaaatcaatgcattagtattggggttctcgtagctgttaaaaattgtctgctccaatccagggttattaggccaaagttacataattcagatctcactgcaaccatccaaaagtggattctcgagcccttgctccaatggggggaggagatcaatacaattcccaattccatggaaattgtttcccttctaaggaagaaaaaataaatcatctgcttcaacatataatcgatatggttttgttagcgtaatttctatggtgggtggggtgggaggtgagagaaaaaaatattgataaatttggtaagacaggtgaattgccgcctggcaaccgtgcatgtcactgccgagggatggctgctaaggttcaccttagaaaacaagatctgggctggcactggggcatacatcaccactcagcatattcctagaggccaggcctgtcttcactcagccagccctctgaggcttctagaaacttctttctggaggaaaaaaactaaataacataaactcaggagaatgtctttacccaccttcataccactgctttctttttgctgaataaaacacagttctgataagtaagaactttagaattggaaaggaggctgacatgcaaatataatgcaaattaccctcaagtatcgccattcttccaccacctcttggtaccagtgagagcgagagattgccttttcttccccatccctccttccagctaagaccaccaaccagctgcaaattgagatgtccatttaaaaatttatatgtcaatatttaaatgttacatatttggccctattttgtagttcagcaaatcctccaaatacacagcatgttacaaggcactggtggcacagggcacaacaggaaatgatatttatttagcaaattcatttaacaaatattattgggcacctgttatgtgagacactgtcctaggcactgtgggataacaacagcaaacacttcacacaacagcctggccttcctgtgttttacaacagctcctaaagatagctgatatcaagacatttgagggacacagttcatgtagaatcaaaatattagtatttcagaataaggattttttttctgaaaagcatacagagaggaaacagcttaaaaataggtcaagacctaaaaacagaatataatcacggaataaactggataacccagacagtccccacagaatttctttcaggtcacagatttcttaaaactcacccccaaaatgtgcctgcttggttgtttgaatcttgcataattaatgtcacaggcgcaagccgctgaacttagttgagatgcagaaaacaaacaaatgcaatgacatatctgagaagcatttatgtaactccggttaagtggtgaggaggggtgtgtgaagacagtgtgcatgcatgagtgtgtattcatatatatgtgtatacatatgaatttcactgttattttccagggtctatggacaatgtggcagtaagagtctatgatgttctgaaacttttcacagtaaatccaaagattacagaccttacaaggtgcttgcattctgttgcttttccatctgtcacttctcaggttatttgactgtgttcaaaccttcttttctttttcattgagtttcattttttaagcttgttaaatgcttttgtttaaaaaaaaaaaaaaaaccccaaatgtcatttttcacattatcctctcttctctgcaacaaggatagtaagatgtagatgaatgcaaaaataataacaacaataaggaaatatattaaagctttaaaatatgcacatatgtagttctaaagagcaataacggtagtatctatttcgaacatgcattaggcaaaaaagaaatcaaaactgaaattttcgtgtatttttccccttgtaagatgttcaaatgctaacttcattttctcctttcctctatgtggcactttctcaaaatatctatgaaatacttttagacaaagattgagctggagaaagagatacaaatttccatccccccagacagagagacatatttccattgtaggaaggcattaaacattttgaaacttgtgaatcatctttagaatttctactggggaattttacttcttcatccaaagtaaaagccacttatctcctttggttcccagtgacagattcagaggcatacgcagatatacaattttcaggctctagttaatcttcttccaatagttacgaacaatgggctaacaggcgtgggtgtttctccaaaaattattcatgcacaaggcagcccaaagcttcagggaaaactagaaatgtgttatggattagaataggactgttttaaaatgctagtaccaggtggaacgctatttctgcaacaggactctgtccatttcctttggaacaatatattccaagtaaaatggctcttccaaggaatgacacctttacttgacacccttcggcatacaaatgattttaccaatagccatgattattattaaggccttttaaaatacaggctgtttgaaaaaagacagattaaatattcacagcctttgtatcatggttatttgcttaaaacagcttttagaagtacaagtaataactttttgataagaaaccccaggagaaactttttggtaagaaacctcaaaaaatttgaacaaaggcattacaaaaaaaaaaaaaaaactaaccactccattcaactctctcagaaaataaatttcaatgtgttcaatgaattgtcttgaacctgaaacctgcatttagatatcagtcccctgccaatagctaatattaacagaatttgaacaatcatacaattatgtctcaaatgtgaagactttgtacagtaatattttcactttctaaatgacccatataacattcaggaattatagatgtgtatgtatattttttaagtacagaaagttcagccagtcttcagagaagtaaaagtgatgtctattgtgcattgaagtaaatattacaaacattccagtttcgcaatacaatacttgagctttcgaacacctcagacactagaatgtgtaatgcgagtcaaaaaagctgacatacaaaacaattcccatttggctcagggttcctaaatgtcacaatatcttgggtaaaatatactttttgatttcctgatgatgtccttctaatcccttctgactttgattcctaacagccaggcactgttgacatgaatcattaacttccaaacccctttaaaatcaagaagctaggtgatcatacagtcatttcaatggccaaccagttcttgctctacagagcttttacacctttttgggaaacctgatatcaaacacatttatgttatatatttgctcccttgcattaattctagatttttttttaatttcttttagaaagggcaggggggaagtgggtcagagcaaggttcaagaatcacattcatccttgctctaaagtgtttacttgccagcaaagaaaggcaaacacatttttatattcagaaagcagaccggtcattttcaaagaaaaatgactgcaaccatgcctgtagaatgtttctgtgcaagcgcactaattttctatcacctgcatgctgtatataatacatttgcctgtatactaggaagaaaaaccaggctgttttccctgagtacaatgcagcttggatggctgggagcgtaagccttccgtgcatttttatagtgtacatatttgtatatactaactatatcgccatgtatgaacacagattttgttatatttgcttgtttctgtttcctaccaaactggcccacaatggggattcttttgtatagaaaaaatatgcttgtaattttttcctggtcattctctttcaatagcttatgaaagaattagatctgagtttacaaagaaactataagaaccaagtttgtctgtctgcatgagtcccgtccaattgctggatctagggaggaaccaacttcctaattcagagttttccttttaaaggcatgctttacccccatgggaaaactgcacactcatccatgtagaattattctctttgtattttatctaatagtgcctgaaaatttttttaatgtcttcttagaagaagaattcataattgtcaaaatttgaaacattagcttaattttgtttttatgacctcaagattcttctccttatttattcggttgctgttgtaatggggccccaggccattcctgacatcggcgtgttcttcttctgcattaaggatgtttttgaaattacagagattattgagccaacaggctgttttaatcaaaaccatgtttcacttctttttgatgattataaattgtccttgcaatgaaaaaaaaaaaagaacttttctgctaggaagattataccaccctgtggccaaacagattcatcacagataggcatctatgcccatttctctgggatctggaaaattcttcccttggctgaccccaatttcttttactccccattatcctgaatattagctttcaatgcagtcactatttgacatttccaaaggctttgccgcattgtcactgcccaaagacaaacaaccactggaaatgatggctttcctgcttgaaacgaagggggccaggtgcagtggctcaagcctgtaacccctgcactttggaaggctgaggcaggcggatcacttgaggtcaggagtttcagaccaacctggccaacatggcaaaacctcgtctctactaaaaatacaaaaaacattagcagggcatggtggtgcgtgcctgtagtcccagctacttgggaggctgaggcaagagaattgcttgagcccgggaggcgaaggttgcagtgagctgagatggtgccactgcactccagcctgggcaacagagcaagactgtgtctcaaaaaaaaaaaaaagaatggattttcagaaaaagtgctccctttcctgtcctgtggtgccaccatcctgtcctccttcgtaatcatgaacaatctgatcttgaactcccacataacttaaatcaggcaaaaagaaacattcacagcgtccccttgctgaataaaaatgactttgtttggaggcacttaagatgtatgcctgtgtgtggtgccgcagcattgaaattatctgtagaaggggaattttttttaaaaatacaattttatcactagaaataaattccgatggtggaaacgaagaaaacccttaaattatatcacaaaagccattattttttgcatccaaagagtttttttttttaaggaaaatcattctactttgagaactgtaattaaagccctaaataacagacactactttgttgagctattgtgaaaaaaaaacaacacattcgccaaggttatatggagcccctgatttccatcaaaaaggtttctataagtatattatttacatttttatacatgataactcttgcctttgtgttgaaaaaaaaaaagtctcttttttttcccccactcagcagttattggaaatagactgttcccatctgaaaccgtatcgtaatttgcatcaggaaacccaactgctgacattgaggacctgggtgtgttcaattatgattttgctggaggctgtccctcattttaatgctgcagctattgaaccaccttcctgaaacctagctgatacggaatagcagagacatgcctctcaacaccattagctttgcaaatggcttcatttcagtcaacgtcgacttctgctttggccaattgaaaaatgaaaattaaaggagagaagaaaaaaaacacagatgcacttaaaacatgaaaagaattatttatatgataaaaatatatttagcttttcaaagcacaagactgaatagaagtgctctttttatgctttctggagatgttactgttaaatgtctttctacatcaggcttaataaatctgtaatgacatttgatggattga

SEQ ID NO: 2356 - DNA, 28972 bp, Homo sapiens
gtgtttatagcatctttattcataatcaacaaaacttggaagcaattaaggtgtccttcagtaggtgaatggataaataagtcatggtacttccagacaatagcatattattcaatgagaaaaaaaaaaaaaaaagagctagcaagctacgaaaagacatggaagaaacttaaatccacattactaagtgaaacaaatcaatctgaaaaggctgcatactttatggttcagaggcaaaattatggagacaaaagaaaatagccaggagtttagaggagtaggcgaaacacagaggattattgggacagtgaaacggctctttatccttctgtaataatgcatacatgtcattattcatttgtctcaacccacagaatgcacatcaagactgaaccctaattaaaccatggactttggccgatagtgtcaatgtagtttcatcaattgtaacaaatgtaccactctgaagggggatgttgatgatgggggaggctgtgtatatgtgagggtaggggatatatgggaaatctctgtaccttctgccccattttgctgtgaacctaaaatttctctaaaaactagtcttttatataaatgggcatacatatacatatatatgtcagcactaaaatatcacgttacaataaatataaaggagaaattattgaaagtcatgtacagtgaaatgtgttttcctccatatttcctggaattcatgaggagtgatacacttaggagtaaggtaaaatgggaataatgaaggggaccagaccttgttctagggtatgttaggaaggaagaggtgatctccaggcaccctcctgagagtcagctgacattgtcctaagttggggataatgttgtatcacaaaatatccaaaactgaaggaagaatagtgaagcttcagatacagtgctggatgaggtgaagggaggtaatgggtgagcagacattggtctaagatgttgagcagcatgtgatgggccatcagatactgtgaagaagtgaggaagcagagctaatgatggctcagtagacattgatctaaggtgaggtaatgggatgtgtcaccaagcactgcccaactagggcttgggaattaaaggggcattgtggccctgcttctttgactatgttctatcctttgggccccatcttcacctccccatactgcccttcttaaaggtgaaaccatctttgcagagcccaaatagttcccactcccagaactgccaatagactggccccagacgccacccagcaactgtgcatctaatcagatcatctgtcagcatctgtaaggccactgctgcctatctagggcaagatacctaatatccaatgaagatccacccaagtctgctctagttccctgctattggcttcaggcactcctctcggggcaggatgagcaggtgtgtggattgggttctggagtaaatgcggctctgtcgagttgcaactgagacaggacagcgctgtgcatgctgaggaaaaatgagcagggagtcttttgcaatcatgttggagctgtgggattctggaatcatggcaggaaatcctggaagcaagcatccacatgggatttcctgtacctgttttcccttctttagcatcagaccaaaaggttcacaatgactttttagctttagggttgagaagggatacagcccaggtacagactagaggtgaaaaagcctggtgtgttttagccaagttggttctccctattagcgcttcttatgctgcaacacagaaaaaaatcagacagaagtcacgcaacaagcatgggtcaactctccacaggtgcatttatggaatgcctgctgtatggcagtcatgggtctagactcatagtggtgaacaaaagggaaatattttctagtgtagaagccacagagaaatgaggaaaatacaccaggcagcatggtggaaattgctagggagaagaataaaggaggaagggtaaggggctggaattttaaaccaggcaggcagggaaggcctgtgtggaggtgtcatggaaaaaaagacatgacggacaagccacagataaaataaagaattgtgctctttgcaacgggcactgcaaatacaaaggccctgagtcaggaactgatgtttgaggcacatggcggggaaggtccttgtggggtgcgtgggacgaagatggacacaagtagacagtgaacatatggtggggttggttttcatatgagttatcaatttcatatgatttatgatttatctcatatctcatataatgtaagataatgatttcatgacttatcaacttatgaaagtcagatcattaaggaaagtaaaatgctgggcttcaactcagtcacaagtaaattaaaaaaaaaaaagaggcaggcaactgagtgagaagaattgtaatagcagaaggaagaatttaagttctcccagatgacctgaaaatcctaacctcaaaggctttcttgagggtggtgggagtgtacaaaacactgtgctgggccgggcgcagtggctcacgtccgtaatcccaggactttgggaggccgaggcgggcggatcatgaggtcaggagttcgagaccagcctggccagcatggtgaaacccccgtttctactaaacatacaaaaattagctgggcgtggtggcacacgcaatcccagctactcaggaggctgaggcaggagaattgcttgagcccgggagacggaggttgcagtgagccaagatagcgccactgcactctagcttgcccgacagagcaagactctgtctcaaaaaaagaaagaaagaaagaaagaaagaaagaaagaaagaaagaaagaaagaaagaaagaaagagaaagaaagaaaaagaaagaaagaaggaaagaaagaaagaaagaaagaaagaaagaaagaaagaaagaaagaaagaaagaaagaaagagaaagaaagaaagaaaaagaaaaaacactgtgctgggtgtcaaacacaatgtgctgagaacctgtggggctcagagagagtcctggcagataatgaaggggactgtaagtctttttctatgacaatggggactcaacatacgctctgaggtctgtgtctgaatacacagggagtttgtcttattgcagtatctcttgcttgatagaaatactcaatggggaattggatatgcacaactgtgttcgattcaaaagaagaaaatacccacaattctactagacagtgtgttctggaacaaacaactcacagaaggattcatcactatcatatatattatgttgtcttaccattcaaactgttggcactatacctaatccacagtaaacaggattatcattcccataatatgatctttcttatgaagaatttggtaacagtattctattgtagttttcatgagaaggcttttcctattcaccaaattgactcggttccttgtcagtatgaataatgacccaaggtttactggggatggtgacaatgtaggaagggtccctcgcctcattcagtgccttctcagaggccctctccagaacagccatgtgtgacattctgatgtggtcatttctatttacaataatatacatatttttctgctgcatgcgtgcaacagtgtacaatcagacccaaccctcaggggggttttctcacactgtttctctcaagcgtggctgctctgatgaacactgaacactgatttctgaacgaagcctttcccacagatgccacacttgtagggtttgtctccagtgtgtgttgtctgatgtttattcaaattggacctgttgctaaaggccttcccacactcagcacacacgtaaggcttctctccagtgtgaattcgctgatgcacttggagctgtgattttttagtgaaagacttcccacagtcactgcactcataaggtttctctccagtatgaattctgtgatgtgtaatcaactctgacttctgtcgaaaggtcttcccacattcagaacaaatgtagggcttttctccggtatgagttttctggtgcttactgagatttgacctgccactaaaggctttcccacactcggcacacacatagggtttctctcctgtgtgaactggctgatgcaccaggagctgagacttggaggtaaaggacttcccacagtcactgcattcataaggcttctctccagtatgaattctttgatgagtaataaagtttgacttgcggatgaaagctcttccacactcagtgcatacatagggtttctctcctgtatgaattttctgatgaacaatgagtattgatttctggttgaaggctttcccacattcgtggcattcatactgtctctctccagtgtgaattttctgatgtatattaagatttgacttctgagtaaaggcttttccacaagtattgcattcataaggcttctccccagtatggattctctgatgtgtaatcaagtctgacctctgggtgaaggcctttccacatttggaacatatataagatttctctcctgtatgagttttctgatgtgtaatgagatttgaccggttggtgaatgccttcccacatttattgcatacatagggcttttctcctgtgtgaattcgtttatgaacatggagttgtgacttggaagtaaacaatttcccacagtgaccacatttataaggtttctctccagtatgaattatttgatgtgtaatcaagtgtgccttccggatgaaggccagtccacatttcatgcatatatacgatttttctcctgtatgaattctctgatgcactgtgagtgctgacttctgagtgaaggctctcccacagtcactgcattcataaggtttctctccagtgtgaattctctgatgaataatcaactctgacctgtaggtaaaggccttcccacactcagtacatatggaagatttctctctactttgaatcttctcatgtgtaatgaggttggaattattgctgaagaccttcccatattcggtacatatatagggcttcactcttgtgtgaacacgttgatgtacctgaagttgtgacttggaaatgaaggatttgccacagttattgcattcatatggtttttctccactatgaattcttcggtgtgcaatcaattgtgttttctggatgaaggcctgcccgcattcaatacagatgtaggatctctcgcctgtatggattttctgatgaatcttgagtgtggacttttgtgtgaacgctttgccacagtcagtgcattcatggtgtctctctccagtatgaattttctcatgtatactgagatctgagttataagggaaacctttcccacattcactacattcatatagtttttctccggtatgaattctgtgatgcctgaaaagagacgatacttgaaaaaaggattttccacattcattgcacttatagggcttctctctcatatgggttttctgatgtgtgatgaattctggcttctgtacaaaagccctcccacattcaatacatacatagagtttttctcctgtaggaactttcagatgtaccttgaactgtgacttccaggtgaagctctttccaaattcagcacactcataggatttttccccagaataaattttttgatcttgagaggaagctggtttataaccgatgatttttctatgttgattatggtcccataatttctctcctgttggagtacattcacagtaagtatagaaagacattttaccatagttagtactcttcttaacattctttgaagcatcgtttctatcatgaatgtgtagatctaaattatgcttcaagccatttccaaataagtcacactgatagggtttttagggggatgtaaaatgtttgggttcacatgaattatccttctgatagccttatattcataatgcctatttgtagtcaatattttcttgattaaagcaacatcacttagatacttattttcttttctgataatattctatctggttatcagtctgtcactgttattctagaatgaaatacaatctcacatcatctctatcatcatcttccctttcattgtggaaagaagtcttttttttttccagagattccctgtaataaggtttgaaatccaaacactttttcaagggataataagtcactttttgcttatagagcagctagcagaggctagaggggaaggtaaaaatggcttatccagcttgaacacagagaaaagggtaagggtgagtaatttcatgagaagggtgtgacactacttaaatgaaacattctggggaacaattcagcagttaaaagaaataaactagatgaacagataacaccatggatagacatggaaaaaggcaaaaaacatgatatatagcataataagatttatataaactaatgatccatgcccctaattcactttaaattttacaacatgcacgaattaaaaaatgcttccattatacaaaacagtggcttctggtgggaaggcagatgggtgaggggaaagagagaaaaggggatattatcacaaaaataaaatgagaatcttcacccacattttcatggtcatagtgtgtcctaaactaaagacaatgattaaactcaaacctcatcaggtgaaatataaaaataaagcaatgacaaaaacaaacaagcccgggcatggtgcctcatacctgtagtcccagcactttgggaggctgaggcgggcggatcacctgaggtcgagagttggagaccagcctgaccaacatggagaaaccccaactctactaaaaatacaatgttagctgggcgtggtggctcatgcctgtaatcccagctacgtgggaggctgaggcaagagaatcgcttgaacccgggaggcggaggttgcagtgagccgagatcgtgccattgcactccagcctgggcaacaagagtgaaactccgtctcaaaaataaataaataaaaataaaaatacaaaaattagccaggcgtggtggcccacccctgtaatcccagctactcgggaggctgaggcaagagaatcatttgaacctgggaagtggaggttgcagtgagccaagattgcgccactatactccagcctgggcgacagagtgagactccctctcaaacaaacaaacaaacaaacaaagccaaccaggaagagagaccctaacagtgtggaatcgctcaagcaacatcagaaggaaatgtgagaaagggtgattaatccatgccatgtcaaacacagcagagaggtattcccaaagattaagtgacaatgattcccaagtcattagctggatgaaaggcctgaaggactgggaagataagagaaatctcatggccattactatagcaaaaatagttagagagcctgactggaaataaagttcttttttttttttttctttttcagactgagtcttgctctgtcacccaggctggagtgcaatggcatgatcttggctcactgcaaccttcacttcccgggttcaagtgactcttgtgcctcaccctcccaagtaactgggattacaggcatgcaccactacacccagctaatttttgtatttttagtagagatggggttttgccatgttgtccaggctggtttcaaactcctgacctcaagagatacacccaccttggcctcccaaagtgctgggattacaggcatgagcaactgtatctggcccagagataaagttctgaggcatctcacagtgagaaagacagaaataaaaggggtgtagcacgagtgggagtgtgtgacacagagtaaattttgaaagaaagcagatccaggaatacctggatgtaaacgagagactctaggacaatatggaaggcagggaaaaaaagactgttacagaaaaggaatataataaagatttatctttaatgaggctgactggcacatgacttataatcaacaaggaaggtcatccaggtagaaggcatttagtgatctgagaggcatcaagcaatataaaaaattcagagccttactgaagagtggtcttaatagcacttcacaggttccagtgtttttcaagacagctgagatttcctcctgtctcccatctaacctgagtcacattcacctcacttcactcacctgggcagctgtgacgtggcctctcaccctgcagtgcccatggttcctttccttgctccaacatgaccacctctggtttaggaacttgataccctgttcatgggaaatgataaaggtctgggtccagctaattacgtttcagagcccaacaaatacagtcttattgttcaatgatggtttgttctttaggaaagtaaccagatatctctgagtaatattctgagtaccctaaacaaacagagaaccctggaggaaaaaaggacaaaaccatcacctatctaagatgccaacagcattcgtcaactgagaatgaaaacactctcagtgaggcctcctttcagataccaaggtgactgtgcttacctactgagagcaggtggctgtaggtctccagcatcacatcccggtacaggtttctctgagaaaggtccaggtgccgccattcctctctgctgaaatcgatagccacatccctgaaggacactgatccctgtaagggcacattcctgttcaatgtgcatagtcagctttgcacggtggagtgactatatatgggattacggaacatgggttttgttgtttttaatttacttcattttttttttgagacagtcttgctctgttccccaggctggagtgcagtggcgcgatcttggcttactgcaacctccacctcccgggttcaagtgattctcctgcctcagcctcctgagtagctgggattacaggcacgtgccaccacacccagctaatttttgtatttttagtagagacggggtttcaccatgttggccaggatggtctcaatctcctgaccttgtgaccttgtgatccgcccacctcgacctcccaaagtgctgggattacaagcttgagccaccgcatctggccgtttttgtttttgtttttgttttttttccttgagatggaatttcactcttttggcccaggctggagtgcaatggcgtgatcttggctcactgcaacctccacctcccaggttcaagcaattctcctgcatcagcctcctgagtagctgggattacaggtatgtgccaccatacccggctaaattttgtatttttagtagagactgggtttcaccatgttggccagaatggtctctatctcctgacctcgtgatcttcccgcctcggcttcccaaagtgctgggattacaggagtgagccaccgcgcctggccaatttacttcctttttaaagaacctgccactcatttccctaatagcttattacgaaaaattttaaacatacagaaaattagaaagaattgtacagtaaaaacctatatatctactacttagatctaccattaacaccttaccctacttgcttcatcacacattgatccatcttacttttttttatgtatttcaatgtaaattgcagtcatcactacactttctcttaagcaccacaaaatgcaaattattaactagggtgtaacatttgttaacctgataaggtaaaatttagtacaatacaaataaatgcaacaatctttattttgccatttgaccttgtgacaaatgtatacacctgagtgataagaaatttctaagaaataatattttacataggtcacatattaaatatccagttttagctggggtgcagtggctcacgcctgtaatccaagcaagaatgtcagagggggccggacacggtggctcatgcttgtaatccaagcactttgggaggccaaggtaggtagatcacctgaggtttggagttcgagaccagcctggccaacatggtgaaatgccgtctctattaaaaatacaaaaaattagccaggctggtggcacgtgcctgtagtcccagctatttgggaggctgaggagggagaatcacttgaacttgggaggtggagtttgcagtgagctgagattatgccacggcactccagcctgagcgacagagggagactctgtctaaaaaaaaaaaaaaaatctagttttacataatttgtggaacacagaaatctaacaaagaattccagctatttgttctgttctacagtcagtcaatcactcatttttcaaaactggccattgaaataggctgtcttggctgggcccggtggctcatgcctgtaatcccatcactttgggacgccgaggtaggtggatcacgaggtcagacgttcaagaccagtgtggccaacatagtgaaaccctgtctctactaaaaatacaaaaaattagccgggcatggcgagcacctgtaatcccagctactcaggaggcttaggcaggagaatcgcttgaacctgggaggcggaggttgcagtcagccgagatcatgccactgcattccagcccgggatacagagcaagactccatctcaaaaaaagaaagaaagaaagaaataggctgccttttagtcttctagcacatggatgaacaacctgccacacagtggctgatcaatttaggaccagtcattatgctactcctgaggacacagaaatgaattatttatgttactagtcttcacgcaacctgaaatacatagaaaataaataagaccaaagtttgaaaaagtgaagacattaagttcattaaggtgctgaaaagtagatctctatctgagacaccctgagggctaaaaagaagaaaaagtgcattctacatgaggaaataagtttacatttcatagagcggaagaatttaacttggaagataagaagagtaatacaaagtatggggtaagggggacattgcccagcaaagacaagaacaaaaagatggggagatgggctccagtgagccacgattgcatcaccgcactccaacctgagtgacagagcgagaacctgtctcaaaaaaaaaaaaaataaaataaggccgggcgcagtggctcatgcctgtaatcccagcactttgggaggccggggcaggtggatcacctaaggtcaggagttcgagaccagcctggccaacatggtgaaaccccatctctactaaaaatacaaaaaattagccaggtgtggtagtgtgtgtctgtaatcccagctacccaaggcagaggtaggagaatcgcttgaacctgggaggtggaggttgcagtgacccaagattacgccactgcactccagcctgggtgacagagtgagactccatctcaaaaataaataaacaaataaataaatattaaaatacacaatgagggccgggcacagtggctcacgcctattatctcaacaactggggaggccgaggtgggtggatcacgaggtcaggagtttgagaccagcctggccaacatgttgaaaccccctctctactaaagatacaaaaaattagctgggcacagtggcacatgcctggaatcccggctacttgggagactgaggcaagcgaatcgcttgaagccaggaggcagaggttgcagtgagccgagattgcgccactgcattccagcctgggcgacagtgcaagactccatcttaaaaacaaaacaaaacaaaaaaaaacaccacatgagtttaaagaacagcaaatagggctggacatggtggctcacacctgtaatcccagcactttgggaggccgaggcgggcagatcatgagatcagaagattgagaccatcctggctaacatggtgaaacaccatctctactaaaaatacaaaaaattagctgggcgcagtggcgggcgcctgtagtcccagctagtcaggaggctgaggcaggagaatggcgtgaacccgggaggcagagcttgcagtgggccgagattgcaccactgcactctagcctgggtgacagagcaggcctctgtctcaaaaaaaaaaaaaaaaagagaactaaggccagggcaggggctcacgcctatagtcacagtattttgggaggccgaagtgggtggattgcttgagcctaggagtttgagaccagcccaggcaacacagtgagaccctgtccctaaaaaaataccaaaaaaattagccatgcctggtggcaggcacctgtagtcccagttactcgggaggctgaggtcggaggatcgactgagcccgggaggtcgaagctccagtgagccgttaatgcaccactgcacaccagtctgggtgacagagggagaccctgtctcaaaaaaataaataaaacttaaaaagtaagagacttacgaatcatactaaccaaatgcaccttgtggactttggcccctaattaaaatgaaccaatcttaaaaagatatttacaacaatttagagaaatgcaagcaatgggtattagatgataacaaagaattactgttattttgttgtaggtgtgatattgacttatttgttatgctaaacaaaagaaaaaagaattcatctctttgagatacatatcaaagtatttttagataaaacattgtgtttgagattcactttaaaataatccaggagctgtgtaggaaggtggtttcagatgaaataagaatggcagaatgttgatgatgactgaaactgggtaaaaggtacaataggtgaacaggttgcttatactattctctttacttttgtatatatttaaattttttcgtaataacatgtttttgaaaaatatgatcctccaaataaaaaatctaatttggaattgcacagttaaaggaatgcctatttccacatggtgtacatatttaaagaaaagtattggctgggtgcagtggctcacacctgtaatcccagcactttgggaggccgaggcacatggaccacctgaggtgaggggttcaaaaccagcctggccaacatggcaaaaccccatctctgctaaaaatacaaaattagctgggcatggtggcgcatgcctgtaatcccagctacttgggaggctgagggaggagaattgtttgaacctgggaggtggaggttgcagtgagccaaaatcacgccattgcactccagcctgggcaacaagagcaagactccatctcaaaaacaaacaaacaaacaaagtatactagggacttgaatacccttccctcacctcagcaatttatcaaaatactagacaggaaatcatcaaatatacagaaaaagaagcaacagtatttaattgatatttatagactactgcaacaaacaacagcagaatacacattcttttcaagaatcatagaaaaatgaccaagatagaccataccctaggctataaaaccaacctcaacaaatttaaatgaataaaatacaaagtatgttccacaaggaaatcaaacaaaaaatcaataacagaaagaccacagaaaagtctccaaaggaattaaaaaataaaaacaaaagctttctggaaaagcaaaaactatttggaaattaataacccacagttaaatgacctataggtcaaagaagaaatctcaaaggtcattttaaaaataaatacacctggccgggcatgatggctcagcctgtaatcccagcactttggggggccgaggcgggtggatcacatgaggtcaggagttcgagaccagtctggccaacatagtgaaaccccatctctactaaaaatacacaaaattagcagggcgtggtggcacgcacctgtagtcccaactacttgggaggctgaggcaggagaatcactggaacccgggaggaggaggttgcagtgagccgagatcatgccactgcactccagcctaggcaacagagcgagactctgactcaaaaaaaaaaaaaaaaaaaaaaaaaaaaattcaggaaaacaaaacaaaaaacagaaaaaaaaagtcaataaaacacaatccagttgttggggagaaaaaatcaacaaaatgcggctgattggcctgttagtcaactagactgatgaaaataaaaagacacaaatcagcaatatcaggaataaaacaggaaatatcatgacagattcaggaaccattaaaagaaaaatatgggaatacaaacacttatttagataaactaaataaattagcttatttagataagataaataatcttataactattaaattacattcataatttaaaagttggtgaaaagaaatttctaggcctagttttgccagagaattctaccaaacttacaaagaagaattagtcttggccgggtgtggtggctcatgcctgtaatcccagcactttgggaagctgaggcgggcagatcacctgaggtcaggagttcaagaccagccttaccaatatggagaaaccccgtctctactaaaaatacaaaattacctgggcgtggtggtgcatgcctgtaatctcagctactcgggaggctgaggcaggagaatcgcttgaacccaggaggcagaggttgcggtgagccaagattgtgccactgcactccagcctgggcaacaagagcaaaactctgtccccctcaaaaaaaagaagaagaagaagaattaatgtgatttttacacaaactcttccagaaaatcaaagaggaagacctcttccaaattaactttgtacagccagtattactctgacatcaaaaccaaagaaagcacaaaaaaagaaaactatagaccagtatctttcataattttaggtacaaacatcctcaacaaaatatcagcaaacaatccagcaatgaataaaaagaatcgtgtactacaataactgaaattcatgggggaaccctctgtatcattttgtaattctctgtggatctataattatttcaaaataaaaagttttaaaaaatatactcctaaagaaagattattccaaaacatttggaatattttggaatagttatgactggaaaatcattgacaagactcactgtacaagtcacatgagagaatgtgaattacagttcacctttgaaccacatgggtttgaactatgtgggtccatttgtaacacagatttcttttttcagtaaaattacaccgagtgtgcctccctctcctgccctcccttttaccttcacctcttccccctttgccacccaaaacagcaaggccaaactctcctcttcctcagcctccttaacctgaagaccataagggcaaagaccttcatgatgattcacttccacttaataaataataaatatattttctcttccttttgattttcttaaaagcattttcttttctctagctgaattttattataaaaatacagaatataatacatataccatacaaaatacatgttaaccaactctttgctatcggtaagttaacagcaggctatcagtagttaagtttcagggatggtcaaaagttatacacagcttttcaactgcacagaggttagcgccccaagcctgcatcgtttgaaggacaactgtgcttagtataattgcggtttctgccattttttctttttattatactttaagttctagggtacatgtgcacaacgtgcaggtttgatacataagtacatatgtgccatgttggtgtgctgcacccatcaactcatcatttacattaggtatttctcctaatgctatccctctcccagccccccaccccacaacaggccccggtgtgtgatgctccccaccctgtgtccaagtgatctcatagttcaattcccacctacgagtgagaacatacagtgtttggttttctgtccttgtgatagtttgctcagaatgatggtttccagcttcatccatgtccctacaaaggacatgaaatcatccttttttatggctgcatagtattccatggtgtatatgtgccacattttctcaatccagtgtatcactgatggacatttgggttggttccacgtctttgctattgtgaatagtgccgcaataaacatacatgtgcatgtgtctttatagtagcatgatttataatcttttgggtatatacccagtaacgggattgctgggtcaaatggtaattctagttctagatccttgaggaatcgccacactgtcttccacaatggttgaactaatttacactcccaccaacagagtaaaagcgttcctatttctccacatcctctccagcatctgttgtttcctgactttttaacgattgccattctaactggcgtgagatggtatctcattgtggttttgatttgcatttctctgatgaccagtgatgatgagcatttttttcatgtgtctgttggctgcacagatgtcttcttttgagaagtatctgtttgccattatttttaatggcaaaaccgcaattacttttgcaccaacctaatacataaagtaaggctataatgttaacagggatgtagaaggaaaatggcactaattattagggaggcagacctgatgttgaatatgaaggtgagaaaaaggattaagaaataattcttagtcatcaattttgtgtcactatgtacattctggtgccaggaatgtgtagagaaggctgaggaaataaaaaaaaatgacttaaattttgtatatgttgagatttagctgacaggatatatacgagggtgtacactaggtggtggatagagagcttatgattaattgtgatagagattagctgaatagagagcttatttatttattttattattattattttttgagatggacttttgctcttgttgcctgggttggagtgtaatggcgtgatcttggcttactgcaacctccgcctcccgtgttcaagcgattctcctgcctcagcctccccagtagctgggattacaggcatgtgccaccatgcccggctaatttttgtatttttagtagagactgggtttcttcatgttggtcaggctggtctcaaactccctacctcaggtggtccaccagcctcagcttctcaaagtgctgggattacaggcatgagccaccaggccaggccattccagtgttttacaagcactttgggaggccaaggcgcagatcacctgaggtcaggagttcaatatcagcctgaccaatgtggagaaaccccaactctactaaaaatacaaaaattagctgggtgtggtggcacgtgcctgtaatcccagctacttgggaggctgagacaggagaatctcttcaacccaggaggcagaggttgcagtgagccgagattgcgccattgcacttcagcccgggcaacaagagtgaaactctgtctcagaaaaagaaaaaaaaaaaaaaaaagaaagctatattattaatatagtcacaatattatttattgtataaagattcagaggtcctttgtatagaggtcactggattcaggggagggtatgagcatgcagatggaagtggaaagaaaagtactaaagatatttataatttttaatatgtaaaattatgatttttgaaagctaccttgttgatttcttcatttaactgcattcagagattacagtttgtctcttgtgatgcatattgattgtgcttatagggctcagaacatcatttctttgaaaatggtacctatatacctgaaaagaatatacatgttctaatttttctctttatcatacacttgtatagtcacaccctacacacaccaaactccccaacccccaaaccctatgttatcaagaatttagtaggaacacgagatgtcatgttaggctggaatagagctttaccacctcaccaaatgagcttcttatacacagtttgtccaggctgggtgcagtggcccatgctgtaatcctgggattttgggaggctgaggcaggcagattgcttgagcccaggagttcaagacaagcctgggtaacatggtgaaactgtctctacaaaaaatacaaaatttcgccagttctattggcgcgtacctgtagtcccagctactcggcaggctaaggtggggggatcgattgaacctgggaagtccaggctacagtgagccgtgattgcaccacagcactccagcctgaggatagagtgagaccccgtttcaaaaaacaattaaaataacagtttgtccaggaagaaacctcctcactcaaagataatactaagcatcgcctaatgtacaaagatactatgagcaaaaaggataaaacaaaaatagagaggagattaaaaggaatacactacaaataatatactacaaataaattgacacacaacagaaaaaacatccaccatgaattcaaggaattcactataattataactacttaaaataattaaacaggccaggcgctgtggctcatgcctgtaatcccagcactttgggaggccgaggtgggtggatcatgaggtcaggagctcgagaccagcctcaccaacatggacaaaccccgtctctactaaaaatacaaaattagctgggcatggtggcacatgcctgtaatcccagctactagggagtctgaggcaggagaatcgcttgaacctgggaggtggaggttgtggtgacccgagatggcgccactgcactccagtctgggcaacaagagcgaaactccgtctcaaaaataaataataaaataaaataaaataaaataaaataaaataaaataaaataattaaacccaaggaagaaatagtggaaaaacagataggctaagaatgtggttatgtaaatttttgaaaaataaattggcagaactcagtaaagtttttttgtttttcaagcaacacagaaataaaggtctccttgaaagcaatgaaaagaccctgctaaaacacaaaaggtaggccaggcacggtggctcacgcctctaatcccagcactttgggaggctgaggtgggtagatcatgaggtcaggagctcgagaccagcctggccaatatggtgaaatcctgtctctactaaaaatacaaaaattagccaggcatggtggcgcgcgcctgtaatcccagctcctcaagaggctgaggcagaagaatcgcttgaacccggcagatggaggttgcagtgagccgagatcgtgccactacactccagcctgggtgacagagcaagattctgtctcaaaaaaaaaaaaaaaaaaaagcacaaaaggtggcaaagacaagtgagcaacataaaatggaaataaggagtttcaaaaagaaaatagaaaaaaagaatttaataaaaacatctaattaaaaaatccttgaagtggcagtatagaacttttattgttattcacagtataaatttaatagtcttaaacgatagatataaagattgggttaaagaaggtaatgttataaagccgccactaaaagaacaaaagaaaaaacagaggccaggcacggtggctcacacctgtaatcccagcactttgggaagctgaggcaggcggatcacctgaggtcaggagtttgagaccatcctgcccaacgtggtgaaaccccatctctactaaaaatacaaaaattagccgggcatggtgacacacacctgtaatcccagctactccagaggctgacgcaggagaatcgcttgaacccggaagccagagactaccataaggcaagatcatgccattgcactccagcctggcaacagagcaagactccgtctcaaaaaaaaaaaaaaaaaattatctttccactgccatacagaagaaatgtacaaggactccaaaggatgacagtaaaaggaggagcaaaggcctatctggaattgccaaaggaaaggaagcaagaacctccaccttaatatttgagctgaattctcaccaaaaaaattaaatatgacaaggacacaatctgaaatgaatctcagatgccattactgtcactgcaccaaattacatagcatcaaaatttataaactataggaaactataggaaaataatagcaagaaatacattggtggtgggaaactttacataatatctcccagctccatttgataaagtagaaaaaaatcattaatactatgaaagcctcataactatataagatatcttataagttaccaataaaatcttattgctaagatatcaaattctatatcctggaaacagatttcctgtttacacagtgccggtgtaacattcagaaatgttaaacataaaattttcaaaacaaaaaacacaaaaacctttaatgttatgccacatgcaaataattctctccatctctgcaatcctaattttattaaaagtagaatattttaaatgaaagtcttaacatgtagaaatgaaaatgtggtaagtggtcaatgaagacttggtgcttggtgggaaacaatatgttactagaatttcattctttttttctagatttttaaatgtaattgcataaggtaaattacttctctaaattatttttggtactgttttgctagactgtgtaccattacttctgatatacagtatttttttgaggtattttactattttagtttttagacttctttgactttggactgggctgctgaatgagaaaacagtgcttgcttcacttttttcccagtgataaactattagtctactgttttcatctactcttttttttcttttttgagacagagtttcgctcttgttgccccggctggagtgaaatggtgtgaactcaccgcaacctccacctcctgggttcaagtgattctcctgcctcagcctaccagtagctgggattacaggcgcccgcctaatttttgtatttttaatagagacagggtttcatcacgttagccaggctggtctcaaactcccgacctcaggtgatccaccctccttggcctaccaaagtgctaggattataggcgtgagccacggcacccggcctcatctactcttgaatacagttagtgaatacatttgacttctgaatctatttatttccagttcttttgggcattgaagttaactctgtaaacaaaataaaacaaaaacctgaaacaaggttgagaataatttctgatattatctgttactcaaaactttggcatgaaaatcaactgtaaaatcacatgatcttttccatcatttttgactgcgttgggggtgttgaatcaacattttaattcctttaagggcttctgtataatttgttcttaccgagttgaaaatttatttcttataaaatttcatccttttgtttaggttttcatatatttgcatggtttttttttttttttttttgagatggagtttcgcgcttgttttccaggctggagtacaatgacgcaatctcagctcactgcaacctccgccacctgagttcaggcgattctcctgcctcagcctcctgagtagctgggattacaggtatgtgccaccatgcccagttaatttttgcatttttagtagagacagggttttaccacgttggtcaggctggtctcgaactcctgacttcaggtgatccactggccctggtctcccaaagtgctgggattacaggcatgagccaccacgcccagccctatttgcatgattttacataatactcactcgtgattgtttgaatcttaggtatagaagtaactattactcctgttttctaacatattttgattatgtttatcttcactcttttttcttgatcattaatatggagaagcaacttgtgtttctgtcacatttttatcaaccattttttgttctctgtgactcatgtctttgcttttctttttttagtcctcgttcttttttgtattttttgactcattctttttgtaacttcttcagttgaaaccataactgcttttttcccaaaatttctaagattccttaaaaggcacttaatctatagttttcccctctatctacagtttagctttaccacacgaactttaaaatgtagtactttattagcagggcacagtggcaggtgcctgtaattccagctaggagggaggctgaggcaggagaatcacttgaacccaggaggcagaggttgcagtgaactgagatcgtgccaccgcactccagcctgggcaacatagtaagatcttgtcacaaaaaaaaaaaaaaaaaaaagtagtactttattgaactattttgcgttgtggtaaaatatacataaaatttgccattataattatttttaagtgtccagttcagtggcattaagtacattcacattttgtgcaagagcctttctgttttgttttgttttggtttttgagatggagtttcactcttgttgtccaggctagaacgcaatggtgtaatctcggctcaccgaaacctccacctcccgggttcaagcaattctcctgcctcagcctccagagtagctgggattacaggcatgggccaccacgcccagctaattttgtatttttggtggagacagggtttcactatgttggtcaggccagtctcaaactcccgacctcaggtgatctgcccgcctcggcctcccaaagtgctgggattacaggcatgagccaccgcacccagccttcaagagccttttacttatttgtaatttaatgctctttgtcagaaaacaatcaatattatagcaaagatttatattttttatctgctttgatcaataagcttctgaaagtagtgtgataaaatggccaatattgcatttaatgatttctgttcatttttacttaaaatagttcaaagatacattattaattaaaaaaatgctaataatttgtataattctttgtacatgattcttttcataaggatgaacaacatgttttcatccctttaggtgattttcatcttaaatcccttttgatctgttcctaaattgcagccctagctttcttttggctcactctcttatttttaaatgaggacaaaagcagtcctaacctctgagagttagcctcgtactatcaattaagcctcagtgttgctagaagctaacctggcaagggccagctaattcatggtgttctccatggtgctacacaaaaacaatctcttagaacaccaacagcaaacaagaccaatctctgaccatcatggtgtaagatgataccaagaccactctgtcgttatatttgagcatagacaaaaatcagaacattcttcaaaccacaaaagtgaataaaagtctccttattctgcctaatgcaagagactgctgcttttttcttttgagacaaagtctatctctttcatccaggctggagtgcagtggcatgctcatagctaggtgtaatctcgaactcttaggctcaagtgatcctcctgcctcagcctcccgagcaggtgggtctataggcacacagcaccatgccagactaattgtttttcttttttttttttttgagacagaggctcactctgtcacccagactggagtgcagtggtgcaatctcagctccctgcaacctctgcctcctaggttcaagcgattctcctgcctcagcctcctgagtagctgggattacaggcgtacgccaccatgcctgacaaatattttttatttttagtagagacggggcgtcaccatgttggctaggctggtctcgaactcctgacctcaggcaatctgcctgcctcagcctcccaaagtgctgggattataagtgtgagctaccgcaccaggcccaaactaatttttaatttaattaaattttttttttggtagtgacagggaatcactacattgccagggctggtcttgaacttctggcctcaagccatcctcccaccctggctttccagtgttgggattacaggtgtgaacgaccgtgcccagccaactgctgctgctttaccaactgtaactttagcctcaagctatccttcctatcttctagaataaaattattaagatactcaatcctaaaactgcccaagagcaactaaagtagaggttcactgaggtgcagatgagactctcaccacgtgactagaaccctgaaatgaaattccactacttctaatatatccaatagaaagagaaggcatgacaatatccactgcgatattgttcataatagtttctgtattttaccaaacaaacattaaaacagcaatgtacaaaaaagttaatctgctatgccattctgaaatcaagagaaaaaaattgtagttgttttcatttgtatacagaactaagcaatcaaagaaaatgaataaagcaggttatcactaccgggagacacaggtagatggaaggcagaggtgggtgaaccacagtcccatctctttcaccataatacttttcaatatattgcttttcatatatttctaacttttgaactaggtatatgcattgcctattcaaaagattaaactattcctaataaattatcacaatatcttcagatggataagaaataacaatacacccaggccgggcatggtgtctcacacctgtaatcccagcactttgggaggccgaagcaggtggatcacctgagggtcaggagttcgagaccagcgtggcccagatggtgaaacaccatctctactaaaaatacaaaaattagccaggcgtggtggctcgcacctgtaatctcagctactcaggaggctggggcaggagaattgcttgaacctggatggcagaggttgcagtgagcggagatcatgccattgcactccagcctaggcaacaagagcaaaactccatcaataaataaataaataaataaataatttaaaaaataacattacatccatgaaataagaacgggatggcaataaaaaaaaatttaggaaacaggctgggaacagtggctcatgcctgtaatcccagcactttgggaggctgaggtgggcagatcacctgagatcaggagttcgagatcagcctgatcaacacggagaaaccccgtctctactaaaaatacaaaattagccgaacgaggtggcacatgcctgtagtcccagctatttgagaggctgaggcaggagaatctcttgaacccaggaggcggaggttgcagtgagccgagatcatgccattgtactccagcctgggcaatgagagcaaaactctgtttcaaaaaaaaaaaaaaaaattttaggaaacaaactagagtttttaaaaattaaaacattaagttaaaatgtggatagtggtaatgagaagctcaatagaagggctggaaggcaaaaggtgtcaaagttacccagaatggatagcaggaaatacatagaaaatagtagagaaaagaaatggagaagcaacatctgaaaaacaagtttcagaaagaaaacagagaaaacatttgtgtttgaggaggtggtttaggaagaaatgaaaaaatgctttcaaaatctcaaacaaaagtcacttctaacaaggaattctatttgcagccaaaacatcaatatagcgtgatgacaaaatcaacaacagttttccttgacagtgcacctctccactgtcacacaggtggcctccagagacggagacattacccacgtgttcattcttgacaggaagatcaagttttctttcaggagcaccaagtctagagtccagctggttcctaaggcctgtctgcctctgccctaaggctgtggtgacagattagagctatctactcttggactgaaattccaccccttgggactcctcctcctcacctcataggagctgccatgatcctctggagccagggctgaggatttctggggtgaggtccaactagctggcatggccacactggatctcaaccctttttgtctagggtgcctgaagtttagtggtcatctgtgaactcagcagagctgctccgaagaggtgggctggagtctggaggaaggtctggcccagggactccccagagacacccaagaacctagaaaaacaatgtccacgtagtcattcaacattcactacataaacacttcctggatacaccaaggtgcaggtccctgcgctagaaaccagagcagtggttcccaaacgtaggtatgcattcaagtcacctggagggcttgttaaaacatagtttaaaattctcaacttcaccccttcgatgggtctaaggtaggccctaagaattttattttctaataagtgcccaggaaatgctgatgctgctggtacaagaaccacactttcagaactgtggagaacagtgctgaaatatgggaaaagccatgaaatttagagtaacattactgcagatttgaactgcagctgtaccacttttcaacaatgagaatataaagaagttactcagattttgtttcagaaataaggatgaaaatgcctgtgtcacagttactaagattaaatgagattatgcttttaaagtactcaatgcctccctgccatgcaagaatcacgcaataaatatcagcaattaccatgcactatattaaaacgtaatacagaaaaccatgtcatcaaaacaagtaagataataaacatatcagacaatgttgatctatatatgaaataaaaatgatatgcgattgagtgtgcacacggcattcattgtatacatatccccaattggtgcatgcaattggccatgcatctggaataaaacaaactagatctccacctcacacaatatttttttcttttaagatggggtctcgctctgtggccaggctggagtgcagtgacacaacctcatctcactgcaacctccacctccagagttcaagtgattctactgcctcagcctcccaagtagctgggactacaggcatgcgacaccacgcccagctaatttttgtatttttagtagagtcagggtttcaccatgttggctgggatgatcttgatctcctgaccttgtgatccgcctgcctcggcctcccaaagtgctgggattacaggcgtgagccaccgcgcccaacccacctcacactattaagtagacaaattccaggagcactaaacatttaaatacatgcattttttaaaacccctaaggatattaaaataattttcagactatatatttgtatagcattgtggtggggtgataaggatcttattacacatgacaggaaacccagaagctataacagaaaaaaacaggtatttctgattatgtttcctaattatatgtttaaataaaccataaaattcgacataaagatatataagaaattttttcaatatgtgatgatagcttgcttgtaatgttaactctaagcaatcactaagcaaaaaaggccaaaaaaaaaaataaaagaaactggaaaaggtatgaaaattcagagaaaaggaagcaaatggcaattaacaaaaagataccaacttaactaaaagaaaaacgcgtcagaacaattagagagaaattttccttagaatcataaaagctttaaaaaagtaacagaccaagcacaatggatcacttgaggccaggagttcgagaccagcctggccaacatggcgaaacgctgtctctactaaaaatacaaaaattagccaggcgtggtggcgggcacttgaaatcccagctactcaagaggctaagacaggagaatagcttgaaccagggaagcagaggttgcaatgagcggagatcacggcattgcactccagcctgggcgacagagcaagactctgtctcaaaaaaaaaagtgacaacatccactgttggaaagcatttaggcaaattgcttttataaattattggttgaagcttgaattgctataatgtcttttgagctatttagtcatatctatttttttatttttttgagatggagtttcactcttgtcgccccggctggagtgcaatggcatgatcttggctcactgcgacctccgcctcccaggttcaagtgattcttctgcctcagcctcccgagtagttgggattacaggcacccaccaccacacccagctaatttttgtatttttggttagaggtgtttttccatgttggccaggctggtctcgaactcctgacctcaggtgatctgcccaccttggccacccaaagtgctgggattacaggcgtgagccaccaggcccggtcagtcatatctagcaatacactcaactgatcccaataatatagttttaaatatataaagcagaaacagaagaaaggacaggtggacaaataacttttccaatgtgagtagtttaccttcctcaacaaaataatctgtgaggagatacataatatatataacatatgattaatatccataacaatacaaattagagaacatattacactcttttcatgtaatagatgtgacatttatgaaaaatgaggaagaactaggccataaagcaattgttcaactgaagcatcacctacagacactaattgaaacataaagtgcacttcttttttttttttttttttttggtgctctgtggcccaggctggagtgcagtggcaagatctgggctcaccgcaagctccgcctcccgggttcacgccattctcctgcctcagcctccagagtagctgggactacaggcgcccgccaccacgcccggctaattttttgtatttttagtagagacggggtttcaccgtgttagcaaggatggtctcgatctcctgacctcatgatccgcccgcctgggtctcccaaagtgctgggattacaggtttgagccaccgcgcccggccataaagtgcacttctaaacagctcatgggtcaaagaaaaacaattactgaaaaaaatttttaaacacttagatttgaacaatacgaaactgctacacatcaaaacttgttaatctttatattacaggctgaaatggaaagaactgaactttcaactcaggtcagaaagcaagctgatcacagtcctcaccgaccaccatagctgaccctacaggccctcagtcactgaccacagactcccgtcactgacccccaaaccccaatcactcatcccaaagagccccatcaatgacccgagaaatccctgtcacagacaaccatcaacggacgtcacagacccccatcaccatgccccgaaaccaccatcactaattccacagacaactcctctattactgacttcacagaatccctaattgcaaccaaccaaaatcgtcacagagacctctcggcattaaaacgtgaaaatagtcctgacgccagcggcgaaatagccttcggggaccacttccacttccggtccgacttctagcacc

SEQ ID NO: 2357 - DNA, 126085 bp, Homo sapiens
cttcaattttctcctttcctcaacagttttattgccttttaagaaaatttttgtaaaatataaatacaaaggcagagaatttacttacaaagttaaaacacagatttcaaacataaacacacgattcagaaaattttagttttatgtacatttccaagcaacctcaacatattatgttagttttcaatattttacagggtacagaaaaaaatagctcaaagtcttctttaaataagagcataaaatgtttaaacatataaacaatccggtttgatgcgtgaaaactaatttcacagcttttaaattaggatataaaagtttcatacaattagttgttgtgtgtggatatggtttgaatttatattacacactactggattacatccaatagcatttacctggcccgagcaggtactctgtaaacaaaacaaagttatatcaccaagtgccttccccgaattcgctccctcaaaccaaccacacagttctgaccactctacagtcatggcctgtcatcagagctttgtatgaaattaagtcaaagtgtggagctccttttactcatttttttttctccttaaaaaagaaaagaaacaaatgttccaagtaaaaacaaacgtatcccaaagcatgtgtgcattgaaaagtaaagaaacattataacaacttcataaaaactgacttaaaagtttaaaaggaaaaaaacatgtttctaagtccttctgactggagtaatttctcttatataaagaagagatattttcatatgtaatagtgtcctttctttacagaaatagttgtattatgacacatatgcacaaggattaacactataacacactgtacatggtgggtccagcttgctcaccagtagttgtctgaggccagatcactggggtggagccactctacagaggagcccagcagagtctgaatttcgttcgtgaattccaccagatctaacagctccttactttcagggttgaaggcttccaggtctttggagcaagagaacaagagacttgcagaaacctgccgataaaattctgcctctgcaatggtgacaatttccacgtttggaaaattgcagcgaaatatgcgggaggacattttcaatttcttaaggacatccgaaagcagtagccagtttcgtggcctacaaaacagaaaggaaaatgctttgagtttccagtaaaatgaaaagtgcgcccaactattaatattaactaccaacccaagtggaccagcctctatgtcctttcattctgctcccacccctcatttctcaccatacctactctctgatcaccattttttttttttttttttttttttttggagacggaatctcgctctgtcgcccaggctggagtgcagtggcgcgatctcagctcactgcaagttccacctcccaggttcacgccattctcccgcctcagcctcccgagtagctgggactacaggggcccgccaccatgcccggctactttttagtatttttagtagagatggggtttcaccatgttaaccaggatggtctcaatctcctgacctcgtgatccgcccgccttggcctcccaaagtgctgggattacggatgtgagccaccgtgcccggccatcgccattcctttctaaggtgaggcagagtaactacttctagcagtaggaactctggactcatctgtccatctagggaggaccatctgaataagccccatttctcccctttctgggggtaaagtcctgctcattcagctgtgaccacaactagggtcaagcctatccaagtgccctgctatcaacagtcactgggagagtaagtctgtatccccatttctttgatctcttctctcctcagaccctcactaacagcattataaacacacaaggctgtctctccattcaggcatgtccactcccatccttccattcttttgggagtgacacttttgagaaggaaggtgttacattccttgcatacaacctaccatactttatgatttccatcactgtttgtaatggcatatatgtttatagcttcagggctgaggaggatgttactcatcaagcagctctgtcaacacacagcagagcagtctcttgacaagtacacccaagatgattggtcactggcgaataggggctcaaccatagggggcagaggggattaactaaatctgatgacacaccaatatcctaagtgtcatgtacaatgattgtcctaaccttacacaaggtggtttatcagtgtagtccgtacatctcaaaacatcctacagtggtctgttgcaggcagtcctagggaggacaccttctcaaagtgtttaaggatttaagtatccaaggtgctgacccttccataaagttccagtcacccacttctctggggagtgacttaagccttggtgttagtgatgagggcaggtttataccatgctgtgccccaccccccaccacactgggtgtaaggaagctgatgtgtaccctttctggaaaatatctactgcattgtgtgaggttcgtggacagttaaggaggtcactcacccacccaccctcatctgctcaaagcgcatttctaactcctgtcacctcaagagcagctcagctagttttcaatcacatgacagccatgctcacccctgagccacagatacttggatgttataacacggtaagaggggggtctctgaaaattcaaattcaaacacatcgctataggcatcgtcatcatcatcctggtcttctggtcctggggggttggctaaaacatcatagccactttcatcatctggttctaatggagggcaaataagagaggaaggaatcagtaaactacagcaagatgtccacagttgtcaacaacaacaaggagtttaaataacaagattctttcccaagtgagtcctgcttccagtgcccaccatccactttccctcacccataccagacagaaatggacttgaacttgttcacctcctacggaactagagcaaacaatgcagcttaccacaaacagagctgccatagaagtcccaagtgccactggcgtcatcatcattgcgaccctggaggtcatttaaataatctggagggagagaaaaataaaaaaacaagataaaatctactgctgagaacaaaatgatggcagagccacgtggcattttttcctatacattcatgacaggctggaaggtcatttcctgtcttcctctttctcagcaaaataaagtagcattacacttatgtatctcttttttttttttttttttgacagagtcttgctctgttgcccaggctggagtgcagtggcacaatctcggctcactgcagcctccacccctccacctcccgggttcaagggattctcctgcctcagcctcccaagctgggactagaggcgcccaccaccatgcccagctaatttttgtatttttagtagacacagggttttaccatgttggccaggttggtcttgaactcctgacctttggtgatccacctgcctcggcctcccaaagtgctgggattacaggcgtgagccaactgtgtccggcctacttatgtatctcttctttgatagcctaactaagctgcttcttccaacaagtgagtgtaatttaaggtaaacaagggcaggtcaccagtgagttagtggcattctttggcaggaagtgcctgataaggactttaactgcaggtgcctgacactcatgaaaaccttgtgcttctgctttaggcactttgtaatgcccagggcttaagtaatgggttatctgatgacctaacaccataaacctgtccaaataatttcatgtatggaaggtttgagtcatttttcccagactcaagatgtaaacctatgagccatacctaagttaagaatgcatgtgtggaaaatgggaataactttaggaaatcttttaaaacattagggtgaatagatgacttagcttcactagaacaaagtcaaaccacacaaaagttcaaacactcggctgctctcctaaaagctttacagtttcagcctttgtgatttctgcctagtcaaattccaatcatctattgtatcgagttatcatctaatttttgaataagaccatttcttgaactttgtcatacctgttaagaacttttccataagttcactgtgggtcattttcatgatggttctacctgagtacgtagccaaggtggggtcagcaccataagagagaagtagtcggacaatttccaagtgatcgttctcaacagcatcgtgcagaggcctaggaagagaggcgcaatagaattatgctcatgcaagccacacttgcttataaagcagttgtctcctttaaaagcaacaggcaaagctgggcacatgtgcaccttgggtactgagcctcctaagcacagtatttcatccaggaggtgtgcacagtcaccgccactgcacagatagggaaactgagctacagtgagtggctcaacgtcaagcaatgaatcactgttattttgatgactaaccctttacagggcagatgaagagactatttcaggcctaaatctcaaacccaaatctatcctttttttgcgggggtgggggtgggggtggacagggtctcactccactgtccaggctggagtgcagtggggcggatcatggctcactgcagcctcgatctcctgggctcaagtgatccttctgcctcagcctcctcatagctgggactataggcgcatgccaccacacctggctaattttttctttttgtagggacggggtcttactatgttttccaggctgatcttgaactcctaggctcaagtgatcctcctgcctcggcctccaaaagtgctgggattacaggcaagagagccactgcccagctgcaaaccctatcttaatccaaggcctaagaaggaagtcaagcccaaaatgaaaacattttcaacaaatttaagtagtcatggaccatatgaaggtaacttacaggggataaaagaggtcccatcatcatggaagccaatacaacaagcaactgtcacacattaaaaaaaaaaaaaaaaaaaagccacctctgtttttaaaagaaactagatgcaaagagattagcagagactctcctgaaagcctgatcccaggacctcacacagatcagtgattaacctctggcccagaagccaagggaacggtggggagaagaaacaggcctggtggggtgtgttctcagcaggatacagaggcctcctacctgtgtccatggagctgggggttggggttggcagggagaagatgggtctctgcccaatctgagggaatgctatttgcaaagtgtgaaacaccaaatacatttccgtttggctatttctgtcactgtcaggaaacccccagtgcccagcctcatggcagcatcccactcacacaaccaggaagatgttcaggctgactcagacctgggtctctgaccaataaaccagggtcaaggacagggtgagggccacggctggggatgtgggtggcaatggcaggtcctgctgaaccagcggaggggcagctggcactctgtgtgtactcctgggactttcagctcaaatatattttaaatacagtgacttcatagatggtgatgaagagtccagggtcttaaaaggcaacacccccaattattcatgcaggcctcaacattttcagaagctttggttcacaggaacattataggactgatcaaaattgggagctttacatctacatttgccagaaaggtctgctggattcaattccagagaacccagtggtcagtgtgcttacagtcaccctctgtctttcctcctggaatttcccgtatacactgagaaccaccaccgcacagatagggaagcttggtctcagcagagccaggctgagaacaagacacatcactgacctggttccatcctgggcactacagttgacatcagcgccatattcaaggaggtgtcgcacaatgttgagccagcccctagcacaagcttcatgcagggcgcagtaacctgcgttgtcccgatgatttacatcacaaatcttgttctctaagcagtacaggaccacttcctgtggggaggggagggaagaatgccatcagatcactgcacaatgaccttgtaaggtggacctctctgtagctttcaaagacatacaccctcaggcctgagaacctgagaacctctcgggcgggctgtggatgtcttggtgagggggaaacacatgtgcgaagcgcctgatgacagggacagcatcatttaggggtctgctgcccagctgcctggccctgggcgagttatgctcctaattctccaaagcttcctttcctacctctggaggagagtaacagcgcctaccagaggctgctaagaaactgtaattagagacccacacaagcccttagctcagtgcctggcacagtgagtacagagggatttggttgctaatgtttcaaacaacgcatgaataagtacaaggacatcctcctcactcaatcgattcatccaataggtagtagtggatgacgacacaagtttagataaaagcaaggccaatcaaggcataatgaacaattaaatgagctggagaacgtttctcaacttcacagagaggaggatgcccaggagtttaggctggtcctcacgccccttggaaagacccggagttggagcctgggcggcagtgcctctgttggtatcatactcatcaacaaatgacatcaacgcttccaataaccctaccttctttttgcttcactctccgccccacttggggctgaatcaatatattttcatatttacttaagttaatgacaggaatctaatacaccacataccacaacctacgcatttcaagaactaagtaagacaatccttcccttccccctttgcagaatgtgttccgcatcaacagtttgcatgagaatcactgttattaatctcacttctttggcgtgttaaaacattaaaatgaaccgctcccagtaagcagagcagtaatttagtccatgttttattaccttgattaagaaagttttcaaacacatggaacagtatctgccaccagacaacaggttacactgttttcctagcagtcatggccagcagagagctgtcaggttctgaagactggggggaaagccagaacatgtggggtagcccaacacatgttccacttggcaaggggggagcttgatgggtcacagcaggctctcctttgtgacaactcttaaataactcatctataacctaaaataggcagcatttgagccacccataaacgtgaggtgagttctgaaaattcttttatgccctttctaagacacatcagtcaaaggtgatcactcacttgaacactaactagaatgttctagatgctccccctgtgaacctaaggctgcacgctggtaaccctggccggtaaccctgttgcttcaggacactgcggcagctcccttccaaatcaaggggaggaagagagaaggcatgcccacagatgcgtctcttccttcaggccctcacctgccagaaagcccacaatcctctgagctcccaggccacctgccccgagcactggtatccaggataccgcatgaagctgctgctcttttagcaggccctcactagccagactcgagtggacggctgcaagctaatgagctgtgtacccagccagggagaggccctgtcacgtgactcagggatcagctctaagcgccaccgactgctgtgcacagatcaatctacccggatcccggcagccggcctggtgtcctatcaacccagggtttatttgctctgacaattatggccttcacctggaaaccttcatcactactagggctgatctgagggaacatagaaatgaaagatgtcgaggctgaagggtaagtcaactctgttatcctggaggatggcaggcaagacaacagtaacccaacaaccaggtcagacgttttgccattggccaccgtaacacttctgatgttcccaaatgtgtatgtcatatcccacagtgacctgtgagatctcaggaaggaaaagtggtatgagtctcattcaacactcaaggaagttgaggcccagagaggttaagccccatattcaattaacacaaagtatcagacccataactcaggtcttttggcaacgggtctgctgggaagtttccaaaggcccaatcaagggccctggctagagggctgcaatccagccatgaccggcatcccttgcaccttttctgttggggtcaagcaggctaatgacactctcctagatgggagggtgatgggatcttaaatgggtggcaaccgctgtcaccaacagagagaatgaagaagccagacaagtctgtctacccattacattacttggtttattctccacgctggaaatgggagtgtttgaagggcagcccgcccattcccaaacaaaatcaaactgtttttgttggacaattctctgttaagcagctataagctgaatgacattaaccgcaaaatgtaaccataaaggccataaacccgacattgttaattaattaaatgcctcattaacttttttaaaaacatgatttattcgattcatagaaaacttaaccatcactactaaatgcacacacatgcggttccacattggcatcttagcctaagaacagacaggttcaactgtaactggcctttcaggtggtctattacagatctgaagacagagggtgtttctaaacctcaagaaccagattaacagaaaacaaagcttgagcagcctttttattgcatgtggtatctttttagctaagcagaagacaatgataaagaggggttttgggaaacctctcccaaagctgtgcattcataccgtaccttatcctgttaagcaaactgttcttttattttaaagggtttacactgccacatctgaatggactatcatcctaacattttaatttctgactaaagaaatcccagaaagttggattcaaagttgaaagctttcatctagtaattaaaacattcagcatcaaaactgatgacctgggaaagttctataatgacatttacatttgaaggggaaaagttgtccttccataaacattctcaaggcttcttgcaccaaaggcctggtagcctaagaaagcatggatcagtgttccttagtccaggcctgctataggaaaaccaccagaatggaaactgttccttagagcacccacaagggtctcttgaagctctgggctcagaaaggtgagactggcagaaatgaagccaggatcaaagaccaggccaggagccctaccccgctatggccggcaagtttgctgccctggagccctcccttacctctggtgtttgctggaagcacaagtccattttcccaatcatgcgtaggaatgagtggccctgcctggcacgctgcatctaccctgtcctcataggcgccgctgctctcagcttatgggaaaccaactggctgccacttgggtttaatctgcaagtaactgagctaattttcaaatccttctagagagttccctcaaagataatccagagatatcgataagaaacaagctggtatgaatagacaaagtcacatacaaccaaaaatacctagctagtgcttcaaaggaccatcccacaggtgtgagccagcatcccagttcccacccacacaatcatgccccagggtgggctctgggtcaaagggagactggcagctgggtcaccccatcaggaaaggctcaaggcacagcagactgctgactgcagcatggttaaggtgcatgagcctgggctctggctgaattccgggagcccacagctgagcatggcctggcatggatcctgtcgcccgggtgcttctccacacttcacactcagcctgctgaaccgcattttattttcaccacgactcctagagagctgatgccagcataaaaaaaaatgtctttgcactgtgggctattacatcactatctcaactgacaagtgtgtggtggggagacgcacaggggcagacgtaggttttgaactgtgaaaagcgtgattccaatgggagccagtcctggagaggagccgagtttggggggatggggggagactgggctttggagccaggctgctggattattatctgttcaaatcatgtaacgcctctgggactcagtttcctcatctgaaagcgggaataatattagttactactgcacaaagatgatgaaagggtgaaatgagttactttggatcttaggggctccgtcaacgtaagctatcattgtcatggcccatgctaggaggaggatgagcaggggggctggggagaagcagtgagttgagggaaaagtctcagtccctccctccagagccctcagccctaaggctactgtacccccccactcagaaagagaccttaggtctgccccacccccctccctctgtgacctacacagctacttcctgcctactccccctacacggccacccttccacccgaaacagtacaagcagccccagatagagctaataacttctctcccccttgctaatcagaatccaaaagggctcattaaaattcccctagtcgccaagccctgggttgtgtcagattttatatcagagataagttagcgagactggaggatgccgtagcagcctacctgcctgaacacgaactgaacatcagagaggcctttctttccacaccgcgattgaacaagccaccaaagagacagcagtgagagtggggctaacacaaacatcctgttggagcaccggcccagccccgatgtggagggggctgagctctgctctccatgtccctcccctcgcccaccacagtccgcaggccccgccccccagcctgcagccccagggagcgcccacagggacacacctcatagccaagcctggctgcccgctgcagaagggtctcgccagcgttcttattgacaataagtctccgtgcttccggcggcatagggcgagactgggtggtctcctgaggggaacttgagcatggcagctgtgtggactgggaggctggtagcagttgctgcaagcggtcgaagggctttggctcctgcttggctggtgacagatcatagtccgaactgggctccggccgctttctgaatctccggacagtcacctatcataaaaccaagcagcgcacacggttaagcccgtgtccttctaacagccgctgcttcccctcctcctccccacgtgacaaacctgcgtggagagaggcactttattccttatctttttttgggggtggggggtgcctgtcaaaggagggtttgggggaagggatttcattcttactagtttgaaacttcgctgccacccagaagacatgctcctctaggacaggggagtgacgtgtggtgtgggggaggagtccaggaaaaggaaagctttgtcccctcaagctgggaagcaggcaggcggggatgtgttcgcacaggccccagagggaagccggggtcaagaggtaccttgccatcggcattctccacgtagtattcccctgtcagtggcaatccccgcctggactcctgagggatcaagtgtttggttttgcacagtctcttcccggatggcttctcgctgttgtcggtgtatttctgcagcagggaggcagcctggcaatcctcttcttcgtctgcacacagcacatctgtcttctggttttctttaattttctgctgtttggcaggcggcctggaggctggtgcgcagcttggctgagcctgctttttgccgcctgcactggtggatgaaagactcttcatgggcggagagccggagaacacaggcaagcctaaatacggagggggtgacggggtggcgggcggatgggagacgggagaagaagcgggcgttacacagttgtagccagtgcaggaagaaaagcccattgttaacactgatcactggagcggcttcagtttttaaagatacaccaattatgttttcaaagcattaatattttaattataccacattcaaacggcacctaagttaacccacaaaacgccaagtggcaagttgcttcaaagggcccggaagagaggacagaagctggctcttcctgctttcctgccccctacccactgggtctgggttgctcaggacccagagactggagacagcctgaggctggaatgaaggtgttcagacttccttcctgtgcaaccacgggcaaggacatcaagagagaactccctgcctgccacatcttcgttgaagtcaattgctatggccttctaagatctcctcaaaagccctttcctacagagagtggatgacccaccctccaggagcggggtgaacactcaaggggtggcccccgcataccttgttcattgtcactgggtttaagagactcttccgaccagcttctgttgcctttggcctctgcccttttcctgccaggtttctcttcagtgatgttagtcccctgaggaatggcctcaggctgagtggcctgggtcacttccttcctgctttgccggccaggtttgccatctgctgccgacacctgctgctcccatcgttctctaaggtgcagcaagtggcgttgttttttaggatggagccctgttaattcaatgcacaccttcaggttggtcagctcactataatgtgggtcttctaagtggttagaggaactgtttgtcatttccctctcaggccagtcatctaatggagaaataactacaaattaatcaaaaagccccccgggggggaacaaactgtcttacgcatcactaatggggtgggggagggggggtgtggtcactggtctctgcttttgggaaggggcctaatcatctttggccatctgggttctggctttgggggaggggaggtgtgggcggctccccccgggggctccagggtgggaacctcacgaggcagtgtgggaatggagaggtccgctccactgctgcgcccccacggcttcccctcaccgactctgtctacgggggcagcgcgccgcacatccacatctcctgtccatccactgtggccgcatgcaaaggcccaccccccggcaggcgggcgaagcagacagggctcacctttagagactcgtcggcgtttggctttcagcagagggtcctctggcacctcctccgcagtggtctcagtgtggctgctgtcacctgagactttgcgtttcctgtccacccggagggtggggctgtgaggcatgtccgaggccacctggtctgcgggaggctcgctcacaggctgcctctccacaaagtacttctccacaggaagatctttgtcctctggggcttcaaagggatcacggtgcttgtttccaacactatactcgcctgggggaggggagacaagagggcattaatgaagcccgaaggtcgccatgagaaggcaggatctggggagtgcgtgggaccaccatgcccaaggtaatctgctattgacagctgcttctttggagactggggtcctcacacatggttagcacaaaaccctcagaaacagaactttccagagggagggtacattgaagacgagtggcaagtaaagcagagtgaggtgcatgtcacactcctgactttctccttctcccttcttatggttgggggcaagagggaaccaagaaagatggggcgtcaatgctacgttttttaaagcactatagtcctttcagcagaagatgcaaccaagctggggctgacctaaaaatctttatggaaacatttgctgaggtcattattttgaaataaatggcaggctgataggataaagtgaccaaatatccccaaaatgtcatctatcgaagggataacaccaatattcacctaggccaaccggggagatgaaaatggactggagacaagagtgttgaaagaaagcctaggtccttgatgggcagaagtgaccctcactcctggggggctctgggcctacagtccaggccagagggaggcagggaacccaggcagacccaggctgctgggaagaggggcgtggcaaagccaaaggcaaggtttcctaacacatacacgagttcagagaaaacttcaaaaaactcgatttgctggatgcacagatgtgaaaccaatgggttgggctgttcccatttcctgtccaacacaaagggacccccttggggatgctggccaccccagctgacactcctcttcacaccctctgtcacaggcaagcatcgacagacatctcctcattgttggtgtgtccttcccatgccaggccagcgcttgcaaaaccgctcgttccaggaaccctgtgctcggcctatcacgggccttggggcttttccttgaatcacctcagcccaacatcacttcctatttttgctctagcccaagaaatagctcattaactgctttgctggtcacaatttttctaatacacaatgaatataaatgataactacttaatgaccactgcgaggttaaggtgtcagcccttggcccgctgaaatgatccctctcatcaccagggttatgagtctggtgtcttggtaactctgagctgaggcacacaagtcaatttctagatgaaataagcacacgcctcatccgctgatctcattcttcctctccccaacccacttcaaatattactcccactcctgaccagcaccgctcacccgcttctctcgggggcattgccagcggttcacggcagtcagctgtgggggtgagctttacaggggtgttggctagcctgtgctctcaatggtgcaaggacccattcaccttctcttcaagggtgttctaagggggaacagatggggctgcatctattcttgcaaaggaatggtagaatctccccaaccgttcctcctcatcctcactcacgacagtgcactgtatggacagggatggctgggactgggattcggcacccaagcccccaccatggaataccaccccaggtctctgtaggtacaaccagcaacggatgggcgtccaaaaacatggccaaggtggtgttatgtcacagcagcaacaggagaaaacacacaagctgcccaaaacttacactatgcagaagtggtgaccactgtgctcagcttggcctggggacgcaaagagggtgggctgcgactcgagttgctctgtgtcttaaccactctggcagtaacagcgccactttacagtttggcccccttgagttgtaaagtgggactattactgcaagccacctcccccggtgggcttcataaacacggtgcagcagggcagagggtaaggctggagaaattacttacaaaaggacgctatgatccccagaccagcttgatttttagccctgatatttatgaaagtttaagatgtgaactgattgtcctagttatatactatttgactttctggagccaatcagccgcccctgaaagccctgtgggaggggctgggggtgcaatgtaaaaatgtaaagactgtgttacgaagcgccacatgcaaggttacttttatacttttaaagtgtactcatttcccctccctttaggtaggagagagggtttgagccaagtggtttgaaagcagaggtgactaggtaatgtcacaatgccttcctgggtcaaaatgaggcagcagcttagccagtgtggggccccacccagaacgaactgccctgtcttggcacccttcccagagacacccccccccccccatcaaatccccatcagattaagaatctctcaaccctagtgctttggatttgacttccacagcttccatttgaactccaggtctcacacagccacctgtatttgtaacaatctcaaccaagtctaaggcatctttctcagggagaaagttttccattggagttttgaccttcactgcaaacttcctaatagtgaaatgagtttatatctcacctacctggccttatgcccaaactgccagtatattttgtccacagaaaaccacctagaagacttgtaatcacttatttcacagactggcatcaacaggcagtgactaactggggacctagtctctctgctagggagcacccccattagatatggggaggtcttgccatctgtcttctctggggctccccatctaggaaaagctgcccagtgggggtggggagggctcccctgcacacaccaccttctgctccccattcatggggaagccagcaggctaggataaggggtgcgaaacacacatgcctcctccaagtccccaccattccccgttcagccggacagggcccccttctgcctcctgaatagtccagaactattatcgggagccctccactgctgcatctggggttcactgcaatcatgcctgcccacacgcagtgtagatgcttcttgtccgctctcaagaagatctttccgcaaacgagatctttccgcaaatgaggcctattgtccttccttcaacccctgagcctctcaaggcaaacatcccaattcccctcagtgaaggcccccaaaccttatgctagggtttccctccatgggccagtaataatcccaaagaacacccaccttgactgccgaagatacgtatggcaaacagctatgagggagaggctccaggtcactttcctgtacacttcacttggacctccctcaaatggggctattcttaccagtacccacagaaattactcttgagggcaaaggagatgggtgcatagacagagatgaagggatagataggggtcctaaccatcagggtcctcttccattgcaactacttacagcccttctgtgagtggaatgccatgtgcctttggtcatgagatctaggcagatgtgaacatggctgagtcctacaccgtctaccactttctccttgcatcatggtcctataaggcacagcacatacatcccataatttaccatggctatgccattgcaatacctcctggaagcatcgccatggcaacatttacaagtcaccgtggcaacaaagcaacctcaccactgttataaccacgcccagtaagccctaaacaggatggcagaggactgagatttttgaggactgcccatgacatctactccctctgcaggcaacatcacctctagcagaggccaaccatgttataacttctaccctctccagcagcagaggcattggtagtcatctgtctgcccaaactcaaagtagtttacaaagtacataggggctgctgtcctggaagagaagtttcctgagccaagaagtcccatgaaaccctttcactttcactcaacgctttctccagctcccgctcaggcattgccactgagtgagtcctaggtccacacaagccaagtggctaccaagggagacagacacccaaattcaagaaggaagggctaatatgcacatctaatatgtatcaacaaaagtaaatcaatcaataaaaataataaaactaaaaacaaaaaggaagggcccaacacctccgtgttccctaccccatcttcaaaatgccacttatcattccttaggagtttggggacactcctaactcatttgttcaatttctaaatgaaaaactcagcaacccatactatcactaagagtcaatgaaaatcctaaccacggtgttgtccagttaattcagtttttttaaacaagccctcccaacaagatgcacccacacgcaggcagctgaggccgcacaggcggcacctgccatctcagaagctactggtgctgtaggagtggaggggagaggcttcggggaggcatcctgtaccctctttgtgacccctgcctgccccaaatccccaccccagtttccatatgctcacagcttggctctgggccacagtgacacccatgaagagacgtgatggccgagatagctcagtgaatttgaagccaaacggatccagcgcatgctgtaccctggatgagatggcagtggcagcagcaaggacaacatttcctctaggttcctcctcttgatcaaccacaaacctatggtgccccagctcttccttggccctagtatttaaaaagcagccttcaccttcccccaactcttcttctgctctccctgccatggctcattacctgaggagcactacgtggtgacttatggcttgcagggccctgtcctgggtgctccaagaacacagcctgttggtatgaagcttggagggacttacagaaagggaaagggaggcctttctacatcatgtggggcttgggccctgctccccattggccacaccgagttactcagatgtgaacggagggtctggccatgttactcaaaaaccacagcaagggcaagaaggctggaagctggctaagttcctgtcccttcctccaggcccccagccatctactcagaacaaagagggattcttatgtatggcactccctcttttagaagcaccttccccatcaactcggccttgcccacttctcccaggtccctctgacaaccttcccaagagctggtgttgaggcaactcagagtgggggctgcgagttggcagcaatcatcagggaggaggaaggctttctttgccacttcacccaagagtggcttggacctcccactgccctgtagccactctttgaggaagagtgagcaacttcaggtacattgagtccctgccacttgagtaaggccaccacctattagcagcagaaactactttcttcagcaatgacttacaacaaatcagtcctggtttagcttacccaggatcctggcaggtggccttagtctgctcccagggatgagctggaagtggagggaggggtgtgcgctccgagtatcaagaagcacactctccctgatcacacattcttcccaaactctgtcaggcaccgatgaactgtgttgtgaatgtcaaacctccgacggcccatggtggggagctctcaaacatacccaacacttccaagtgtcctgtgtcaggaggactttgcacctactcctccagttagttcacccagacaccctaattccccttcgcccagtgaggtttctcatgttgcaagcagacctaaagcttcaagcttgcatatttaagaaataaagaggaagacctccacttgctgccaacacatcttagcaccctagaagactcgtgagcaaatcccaaagtcaaccctgttggtggggtgggggacctgctgtaaggaccaaagggagtgtactgaggaagatactagccttctcttcacatcacttgccctccaaaatgcaagctgccctctgtccggtgggaagagccccctcatgcatgccaggctgccttgggattctgtggccaattctcccccaccccccacggtaaatcgtaacgctcatctttatggtgacttcaccatgttcatcctacttcaacaacatctatgcctttggagggagaatataaggactcttcattccacatcagactgtcaccacaggggtggggcaggagatggctgggaagtgtcattccactgctacaaaatataacctgtccctgcacctaatttcctactgccatacctctgctacactgcgttatattagactgttatcaactctagaaccagtgcttctttggaaaaaaagatgtgtcccaggaaactatctttcacagacgcctcgttcctggttgccaccattcataaggacaatcggcccttcattccatgcatggcaaaagcagcccatttctccaagcagatgccaaccggacctgaggccaacacaagcaaactgctcaggtttacttacatctctcactttcgttctgttctgcaatggcctcctccagggtgaccgactttggctttttgtcctgatttcctttcaacctttcccagtcggctgggctgaatttgcacatctcggagtctttggttgctgggtggccaccttctctttctttcatctccaactctgagaagcgcatcattgcacgctagaaagagaacggagatggaaaaaaaaaaaaacaacaccttaccataaaagctatttcatttgccttatcttaaaggaaagtattttcaaagaaaagtgcccaaaaccaaccacagcttatgagatgtaactcagatattttaaagtttaacagataaaacttaagagtatctatatataagtagtcacacattctttattcataaagtcatgtgtatatagatatatatgcgatgtgtatgtatatccacacatacactattgcatacagacagacattctcttttgaaggtaaataaaacaaaacgaaaacacaacgcaaagaaaacaaaacaaaaacacaacagaaaagaaacaaaatacacaatgaataaagacgaccatggcccacaaacttccctttgtatatttggaaatgaaatttaactcaaaaggtttatgtaagattctagtaataaaaatttgaagaactgacctcacagtaagcagcgggtagacataaaatactgtcctcttgtaatccttccatctatgtaattaaaatgggcactcaatggatcatttagataacttcatccatttttataagcataaaccaatttttttcttaacattgcaaaacaatttggctttattcatcttttaattaaaagtaaaatatcttaaggaaattcctatacaacatctatcataattcactagcaagttaaatacatactctatccctttaagcaaccttttttcttttttttttcctttctttttggtgaaaaatttgcatgaatcccacagacatgcggctgctacacatctctaccaggtatcaagtaaggcattctaagcagcacttctaggtatatttgctatcttacaggcagagaaatcaaagcaattgataggtaaacgtcatgcagtctttagatacccttcacaataattaaaacatcggttatcagcaattgagtggagttcccttataatctacagaataacttaaagcatccagacacgcctcagtgctaccactcacgttctcttactggccacattgcatatattcaaattaccacaagcttcattcaccaaatctgcctggtgccctgccctaccatactcccccaatcctgtttacacattaaaaaactgacaactggtaaagtaactgaaattcaggtgggggggctcacctgcaatgcccgttgctcccggctgagctgactggaatctgcatacagttcggtagtgacacatttgaatcggtcacccacgtaacccgctgagttggcgattctctttgccagcttagatggcttcggtttcagaactttgccatcatttgattcagcctcatcagctccatctttggtataggtgggggtcacatccacacttggtggggcactgcccacacaaaatggtttgggatcctcttgggttttaccaaaagttacagcagggccatcgctccccagaggtggctccaggaatggagtcgagactggcaaccctaggttctctttgttggtacctgccagaacactgtccttgcttacggtgaagactggctgtttgaaagtataagtttcgtggaagtcactgatgcgccccaactcctctctcagggcgatgaaatcacggtgctgctgcagggccggctcaactgagggcttggggggctcagcgctctggccaacactctctgctgcaaagctgggtttggacacgtttgtgtcagttttagcatctggttcttctcggagaaggtctacgtagacaagcttgtcgcttttgacaacagtcttcccttgattccagttggggttcggctttaggttcttgtcggtggggacatctggatgtaacttggtgctgctagtttccaaaatctcggaaaaccgattccggagggttgggtcctcgtaacgggctctctcatgggaccgggatctcctctctggtttctcctctttagtaatctctatgggcgtgtgtggtatcaacatgggatgcaccatgcccaaccccagggcatcttggtaggtcacaaactctggacggccggtgggaagcccatagggcagcccaggctttggggcaaggtgcccaggaaacagactgccattgggtaacaaaactgggtgagggtagacaggtcctttgccatgtaaggagaggggacttacagcaatgccctcaggggctgggtaagggaggtaactcctggggtagggaattggtggggacctgaatgcctcatttggagacagaaatatagagcttggtggaaggccgttctcgtttgctttgaaactcggttctgggttgctggctttggcgcccttgctgctggtgctgctactgtgcttggcaggagtggccgggggctggcccacgtgctgaataacggatggtgtggtttctacagagctcctgctggttttggtgccatctgcattggcattgggggcgggtgatgcggaggctgggcggcctgcactcgacactgaccctgaaacgttagtgatgacagcatcggtgccgcccatgcgcgggcatgatgaactccgctgctgtggtatcgcccagtccaatgccttgtttttcagcgacatgcttttgccattgttctcttcgttaggacttggcccgggcaccacccaggatgagggagcagtgctgatgatttcagatctatagatagcacaaccatttcctggaggagatagtgtttctttcggaatctcacttccggagagcactaagccacttccagccctgctgtgaaccaggaccgtgggagccatctttttcatgtggtcagctttggaagcatctacatccaccactttagaagacaagtctagtggcttatctgtgacgtctttggtaacggtctgcttctccaacagaggaggtgagctgccatcttttctgtcttgaaccgctgtcttccgggcatgcccgggcactggctgggcaccttcgcccccttccggagccttgggatacttgccattggagagcctggccgcggggaactcgctgctaactgtcatgtatggctttgacagggcaactgaaggagaggtggagatcctggcatagtgcttgtggaactccgagtaggtgtctgcagcaggctgggtgggaaggtggactcggggtgacggccgaggcgaggggggcaacaggagagctgtgtcccccggcaggccactggtgaccgccttggcagagggaaccctgggctgcttactgttctggatgtgaggataggcgtgggaatcaacaggattcccagggctgacgcccatcttccacgggaggcttttgtctgcgcaatggacgagaggcgggatggctggggaggccgaaggtgtcgagagcctcatgggtgatgccaaggacgatgggatgtggggaccgacgtagtgaggtggcggcaggtagagaaagcgctccccattggtgcagactggagaatacagcggctgggccaagctgtaggactgctgaggtagcaaggccttgtacatgttcagtgaatacttatttggcgagtcgaggaaagggtagatggctggcgtggcaccctccatgtaaggattgacccagggcagccgcagataactagcaccattgatgttgagagggctctgtttgtcgctggcaggcctgtccaagcccagcgcttctgctgtggctacagcacttttttgtattccaggcggtgttttgtatatagcactgaagccatttgggggttttccagagacggcagaagcctccactgtctcgggtgtattcggtttgaactgcatctctggatttctttccgaagaaaacccaaggccacctagagtgcttgtggcagcctcccgacctttctctgagcccagtccacacaagctagaatagacgatgtttcccgggacccgcagcccttcccggatcaggccagtgcggtccatgctcagtgctgccaggccatcgatcctatgggccgtgctcgcatccacctttgcagaagaacaacatgggtgttactgggatactccttcaaggcagcagcacccaaagacactgccaactagttcaacatgccatcagccttaacatccaagcacaaagggttaaagacaggcttccggcggggcgggggtggggggtctgtttccccacccccttatccaaacccctttgctgcctgccttctcacctctcaactagtatcctggaagcagggaaaacattggtccctttggacttgaggcccatatattaattcagtcatctattaagtctgaagattttggccaggcgcggtggctcacgcctgtaatcctaccactttgggaggccaaggcgggcagattgcctgagctcaggagttcaagaccagcctgggcaacatggtgaaaccccatctctactaaaatacaaaaaaattagccaggtgtggcggtgtgcacctgtagtcccagctactcgggagactgaggcaagagaattgcttgaacccgggaggtggaggttgcggtgagccaagactgcgccactgcactccaggccgggcgacacagcgagactctgtctctaaaaaaattaaaattaaaaaataaaaataaaaaagtctgaagatttttaccttctcagcaaaaattctttgctacaactaggacaccaactccaaaactctcagcatcaccctcatggggtacagaattcacactaaccctccctgggcctgtcaggcttgggggtgggtgttcgcttcatttcccctgggtgcaggaaggcatgacttaacagaacaagaaacgatcttcgatgggacaacaggaacagaggactttagcagcctcatttctatatcaatatagaggccatgggtcaaactgtggttgtgtcttttgacttcctctcccttgtgtctgaagtgacagtcctgtgtttcgtattttactggaaaggtaaaccctaaggggctacttggaggctggaaatttatccagctgggagcgctgatgtggcatccagcttatggaagaaaagagagtacacatcccaccagtcactaggggacagggacatgtgtggcgaggcaggaaggcaagactggaagagcttgggtgggggccttgtcctctcgcagaggcctccaactcagccctgctctgaactgccacccctcccccattccccaccctttaagggcatgcaaattaatacgattgattacagatcactgatatgcagatatggcatcaacagaagctattaatctcttaccacgttgtggttcaagggattctcttccctcagttccagtctggcttttgaagcgtcaccatcatttacaaggattttcctatttaaaaagatacaccaacttcatgaaagcattcctcactgaatccatctttcacagatctccccagaacagaccagtttctactaacccaatttttaaaactgtccttaaccctccgcccccaccagctgtcaatggcccatattgaaagtcgcccccaaatggtgattcaacttgaccaggaaaaacaaaggaaacgcaaagctttcatgtgtgaggacatgaatcacaaatatgatgtccccaaggtaggtaagccagaaattaagcacaactacttctccctcgagatttttttctctagaggccaagtaggccaatcggagctcggctgtcccagccaacccttataaactctcctggagggtagacatgaagtggtaacacagccaaataccaaagggggctggaaggctggtcgtgtcatcaaccacttccgtgttacccaggagggtaggctttcaaaactttttccaaaacaaagttagggaccatgtcctacgaaactggtttccatggtgataaaaaagccatatttgactgcctttgtcaaaatgacagggggatacacactagtatcatacaaatgtcagctgttccaggctgaaaaggaagctgcacatctgtgccaggctgctgcggctgccctgggacttgttatcagagagcatcgataaagaaagtgcttggtgccaacttccaaatccccaggataaaaatcgctgacaagcggcagaggaaaagtttcctcattaccccgaagagcagcttcaatcatctactgcttagctgcctccaccccacaactccaaaattactgattaggaagcataacagagctgtctgacgaccaaaagcaggcgccagtggcctctgggaacaggcagcagaggacaatgagagatcctgggcttcaatgaaggaaaacggtggctctctccccatttattactgagcaaactatttgttttaaaagcacatagaatgctgctccacctgggcccacactcctgacatttagagttaaagcagtatatagactgggattaattctccttcataaatatgaaataataaattaaggacgaaagtgcactgaaaggccgctttaggggctaatcttttaaagggcggcaatgcttcactgagccaggttgcctgttaaaactgtaaatcaagagcggcctactaggcgggaagctctttctctcccaccccttttgggcccacggtggctgtgagaagttgaggggggcttcagcatgggcgtgggctccactcaggcccggcccagatgggcgcattcacctgtcttcgctcgccccacacatgcggaccctctcgctgttcatccagctgtgaacgttcccatacaggggggttgctgagagcatgtcgtcttctgggatggcagctttgcttcaagcgtctagtctgttaaaaggaaagaaaaaaaatcccaggaggttcagtaaaggagagccaaacagggcgctagagaaggcctctttctaggtgattcataaaggatgcagatggggaaggcaggctgtgcctgctgtctacagtggtctgggagccaaggacagacacctgactcgaagggacagcggaggggcatgcagcttccctggtaggaggtgctggggctggggaagaagtttaattcgaaacaggtagcctcatccaaggcacagaacacattcagggcacaccacagcacccgcccactccctttcctctgaaagtgtacagtggtcattcattcttgccacttgttaaagaaggtaaagaagacttgattcaacaaggggaggctctgacaataggttcagggatgctgcatcactgggaggcacacaactgatctttcctggggccaaaagggtgcaagaagggtggaaggcaccacagtgaggtgagcggcaggtccagctctcaaactacctgcgtttctagggctgaatttccaaggctgtcgtgtgtgcaacttacagatcaagtgtgaaaaagagtcggtgggctggtgagccgccccaccagagccctggattagattaagcagctaacccgggtggttttgcctggaagctgcagagagaggcggctgagtaattcaatgacgcctgctcactggggacgagaaatcattagcgagcacagaagtcttagcagccctggctgatgggctccaagccgctggcacatggggagccggcagaagccacccattttccacgttccgggagcgggaggttgccaaggcagaggagctcagaccaccacccacccccctttacctcctctgcccaccgcccccacccacatcacattctagtttgctgcatgagtgaagggtcaggacaagctgcattttattaacaggattatcacggcgcgtgatttatcctcgtgcaggattttaattgctctttggaggttgagccgtttcttttgactgcgcttcagcccatatcctgctgttaaatgctgggttaataagtaggggagcctttaatgcctgggaccgatggccctcggcaattccctgctcacaaacacatctcagtgtcccttgtccagaccggccatggcatttttccacgggacccaaacctgggtgtgaaataattggtgtgcagatcatcaggggaacttttttctcctccctcacacacccacccacacagtttccgaaagcccaaatgttccctaagtcgacacatttcctttgttagcaggaaaaaatatgcaaatgcttgcttttacactttagcacacggagcagactgccaggtcggttgggttggaggcaccaggtccggggactcttctgtgagagtgactgagggtgggagttaaggggacacctgggggatggaatcccaaagccggtctgtactttctcatttctttgtcctaactaggtcttttgtccaccagcatcccccatgggcccccatccccatagaacaacgtctgttaaccaaaatccacatgcagcgacacaccacgtacagttagagctcaacaatgaggctggaagagaggtaaagggcccaagaaaaaggcagaaatctgcagaggcatcaggcatgatggggttctggaaagctatttccctaggaagtgtctccagacagcggctcttccagttgactagccacagcgcccccaaaggaccgactcggctgttggggaaggttctataagggttcgtgggcttttcttccatcttgcaaatacacaaatcaagtggggaaggccaccactagggctgggcagaccacaaggcacattcccttgtgcagtggcagtgtcccctctccggcccctgctgccctttctaacaaaaggaagacattctgggtaggataatagagaaggtggaacatcattccccggtgccagtgtgtcccggtcatcgggctgcagcagtgggactgcaccatgccaccccctcactgtgccatgatgaaatacagaaattacatcatgagccaaagggtcactcaaccaaacccccaagaaaaggatgagggaagaagcgtgtgcctaatgaacctcaatcttctggtgtccccattcttaaaaattggcctcccctttaaaaaagctgcctctggccgggcatgatggctcacgcctgtaatcccagaactttgggaggccgaggtgggtggatcacctgaagtcgggagtttgagaccagcctgaccaacaaggagaaaccccgtctctactaaaaatacaaaattagctgggcgtggtggtgcgtgcctgcaatcccagctactcgggaggctgaggcaggagaatcgctggaacctgggaggtggaggttgcggtgagccgagatcgcaccattgcactccagcctgggcaacaagagcaaaactcaaaaaacaaacaaacaaacaaaaaacctgcctcttacccacctcccttaagtagacaccttgtgcaaaggacctcccggcaccttcttgggaaacagaatcattatactgaggcccagccccgaaaaggccagcagctgcttcccttcaaagagcctttcttcagcaaagtccacctggacttagcagaaaggtgactgcggtttacaggcacctgggcctactgggtgctttcaaagcatctccccttctccagggctcctcctttggggctttccatattaatggcgcacagataaatgataccagccaccagaacaaagtgttctcaaatgcacagggtcagatggagggttgaggctagcagagcggttcactgtcgtgtgtgtgtgtgtgtgtgtgtgtgtgtgtgtgtgtgtgtgtgtgtgtgttttgggagggaaggggtggaggatggggctgaacataaaagcaaaaggggggaacacattgttggatcctgctgtggacttacgcacacacgtgcacgcacgcacacgcgcacacacacacgcgcacacacacacacacttataatctttagctgccccatgaactttttgtgaactgtttaaaagtggaggtctgttgaacaaacagcggcgccactgccagccataatttcattgcaacaagctaaagacttttaactcttcgggttcctggccaaagatggagaggagtggaaagggccaatgagcaatggccctggctcacaggaggccctcctcctgggtgacaaagagcagtccaaacctacaaaagcagggacctcctttgcaaaggccatacggctcacaccaagcctctactgaagaacaggggtcaccattacctacagcccaccctggtttctctgtcatgtacaacgaaggggacactggggtaagaaacaaaaagagactgggaggcaaagtatagggacatcaaacttctagaagctgctgttgaaatagctggggacttttttacctctaaggccaagtgcttcgaaactgatgttgctgacccttggcagcggaacactgtggagagggcaaatgacctgatttcaatgacaaacagagcctcagggtgctttgcagctatagatgaagctcgtttgcttttatttttcaatgcccacctccaccccccacttcttccaaatgcaggctatgcttccagaagtgccaagatgtgtgaagtcactcatgaaaagcactttacaagcaccaacctgttccactgtgagctgcgaagctgcaccttggatctggggtttaacccctttttctagtagtggagagaagtgggtaaaggtgctggatagggatggagaggaaagacagctgagaagaggtcagatggggagggtgtgggtctctaaagaacagactgggaactgttccagctgcctgcaggaacacccagggccaagtggagagacctggcttgtgagaagcaggcgtgcacactgcatactgcatggtctccagctcttagcaccaaggaagtggaacacataggagagcttgggtcaccctggacagactctgagtagtcattcgctcttcagccaagggttatgatgagagcacctgagcttggcccggacacgggggagaaggcctgattggcagaaggggggcgtcgagggaccaagatcataagccatcactccaaccttggcatccctgagtagggacacacccaccctctgtgaaaagatgtgagggcagaccacaggtcccaagccttggcccctttccttccccacccccaaccctggccccctcttgcactagggccactttccactgcccccacccttgaggcgccgatcagttaaaagtctgcacattacacttgtcaagtggcactgacaatttggaaagcatggccaccaaactaactctgctcacgcctccctgctgtccacacaggcattgagggtggcccatctcggggtcttttcttgggatctctctcactaggttccccttgcccccaccggcagctatccagcagttaacagccagaagaactggagaggttcgcaagggcttccagctcaggtggccaggcaggcattcccagccagtgtgctggggtcctctggcagaggactcttcaggggaggggtctcgctactgcatggctggttctctgtggagaacatggtcaccacagcctcccggctcccaccctcactcaccgcgtgtctctgggcaggtggctgaacctctccaaccttggtcccctctgtaaatatttggcactgtgttttccaaaggattaagctgcactatggacttgagttttgcctggcaatagctggcgctggccacgtttaaccccgctaaatagtacccgactccaataaacacactgtgtaataagccccagaatcacaacacagtttctttggggcactaccacctcatcctgcgggggaggctgaggcagcaacagagaggggatcagagcagggagggaacttcagcagaactgtgtagattttacagaagcccaaagctcaccacccgccagcccttcctggggttgctccaaacagagactgcgtcacagcagcagcgctgtgctccgggtgtcaaggaagggaggggtgaagaagttcctattttaggatgtgaggggtgggggtggggtgtgtgggagtgggagatgagaagaaaaagctcttccggatgtgcagtgtgggatgggtcctccgggtctgctggagagtaagataccccaaggctgccccccaggtccctgggaggcaaaaccgcaggcttccaggggtgtggtcgagggaggtggctggcccggtcccacccctcccgaccccctcccccgagagagttgggggtgagggaagtgatccagccggcccaggtgctgcctcttggcacactccaagccacagccttagccgtagccagcacgggcgtccccgcccacacctccaagttttgcattagtaagggggagggggaaggggaaactcgccggcccagaccattccagcacccagaaccttcccggcctcctcccggggcgtcggggtctgagcggagagccacctgggctgggagtgaacttggccccggcgaagaagaaagggggaggggcgccccctccccgggctgaggcgcttcagcccggagcgcgatcggtcggcaacaaagggattttctctcccaccacacacacccgtgctgctcggggctcgcccgctcctcctccccgctcctcggcggaggtcccagcgcgcggggccgcaccacggcacacactcacgccctcgcggcgcgcccccgccaggccttccaggaactccagcagcctccccggaggcggcccgaccttcccagttcccgaccctaggtaacccctcggaccctgcggcctggcacgctctccatggtgccccttcccgaggccccgccgcaccttctctccccatcaacgaatctgacgaaaagaaactttgggtgggcgcagggagaatccgagacctcccgggaaacgccgccgagcccacccggggaatgggcacggcagacccctcctcgccatcgttctgggttcccttccgatcatactagagcgctgctcctctggacgcttccccttacaaagatgtgagccaagcgtcgcctactgtaacgtgggaggggtgcgaatctcgggcgttggggtccggggtggaatctgcaggggttgaccctgagggtcgctgccgaacctggattgtccgctacactcccctcctccaggcagagcccatggcccggggtcaggtgcccccaacctctctctcacaggccaacgggggacacttgcccgtctccccggataatctgtccaggccaccccaccggctttttgttcttttcactttccttcatggttttgccacacggggagtcaggaaaccacgtgtgtattcaagagagggcaaatttagaaacaggtgtcccttcacaggaggccacccggcaacagaaacccaagtcaaaagccaggaatccctccttactatcttccctccacgcaaaaagaaaccacttgccccctttgatctagtccctgcagaactgggtccccacttgggaatctacacaacctgggggcaaatccagaataaatgttccacaccatgcctccaaaggctgtgtcaatgcacttttgtttccaccagggctttgtaggagtaaaacacaaacgccgtcgccgccacccccccccaccaccaccaccaccgaagggaacaagctataccgtaaggctaataacaacagctatcattagtatacacaggaagcacaaaggaacttttaatgcataaaagatgtgtaaaatgcaggggtcctgcaatctgcaagcgagtctctcactgattgtgcagagcctgggagtcccagaaaggctgggatgagggtcagagaaggagaggggcacccaccttctttacaaggaacaataggaatcccatgtctgctactcagtcatggaactcagagcacccaaaacaaagccatggaacaactatggtatagatgggggcccacgaatttttgtagctgttcagggcttaattactcctccttgatccatgggactagacacgacaccgccaaggttaaaatgccccgaacagcgctgagcagatgtgagcgagctggcagacgcgcaaatgaggcctgcctcggagcacgataacaagtgactaatacattgcatatcgttgaaagaaaattatttttctctaatttgcatttgcttgggggaaaaaaagccaacgcgagtccctcctcacatgcacaagtctaatcctggaaatacagcccggctgctttaagagagctggaaggagggaaagactgccagtgttttggcgttgcaggcttgtttatctttccgcctttcctccaaggcgaaactcgttttgcaagcaacattcctacagaaaatggcacacgtcataaaaagagaccaatttatagaactggcaccgaagttcatgtctcactccagaagcatctcccagctccccatcggaaacccaactagatgtagaagtccatgttaaaacttagagagtagacttagggaggggaggtgctgagggtgggggggacaggagagaatgaagtagatttgcagatatcctgtaggctgtacacccagagaccaaagtcagccctaaatgatcttccaaaacccaaggaggaccaggcaggtgccagggcttggaaggcttcaaccttgggactcatgggggagaggagtgaatttttacacccagcttgccccaggacggtccagaggcaggtccacattcttggccatcctaagtccacctgcttgggccagccatgaacctccaggactggcctagtgggtaactgccaccaccaactgctctccctcccaccctggcgcctctctgcagggcctggcggggtaccaggaactcaaagaaagcctgttgctgtgggcatctagttgatgaagtcagagtaggtggtgctgtgggcaggcttcaggacggcacctttgcgtgctgcagttgaaggcaaatgtgctcttgaaaacgggaaggcttggaagaaaaggttaagggatgtgggtaatcaaaagccaatctgtcctcccttccccccaaaatacaccccccttagggtactgaacctgcacacttgcatttccaagctggaaacagtgtcgagtgcacagaacacagcacccgcctgtctctaacttgtctgaataacagggccatttcagaggggaacaacggccttcagagcctctgcaatttccagaaagctttcagttaataacacattctttccaacaagcttacttagggctgaaagttattttcacaaatcttaaaaactcagccataaacagctgaggacccagttcaacggatcctggccaaaccccaccaacacggtgacactcacggccccgtgggccttctcccgccacctctgcctcaccacaagttccctaaaccacaacatacaaaccatcctgcaccccaccccaatcctgggaagtcataaagatgtgtgttggggatggagggcgggtgtgccgtggagctttctctcatctggggatgcgctggccagaaactggccgccacctctgcagctcgtccatgggcctgcatagtgcgcgctttgtgtaagtgctgaggaggcgcagcgctgctcgcgcgccaacagctgtcacattatttgcactcgctgtaaacagccttcacattccccccttaccacatagttaaagccagactaacaatccacagttagagatcaaaccaacaacagcagcattgtgtctgcctttgctgccttcacaccaagcccagcagctggcaggtttctccggaacaagggaccccttctccccctacccctccgggatccagccaaggctagccaaggaagcatgcgtttgtcagcgctgtttgttaaagcaaaagagcaccgccatttcgcagagatttccgtgtggctcatcagccctctccgagagtttactccttctggaagctcgaggaagcatcacgagaataaaggttgtggagactcgcagggttggtttccatgctcagcaaagtggggtctggccgggctggggccggggccgggacagggaggtctgcccctctccatgccatgtcacagaggccagacaggtctgtgctttctgcagccctcagcggaatgcctcctgtctttcggaaattgcccaactcactaaatacttactggccgccccactgatcaaaatgtctcctttatgatttttggttaagttgaacatttccataatcgtcattattagtgcaaattacacgcctaatcggtccttaaatagattttaattaaataagcatacaaggctcattttatgacttaagaaaggcattacttttcgttataaactttccaccaggatatagaataacgatagcagacaaatacttattctttgaaaatcaccaataaccgatgggcagagtatcatgaaacataccctgttttaccctctggaatcaaagctgagaccagacatatcacagctgtacaactttcctcctgggatgggagagaggatttcttcctccaaagcactatgtctgtcttccttgtggccagtagaaataaacccccggtgctgctttccctacccatctgatgagatttctctagttgatgtcctctagcaaccactcctcccccacctccatccattttccaccctttcgcctgcttagagtcctggtgcaaagcaggcacgctgtgcttgttaaatgctgtgtaaaatgctgttaataaaataataaatacaaaggatggaggctgctgcttccatgggtgttttgactggaaatgccttggcacttgtcatgtgtttatgggagggcagacaacgctaggatttacatagtttggacatttctgtacttcatttattctttcctaaatgacgtaggcctcgagctatttcaagtttgcatttgtacagaactgttaaatgcctaggagtttctccaattaaaccaagtttaaaatcagacccaaagctggaacatacactcagacttgcccaactccaccttcagcctcggtggctggacaaaacaaacagatcctcgaaaacaatcagtcctcgagctccccaccttcaccccccactccaggagggcccctagggcaaaggttaaggcgtctctagattccaagccccagcccaggctacacactgaggcaatcactgcagtaaggcgcatcttgtccatacactacctttaaaatcgtgcgctaaaatcggggggaaactgctggcctggtaaaacccactgttcacaaaacaatgtcagcaaaggctgtaaggcattctttagagagggaccagggattcgtgcctactgaagctctttcagcacaaaggcttttaggggaagaagggaaaaagagggaggaggagggggagaggaggagagaaagggagggagggctcctgtttcagagcaggcatcccctgagagtcaagaaccaagtgtagcttcaatcaaacactgacttcccctctgggagtcgagtaggaaacctgatcacagtagcttactaccagcctggatccatacaggtctggttttcttctcatgctagtaatttttttaaatacatattgatataaaagaagcaatccctggcagactttattgaaaaccacattgagccctcataacatccggacttaatccctatcaaacaaaccacagcacctctggcctctgcaccaggccaccccctctcacctcttccaaccaggtcttgcccctctaggcaccgtggttcccccctgaaataatgccaggaagccttgccgaagggtacctagatgacggttctgaaatgagttcctaaccatataatgatcccacttgggggtggaggggagaagcaagtcttttcatatggaatcctttaaaaggcagaatgcaaactacggtaacaaagggaaaggggaacccaggaaggtggacctagaataccctcgtaggggagatttaatctgcatccttgggtcccaggacacaggcctagcaagtctcagggggtctcaggggcagcagggaatggaggagcaacctataggaacatgacaagtcattcaaagcaattattcatccttggggcctactatgtgccaagcattctatttagatcctaaaggtggataattattcccagtcttacaaatgaaaaaacttactggggctcaaaggccataaataacttgcccccaaggtcacacagctagtaaaaaatgggccacggtcaaactcagtcctggagttgcggagaggagccaattattggtctaattgtgccatttgaaatcctgattttcacatactgtctcctctgaaaagcttccttaggccttatgtacccaagaacgaggcaaagagtgtttaacacctatgttacttggtctacagtgagccgtgaacccagtttctcctgtatctaagtcatctcctggtccactcaaagtctttcaccatttccccctacatcctacaaatctccctacactgttataccctggtgtaaggccaatgctctcaacaagcctcccctttcccttcctccagtaccccagaatagtcaggggtaaggtgggtcgactcctttcaggtctctgggaaaagtgctgactactggtactaggagctaggcttgccaccccagtttcgccacataaagcaataaatcaaattatctagatagagcaaaagccctttggagggagctcctccatctacctttcctaggatttaaaggaaaaaccccagggaacaaagtagtgtgggagagggaattaagatggaagacgccagcaagatgttctattgggccacccagagtcccccacaaaagcgcaagccgggggataggctatcttgtcctttccccaacgtttctttacagaagcggccggcagcaaacctcagggcccaacatcccctccccaccctatccccaatttccgggtctgccccaggctttcagatgttccgggaactacctacacccgcagagcctgccaaagccacctccggctcggctcgatgggtacaggcaggggtaccggacactcgggcttcccggccctggactggttactcctccagacgctgaagctccggatgtgcgaaatggctccgcagtgcgaccgagtgtgcaggggcctcggcggcgggagggacggaggggagacggcggcgccggggcgctcaccccgctagccagccgagcacgcccccgcaggccggccacccctggctgcaggccagccctctgcaagtggcgttctttctcttttttaaactttccggccttggcgaacgggcagggtttccagtcctccccggcccccacccagttcggggaggggcggggcggggcggggctggccctcctaacccctccggggaggcgattccccccaagtcccgggcaccgctagacggcggccagggcagacgccttgctccaccccaccccacccccgcctactgtggccacctggagagggcggcttcccgaagcgatcgccgtccagccaagcctgggaccgcagcgtccggggaggaactccctacagcgccaacggtcctggcctgcccgcggtgcgctctctccgaaaagtctaatgctccgggaagggggaggggagagagagcaaggcgggaagggggggacgggctgcttttatttattttttaactcttcaaatgcaagaggtttttggtgtccctagcacgactgcgagcgtctggccaggcagaacaatagaaatggaggggggacgccggaaatggtgctggaagacccctataaccctataaacctctcctctccctctaagttcctattagcattgaaagatcctagtgacttcaatgcaaaattgtctttttataacttttttccttaaacacattccccctccccacatgaaatcacaagggcaaagatcgcttcccaagttgtgaccttccgaagctccagggcttctcacctgctctgcccctggcaccctgacctgagtcaatcccatcccccaacagttcccctggtttgcacctagacaataaatttagtttaatttagcttccggtctttaattttagcaggtctcctttttgcatgcaaatcaatatggcaattaccatctaaaagctcgcccagccccgggtcaatgtaaattgatcattgtccgccttccacaaaataacatcgggagtctgtggtgcataatgagattatactggaaactgtcttttagatcacaaattattttttatgctgtcaggatcttctccgagtggacttccccgcttctctaatcatggagagccgagcccgtgggtgccggctgtgggagacacagctctaaaacaatgacggagtgaggacccccgtttctgagaccctcgattgtaaacacatggaggtgagcttgcgccccaaaagggagccttctacagaaatatcgcagaaaggcatcgttaatgaactccacccaacaaaaagtaagatatcccttcctgatgaacacgttgagggcaaccagagaaagccgtcgggcagggctggagaccagtggacgcccccggccaagtgcgcgcgacgaacgcggctcggctaccaccagggcggctggggggagaccatttactcccgccccggcggcttctcctggctctaccacctaggcctcagcagcgcgtccggttttgcaaacagacggaatcccgtcggccataaacactggcaaagaagccggggcgggtcagggccggcccaggcctccccacccagctttgggcgaggcccccaccgggcccgatccagaagatgggctggggcaccgaggcaataaggaggctcctcttgacccgcagcactgctttctcccacccatcggcggcccccggggcacgagtgtgacctcggggcctaacaaagggccttgtgagctcctttcggcctcgggccggagggagaagggtggggcggggcggccgagatggacccaggaagttccccgccccgccgcgcctctccgggtccgccgggcccggtgtcctcgaggaaaccaccggggtggcattgccagggctgcccgcagctccggggaacgtcctgcgggctccaagcctcccgcccagcgcgaccggaccctgccccactccgcccggcgcgggccccacccaagtgcggtcttcccaataaaagctggaattcccggctgggcttagacaaagagggaccgcagcaaatcgacgccgcgggcaagccataccctagccggagtttacgtgcgcgtctggggtcaccgaggcgcctgctaatccacccaacacaggctgtccccgccacggtctcctccagaggaaaaaaaaaaaagaaaagaaagaaagcatacctcccttttattcctcccagaggccgcacttcttcctgttctccttcccagcccactgaggccctgctccaccttagcaaattggaccccagcagtgcaacagccattcctactgaccacaaagtggaaagctacccctcttgtggctacacgatccagccactcaaggtcaggaactcaaaatctcttcagaaaggctcctacctgctcgtcaccaacccgctgcccactccacctcacccctagaagggaaagaaactataaccagagataatcctagttcactgcacaccatccatcctttaggctgctagcgtggccctcagtttccttcaagccaaagacacattatttccctgtgaataagtgtgtgaatgtggttgtgtggcccactcttctgtacccaagtcggtctcactcactcggcaggaaagtcttcgtcaggcattgaggagtgtttgtcattcagcctgtgtatctaagcatggatgtatgcatatgaatgctttttgtgtttccaagtgaccctcttcacacctttaaatgggctattgtctctggaacgcacttacagaaattctgccccagtttccagctcaacaaagtctgggatttttctctcagaatatcgctatacatctctgtatttgcatacccatgtttacattccccttggccagttctttatctcttatgtatctcttgttccatttgggcaacggagcccaagtgtcttgatttgtctcagcacatgtcattcaagcgcacatcttaatctgagcattcgtactacttccattctttttgctttgcctataatgtggctctttcccaggccagaccaatatgggtttgcagtttaaatgtaaacagaggatcccttaagatcacaaactcttaaagaaaggaagaggagggaggaggagactggaatgttagtaatgagttatttatgtatagggtaacccatccgcccatttcaagctgaagaaagaactagataaatgtctgcagaggtgtattaaaattttagaccaatttaatattagccatatatatacacacacaaacgatggatctcacaacacatcagtgtccagctcctctttggaggctgtctccttgcacatatctaactcctcacaagttcctggttaaaagtatgtctatttatatagagacaactcaaagaccgctttgctctcttcagtgcatacctgtacatgctggcggggcatttcaggctcaggtccttggtctgcagcagtcatagtcagaggccccacccgactacagctatgtgcagaccttcccgtccttgaacacccgcatgaattctctttgggaacattgagtctacgtctgtcttccaaactcagtttttaaagtgagggtgttcattgtgtgtgttcacagctccccgactgagaaatacctggtcaaactagatcatctagcagctgcgtttggtttgtggaagaatcgagcccgatgcaccaagatgtgaccgtgcacacataagagaaaggaaaaccctaggcccagactcacagctcctccccactgcgagctactctgcctccaggaatttccactaggctctttgcccccctttccctattacactaccccaccacggcctttaaagggttaagagaaacccccacggccttccctccacccagctcgctgggcccggaggctagctcgctcactcgcagctcacagagtctgctgccatctccgcgcctcccccccctccagtccttcagccgggagggagcctgcatgcctgtctagaccgatctatcaccggcacaccaacaacacccgcgagagcgcggagaccctgcccaggtcccccggcccgcacggttcacggcggacagaacccggggagcgtgacggtgcctgcggggtgggggtagggggcccacaggcactggccgctccgagcgcaccacgggtcctctccagctccggccccccgcgctcccaccagcccggctgccggggcacagtcacagctccgcgcgctgggcagtcctatttttatcttgtctaatcctaaactgggcggggagcacaggcgtcgtgcttagagaacaagagataggcgcgggaggcggggaggagcagccaggcagcgacgcgagcgggagcgagttaaagacacagtggaggcgaccgcgggcaggaagaaagagcgggctgcgcgggcctcgaggcgccgcacgcaacgcgccgccccgcgaagttacactcgcttccccgccgtccctcgctaccggcccctccccacttcccagcggcgctccccgcagcctggacagcgaggccccggcctgtgtgggaggcggaggccaggacggccctgcaaagggctggagagaatcgctaatgagctgtgcagcccattgatccggagaacacttcctaattaactctcagtcacctactggtgacagcgcctcaaaggacagcgctggggccagccgagccccagccgcgacttgccggccgggcgcctgctgcccaaaacccgcgcgctcccctaaacaccccaaggcaattggtgtgcgtggcggtgtatacccgcacactgaaggccagcctcggattaaacctggatggcatattaatcatcgccttccccccccactccgctctacgcgctgaaaccctgcccaaaataaacacgaaaaccaacactgcaaaacccacaccagataacaggtcgagagaggagtgggcagggtcaaggaacgagcgtattccctaagtgtccacgtacaggaatctttgaggctgacaattaaaatgccttccacgcaagcaattctgttggcaaaaccgaacccaacacttcgtaaggattgatttcggcccgcggtgtccgtttccagtgccacaggaagtgtcagatggccagaaatacccaagtctgtctgcactcaccacccaccaccttctggggtgggccatttcctcctagtctttactcccaggccattttaaggatctttctccaaaagactacccctagaaccaaataccacactacccctcctctagcgtcttctcaaaacgaaaaaagggggggaaaacacagctaaaaccccgagctgtctagtctagacgcagcgaggctgtgcgaatacctatttgaagcgcgttggtttctttttaaggtttgtttctaaatacacataaccctcctccttccttcttcgctcttccattccccccacccccaccctccagacgccggcggcgcgcgccctggcgcgcgggcactcacagcctctagctggagatcgcggactttctggaaaagattcattaacagcaaattacgcctcgcccggccacggcctacacgctgccagactcgtccgtctccgggaccccgggaagggcccactcgagcgtgcgagcggcgggaagcccgccgggaccacgcgtgacttcggccgccctactccacacacggtgccccaaggctctctccgtaaacagcaggcgctcgtcaccgccgccgcgagcccccgagttggcggaggctctgcggcgcagccgcccgccggctccgagcgcgggccccgcggcgcctcgccctccccgccttggccgaggatcttgccccggtgcgcaagttcctcttcgcctacagcctccttgccacacgccctccgagtgggaccaacttcctccggccgcagactttcacacgcccatcagggctacccaccagactccccattgcccagcggagggcccaggtctcgcccgcccccgccctccctccacgacgctgcccccgcacaagcacattctacacccacccctgggggctcataacttaaaacctacgctgaacatcggggagggagaggagggggaaagcgggagggggatcgcagattataatcttaaaagaacatttacaaaacaaagcgtctgacctggctggcgggcgggccaagtcggaaccccttgctctgctcgatttcttagtagtttttttttttaatccacgtgattcgtgctttggggcaagccaagaaaaaacgggactcccctcccgagttgcgcggcagcggcggcaggtcgagctcggctcggcccgaggcactcgccacacaccctcgcgcacgcacacgccgacgttccacttggaggaacgaccggcccccggagaggcgagacgaggcggcggtggcggcggctgggggtttttacagttctttcccgagtcgaaaaagaaagcagacggcaacccgctgccctccccttcctgctcgcgagctaacgccgaacccagcttcccagcttccagcccacctcccccccctccgcccgactcgcggcgctcagcggcgaccgcgctcccgcgcacagacacacacaggctgcaaacttccactctgcgaactccctgctctcctcctggcccaccgggaggcgccaggcccccagccgcgccccctccctccctggtgcccacgcggggccgcttaggttggctgcattttaaataacatagctatgaaataaaaacgaaagcgagccaagcagccaaagggaagcgcgaggcaaaagcttcgcggggtacgctgcgggagggggccccgggagagggggccgactgcagccctcagcgcgcccgcccgcccacccgtccgcggtctcccgggggaaaggtgttccgggcactgacctgaaatccccggtgggggagtaggcagggagcctgcgatccggctctttgaagttttcccccaagcggactcgaggcggcgagaaggagcggggggcggttgggtgggtggagagagatatgaggggtggggggggttggcgacgttaacgagcggagaaggagccgggccggagaagcgcggcgagcagcaaagtttgcggtccccggctgcccgcagcccgctcgcggcgccgcgctcactcgactccctcgccgtctgctggcagccggctgccctcggggtcggccccgccgaggggtgggctctgggccgggtgggggcggggcggggcgggctcggggcctccgggcaggtggcgacagccccgtgcgatcctccgggctcccgcagctggactgggcttggccgagctcagcagctcccgcgctgccgccgccgcccgcgctcgggcaggagccccagcgccatgttgacggttcgccgcgagcgcccgctcgggctgggtgtgtgtgagtgtgtgtgagtgttggccaagtcgtccctgcgcggcgacagcgcggcttgggctctccgcccggcggctcgcgggctccccctccgccgccgccgcccgcctagctcccgctctcggtcgcggtctgggctcctgcgcgtctcccccgcagccgccgagctcggcccgcgttcagcgaggagcgcagctctgcctcaccttgccgctgggagcccaggctccgtctgccgccgcacgccgcgatcccaacgcgtcccccctccctggttccctcctcttcctcctccccctccctccgcccgtcctccctcccgcccgccctacctccctccctcccaacagccgcctcccctccccccgcaggcgcagcgctcgggcgacagccgcccgcccgccgccgcctccagctctcgcaagtttgagctccgccagtctccgctcaccctccgctgcggcgcctccgcggcggggtttcgggaggggtgattccccaggaaaggtttgcccgagtttccccggccgtcatcgatgcacggcccggcacgttttggcctctctggatccgaaccccggaccacttgggtggcgccccccctcctcgtcccccggcctcccctccccagctcgggccgagttggctgcgcacgcccgacccgggcgcacgtcctgggcgagccggagaccgacttgggcggcggcggcggcgagggctgccggcagagccagagccgaagggatgggggcggcgggggcggctctcccagccgcgcgccgagactcccctcgctacccagaaggccagtggaggaccgcaattaccataaagcgcctcgcactccgctcagccaaagctgtcaaaccccagcggcagcagccgctgccgccgcctcttgccaccagcgctgcgctctcccggcctcgtcccctccgagacccagcggagcgtggcctgtgtgctcccgtgctcacccccaccccagtttgccccttcctcccagaggagccctttcccatttcggtgttaaaagctacctgaaaacaccaccccaggcaacggtggccgttccgcctgaactccgcgcccgagttccccggacgtttcaattgtgtgggaattgtttggaggtgggggaaggggggagcagcccgtggaggcaccgggaggcgtgtggggggcggtcggcgagcggagatccgcctgtatttctcccggttctcgagcattttcacggtctgtacctctgatggttggaggggctgcccaggcccctcgccccggcgttgggagattatctcccgcgttttattttccttgacagggagcaacttttggcttacaccgttcgccccataaatttccactcggtaacgtcgtgctgatcggtgcttggcggcggcgtacagcctgcgcccgcagcagttcaattcaattgacacgtattgagcttctccagcgcacccggcgcggctctgggcgcggggggagggcgggggcaggcgggagggagggggaagcggagaagcgaggttccggcctccccggagcgcaaagcctcaagggcgagccgagaagccctagttggtgaagctggcgggaaggggtaggagtgggggagggggtattccggactaaccgcgcccagactgcgggcccggacttcgcggccaatggtgaccccattcggctgcccactagggtctttttatactgggaagggggtggggtgtctctttctgcctaaggacaagatggtgcaggctccatgaaacataaatctgaaatggaggtggcttgtaaatccacacggaaagtttttaaaatatcctggagtgtccccatgccaaaaataatcaaaagcatctcaagttgattactaagtcaaggtcaaggccaaaatcagctctagctagcagatattttcccttttaaaaattagactcactactgactgtgggactggtattaggtgcgattttattcattctgttttagttctcagcacatagttataaaaacagcccttctcaaagcagaagtgaaacatctctaccgtttgaaacccgaaacttcggcagaattaaatcttcatgctccagagctgcttataacaactgatgcaaaagacaggcgagcaagtgcccccgcgagcagtgcccagccaggctgggccgcgaacgcttccaggaccagcgcctgcagaatggaatgcacgcttttttcttcctggtctttctgggggtggatatctctgcaagccaacccacacatttttttaatctccggtaacaagcagaaagacacctggactattatgctgtaaaactattttttataaagacattttaggaccagacattaaaagttattagattgaacgcatgcgagttacagacacagctggagaaaaggcctctggttgtgtgttgtggcaacatttctttttgaagcgactccttttattcaaaacaagtcaaaaataaccgggaaggctgaagctgggtatttgtggggaaactctgaacgtggttccaggcgaggaggccgctctgctgctgcaggctggacgggagaactggcctgggccagtgtggagccgtgccaggctcttccggctcggttaggccgaaccgcagaggccctggcccggcgcccagccaccttctatcccctcccctcgtctccccaactctgcccccaggcacaggcttttctcggagttcgaagtcgcatgtaaacgtccagaacttttagaaaatccaggaaccgagctcggggcctgcagcctctcagagtcttacggcctcccggggctgctgacaaagaggcctgtttgtctaactttaaaagtcctagaattcgggaggctgagccaggagaatcgcttgaacccgggaggcggaggttgcggtgagccgagatcgcgccgttgcactccagcctgggcaacaagagcgaaactccgtctcaaaaaaaaaaaaagaaaagaaaaagaaaaaaaaaagtcctagagttaaaatgaacaggggtggtgggggtgctgtaaatgcgaaggggccgaggggagggctgactgggggagaaatttgatgctggagacaaacaggccagtaaattcgcctttgacgtaatttgcaacatcctcccccaccttttctagggatcttgcctccacggtaggctggtaggattaaagggtttctcctccatctcctagggatacatttttcaactccgtgggatttcaaaaatatcttattaagggagtcctaagaggcatgagtggtgggggggattcgtgactcactgggaattaaaatgtgggattttcccgaggcgctataaggcagagggggggaggggagattacacctattggcccggttagttccaattgttctggggaaaacaagcagaaagctgtcgaagggcaatcccatcttgtgtcctcacttaagaaggggctcagggagctggggatgccgcggggcctgcaatgggtgccggcggtttggcccttctcctgccccctcctctcctgccctcccacaagcccttcgggagctgacccgggggtcaggctgctatacccagcactcagcaaggggaggatttcaatgaaaacagaggaggaggagagagtgagcaaaggagtgcatgggaggggaggccgtgcagcccacggagaaataaagaaataggtgccgaaatgagaggtgctgcggatggagcagcgggggctgcccctccgccaccaatctcccttcccatggaagtgtctcctgattataacaaaccactcgacctcaggctaaccaggccctgcaactgggcaatcgagctggcccttctaggagcaggccttgagcctggctgcccttctcaaggcaggttgactctgcaagacccgctagggcctctcccacacacctccagctccaccctggcctaggggaaaggccaggcatcctgtgtttggggggaccctggccttctaaccttgtgtgcaagatttatttataacgtatactaggatccacatcataaagcttataacgtatgtgtaggcttccgatggtcctcctcggaggctgttctcagggcgatgacacttggtactggaacaggtgggactcggatgagtacagataatgtatttttacataatgtgaggtagcctttctttaaaaacacacccacacttatagtcttctggtcactttgtacaagaactctgggcttatccaatggcactttaaaaaacatccgctgccccatcctccaagcacaaggcacagctggcttcccctctgaaactcaaacgaggtaacaaacaggaggcgcatcctcctcccaggatttcactcatctggaaacatctaaaggtagctgcctcccagggcagaagactgctggacttaagggtcgccaggctgaacatgactgttctttcttcttcctagcctttggagggttattgggtgtttggggaaggaaggccctaagggcagcctctccgtggttcctagcaaccatcttggaatttctggtctgggctcgatttgggtcaggccctgagctccccgaacacaggcacgtgtgggtgaactggcatctacactacgggggcccgcagggtggttgggtgtcgaccaaatgggcataatacaggaggcttctgggaggctggccgcctcttgcgctcggcaagggcttaagagccctcgacgccgccgcgctgggccgggtgctcctgcagataaacccggacgccacgtcccgcctcggctgcttatttagcaaggcgccttctgcgcatattttacccggctgggggcagtgagtgggaaccgccgggagagggggcggggaaccaccaactactcgccttcggacccagtgtgccggcctccggccccagccattttgtatccagcttccctcctccactcccaccgggtccctgcgaagacgcaccaccccgaaccccttcgcggtaccactcccgaactggaggggtagagaaggctctgccagcccctcgcctgcagcaggaaggtgggtacggaccagcagaagggaaagcggtgctgatctgtctctaaatacctctgccctcccgcccccaacaaagtcggtcacagaggtgagtggcgcgggatggttgcctcgagaaggtcgcagccaggagcaaagctttggggctcacaacggactgggcattccaaacggtgtaatcttcggcacatttcacccgctcccattccaccttccgaaccactctgctctcggtgctcatcctcctctccatacctgcgttcccagcgcgttagcagccgcgcagcccccggccctgagtgcggggggtggggtgggggggctcagggtggtttgtgtggtgcggcctgacagaaccttctgtgtgcggcggagggaggaggctaatgcataatgcacagcgcctggaagcccggccattagcggcctgtcggtgacacagacaaacgactgagagggaggagatccagctcgctctggagtttaaatagaccagcgtggaggggaaacgccatgatttaaaagtgtgtgtttgcagacactcgcatatattttaatgatttccagcaggctatgtgtcctagccttgcatccccccctccccaaaaggaggatgtgtctagaggagggaggatgaaggcagagtgagaggcctcaacccagacccaccagcagcttttgagagatgaaggaggggagaagttcagaaagcgaggcctggggaagccacacgacccaaggccaagcccagattttgttcttaaaataataatttaaaaaaagagccacccagccttccaccctggactacaccctgtgttgtaccagaaaggcctgggggaaagaataaattctgccacccttgcttcccccgggagcccacatttttgaatcttccttttccactgacactccagagacctccttcctcccggtttaacacactagtgttttttagcaattaaggcgagaagggggtggggataaagataagccaatttttttttccgccatgcaagtgtgagagataagataacgctaagctggggcaaagcggctgcttacaacctccccttagcgattttgatcggtcacttcttatctcgcaaaaatgctcttttcgaaaactggatcaaaaaagaaaaagagaaaaagaaaagaaagaaagattttcatttggaagtgacatttaaaacccacctcccctccactgacaacccaccccccattggcggggctccccaggaaaagtcgcacctcgactgcaggatttcaggctttctcgcggggggcaggattactagtgcaattaggctgaataaaaccagggatgcgtgatgaggatttatcctgtatccaacccaagctcgcggctgggttttccttctcttagttactggtcgatgtttgtgtttcgccatcgcactcagtgccttcaaactaaacaggtagttatacttgggagggtcatataactatgtcaacatgaagtggttgttaatgcgaaataagaagaaactcttctgatatttataggcccctataaagggagagaaaggaaatcacactccctagaacccgaaagctcccagccgaaccggaccctcggggagttttagaaatccttctttccgcacaggaatttcgcgaaggggtttccggaagactttgtcgaggaaggttttggtatcagactccacgacctcagagcgccctgcaaattccccccggcccagtggctagccccagaatgcaaacctcaaggcgggcgccccagaccaagctgacctagcctctgcccacccccagctcacaaccccgaggctcccaccccctgcccccgaccgggtcggcaccgtggcgtccggcacatgccaagtctaccgtctccaagccaggctgcaagatccaaaggttggggcctgccgcggacggattgtccctggggagctgaaaccgcccagcggggaaacccctcctctcgcccttccccgaaaagcttggccgcggtctaagctccgagcaagcgggtatccgctgacagccgggcctcacgtaaggcccacacgcgtcccattagtcagcccgagttcccctcgggcgagccgcctggcgcggccccaaggccgggctcaggcggggagagggtgcggggccgcagcgagctgcgggcggaggtgcgggctccgcggagcccggccaggctcggttccgcgttcctgggcccgcgggtaagctgagtcggcggggcaggccgctccctggctggcgccggggcgccaagctgcgcttcacgtgcccgccatatcagcagcagcggcggcggcggcgaggagggggtgctgggaggcgcgcggccgttcccgcggggtctccggaccccgcctccccgcccctccccgtgggggctgggccgagaccaccctgcggcccccatcccagcgcaagccgaaagcggcgctgccagacgcagagaggctcctggggcgccgttccgagagccgcgcggcggcagcagccaggggagggtgctcctcgcggccgccccgccgccgccgccgcagtcacggggaccggaagccctcgcgccgccccgagcggcctccgctggccccagggctgttccagacgagggctggccgcgcgtcacccctgatccctcctcgccccaggcgaccacccgggccctgcggtatcccggtgtaagccgagaggacccttcctgcggtccgatgagatgtccctgtccctctgctaccaccataagcacgcccccccgcaccgctcgcagctccgcagctgggaccggaggggcgcggagccgccactccggccgggcaggaacacctgctcccaggccctgcagctgggcgcgtgctgctgtgagaggctgcctactgttgtgtgcagagatcgcggaggagaaaatagggctccgaagctcagggccaggagcagccaagcctcggccacccccatctcccacccactgcaggcgacagagcgcgaagccagagggcctgctgggggcccgggtctcctttcgaaggtcgaagggccgccacccctgggatccggcttctggcctgaagaggtcgttcataaaacagatggggcaaaacctgttttgggagccttcccagtgtccgcccccgctctccaaaccagacacactcatctccccctcagccctactctagcctccggcgggggacgggagtaggtcatggcggcaccggtactccacccgcccccctccacgtagggacgtagggtcggctgcggggctcggactttgccactccacctagggaagggccaatggacgctccccgtctcctccgtgtccggaggagatccggcggcggagctgacctgcaaggcttgccctgcctcacccaccccccacctccgtcccaccctccccgactctcctggcccagggcccggcccgggaaggcgttgttttgccagcgggagccgagcgagtgcacagagaaaagcctccctactctaatgagagtgcacacagcgctgcagcgaggaggatgattacccggcgggcggggggcgcgggctcgggccgcgggcggcgtgtgcggcggccccgcgggcccggagtccccgcctgtctggctgctaatcgcacgctttctgctgttacggaggcaggcgggagccggcggccgagcccagcgccgacgactcggcgggtgacacggaaacatggcgcagcgcccctcccccgcccgcgctcccgcctcccgccctccccgcgctcccgcctcccgcctcgcacttcctcccgcccgcgcggcttttgcagttttaatgctctgctttcggcctggcaccattacgctagcagccgcttctccgcggccccgcgcgtctctttcccctttgttttcggggtctatagaaaacgtttgcttttgtcccgagctctcgttaaaccaaacttgtggtggcaacggaaggcggtgcaggcggggaggggtccggggattttggcagtagccggccagagcgtggtggaaacttctctcgctgggttctccgctccctcccactccccctccccaacacagagccgccggcctcccgacgcttctcccttcgcccccgagaggccccagtgctccaggaaggtctgggccacagagactgtgaccaggggtgaagaactcagagtgcgtgtctgtgagccccgaggttttggcactcgatgaccttgctccctgcagccccgacttacctctttccctttggtcattcggggctttgtatcagtcggtgaagaaggggagggaagagaaagtgtttctttcgtgcgtgtggtttttattttaaggatttgttggaatctgtcacccccaactgcacagccccctcccgtataggatctagggcgaaagcggggaaacgtcggatttagggggaaagggtcgggtcagaaacctagccctggaggctggatcgtactctcctggcgggctcagccacacttggtcggcacgcggggcggggcgacccagcagagtgggggacgcaagggccaggtccctcggtccaggagacgccaaacgttccaaccttggagcgagagagcaggaacccccgcccccacccaagcgcgcgcgctccctagctcgacgcgcaagccgtggctctccgcgccagagctgctcaggcggcaattttttaagcctgcaattaagcgaggcgtcgccgtgtcctctgctagtgtcggtcctgtcagtcgcacatggccttggtgctccggtccgaggccccgcgattagtcacaggctcgcttcgctccttccctaatccgcctctgcaggcagcctggggacgcggccgacttggcggcgctggcagggagccactgcccgcggggcgggcctcctgaccagtgccagccccgctgcgcccgagccggcgcgggccctggggtgcgggtttggcgcccctcccctctcacagccccctggctggggtggcggcgcccctcctcctcccgcccctctcccgggcctgcgagatctatttgtgtggtgtcatttgcataaaaataggacaagtgtttctgtgcgttcatacgcgggaggcgaaatccttattgatgtgtctgtgtggagccttcgattgtcggagcggtttgatttagggtgtttgtgttgccttctacaagaaaggagagaaagtccttctcaactccttcggcggcctgggcccccagaagcatgtccctctgcgcggccggaatggtccaccacttgggccccaagcgcgccggatccacagcgagcaggttgagggccaggcgggaggcccattatgactcataaaatcgggcggcctaatcgccagctgccaacccatttacatgtggagcttcccaatgctcccttcgcccgggcccggcttcctgagggtttgccccgacacagctagagccgccaagtgggagctaatctagtggcctctccttcccgtcggcagcgtggcttcccttccccggcgacccccgctctcttggcctactgcgctgctcgccagcaactcctcagcttggacaaatagctgggagggcgccggccgcgcggagccagtaaatcaatcattaactcccaagcgaggcctggaccaggggagggagcggcggccagagccgagtccgcgaggcgagcgcaaagcctccaccggggttaggagccacccacgcgccaacgaaccgggtgcgtgaaggcgggtcccgccatggcctcccgggcccctccagaagcctccgcccgccgggcctttcaagcccgcaccttgcctggccaggcaggtcgcgttacagcgctgcccctgggagagcttgaacattaacgagtcgcctcgggcctcagcggcctgctctccacaggagagcgtcccgcgcttgggcaagctcctcggatccggccgggctcctcctggctcaggcttgctaaaccaaactgatcgcaccctgtatcgaccaatctccctgcggcaccctcttccctcagcccacggtggagccggcacgcagggggttaaaagccccggttcgctctggctcctcggctgcgaggagaaaacgctgatcaaagtgcttaaggggaaggtaacacatgcacattcggtcccgggtcgaaggaggccgactggagacggctcccgagccacccgcctcgacccgcttcccacactcccgggaacgcggcggcggcggcggccctggcccgcacgattcgctcggcggagcgctgcgctgctgggctgggagggcggcggggaggaggagagacgagggggcgggaggcgaacccgggctgcgcgccaagaggcccggagccgcagattagtcaccgctcggctctgcgctcccgggtgcgcccgggaaccgggagggcaggcgtcggccccgctcagccgggctccccggtcctcggcgcgggtgcccccacccccacccccgcgcgctcctggcgcggctggctcgactctcggggacccgcgcagccgagatccacttgtcaggtcaagggcaggacagaaactctgcaagcggagtcttgcttgcgaacaggaaatttctccttgatgaggtgctgcccctcccccacgccgggcttcaaaacaaaactccagagcgggcggccaggtacccagcctcgctcgccatggccggcgacctccgctcctcggccccggccccgggcggcggagccaagccaacagagccggcggacggactcggcgccggccccgcggagggcgccaggctgccaccctccggggcccggacggggtcggcgggggtgcggagccccggagcccccgcgcctccccaggttctacagccaccgagcggttttgcggagctgcccgaggccgccgggtcagcggctccccggagggcgtggggggcggggaggccgcgcggcgccgccgactcggcgaatcccgctgcgggagcccgggagggctgcgagctcggcctggcaaagttcctgtggaaactccatgttttgaaactcctgcggcgtcgcagaaggagggggagaggggagcgcgggaagcgcgcgggggcggtctgcacccgcctctccccgccggggagtgggttccgcggccccccgggcctcatgggaaagctggagggcggggacggccgggtccccgggcccgttcttttgtgtgttctctctctcttccacactctaagagaaatttataaacccgtttcatttaatgaattcacccgggagaggaaggctgcctttttagggaccatgatgttcagggtaatttcgtatttgacacatgtaaatacttagtactctcaggtaaggtcaaattatttatcatcttaatttatatttcaataggcctacaatttagaggcgagaaatgcctccttatgaatcattatggtctattaggggaagtaatgtataaacagcactatttgggagggaatcacttatgttgacatttaaatagctcttcaatagttaaaaaaaagacatttgagtgtctttgattaaatatacaatttacaagaccatcagcatagccatcaggaatataaattcttcttggaatttttatttatttccaatttttgaaaccttccagggcatgcgtgtcattgaatccctatgggggaaaaaaatcttaacatttcaggcaaaatattctcctctcccctagcttcctgtcttatcaggaactcagggaacttctggaactctgagcacacttcaccagcagggaccacagtgggaagtttgtagatcctgtacctctaagacaatcaaccattttcttttcttttcttttttttcttttttcctttttcttttttttttttttttttttttttttttttttttttttttttttttttttttttttttttgagacggagtctcactcttgtcgcccaggctggagtgcaatggcatgatcttggctcactgcaacctccgcctcccgggttcaagtgattctcctgcctcagcctcccaagtagctggaattacaggctcccgccactacacccagctaatgtttttgtatttctagtagagacggggtttcaccatgttggtcaggctggtctcaaactcctgacctcaggtgatccaccagccacggcctcccaaagtgctgggattacaggcgtgagccaccacgcccggccgagaatcaaccactttctaacaatattgcagccaatttgtgaaacagcacagcttccctgctggagttgaaccttccagaaggccagtgtctgtccatccatcctgatgttcccgcagcacccaacataggatctcacactgttttaagtcatcgtttcatacctgctaaaatatcaccttcttagaggcttttccttgctgcctccaccctcaccccccataccctttcttgaaaggccccttgttatacttctttgcttgaagcatcacccatctttataatgccccttcttaacctcgcatctcctttgctggttccctatttatctgtttccctgtacacctggacttcttgaaagaggtgtctccatccatgtggaatttctgcaggcttacctcatgttcactctaaaaatcagctagtcatgaagttattttaagacactggaataagtgcagctttgtttataacagcataggattataaacaacctaaagagtcagcagtgacattgatggcacatgcatacaatggaatattctgtagctgttaaaataataaagaagatctgctctgtgtattgatatggaaagacccccaaggtctacagttaaggaaaaaaaaataaggtacagagcagtgtgtaccatctgctacagtttgtgtaaaaacaaaataggggggaatatagacacatatttgtgtgtgcattaaagatttccaacactgcaggggagtgcccccttcccccccagtttctctgtagatatgcatgtcctctggtctactttcagaaatgggaacacactgcacaatctgttctgtacctcacctatgaaacttatcaatatatcttacttttctagcaacacatggagacaggccttgtcaatttccaggctggtggaatttcactgtatagacacatggtcatttatctcactcctcaacccctccatcctccctggccattctgcagaaagtgctcaagatcactggttacttccttgttgccaggagtgggggccggggtgggggggcggcgttgtttttcagtccttgccttccttggcctcccagaagcatttaccacaccatgaccactgctcccttgagctgcttgctcacagggttttcatcctagctgagaaccgctttcaatttctttgtgggcttttctatgctctaccagttgccttgggcctggatcctccccttcctccccaccagtctcatccaggtttatggctttaaataccacctacttattgatgacttacattttttttttctagttccaaatccccatatcaaacttcaaacttggtatctcaactttgcatctacgctcagcttaataacaatagcaagcatttacatcacgcctgttaggttgaagctctcttcaaagtgctttctataaattaactattaatccttacaactgccctataaggtaggcagagttattatgtacattttttccagatgaggaaactatcagagaagttactgaacattcctagaaaatggtggtgctaggattcaaatccaggcagtcctatcttcagagtccatggtcctaatcactttgccacactgcctcgttggcatgtgtctcgaactcctgacctcaagtaatccacccgcctctgcctcctaaagtgctgggattacaagtgtagcaccgcgcccagccacaactgaattctaaaaagaggaattaatttacaaatatttgggggcatttaataaatgccaggccttgtagcgggtgctagggaaacagtggtgagcaggacaaatgtctcttagatagagaagagcttttcctttagaacctgctctttgctttaactcccttccccatcacagaaaatggctcacccactcaggtgcttaaagcagaatcctagggggccatttttgacccattttcattcatctccccctcaccttcctccagtccactggcaaagctaacccattctacttccaaatagtctatctagtaagcctacttcttcccattttcctacatccacctgaggccaggccaccatcttgggcctggattattatacaggatgattattctagcaatctctgtgctgccacttttgctatcctccagtccacccgcaacgtggcagctagaaagatcttatttatttatttatttatttatttatttatttattttgagacaggatcaagacctcatctccacttaaaaaaaaagagtagtcaagtgtggtggtgcacgcctgtagtcccagctactcaggaggctgaggtgggaggattgcttaaccctggaaggtccagactgcagtgagccatgattgcaccattgcactccagcctgggtgacagagggagaccatgtctcaaaaaaaaaaaaaaagtgttgaatgtcactaccccactagttcccactgcacttagaacaaaatctaaatgccttaacaaggccacttcattgcttgccagtgtttagctcaccctctgaaggccaaccacacaggcctgctatcagctcctgaataggctctgcgggttggtccctgggaggtcacctccctcagcaagaccgtatcgtccataatggtacagtgtatcatcaccaggtgctaagcttgcatcagtgtgcagcgatgtacatatatccataatgttctcagaattttgtttctggctgtatgtgcccagtgcctagcatggtgctcaccacatattgatgaaaaaaaaatctgataaacaataaatgaagtattgcatgcctaatactttttttttctttctttctttcttttttttttgagatagagtctcactctgttacccaggctggaatgcagcagcacgatctcagctcactgcaatctctgccacccgggttcaagtgattctgctgccttggtctcctgagtagctgggattacaggtgtgtgccaccaagcctggctactttttgtgtttttagtagagacagggtttcaccatgttggccaggctggtctcgaactcctgacctcaggtgatctgcccacctcagcctcccaaagtgcgtgagccactgtagccagccacttaatacatttttgctaactgaatcggtattctatatcctggctagagaagaaaccaggttcaagagaacaagacagttgtggagagggtgctataggaaagggggtacctggactggtggggagtggctctgtagttctggtgaggattggggcagaagaaattaggaaagtgaagcataaggctgggggagacactgtcttttggggaggcccgtgggagtatgggacacctgtgtacaggtctctgtcggctggaggagccaagtgacctggtgtgcatgctggtggggaggccttgggagtcctgtccttaactaagtcctgcagaatatcatccccaggagatgagaaagccaaaaggaagacaaaacccaaaccagagccttcttagagtactttgcctattgccaatcatttggtccttaacttagtggcagaagattgagactgtctttctccttgagaccctaagaaaccagaagtgtaggttcttctcacagctgaccctgggcaattggagttctctgaattccatgccatttgacctctaacagtaactgtgtccctgcgctgtttttgatagcaaagcaagtcttttaacaatgaataattcctatgtgataaaaatagctactgtttattaaggacctttgttcatttcagttactttatcaggtacttttccaagttatctcactcacaccccaaaataaccctatggcttaggtattaccattcactttttttttttttttttttttgagttggagtctcactgtgtcgcccaggctggagtgcagtggtgagatctcggctcactgcacgctccacctcccgggttcatgccattctcctgcctcagcctctcatgtagctgggactacagtcacctgccaccacgcccgactaattttttgtatttttagtagagacggggtttcattgtgttagccaggatggtctcaatctcttgaccttgtgatctgcccacctcggcctcccaaagtgctgggattacaggcgtgagccactgcgccaaaacacatggctaatctaggagagtgtggctacggggattctacctgactccaaacctaggctctttcccatagggtatattgtttgtctgtcatgcatatgcactgtttccccaaacctttaactatttctgggaccagatcctacatagcttctgcaattgcatccttctgggcccatcctggcaactcgccaactgcagtaagtatcataaaaggagtttctttctttctgggatcagcaggcctcagctcatctgttgtgttcaccatgggaacctaagaattgatcatctgaatgaagagttgccttccttccaggtaagccttgaaaaagtgtggggccggcctgggctcggtggctcacgcctgtaatcccagcactttgggaggtggaagtaggcggatcgcttgaggtcaggagttcaagaccagcctagccaacatggcgtaaacctcgcctctactaaaaataaaaaaattagctgggtgtggtggtgcacgcctgtgatcccagctattcaggaggctgaagcacaagaatcgcttgaacccaggaggcggaaactctagtgagccgagatcgcaccactgcactccagcctgggtgacagagtgtgactgtgtctcaaaaaaaaaaaaaaaagtgtggggccaagatgttcaagggaaggacttcctccccagaacaaatagattctgtttgaaaaatacctgtacctccaccaatactaaattatggctcaatgtctggcgagattataagctaccttgccctttcatattcctgggcaacacttttccccgttttgagcttccataaagactactcttgtccttaccatgggaaaaggtagttcacgaagggataacatgggaagaactcatcacacagctcttctgaagcagaagagctcttgggatttgaggaaaagagagtcactaatgttcttcagctcctagaagaacaatagctagaatttattaagggctttctatctgccaggcacagttctaaacattttatacacattaataatctcatgtcatatagaaaactgtcctatatggctgggcgcggtggctcacgcctgtaatcccagtgctttgggaggccgaggcgggtggatcacgaggtcaggagatcgagaccatcctggctaacaccgtgaaaccccgtctctactaaaaatacaaaaaattagccatgtgtggtggtgggcgcctgtagtcccagctactcgggaggctgaggcagcagaatggtgtgaaaccaggaggcagagcttgcagtgagctgagatagcgccactgcactccagcctgggcaacggtgcaagactctgtctcaaaaaaaaaaaactgtcctataataaaggtactattattattcccatttcagatggggaaactgaggcttagaggataattaatttgcctgcttgcctggaagctcactgcccattcccaaagcccagacttattcatgccgtcacagcccctgccatcacggtgcaacactagcaactaaatttcggactttccaggcacctgtggtcagcttcattactctgccaattgcacaagttcatgctaattgggtgctttatttggatctgaaggcagtggccttactgcatcctggcatgcaaatgatgtcccctgaggacacgatgggcaatgaatttgtcctgcaggtccctgtgagaggccttttctcttctgtagcttcctaagcagaagctatggatgatccacagacagaaggtggtcatctctaacctgtcctgtgacaaagcatgctggtcagccagtggatgcccccatcggttccatgccagtggctgcaccgggacccctgcttgcaggcacagggaacccggaggagagaagatcagtttccaagataatttaggttcagtctttcttcaaaccagccattgtcctctgctctagatctgacaccgatgattaatgcgcctcgtatttgagtatttcttcttttcggcttcttccttgctttgggttttattttccagctgctgccagagtttctcctcagaagagagtaaatacagactggagcattgcccttggtgttgccctgaaagcgtcccaggtgtcagatcgcactgggccattcctggagtaggtgatgttactgtttagagttcagtgctaacccaccacctccaccaatcgagacctaagccgttaattattctgaaaataccaaaaataaagattgcagggaaggcaattaataggatcatacggtctattcctcatttgtaattacatattattatttttctccctactttgttccaataatgatttaaggctgcttccaaagatacacaaaacccagcaaagataaatagaagaagtggaatatgaattataatgtcatgcctgctcacaacatctctgccccattccacataatagaagtgaattcataacgcctttcaaaaatgaggtaattcagctattttggtggcaacactaggctctttgtaaagtgaaagggtggtacacgatcatggaaaaaccatggaggggacactcgatcccctttctaatgcttgctttcttggtgtgtgaccttgggcaagtcgctcaccctctctggacttcagcttctgaaactctcaaatgtctctgccaatccctgaggcttcctcctctttctgacgtccaagggcaccatcaagaaggcagaggccagtactactgccctctggcatgaggcttcctagaactactattcgagagatagtttcccaggaagtatactatgctcgcactctttctctctctctctctctctctccaccccccccaccccttttcctccctccctatctgtcttctctctaacacaccacaggcacagagaagtctttctggatgactgagataatagaactgaaattgtctcctcccccaaggcaaggaccccccctttcaggaaagtgactttaagggtagcactgaggggatctttttgggaggcggggagtcacaacccttctgacctttctgtcctcccctcaggtgtgagctttcactttctttcctcttcttgcagttcaagacattcttttatttattttatttatttttttctgagacagagttttgctcttatcccccaggctgttgtgcagtggcgcgatctcagctcactgcaacctccgcctcccaggttcaagtgactctcctgcctcagcctcctgagtagctgggattacaggcgcccaccgccgcacctggctaatttttttttgtatttttagtagagatggggttttgccatgttatccaggctggtctcgaactcctgacctcaggtgatccacccgtctcggcctcccaaagtgctggaattataggtgtgagccactgtgcccagcccaagacattcttacaacctggccgactctagatccagtcttatcttcccttcaccccctcttaaccgcatcttccacttttgtatccaggcagcatctaacacaatgcttagcatgtcatttgcttaaaacaccaatgctgtcctctgccccacacaaagtctccactgaccccctagttcctctactgagtattccacaggctacaggggcctcctgagactgggccctgatcccttgcctcaggtgggaggctgcttgggagactctgtttttgttgttgttgagacggaggctcgctctgttgcccaggctagagtgcagtagtgcgatcttggctcactgcaatctctgcctcctgggttgaagccattctcctgcctcagcctcccgagtagctgggattacaggcatgcgccaccacgcccagctaatttttgtatttttagtagagacagggttttgccatgttggccaggctggtctcaaactcctcagctcaggtgatctgcccaccttggcctcccgaagtgctgggattacaggcatgagccatcacccttggcctgagactctgttttttaagatgcaagcacacacaacaccttgcaaatgaaaagaagccagcctcaaaagaatatgcacaataggattccatttacatctagtttgggtgttgtttttttttttttttttggtggtggtgccggtggggggtggacagggtctcactctgtcacctaggctaaagtgcagtggcgctttgcctatgtcaagttttaaagtgggcaaaggttttaatctgagttgttataagtcaggatgggccaggtgcagtggcttgctcctgtaatcccagcactttaggaggcagaggtgggtggatcgcttgagcccaggagttcaagccctgcctgggcaacatggtgaaaccccatctctacacaaactacaaaaataagctgggtgtggtgggcgtgctgtagtctcagctactcaggaggctgaggccgcagtgagctgtgatcacagcactgcactccagcctgggtgacagagtgagactctgtctcattaaaaaaaagaagaggagtcaagatggagttatccttggagatggggagcacagtgggactccttgggggctgggaacactgcaggttgatctggaagctggttacatgggtgtgttaaaattcatcaagctgtactctcaggatttgtacacttttctgtctgtgtgctgtacttccagaaaataaaaaatagaaactaaaaaaaaataataaaccagggaggaatcagttttaaaactgcaatcacactctgggcagatgacctgatagcaggagtgtggggttgctctgagccaagttggggggttgggggagggcagtgtgctgcttctagagacagcaaggaagcaaattttgttaataaaatcacgtgaatagaagcaaacttactgctccacagttggggcggggggaggagcggggtgagagtgatgcgccaggcagatgtgccgtattggaggcttggcagcacttcatcatggcagccctaggcatggcccaggcttccagagtgaaagcgtggagttggcagcattaacgggttgcctaggcccccaccctgtcttcctcaccttctctgcaggaacttccactccagcctaaattgggttttccgctatgcccggagcagacacagcctttccccattgtggcccatgcatgttccctgcaggaatgccccttctctcttcctccccttaaaactgcttcttctccctggtccccaccaaccacctggttatacattccagaaacctgagaatcacccttgacctctccaatcccttcactccccaaaccgacccttcaccaaatccgttttcttttctctgcgcagttttaggagtccatccatttcccccacatccagcgccctgcactgcctagcacagcttctcacctacgccatggcaatggcctcctcactgggccccctcctctggctcctacccctctgcagtccatggcccccacagcagccaccagccacaaccacacccgcaaataaccactgctgctgggtgccaggtgctgctccaggctcccgacacaccccaggaaacaaaacaaatacctgtcctcggggtacttgtattccagaaggagagagatgggcgataagcaataaaggtaagaggtcacaaaattaccatggatggtggacagtgatgtatgccatggaaagaaaagtgggagcaggaaagaagcacctggaaggcagggtgtggggagaaggatttgcaggattaaggtgctcaggggaggtctcttgggaaagtgagatgtgagcaaagactcaacggagccgggggagcaagccaagatttctgaggtgagagttttgcaggcagaggcaaagccagtgcaaaggccctgtggtaggagactgcctgctgtgtttaaggaacaaccaggattctagggtggccagattgcaaaagaggaagaatgatcagacaggtaaaaggggggcgggggttgatcctgcagccagagcgagggtgctccagtggctttcactattgagataaagatggaagccctcagccaccctactgggccctgcccctcagaccttggctctgggcttctgtttccagccccttcccacatccagccgttgccaccgggagctggcttagatttgcgatccctccacccgcttcacttagtcattcacaactctgttcaaacagcacttcctccaagataccttccccaaacagtcatccagaccagtttagtggctcagcctcaccctctcaaaccaccctgcccttcctctacgccacaggcctccccagtgcacagccatctagcgttaaggctataattacttcatttggttcattgcaaatttggcagttgtttactctgtgccaagcactgtcctgggtgccagggcaccgtggagaacaggactgacaaggtccttatcctatgggagatggaccataaacagagcaaataaggtaactttagatgatgacatgtgccacacagaagatgaaacagagcagtgtggctgagagtagtgggagggaaggcagtgttagccaggatggcttgggaggcctctttgaaaaattgagctgagaaggaaccagctgcatgagtatgggggaaagagagtttcaggtagccgagcaacaagtgcacaggccctgaaggaggaccaaccttggaccacctgaggaagagaaggacagcccacatggctggagcagaatgggctctctctctccagctggaaacggtgctgcacacgattccagatcctctctggtctctttgtcatcgcatccatcccttgggcttgctgaccgttgaagctcatggcattcattgaatgaaggtgtagccatctcatttctgcccaaacttcgatcctgctttctccatgaactcttcccagccacttccagccctccaagaacagtctctcctctatacaaaaacctcagagccctcacttgagatctggggctggtctacttggggccggacacccctggaaatgctgtgaaaatggtggccctcgtgcacatgtccactttgccaggggtacatgcatcagagtcccagagggcctcagacacccaaaatgttgacgaaacaggactcccaaacccctcactctgcagatgaggaaactgagggctagagggtagaatgtgtaccctgggcctacctgactttctgtcaggctgccagctgccaggccacaagaactaccccatctggctgtgggaagccagcctggggtcccttgttggcacttggtgtctcggagactgttcccttctgcatggttgtccttgttttgatctgttaacgcacagtaagtaccccatggtaggtcaatgtcttcccttctcagattattccttgagggcacgatcaggtggttggttttctttaatgttattttactccttactttgtgtctgcacaattcctgctgagggactccacaagtactggctgcccagtcggctccttcttcccatgccccaaggaccatggaagccgccactcggggcgttaactggcttgtggtcaggcctgtgactggatattcttagcagccttcggtcacccatcccgaaaatttaaactccccggtcactggggcttagatctctccccgccaagggagagatgttttctataatattttcaggcagtcagctcagtacagagccgagtgtgcttttgccatcaaaggcttaagctttgggggcaaggccgagcatcacactgtcgctacccaccactgccccgggcctgcctgacgagcgggactgtttggaactgcttagcatgatggaagcttttggccacatcagagccgttatcacatctgacctcgttcctgggccctggggcagctcggaggcctgggagtctcgggcacttactggccttcctgtagagatgtccactgtgggtcaaatggcaacttaaaaacaggcatggggattagagatctccatttgggccatttccttaacctgctaggtgaattccccttctaaatgcaactgtttctctcactttcaaggagataccatattcggcttgccatcaagctctgtgtgcagtggcagggagtgagaacaaggattgagaaggggtcttagggaccctccaacagagcaatatggaggggagggtggtgtatagtcagtaggggtacagcagtcacttaagcacactttttttttttgagacagtttcactcttgtcacccagactggagtgcaatggtgcggcctcggctcactgcaacctccgcctcccgggttcaagcgattctcctgcctcagcctcccgagtagctgggattacaggcatgcatcaccatgcccggctaagttttttgtatttttagtagagacggggtttcaccatattgtccaggctgatatggaactcctgaccttgtgatccgcccgcctcggcctcccaaagtgctgggattacaggtgtgagccaccgcgcccggccttctttttttcttccacactttctgatttctcttggggtggctacatctgcagctgtgtttttcctccatttatctggctctggaagtgcaagagcacagactgggaggagacgtgggctaggggaagagaaggtttcctggttgtgtgtgtgtgtgtgtgtgtgtgtgcacgcgcgcacgcataagagggttcagaggaagcagaaatgtttcctctctcccagcactaccattccaccaatccatagcaagcaaaactcaggctgaatgttcaaaccccatgcttttaaggatgccacatggtgagaaagggccaccatgtaatgaatcctgggaaaaggccagggcccttgggagcgggagaatgagcaccagagaagctgataggagaaaccttcagaatccccactggcctctttgcaactttgggaattgagagaactcaggggaatatggtgaactacggacttaagcggaccataaagattttgaactattggtcaggcagggtggctcatgcctataatcccagtgctttgggaggctgaagcaggaggatcgcttgaggtcaagagttcacaaccagcctgggaaacatagcaagaccccatctctatatacatttttttttttctttgagacagcatctcactctgtcacccaggctggagtgcagtggcacgatcttggctcactacaaccttcacctcctgggctcaagcaatcctcccgcctcagcctcccaagtagctgagactacaggcatgcatcaccatgcctggctaattttcttattttttgtagagacgggattttgtcatgttgtctgaaactcctgggctcgagtgatccgcccacatcggcttcccaaagtgctgggattacacacgtgagccacggcacctagcccttacaattttttaaaaaggttttaaaatcaattctattccacaaacacttctttttgagaggggggtctcactctgtcacccaggctggaattcagtggcgagatcatggcccactgcagacttgacctcccgggctcaaccaatcctcccacctcagtctcccgagtcgctgggactacaggcacacaccaccaccacctggctaattttttggtattttttgtattttctcaaattcctgggttcaagtgatccacctgcttcagcctcccaaagtgctaggattacagggccactgtgactggcccacaaacccttctgaaacaccccttacatatatgtacagagctatgaaaataagtaagacatacccttaagggaggccgccctgggaaagacattctaggcatcttgtggggagtgttgggtcagacagaggatggaggggtgtgtgtggcgtcgggggggcgggttggggaggagggcataaaagcacacgtggccagcctgctttgtcctgttctggaaggccatccagtctgctcaagggcagctgaacaagtgggaagagaggtggcaaaggcagatgaggtggtccctgcagcctgctatgtgccaggaagtgatgcattggggcagcagctccagcagctgcctggagaaggtggttgattatgggagaaattgactgtggagtctcactctgtcacccaggctggagtgcagtggcgagatctcagctcaagtcaacctttgtctcctggattcaagtgattctcccgcctcagcctccctagtagctgggactacaggtgcacaccaccacgcctggctaatttttgtatttttactagagacggggtttcaccatgttggccaggctggtcttgaactcttgacctcaagtgatccatctgcctcgacctcccaaagtgctgtgattacaggcatgagccaccacatctggacctcttcagtctcttctaatcactacatttttcctccctcacgcccaaccaagtgagtgagccaccatggaaatgtatcatccagcatcccagcttcaactcctccacctgaagccccaaacattgtgagcagagacaatccatccctgctgtactttatctgaattcctgacccacagaaatcaagagatagaatacattgttattgttggtttatgccactacatttttgggcaacttgttatgcagcattagataactaatatgggggtgggtgagttccctcagagctgtcacagctgagtgtgttcacagaagttaatggcaagcctagagggcacatgtctcacagcctccaggcagacagaagaagtcactaaagaatcatctgggagtcggccaggcgcggtggctcacgcctgtaatcccagcactttgggaggccgaggcgggcggatcacgaggtcgagagattgagaccatcctggccaacatggtgaaaccccgtctctactaaaaaaaaaaatacaaaaattagctgggcgtggtggtgcgtgcctgtagtcccagctactcgggaggctgaggcaggagaatcgcttgaacctgggaggcggaggttgcagtgagccaagatcgtgccactgcactccagcctggcgacagagcgagactccgtctcaaaaaaaaaaaaaaaaaagaatcatctggggctgggtggtggctcacacctgtaatcccagcagtttgggaggccaaggtgggcggatcacctgaggtcgggagatcgagaccagcctggctaacagagtgaaaccccacttctactaaaaatacaaaaaattagctgggtatggtggtgcatgcctgtaatcccagctacttgggtgcctaaggcaggagaatcgtttgaacctgggaggcagaggttgcagtgagccgagatcgtgccattgcactccagctcgggcaacaaggcaaaattccgtcaaaaaaaaaaaaaaagaaaagaaaagaaaaaaaaccacgaaaacaacaacaaaaaagaatcatctggctgggcacagtggctcgcactttgggaggccaaggtgggcagatggcttgagcccaagagtttgagaccagcctggtcaacatggcgaaaccctgtctctactgaaaatacaaaaattagccgggtatggtggcgtgcgcctgtggtcccagctacccaggaggctgagatgggaggattgcttgagcctgagaggtggaggttgcagcgagctgagatggcaccactgcactccagcctgtctcaaagaaaaagaaaaaaaaaaaaaagaggaggttaggacacacacacacacacacattgggaagaacatgtgaagacacaacaaagaaggtggccatcttcaagccaaggagagagatctcagaaggaaccaaccctgctgacaacttgttcttggacttgcagcctccagaacagtaagacaatatatttcagttgtttgagtcacccagtgtatgttactttgttatggcagccccagcagactaatctagggtggaatctccatctcttcctcgaggatctgagttggcatcatgacttgctctgaccaatagaatgcaccagaagtgacactgtgtgacttctgaggagaagccttaagagactttgtagcttcctgcttcaccctctcaggcagttctgaggctgccacgtaaggaagccagtctcacatacttgaggatgtgaggccacagggagaagagtgacagttcactgcagctgacagctggcaccaactgccacactgttcatgaggccatcttggatctccccacagctgttggctagctgactgcagctgcatgagtaaacccagatgtaaccagcagaggaacagcccagccaacttacccaattgtgatagaagaagaaattgttgctttaagctactatggtttagagtgttttgttacatagcaatagcaaactgatatatctcattgaaatatactctagaagagtttccatccaaaagtcttagaagcaagtctgttgactaggcagtggctcacacctgtgatcctagaactttgggaggctgaggcaggataatcacttgagcccaggagttcgacaccagcctgggcaacatagtgagaccctgtcttaaaaaaaaaaaattaaaatctggccaggagtggtggctctcacctgcagtcccagctactgaggaggctgaggtgggaggatcacttaagcccaggaatttgatgctgcagtgagctatgatcatgccactgcgctccagagcaaaaccttgtctcaaaataaataaataaataaataaataaataaataaataaataaataaatttaaaaaaaaaaggcagcaagaatactggggaagaggccgagcgctgtggctcacgcctgtaatcccagcactttgggaggccgaggcggacagatcacgagatcaggagttcaagaccagcctggccaatatggtgaaaccccatctctactaaaaatacaaatattagccgggagtggtggcatgcacctgtagtcccagctacttgggtgcctgaggcaggagaatctcttgaacccggaaggaggaagttgtagtgagctgagatcacaccaccgaactccagcctgggcaacagagtgagactccttctaaaaaacaaacaaaaaaacaaaaaagtatattgggttagaagccaggtgcagcggctcacagctgtaatcccagcactttgggaggccgaggcgggcagatcatttgagctcaggagtttgagaccagcctggccaacatggcaaaaccccgtctctacaaaaaatacaaaaattagctcggcttggtggcacacacctgtgatcccagcgacttgggacgctgaggctggagaatcgcttgaacccggaaagcagaggttgcagtgagcccagatcacgccaccgcactctagcctgggcaacagagtgagaccctgtctccaaaaaaaagaatattggggaaaaactccaatggcatctgtgcttactgattccaattctagggcacagcatagatgtaactcaggaaataaaagggagcagggaccaccttgcctgaatcatcaggggaaagaaaggaatacctccttttctttatctgccctccaataataagtggctccctatgcaagtcataccctcagatggctttttgtaaaaaactatgttgcccaggctggtgtcaaactcccagcctcaagcaatcctcccgcctcagcctctggagtagctgggattacaggcgtgcagatgtctattagtcaaatactctctggatacacaggcctagaatcaccatggaaatagctgccatttattaagtacctactatgtacttgttgcatattcaatgcattcccttattcaatcctcatggaagtacggtcaaaatgaggcactagtcacaactaaatgaccctattttgcacatgatgaagctgagactcagagaggttaagcggctctcctgaggtcgcagagctagtgggcatagactcccaaatggacagtctttcctcttagccaaggtgtgatgtttaaggaaggtgacataggagaacggggatctcagcccaagtgagtagaaacaggaaaagttagccgggcatggtggctcacgcctataatcctagcactttgggaggctgaggcgggcagatcacgaggtcaagagatcgagaccatcctggccaaaatggtgaaaccccgtctctactaaaaatacaaaaattagctgggtatgttggcacgtgcctgtagtcccagctactcgggaggctgaggcaggaggatcacttgaactcaggaggcagaggttgcagtgagccaagatcatgtcactgcactccagcctggcgacagtgagactccgtctcaaaaaaaaaaaaagaagaagaggaaaagctggtcacataatgggggggccaggcctcagtggcagggctggggccaggccaggtatataagtagaaggaagaactgtgggcagagcttccaggaaatgtcttagggagaaggggaaacagtccagacggagggagggaggagctgcggggccttagggaggtgggggttggggtatgggcgaaagctgtttcactgtcctttccttgggagcaggagtggtggctctgcctctaagaacagactccttgccgggtgcggtggctcacgcctgtaaacccagcaggcgtgggaggctgaggcaagcggatagcttgaggtccggagttcgagaccagcctggacaacatgacgaaaccccgtctctaccaaaaatacaaaaattagctgggcgtggtggcgcacacctgtagtcctagctacttgggaggctgaggcacgagaattgtatgaaccagtgagccaagatcatgccactgcactccagcctgggcaacagagcgagactccatccaaaaagaaaaaaaagaagaagaacagacttcacccgtgcagcaggcacctcctctaccaccctccgggccttctcctccatgactctgcctcccctgccccagcaactccctatgcacctgccctccttccctgtccctcttcatctaaatcttcaacaggtggagagcagcctgattaagggtgcaccccaattccctccttgtggtcacactatgaggtgggcacttagttactctccttttacaggtgaggaaactgaggcatggagactgaggggagggcagcctgcactatgacctatcctaatgactcaatctgggaggtttcccctggtcttcctggtcctccaagacccgctctgccagggattccggggtgctgactcacacatcactccttcaggcccatggtgtgagttcgtcaatgagatcatggagacgtgtgaccatttttagcccttggctaggtgtggggcacatagaaggagccccatcatgtgtcgcatcgctgtgcagctccaagcctacccctgtctgctctcagcaaggcagctgctgcatgtgaggcttggtggtaatgagggaagcatgtcggtggggaggttcaggagccccagaaggaaaagaagaggaccagagagagcaggttcctcggagtgctaaacacaggcccaactgcctttttcaggaataagggtgtgggccagaggggcaaacgaccccctccacaaatgccagtgaattgcagcaggcacataatggctcctccctcttgtgtcctgccttccaagggtaccctatttggcaaatcctacccactctggcagcccctggaacccagccaccctcttaatgcccctcatcctgaggcatctgtcatgcaagccaccccccaccttccctggggagctggcttgctggccccagtggtctccatgtgacctttcctcagctcctccactgtctccagacctgaggtgaagaaagcaaggtcagagaaggggcccactcatgaccgtgagacagaagacccacgccaaccaaagctgctctctttctctccagctgcccctcaggccaccattgcaacagatgaccctcctgggccccaaaccaggttgtctgacctgaaaacactcagtactcagccaggtgttcccattcggagcccagtgagcttgcacttgagatcaggcacatgggtaaggctgatatgggggtgacagtgaaccacagatcttgcagtcccaacctcctgagagagctgagctggtcagaatgagaaggtgctcactgcaccctgcatttactatccaaaaggactagaaatgactagaaactgagaaaaacaggccaggcgcagtggctcacgcctgcaatcccagcactttgtaaggccgaggcaggcagatcacctgaggtcgggggttcgagaccagcatggagaaatcccatctctactaaaaatacaaaattagccaggcgtggtggcacatgcctgtaattgaagctactcaggaggctgaggcaggagaatcgcttgaacccaggaggcagaggttgcagtgagccaagatcgcgccattgcactctagcctcggcaacaagagcgaaactctgtcagtaaaagagaagagaagagaagaggagacaagactgagaaaaacggtccctatggcccagtagacatgaacaactgcaagcgactggagacctggcacctggcactggctttaccctgttagcctccaggcctcaaattagaaggaggaggggaactcatgcttgtccagcacttcagcaagatcatctcactgaatcctcataacaaccccatgagataccgtggtggttttaaacacgcccgctagttattcgacactcttcccaccaagaggtgtggtctctgtctctacttctagaagtctgggtgggcttgtgactgctttcaacacaacagaagtgacactctgagacttgtaagacaaaggcagaagaagccatgcagcttgctcctggctctttttggggcacttgctctgagagaagtcagtaagaagtctactgccatggcagagactcacaacataggtgccacagtcaacagcccagcagagctcccagccaatagccagcatcaactgattgctacaggagtgtgccatctcggatatccttccgatggctgcagcccctgttgatgtgtgactgcaaccgaatgagatatcccaagtgagaagtacccagctgagtccgttccagaattcctaacccacagaattgtgaacaaaatcaaagagttggggttttttttgtttgtttttgagacagtatcactctgtcacccaggctgaagtgcagtggtgggatctcagctcaccacagcctcgacctccagagctcaaggaatcctctcaccctaatttttgtatttttgtagagacagggtctccccatgttgcccaggctggtctccaactcctaggctcaattgacctacccgcttcggcctcccaaagtgctgggattacaggcatgagccaccaaacccggccaaagagttgttttaagtggcaaagttctggggtaatttgttgcatggcactagtcacaaaacagatccgtggtgttcccacttgaaactgaggtgcagaggggctgaataacttgcccatggtcacacacctggtaagtggcagaactgagactcaaacctggtctctcagaatccaaatcatagccccttctcacggtgcccccctaacattttctcacttccaagaagagaacattcttttcagactcgactagtttccaaacctggctgtgcgtcagagtcagcagtggcgtgttaaagatagagatttccaggccccaccccaggcctagtgagtcagtattttcaggcgtggggccaggactctgaattctgaactggcaccccaggtgaccctgaagcagttagtgcgtgaaccggacagtgaaacccactgctcagccaggttattacagaaaactggaggggaccagcaaggttttcttcaaaatatagcagtttcagaaaatccctcatgatctgagctcatctgcttcaatttcttttttttctttttttcttttttttttttttttgagatggagtctcgctctgtcgcccagactggagtgcagtggcatgatctcagctcactgcaacctccgccacctgggttcaagtgattctgctgcctcagcctcctgagtggctgggattacaggcacatgccaccacacctggctcatttttgtatttttagtagagacagggtttcaccatgttggtcaggctggtctcgaactcctgacctcgtgatccaccctcctcggcctcccgaagtgctgggattacaggcgtgagccaccgcccccggccatctacttcaatttcaactttttttttttttttttctttttggagacggagtctcgctctgtcgcccaggctggagtgcagtggcgctacctcggctcactgcaagctccgcctcccgggttcatgccattctcttgcctcagcctgccgcatagctgggactacaggcgacggccaccacgcccggctaatttttttgtatttttagtagagacggggtttcactgtactagccaggatggtctcaatctcctgacctcgtgctctgcccgcctcggcctcccaaagtgctgggattacaggcgtgagccaccgcgcccggcctcaatttcaaccttcttggccctaacatctggggagtcttttctactcccacaccactaagagacagaaattgatgggaggctatccaaccagtaagtacactcatgtgtattaacaccttgctaggctctgtggtccctgtgctctaagaacttacaactgaagcgaggagataaggcgtaaagtcatttcagagcaaccaaatgataagttttgtggctgtgacaataagcacaaaggcatctgggagaattagactgaaatgtaaccccctagaaatttgggaggggctccgcagaggaggtggggcctggagctgggagtcagggtgagcagggggatcactccaggcagggggctcaggggctgaggctccctcccagggcagaacaagcaggagggcatgaatgggtagagggactcactgggctgccccaggggtgtgctctgtggcagctgtggaaccagaggagaggggaagacgaggaccagatcagagaggggtcaggggacttgaagtctgatccagatttttattttctcagtttccaaaagctactgtcatttacagatcaaggacatggtcaggcgtggtggctcacacttgtaatcccagtactttgggaggctgaggcgggaggatggcttgagcccaggagttcaagaccagcctgagcaacataatgagaccttgtctctactaaaaataaaaaattggctgggtgtagtggcgcacacctgtggtcccagcttcttgggaggctgaggtgggaggatcacttgagcccaggaggttgaggctgcagtgagccatgatcacaccactgcattccagcctgggtgacagaatgagaccctgtctcaaaaaccaaacaccaaaaaataaaaaaggcagtcccccttccaagtccaggctaggattagttacagaagatggatcaactcacacacctttggagccaggagccagaattctcccaaataagagactgaatccccatggggctccaccataaaacatatctgccccagtgccccagtctctttgcttacaagatgtaaaccttgatgctgctaccttgaatttttagacagtggattcctttgattagaaccactctgggcaacggtgatgagattccattaaccatcggaatcaattgaaccaagagctttccttcctaaagggaagggctaggttccagtacttggctgactgcagagccctggaggaattcattgaaaggaggcccaaaattagaaatcatcactttctgcagagacacttaggaatcccccccacattattcaaggacagcaagagaaaggtgggcagaactggggggaaaaggagctgcaaggaagaacgcgaatctttggccagctcatataccttcatacaacagatgaaggtgtgtcctgcacagcctgcgagactggctaaaagtctagcttttagtcacacctcctggatcctatgccacatctccaagacatgcttagaggtaagcaaggaaacttgctcggtctggggtctcctctgagctttcccacctgtacctttcctgcaagggaaacccctgtaggaagaaaggtctccattccatcatggcttttttcttttccttcttttctttttttttttttgagaaaagagtctcattctttcgcccaggctgaagtgtagtgacacaatactcggctcactgcaacctccactcccggattcaagtgattctcgtacctcagcctcccgagtacctgggattacaggcgtgtaccaccatacctggctaacttttgtatttttagtagagacagggtttcaccatgttggccaggccagtctcgaactcctgacctcaggtaatctgcctgcctcggcctccgaaagtactgggattacaggtgtgagccaccgcgcccggcccttcatggcctttttgtctctcagcattgggatggccggtggcccatcttcccaggtttcctgagattggcggcaatgacccagaagcctctggtgacatcataaaccatctcggggagggtaatgtaattattgcatggatttatttaaatttaatctaaaactgaaggtttcaacaagggtcgttttatcatttgatatatgtgtttgtatatataaatgtcacagctagagatacatagttttggtttgaaacacctgtttcagattgcattactcttcccagtgcttcacctccccctgtgtccacaccttttagaggtagagcatgcctcttcatcccaccgatgtcaggccacatgacttcttctggccaatagatgtaggcagaagtaacagtgtgcaaattttgagtcccggacttaagagtcattgcatttgcactctaccctcttgcacttttgccattgtcatgagaagaacatgtcccaggtagcccacttgtccgtagaagatgagggacacgtggagcagctttagatccaatccacacttggagtcaagccctgttgagcacattctagaccagtgaaccacaggtgacccactgacatgtatgtaggaaataagtgcttactgatgttttgaggtggtttgtgatacaacagtgttgtgacaagagcttattgatatatcgcctgagcacgttactcggtcaacccaaggctcatactgcacaacctaccatctaaaagaacactcgttctacctgctgtagatagaaataactaactacataaaagaacattccatctctctgtagcctcacacccttcttaattcttccgagtatttattacaacctgcaatattatatatttttattgctcatgtactttttctctccccagtaaaatgtagttttatgatgtccaagatattgtttttgttcctgctataaatgtccaaagctttggtaggcgtatggtgggtgttaaataattatgtgcaaaatagatgtctatggtcttttttctccttggttaatatgcctcttacctaatttacgttcctgtgtgcagctcaatgactttgcactaagcaaagttgaggaagaaaaaaacattttgtagaacaaaatatgcaaacaggagacctcccaattttgtccctgatgaagaatgagttcttcttccccaaagagccagtctccatggttggggcccttagaaaccacagcagacctccagaactgtggcaaaccagcaggtggctttgccagtgccatccaatataaccaagacgcagctaaatttctggataccgtatcaggggctgtcctcaaccataggaggtttctctgtgtgtcacttcactggggggaacttcaaagggacttatgtggcttccaagagctgtcagaatgtttgactctctggcattgtgccggcatcacacgttaattaaattatatggcagatacacctcaatgtcaaagtcagatattatagccgtcaaagcctaacattaggtgcagtattttatagcacagagtatacctttaaacaaattcctggccgggcacggtgactcacgcctgtaatcccagcactttgggaggccaaggcaggtagatcacctgaggttgggagttcgagaccagcctggccaacatggtgaaaccccgtctctactaaaaaaatacaaaaattgtcacgtgtggtggcacacacctgtaatcccagctacttgggaggctgaggctggagaatcacttgaacccaggaggcggaggttgcagtgagccgatatggagctattgcactgcagcctagataatagagtgagactccatctcaaaaataaaataaaataaaataaaataaaataaaatataaaataaaataaacaaattcctttatctttccccagtcctctcttgcctctggctcttaagacatctaccattctacacttcctatgtgaagaaaattccagacaactttgtctgttggggggccccaagactctctggcttgccagacagtggaggtttctggggttgcacctacttgctctctctaacccttgactttctgatctcaggcttttgtgagcctaggcttcaccctgagagagaagatcttaccggtctgtgggtaaaacaaatgctagctctttcttcaaagatggttctattagcagggcagcaactagccaggctataaaagggaagtggacggggggcgactttccctccaaatatctttttttttttttaagacagagtttcactcttattgcccaggctagagtgcaatggcgctatcttggctcaccacaacctccgccttccgggttcaagtgattctcctgcctcagcctcccgagtagctgggattacaggcatgcgccatcatgcccggctaattttgtatttttagtagagacggggtttctccatgttggtcaggctggtctcgaactcccgacctcaggtgatccacccgccttggcctcccaaagtgctgggattacaggcgtgagtcaccactcccggcctcaaatatctttttaataagcacagctagaaactctccatgagtggaaactggtcacaagaagcccctgctacttatgtgctgagcgtaggcaatcctctcaggcgagggacgactacgaagccacattcccggttttcttgggtctctctcatggttaccaaggaaaactcggaggccatcaactcggccaaatgacttacatgcaatcaccaaagcaaagttaataccaagtgtgtttaagtctcaagtgtccctaacacctattaagcactttctagatgccaggcactattttattatttatttatttatttattttgagacggaatcttgctctgtcacccaggcaggagtgtagtggcacgatctcggctcattgcaacctccgcctcccgggttcaagcgattctcctgcctcagcctcccgagtagctggggttacaggcacccaccaccacgcctgcctaatttttgtatttttagtagagacggggtttcgccatgttggtcaggctgctgttgaactccttacctcaggtgatctgctcgccttggcctcccaaagtgctaggattacaggcgtgagacaccgtgtctggcccaggcactattttacatgctttatgtccatcaactaatcctcccaacatcattaaatatattgtatcactaccctccatttcacagatgggggaagtaaggtggcgagagtaactgcctcaggtcacacagctggtcaagttgtagagccaggttttgaacccagacagtctggctcccccatactaactacgacatagtcttcgctatttaatcctgcaagctttaggaaatgcccactatgcacgaggcacactaataaggtgctgggggctgggaggagggggatgaacaagcaggcaacatgtctatgagggaaaagtactcctaagtaacagtttaagataaagttaaactaattcagacctttgaaggggttttgaattctttccaagggtaggcgtgttgaataaatataatgcttttgaaaacctgccttcatatatgggtgttcattgtactgctctttcaagttttctgtgggtttgggatttttttcaaaataaaatttaaaatatatatatatatataatatatatacatatatatatatatatatataatatatatacatatatatatatatatatataatatatatacatatatatatatatatatatatatatatatatatatatatatttttttttttttttaagcatcagccttaataggccaggcgcagtggctgacgcctataatcccagcactttgggaggccaaggtgggtggatcacgaggtcaggagatagagaccatcctagctaacacggtgaaaccctgtctctactaaaaatacaaaaaattagcccagcgtcgtggcacacgcctgtaatcccagctactcggaaggctgaggcaggagaatcgcttgaaccaggtaggcagagattgcggtgagccaagatcgtgccactgcgctccagcctgggtgacagagcgagactgtctcaaaaaaaaaaaaaaaatcagccttaatagactatcttgggaagagtaagcaataaactgggagcactggttgccttcagagaggcaaactgagtgactgagaaatgcgggtgggagaggcaccaaacatccttttatagccttagaattttctgccaagtgcaggtgttacccataacatctgccatgaacttgatgtcacctgggcggaccctttggagagaaagcacggaattcccagctcccaagtcccattcagcaggtcagctgctgggagtatgagggagtctttagtttcccagctttatgtgtaaagtgggcagaaacacaccatcagacctttggcttaaaaaatatatatatacctaagcggggtgcagtggctcacggctgtaatcccagcactttgggaggccgaggcgggaggatcacttgagcccaggagttcgagaccagcctgggcaacatggtgagacccagtctctacaaaaaaaaaaaaaagaaaaatgatccagctgtggtggcacatgcctgtagtcccacctactcgggaggctgaggcaggagaagcacttgagcctgggaggtcgaggatgcagtgagctgtgatcacctcactgcactacagcctcagcaagagatagatggagaccccatttaaaacaaacaaacaaacaaacaaaaaaaccaaaaaactatgcctgaggagtaataccagggattgctctttctcctggttttagtgtaagcacaatgaagttttcagctccatggggcttatctctcttggggagactttatgttctctaaggaggggcctgggtcttgttaaccgggggtttccccgagccaccccaacagccacaagcacagtgcaggacagacaagagaggcttgaacgaatgctagttgaatcactgactatgctgtgttcaccatccacgaaggaccatgtggtccaatatccttcctattcgtatgtgtgggtaactcttggagcatggatgccacacttatgacaagtgagcagtgattctcagcacagaatgtgatatttttctgttgcacaaagttaaacagtgaccgagtgtccacaattgcccaacatggcctgaagctgccagccaaggaattgggtcacccctggttcactctgaggggctgggggatccccgtcttgacccattggcaacccactcactcttgggaagctctgggtgaagggattttggaagccattccctggctctggaactagcaacccacaactagaagggggagggggtggtctgagagggctgccaaggggcagcagggcttcctggggcttgggcttgctctggggtgtgcccaggtttttggggggcgacggggcctgagcagtgggctgaagagggcacgctgccagctctggttggcccagggccagtaagtctgactgaacttgagccagccctgttggcccacagactctggaagctgaactgctccagcgctccttggcctctttgttttcacttccccacagctctctcttagtgtttaggaatgtgctttgaaggttccagcgtgtttcgcctctgcttagggaaaccaagagcagaggctgggcccaggccagatggcttgaggaagggcacctgtgatcacactgagagcgccccaaggggcaggtggaatgcatggggcacttaagctagcccccttctctgctgggagactccgtgtgcagtgctaaaccttggagattctcaggtttgttttgttaagggaggcagtattcccttaccagctcccccagagagcctacatttgtccaggagcttttggggataagctgtgctcttctgcttgttcagggcaagagagagagctgtagcgtgtgcttttctagctagaaaagttgcctccttcgttggcattagaataagtttcctggcctgcctagggcaacaaagtcaggccctccaaggaaggggaagtgaagatggcctctctcgcactcccaccactgggaggacaatcttacaggcgcaggtgcttagccaggtagggtttggctcagggaggccatagaggggtccattgctacaggttgccctctggcctcgatgcccacctgtaaactgctatcttcaagagtggaacccagagtggttggcttcctcctcccattccccagccccttcacccactgtctttcatggcctttgtcaccaggcacatataaaggggagagtcttccctgctcagtcctttgagggctcatagtgctggtagccccctttgatgccagcatagtgctttgcacacagcaagtgcttaataaatgccaaatgactaaaataccaggcctcttcagtgaccaagagcactctggatctttctctaaccagcagtcactttcctcctctggctgttttctgaagctgggagctctgggttctggtctcttttgccacaaacatgtcaccctgagctagtgttttcaccctctcaactgatttcctccactgggttaaacagagctcaattaaagccctggtggctcttgtatgacatctgcatacattcttgtttgccggctgtcattttagcttcaggttgggtcacttcgatcctgcctgggcccaggtgctagtagggtctttagccttcagctgaaggttctcccctgctcctccaccatctgtttggctttacaacacacacctagtccttggactcttgacacatctgttcctttctgtccccacggccatttatacagctccagctcctgtgcgtgagggggccgtggcacatgagcaataactccgatgccacaagggcacctgagtcatttttctgcagccaacactgtctggagctacagcagacctccctcctgctctgtggtgacataggccctgttcaggtatgtgtgggctatggatttttttcccgatttccatttctccttgatttcagcacccaagtgaacatgcactccaaggctctgctgagggtaaacagaaagcaccatcgcaggggtccttcctcctctctctcggaagattcactttctcttcctaggtaatgactgctttttcctcccagcttcctctcagcctacgtatatttagtgcacgttgccctggatagagtttaattaggcaccaatgcacccaggggcaaaaaccaaggacccctctcgggttgagcaaatggggccagcctcccctggctggtaaatgacgagctgagctgccggcaggtagaggaggttgtccattctcagctaatgatcgccttaggcgccaagtgatggaaaatccagaaggactggcgagctgcagggggcagccagggacaattgtatggaccagtttaacatggcttccggagggatggcagcaggaatgctgtgtgtctgtgtgtgtgtgtgtgtgtctgtgtgtgtttcctggtctcctttctctcccctccctgccgcctttccctctctcttgctttcgattttctcttctgtttctagcccacacgagttgaaattagaaaggtctttgaattcatttatttgttttaataaaagcagcatttttaagcagcatatttgtagcaattgattgttaaactaaacaccaagccaactaaatgtgttagggggaaatgaaaagtcagtttacaagaaacataattaacacgtcctttgacttctcctaagcctttgtctggctagggacaagacagaggaaccataatcaactttaataaaacgaaagatggtatcaaggccaaaggggaacaaaaaactttggagtaggaaacaaaagccaaagaggggattcttaagttataacaaatatgttaaaaaacaaatcttttggccaggcgtggtggctcacgccggtaatcccagcactttgggaggccgaggcgggtggatcacgaggtcaggagtttgagaccagcctggccaatgtggtgaaaccccgtctctactaaaaatacaaaaaattagccgggcctggtggcgcgtgcctggtaatcccagctactcgggaggctgacacaggagaatcgcttgaacccaggaggcagaggttgcagtgagtcgagatcgggccattgcactccagcctgggcaaaagagcaagactccgtcctgagaaacaacaacaaatcttttgtttcctaatttttggtcatcagccattttctccttaccaataggaaggctccggtttgaactctacctgttcatggggacagatgctgagacctggaggggaagagggaaggtggtacaaggaacctgcaggagactgcagtatcaggtggcagtatcaggaggctgataaatccaggctaatggaaattactattgcacaacaccagagtcttcacgtggcctgactttcaataaactgttcccctcctcactccttggagaaagtgaaataagacattagactttcagtaatctcatatggtgatgatcaatcgaaacctggagaagaaggccaatttatagaaattgtatctgcttcactgggtggctggaaccagggagctgaaaagaaaacggtgctcgcctttgatgtgtgaagttgccccaaaatgacaaacgccaaaaaacactggctatacatgtggggtattcaaagggagagggtactcaggagaggcctttgttaggtggatcattgcggggacctgaccaaagacacatgcacatgttcaggccacataaaagcgatttatttttcttatcttttggctattttaagttggagtttccatctttcttatttgttttatcaccaatgaagtttatttactgaattaacttttaacggaccctccactttgttcttcagagttggcttccacgacttgcgcctgtttagccaggattcctcttgcctttgtgaccgccccccctccccgccaaatcccaatcctggaggtgaacggctcagtctctgttaactccttgcctgctggtgttttttctctgtagctactaatcacctccttttgatcactgccaagttctcaggttgaaggaaggagaaaggacctcttgaccactctggctggctttccacatgagcctgaaaatgtcgacaaatttgaaacatctgccgagctgctttggtctgattgctaaaatatgccgacctcaacccccctccccccgccccttttaatctgtttcatattcacaaattaagcatttagtctgggtaataaatcaaggcggtttacgaggctcacacgagacaaacaagcgagaagggcgcaacacaagcccctggaagaggactgcacggagctgccaggagtcgggagctcccagcgctcgaacgcggagagcagcctggcgcgtcctgacacgccgccagcacccacactttggcaggtcccagagccggcggggcgcaggcgaacagctccggactgggcccacacccctggaaccttccgcgcgaacccgcggcgcccggcccgccccagctctgggcaactcagcccctccgccccgctagggagtggccgctggcaaaggggacaacctcacccgacacacaccctgtggtgggcccattaagtctctcccagccaagccgagaaggctgaatccccctcccccacctctaccatccggcagggcttggccttaaagatcccaggcccacactcaccagaaaggcaaaagagtccccgttcaggtccacgtgtgacctccactaagcctggaggctaccccctccccgccccaaactctccgtgctgcctcctcccaggtttcggtcccagcagccacaaagctactttcagattcagataggggtgggggtctcctggagagcggatcaaggtttaagagcggctggggagggtagcaaaggcacaaacagggtccaggccccctctgcagaaaccccggcccaggcttttgcgaccacccaaactcagggggctccaatctgtgcgtttcccgccctcccctgtgcagcagcgagaagcggacccggattaggggtctgggaccattcgcaacccacgagcttgggagaccccggtggggagggtggctccggggtcacctcgaccgggcctctgttgcccggctatgctcaagttccctgtcgactggcgttctcgatgctatcgtgggacgcggcggcggagaggcggagggcgggaaatcgggaagcctgaacatgcagcccaccccggacctaaggggaagcgtaggaacaattccccaccctgcaacacagtacacgtcgcccttcctcttcccctagcacacattccgactgcgaaagccattactgccggcgcgcgagagactttttaaatatttacagcccgctctccgcacggtagcctgatccatctcgtgggcgcggaggcggggcgcggggctccgctcccgcggaggcgcggagccggggctggggagcccggtgcctccccccacggccctgaggtcctccctgcgcccccactctgtttaacccccaggtggggagaggaccccgagactgcacacagcgcgcccggggccctgccggggcctgagcgggcgggggacagtgtccgggaggagggagggccgagaggctgatttaaaggttctcaccgggaagcgagcgaggcacagacctgagagccgccgcgcggtgaaatccgaggagctctcttggcgaggaggggctgtcagaggccatttatctctcgccagagtggaggctcagctcccacaccgcccgcgagtaacaatggcagcgatcagcagctctgcacgcgcttcagtgcatgaatggattgcggaagatgcctgcgtccgctccgctcaggaggctctaggagcgccccctccccgcccgccgcgcccgcccccgtggcctccctaggccctgcgggcgcctcggggttcgcaagctgggccctgcggcgcgatcactctcacccagaacccccgccgccgttcccagggccttggcacctcgccaccgagtgtcattgggggctgaaatttgacacaagccttcctggcctccccgacgcagacaccgctgtcagccccctcctttcttcgcgcccctagcccctggcggcaagtttactttcaaggagttggaccgtgtttccgccgcaaaggccggcggcgtgcgggcccgggaggagggggcgggctcggaacgtttccttcacctgctcggccgcctggggtgtttgtaggtccccgctggcccccagccctagcgtccatacgcggcgctccccagcttttggcggctaatccaccgagagtccctgcgatccgcacatgcacgtgcactctggataccctcgtcccagcccacatcagcggcaaaatcatgtacccaaattctctttcttggcggcttacagtcttgaaagttgggagagcgccacagacctcgaagtctgccgcagaaatgttccccgtcaactctgcaaagtaggtctcattaaaacaaaacaaaacaaaaaaaccctccagtttcggcctagggctgagagaagcgggaaacgcaagtgaaggataccccaatccctcgagtttgttttggtggagctaaaccagaaacccggggatatttctgtttgggggaccgccaagcccgggatgcgtctgcctaaggcgaggtggggagaaggagagcgcaagaagtggacactcgcagcgatccaaaggcaaagccaagtaccccgcgggaagaggccgagctgacccaggttgcaggaagaccgccacatgtgcgcaaagacgcactcggagaggcagagcgcgacccgccgacctaggagactggcgaggacaggcgagaagctgacagcaagacaaagcgggagtagagagccagggaggctcggtcgaagacccgaaaacgaaggcagcagcagccgcccgagtcccgaagcggaggcgtgcgcagccaggcccagcctggcatagccccattctcacgcctaaggacgcggacacagactcttggcatgacttcctgccagagctggtctctgtagggcttgggcctacagttggctgaggccttcccagcagacagtggggtccccaggggaggtcttcaagaatccgggcccctctggtttccgccccctccttgagcccaggacaaaggtagcgggtttgaggagctcggactgttctcagggcgtctacaaggccatcagagagctggtgcctccactctcagggcctcgggcaactttttatctgacttggcggcgctggagggctgccactttccaccgcatttccatttggccttcgcaattgcaataccctgaaggcactgcccacaccctagccttccagcaatcgggattcaagctggacttcccataaccagcaacagtgtaacgtgaagacactcctagactcaggtttccctcaacccttctcccgcttgtccgcacacggggcggatcaacgccccccacccacggccccacccccgcgggctccgcaacccagggccgcagctaccgagtgtgcttctcctccctcccgaggctgttggctttaaacacacttgctgcactcacccccaccacacactcagtcgttctcacccttcctttctccctgctgggcctcctccaaaccggattgcctagcctgaatgcagagtccaggcagagcaggaagcctgagagatcaagcagaggtggccgaggaaacagaagagagggcccttcatgggggaggaggcccatgtctgagaaagaaggcagccaggagacacagcctgcaggagagagggagtataaagggaaagccagcactaatccctcagcctgcctacgtggggcctgacaatttacaaaagccttttccccgaatattatctcatgtgccgcggcagcctcaccaccagcgctgtgagggaagtaggacagatagcatcacccccattggcaaaggagggaaatggggcccagcgggttgagagaggtctgtgctaaggtcacagcgcgaagagtggtggaagaggcccgaggcctggggtttcctgccccaaagttaactttcctgttccatcgttgtgtatgtgtttctgggtgagcatctgcatggaggggaaggactgccggacaggaatgcacagtccagttagggaagtccaggaaggaagaacacagccccacacctcttcctctgcccgggtctcacacaacagcccctgctctttccacaacagcctggagccggccccccaccagcctgcctggggggagctgttagtgcctggctgtgccttcagtagtgcggatttcagagatctcgtatcctctgctctgctccgctccgctcagctctcttctcagcctgtcatccccacccccagcctcggctgcaggatgccttgcgtccaactgtggtttccgggcaataaaacaactattaaagtctcaggcacggctggtgatttgcatcacatcctcttgtgcatggattcaatgtttaatacacaatattgaatacggatattaaaaatcaatagctggggacccctggggaggcggcacagtgcgatcctgcttcgggaacacaaccagctcttctaaaaagacaggaacggcaagttcagccaagctgagcccagcgccaggggaagtgaggagtagtggatgcatctcagcttcctgatatgcttaactgcgccattcccaggtcaagctaaagggaagccaaaggaatggtgtgcccctaggctctactagctttgagatgggagggtggggaggtacggtttgtttccaagcagggtaccagccaggtgcgcggagttgctttttttccttgttatttgcacttaggtttggttcgagtctgagtcttacatgcaggctctcaactcttcccaccatgatggctccttcctgggcctcatgacatccatcaccataggccccatggggagctcttggcataagctttcagagagatggaacaggaatcccaatggctccgaatatgctttgcacagtaaaagaaatgtgaatgcatgataccaggctctgagctgcaatcttctgaggcactctgagccttcagaacagaaatcctcaggccgtgtgacccgcctaaaggcctggtgatggctgagtggtgacagaggaaaggggacgagaaggagactgggacatcgaagcattcctgctccagagccagaatccagattgtccgttaaacagccaggagaagagcaagctcccaggatgcataattatcttttcaggcctgaagaggaacatgtattactctcttctttatcaaaacatagaaatataccttaccctaaacagaaacaaggttctcacagactgatggggtaggagtgaaggagaataaacatctttgagaggattcagtttttttccactacggaaagggaagagaaactgacagtgggaaacacacttaggttatctgattggaaaggcctgggggattttagatgccaaaaactgtgtgaacttgacctagtgaaatgtcatcttagacaccaaattataataataattttatggattcatttttatcatagtttaaatcaataaggattgagttggaaatcttgctctagttataaatagatggagagaacacctcaggaaaactccaaagtagtaatttgggtaaaagttagaagcggaggaaagaggtggaaaatgacagttaatgagcctgtggcctccactctttgttacctaacagttgtcagagaaccatcaaagggagggaacaggcgcccttctcagaaccatcacaggaaaagcagacattctctggctgctgcagatccccccggtggtggttcctacacccagcctcctgggagtttgcctatgtgtatttatgtgtttccgggctggggagtgtagctactttcacaagattgggccctgagcctgtgaaacccactagcgaaagttctaccacgaggaaaagccattctaaggcaatgctggagaccaggaactgctctgccatcatcaacaatatcttcatgattcctgcactagcaaactgcttcacatcttcccacctcaaccatggggccgagctctgggcctcttacagatccatacaggcgggaccttttgcagctagcacagatgtgtggttaaggcatgagacagctggccaaggggaaaggaggctaaggctggggatggctgggaaggaccaaggcccaggagggcctcctggtacaagcatagaactgacccagcatgggggagttgtacctccagaacccactaagggtggcacttcccccctggacccaccaggtactccaaaccaagaggaaaagcatccttgtggcatgtgggtggattaggcccaaggcgcaggtgagctctgctgcagaaggaacctacacaccaagtcccaaatgcccaagtgctgacagggattggggcaagcaggagggaggggggatctttctgcctcccatcacctcacccttctgtaatgttttcctggaatgaacagaagtcgccagcagagttgttcctggagcccctccctccgggactgtcactacctcctggtgtaagacagggaggaccatggccttctgccgggaggatcctctggctagtacccgagccttggattctggcacgaagcctcacagttccgataaggctttacctcccttcccacgtctcgaagaaaaacaccccctggaactgctggggtgaactcggagcctgaggccagggtcagcggggggacgggtccccaccaccaccaagttgccggcagaggtaacagctgtggaagggggaggggagcgacaggcagccacgactgaacggttgcgatctagaaaattcaacaagaggccgcagcggtggcggcggcggcggctccaattagctgagccaactggggaggcagagagcgagacggcggccccgccgatcgtgtcccgggcgagcaggcaggcgggggcgcggggcctcgagctgccccggcggccctcgctcggcccctcccgtgggttctcggagcgcgcctggtgtttacacactgtcctttcgacgtgagatcaagtttcaggccgcgctggaggcgccaggggccggccacaggcccaggagaggggaagaggtggagcgggatctaaggcagcgctgcgccgacgagaaggcctggcgctcgtgggcacagctagtgcagcggtccccacggggtggggtggagagaagttcactgggcacggtgggtaggggttggtggggttgcaggggggtatccggagagagaaacacctccaagtcactagagtatttgtctttcgctcactcgggccggggaatttagtcctgcaaggggacaggcggcggcggggatatgctcagaacccaggcgcttcgacagccctgagcgccccttgtgcgctcttcacccctccccaccccgtccctttgatatactaccggatctaggccattgttacggggaggggtatgtgggccgaaggaactcggggttggagacctggagcttcccagcgcgccctggccctggcgctgcggaggcctcgggtggagtgctggagggctcgccgctgcgcatctcctctgagctggcagccagcgggtgccccacgctgtcaagcggcggcgggtgagcttccagcagcacaggcacactgtaaacagccgcgtgcacgccctccccgcccgggctgggaacctcacccaaacaccacgccgctttctctccggctaccgggcgaggcttttgtggccaagcctaggggaagggggtccccaccccacccccaggccacccgggccccggagccagcgttctgaatctgcaggagtgcggggtgctgcggggaggggagggagtcagcgcctgccccctcctcactgaatgtctgctttgttccggaaaacaagggaagcattaggcggctgcccccggggaaacacaaaacttctttttgaatctcgggaaaggcggttgactgcattaaggagctcccgagacagaatgaggaagggaaaagccgagagggcgggaggagacagggagacttccgcgggaggccgatggtcaaagtggggggtgaaaccgctcagggtgaccgggctggagacccaggaacccgattcggcgcgaaggtgccgcgcgagttccagcgagcagcctgcccggccaagtggcgcctgcccagccgtcggccgtgccagcttcctgccctgcccaggaccgcggagcagtcggggacgccgccgcaggctggcccggaatcgcaggacagcggcggggggagggggtagccaggccgcaagtaaactcgcactagagctttctgcacacctccgccctagagagggggcccggacccccggtctgtgaggcgtcggctttggccttccaaccttggggtgcgcgaggaagcaaagacccagggggcacccccaccctcgcccaaggcccgagggtgggggacagctgaaatgtctttggtcttgtttgatgaccgcttggcggatctgctcccatccgggttctgccgttccgagagtgccgggtcagtgatacccaggccggtctgagcaggcatgtggatgagcaaaagcaaatctgtcgctcctccgaccgccacccctcacttaacctttcctgcatccaaggaaggggagggcacccagactctgccccaccccccgcggggcgctccctctgcctcggaagctgagactaagagcgagggttttccccctttcccctgggctcgctgggtttctaacttcctctaaacctccctcctcgctccgaaaagccccgaggagaggagctgagaggaagcacgccgctagtgtgcaaaatgaagaccatgtgtgaggacggcggcatcagagtgcagccgcgggggttagggggtggcaaaggcccccgcgcggccggaggctcggggccgcagcagccagtgcctctgctctgcgttggggactcggagccgcagcgagaggcagtggagaggcagggctggcctcgtggcgggaggcgaggagggggtgcgagggctgccgcgccgtggggggcagggggcggggacgcagccccggcttcctgggccgcagctgcgaccgagggcgcaagagcagatcgtgctctgcggcggtggcggctcgggcccgccgctctagcagctgagaatcaacaaagggaggcggcgggggaggggcgccaccgagcgttcgctggctgctctggaataataaaaaataattaataatgataataagagaaaaatcccccggctttcatggctctgggtttccgtgtggctgcagcgggaagcgcgctgtccttgaggcggcctctctcgcctggcctgcccgcccctccccctcctcgccccctcccctccccaggaaccgggaagagaaaggtctgcagctgacaaatattatccattctccccatcgatcgcggagtgtacagatgtgagcgcttgatgtgcccgcggagcggcggatcctccctgctcgctcgctctcgcccaggctccgctcgccgtccccctcctccccctttgttctcctcccctttccctctctttaaatagatttcagggcgctgcctgttggagagcagctggcgatctctcccgagagagggagcgagcgaagcccgaggtgccctgtcaccagcctcccctcccccacctcggcttttctctacgtcccccccaccccacctttctccagtttccaaaatagaaaacaccgggaacacccacgtccactgcaccgcgagcccctgggagcctttggacccctcgtgctgttccttgtgtctgtgtctgtgcagaggaagggcagtgcagggaggggacccagggccgcggcagaagagccaagggtccggatctttccctggcagcagcagggacgcagcgtgggtcacgctaacagggtacagtttacccattagggaaagtcggcggagacggccctgttattcctcttttgcagatggcagattaatccggcagcacccggcctcaaagggaccggctgctcggcaaagggttaacccgtcggccggtaatcgtggacacgcgcgcacacacacacacgcacgcgcgcgcgcgtcctctccgcctgcccgagcgcccgccgcggcccgcagtgcgcccggggctgggggagtagctgcgggaggggagggggtcgggggaggggcggggcgggcttaaccaggccgctcgactgagccggggccacctcgccgtctgtcacttaaatgattgtcctccgctccgctcagtgcggtcagtacgggctgttaacaggcagttgcaatcagtttccgaaaggtcagccaaggtcctccggctctcgcagacggaaggcattacgaaaccgcttttgtatctgcaggcactttagaaaaagaggcgagaaggggcgcaccgcagtgccgcggctgctgcgaccgggggagagggtcgggggctgcggagcagaggagtccgcacccccgcggccagggtcaggcggcgtggatatcacccgcggagtgacccagggcctccgggtttcggtggggaagcaggaagggggtggggagcaggcggcaagggaaggaggagtgggaggaagtgggagaggcgtcctggctcctctcctcacccagccaacagcccacacccggacccagacgggagcgggcggccttggacgcgaggagaccccactcggactctcaggccctcctggcgcctggaagtagggagggggtgtgggggggggaaagaccctcgccgagcgagcgagtcccagcgcggtgtctgaagacgctgctgccgccgccgctagaagtcgtccatcagcaaccagtccaacctgccagtgataatgtgcgatcaacaccaaatcacccccgccaggcgcgatccatcatcgcagcgcgccgcgggcccgcgtgaggctgactcgcggctggggtggggagggggggcgcgcggagcaggaggcggtcgcccagcacacccggactctccgcgcacctcgctgcccctcctggaggcctgcacccaggcgctcataactctccaagttccccagctacagagcgaaaacccagtggctccgagttctgggcacagctcacttaggaatccgcgcgtcctccgcgccctgctgtcgtggtcacaccctgcaaagccattccagcctcggagctgccctgcccatcccctccccctcctccgagaaaccgtggctggcaggaaattaatatttaatatcgtgaaattgattaaagggctggaagccggcgatgggttggggggaagggtagggactcctagcgtaattaaagatctgagagtcgtggtcgttccttgtcggccctggccgcacgtggcctttgtgaagccgaggcggggtcggactgggctgagcctggcgagccggggtcaggagcccgtgcagcttaggctctggcccgcgcggccgggttttttcggggcgggggtagggctggggcggcacagcagcggcaggggatgaggaggtgaccttagggcacccggggctgcgcgcagagccactcttcccctgcccgcctgcaccgtgggccactggagcccgagggtcgggtgctacaactgctgtcttgcttgtacagcacagaagcgcctttactgaccaggtggcctcgagggcgcaccgcctaccccccaggccccctttcagcagcctcactctgggccccgcttcgaggcgcctccccaacccctgacaggagtcttctgagccccccacgcagcccttcgggaggggagtcaggttcacctttccccctgcaacttggaaatcctagggcttaggcgccccggggccccccgccggttctctcctgtccaggccccagcctggtacgctcacgcctggggcagcttaactcgttcagctgcgctgcagatggggcctgctgctcgaagccgctgtctccagggagtcgtcaccgaaccagctcggccagccgcctgtcgtgccgtttaaggttaccgcgcttcccgcgaggggcatcgggactggaccgggcaggaggtgggtgcagctgaggctccctggccacccgagctaacgctaggagaggaattcggtgtgcaaaaggtcagcggtaacccattggccctggctacagtttagaagtcgaatggttggcttggtggtggggtgaccccagctcacggaggcctggctccaaagggctgatgtgaactttttcttgtatctgattttttagtgaagcactctgaaaagtaccaagtgtgcagaggggagaaaacacaaaacacatcaagctgcgtccttggccctaatcaggggagcaggaaggccctccagactccaggccctccagactccaggcccgctgtggggaaggtcaggaccacagaggattaggcccagtcttgggtttattgctgtacttgaacaaagtgccgggggctgcctaaactggagcaagagagaggtaattaagagggcctgcagaaggaagtaaaggctggtgtggctgctgcccagggtaggtggaggaagtgttttccataagaataacaagccggtgcaaatgttatgcagaaagactatttcaccaaaacaaaaccaaaaagttcacattctgcctctcaagctgagctgataaacaacatgcaaactttggttggaaccttgaaccagtgggaggtgtcaacccagtttacaaagggtaatggggaaccgtttctgggtacttctctgtttctaccattgtgattctacctgcattagctgctccctttgggggcccttctgacctcccaacctgagcccagcgggagatcactcagaatgcaccgcattcatcaatgccatttctggtaaattggacctcaggttttggagtgtcctaggaggcaggcagcctacactgcgcgcataccgatgtcacagcaaatgtgaggaaccgcacatattctgtagcctttactgcctttactagagaataccgtggatttcacaaccagaagtagcagattttccaagacattcctgatttcaagtgctttgagccctgtgtttttacggggcatgaagccctacctgcggttactaatgtcgaattgcgcaccagaggtgtcccagggctggaagaaatggcttgggtgtggggctggcacccagtggtccccgctggtcccctgtccaccatgtctagccaggcggccatcctcctggccgtcccgatcccagccggggcccgtccaggtagggctccgggcagggggcctgtcaggacgaagtggcaggactggccctcggggtccccgtgggtaaaggaggagcggcttcgcgccctgggacagcgcgcgccccggctgacacggggctgtcgccgcttctcccccggacgcgggcggctgcgcaccggccgccatcttggcccggctgcgcaggcggcgctgcccccggcggtaggaccgcggagccgcaggctgggccggggctgccgcgcgggcgttcccgggctgccggggggcgctccctcccgaggcccccctccccgctgcgggccacgctgacccaggtcggggacgatggggcggccgtccctggtgaaagcgtggcctgtagtgtcgcccctcctcgaaacgctggagcggattttaatcctgagaaacgacctctggttcccggactcccgcgatggtcaacgtgttatcgcttctcccgcgcaccccagaactctgtccccagaggcaacctgccgaggcagctgggggtggggggcgaggcctacccaccgttcacagggcgctgttgaggccagagaggatttgagagttaccacggtttagggctcctgattggagaacactggaactttatttgtccactttttgaatttaacatgcatttatggagcgcttgctaagggcgaggcgctgtgttaggacctagggggatccaaaagtacagaagtgaatttttaaaagacacctttggccccctcaagtaatttacaatctagttggaaaggcagacttgtaaatgactgaacacaaataaaaggcaccgtgaggtgaacgtaaataaagggcatgaatcttgcagtaaatggcctgggtaaaggccaattattttaaaaataatctttatttctaaaaatgtagaatcagttcgggggggaggggagggtaaagatttactaatactgaatatttccacggttcccggggctaacagtcattacttctgaaaagttgttgtttaggaaaaatgatgaaagtttatttcaaccaagcaaaatatcaaatatcagaaactctggattaatttctcagctcttgacattagctgggtgggacagacacaatttcccaccaaaacacaataccccatttgaaatcagtaaaaactcccaccgcatttcataaaagtgttttttttgtttgttttttgttttttgagacagagtctcgctctgtcgtccaggttggagtgcactggcgcgatctccgctcactgcaagctctggctcccaggttcacgccattttcctgcctcggcctcccgagtagctgggactacaggcgcctgccaacgcgcccggctaattttttttttgtatttttagtagagacggggtttcaccgtgttagccaggatggtctcgatctcctgacctcgtgatccacccgcctcggcctcccaaattgctgggattacaggcgtgagccaccgcgcccggccaaaagttttagaaaataaaactaaatggaagattggaaactttttgaaaaagttttcagatttaaagaaaatagggattaaaaaaagaaacacaaagcaaaaaaagatcagcccatttgcagatggtcttcaagatttggacatgcagaaaattgtcctcagattaattgtacagaggttggaaagtatgggaaaagtagtcataggtcaaagaaaattaggcaaatataaaaatgaggcaattattaactccaggaaaaaaaaatcttacaagaaaggaactgcaatcactgaagctcatttggctcagcaatgaatgatatatatgtggttacaaagtaaacactggatatgaatttagtaaggcattgtgctctagtgctatggtaagaatggagaagggaaagtatggtacagagatctgaaatccccctccaccatcagatggttgacatggattacttttttttttttttgagacggagtctggctctgtcgcccaggctggagtgctggagcgcagtggcgcgatctcggctcactgcaagctccgcctcccggattcacgccattctcctgcctcagcctctcgagtagctgggactacaggcgcccgccactacacccggctaattttgtgtattttttttttagtagagacagggtttcactgtgttagccaggatggtctccatctcctgacctcgtgatccacccgcctcggcctcccagagtgctgggattacaggcatgagccaccacgcccggccggattactttttcttttttttctttgagatgtagtctcactctgtcacccaggctgggctggagtgcagcggcgcgacagagcgagaccctgtctcaaaaaaaaaaaaaaaaaatcagtcaatcaataaaaagaaggctcccaaagacctcctcaaccagcccattactgacactagaaaagttcctttttggagttgtttaattttgattggaatttctttcttcagatgatcctctactttttttttttttttttttttttagatggtgtctcgctctctcgcccaggctggagtgcagtggcacaatctcggcttactgcaacctccacctcccaggttcaaacaattctcctgcctcagcctcctcagtagctgggactacaggcacactccgccacgcccggctaatttttttttttttttttgtattttagtagagacggggtttcaccatgttgcccaggctggtcgcgaactcctgagctcaggcaatctgcccacctcggcctcctaaagtgttgggattacaggcgtgagtcaccgaactcggccttttttattttttttttttaatttttatttatttacatattttttgagacagggtctgtctctgttgcccaggtcgaagtgcagtggtgcgatctgggctcactgcagccttgacctctggctctcgggctggagcgattctcccacctcagcctccagagtagctgggactacaggttcatgccaccatgcccggctaatttttgtttttttgttttttggggtttttttttgttttttgggtttttttgagacgtcgtctcactctgtcgcccaggctggagtgaagtggcgcgatcttggctcactgcaacctccgcctgccaggttcaagcgattctcctgcctcagcctcctgagtagctgggattagcgccaccatgcccggctaatttttgtatttttagtagagaaggggtttcaccacgttggtcaggctagtctcaaacccctgacctcgtgatccgcccgcctcggcctcccaaagtgctgggattacaggtgtgagccagaaaccaggccgattctcccctttttttttttttttttttttttgagactgagtctcgctctgtagcccaggctggagagtgcagtggtgcaatctgggctcactgcaagctccgcctcctgggttcacgccattctcctgccccagcctcccgggtagctgggactacaggcgcccgccatcacgcccagctaattttttgtatttttagtagagatggggtttcaccgtgttagcctggatggtctggatctcctgacctcgtgatccgcccgcctcggcctcccaaagtgctgggattacaggcatgagccaccgcgcctagccctgttagggtcttgcactcaaacacctacatcaagtacataacggtctgcagtgaacaatatgccttaaaatcttcatattcataaaccaaagaaactccctctgcccaagaaacaaatcccatcttgctggctaaacaagacacataagtagggtgacactcctgtccttctcccacccacactccaaataaggcctaggagggacccaataacttacgaaccagtgcctgcagatgagaggtaacaaaacaaagagagtgtatataggcctaccgcgccaacatgctgggtcaacactggcttggtccagtcttaggctgatccagtgtgctcccaagaaacccttttgacctctatctgtcctgtgtcaccttctcttttcttctggatcagagacataatctctttctcctttgccctgagaacagagctgccagtagcctattctgtgttttggctggggacctttgtgcagtacacaaactgtacaatgtaatacagtgaccctgcctgagaagccagcttatttcaagggccatcccctgaatgtcgcttagttctgacccacctgctgaatctgggtttctttgtttgggtctcaggataggagttggccctgcagacccaaaatcacctcaagggaggctagggtgaaccagatacatcctgggaagccgtggtgaggtcaggaaaggggcaggtgtggcagagttcacccaggtgtattacactaattcggggctccaatctgcactgaggtctaaaatctgaacgtcatgcctccaaagtcttactgaaaatgaaatcttcaggaggggagaggaaagcaggccagagggtacacatgccttttggattttcaaaaatgggaaaatgattagattttggatttagggaagatgtgtcatgttaagggagccatagaaaataataactgccaattcccaagcaaaacaaaatcatgttttccaccacgtttctatctgtgtctcctagtcgaacccacaataaactagcagatcaaatagcagatcaaaggcagaggcaaatacaattatgcccgtgaaacctctagcatgaaattagaagtcaaactctccattcaggggttagagacaaggataatgggaacctggggccctagagatgtacccaggccctttcagtcacaacactatccatgctggatatttaaaaccacacctcagggagggcacaaatagtaagtattaattgtttttccatacacactacaggaaatgcattgactacattcctagctttgtaccatataaagatagctgtatactggtggtagagggggcggtgacttataaggcaatagtgaaaataatgttgttgggagcgatgaagggttactagatcttccccaagacagtaggctaaggatggcggcagatagaatgctaatcttttacctgcttccctttcaatgcagaagagcctaaaacccatctgatcccaccactcagttctccctcagtccttcccacattggacaagatcatagagacagctgtcttgatatattttctatttttcctaaaatccatatttgctttataggctctatttcttttaccctggcctaattttagctctctgagtccccctgcccccatataatttatgaggcctcttgagggtagaaacccctattacaatgtagactagtctgtttagagctactgctaattaagcttagctctcaaaggtgcctggtatggcttcccctaccaccttcccacccccacccccaccccaccatggccacaagttctttgacactcctcccaagtggaagtaggatctctgtcccttccccttgaatctggatgggtttgtgaccacaatcgcaaccaatgaatatagacttcaagggtggattagaaaaggtgatgcagcgggccaggcacggtggctcacgcctgtaatcccagcactttgggaggccgaggcaggcagatcacctgaggtcaggagtttgagaacagcctgaccaacatgctaaaaccccgtctctactaagaatacaaaaattagccgagcatggtggtgcatgcctgtaattccagctactcaggaggttgaggcaggagaatctcttgaacctggaaggcggaggttgcggtgagccgagatggtgccactgcactccagcctgggcgacagagcaagactccatctcagaaaaaaaaaaaaaaaaggtgatgcagcttcagccttatttactgcaatgctggttttctggagccctgagctgccgatttgtaacttaaagtcctattaccctcaaggcaccatactgtgaggaagcccatgccacatagagagccctgtgctcatgctatgggacacagctgaggtcccagccaacagccagacataaagtaaagacccctccggatgcttccagcctccagctgttgagtccaccaaattctggacccacagattccaggagcagaattaaattgcttctgagctcccttgtagctgacatgctataggggaagagatcaatttcataacttattgctaaatccatggaagaaggtgaactgggttaaaaacaaaagtgtgacaggcaggaaattttttttaaggaaatttctgatcataacccaaatcccccacctttgataacgcagtgtcttattctttctgaaatccctgtaggacagtgacctgtgtcttcctcaaatctgatctcacattttccctagaggatctgggtaaaggaccctaactattgtcccctcctgacctacattggctgcacaagggagccagttccctaggcaggaagggagaggggcaaagcatttccaccaggctggttttgctctcccttctcttctcttctctcttgtttttcttgcctctcctggagggtgctcatctcagggatagggagggatgaattatgcaagaagtgttagcttacttcattttcttcccaattcccctacaaatcccacaccttttcattctgaccccgactaccagacttgtgtcacacaccaaatgccatgagcttccattcacaaagctaggaatgtgcagcagtgcagctggcctctgtcccccaccatttcctccttctctgagccaggcactcacaggcccctgatgcccaggcggcccatggaccctgaccctcaggctgccctcctggggaagtgccaagctcagggagatgggaggaggggctgaaagacatctggaatgtgatggaccgaggaggggaatggggagagcccaggtcttacccccactctcaaacaagcagagcagccagggaacaggcaaaaatgataaagcagcttgcaatggggagaaaaccaggccacattgtgtggggtggggtgggggatgagaggtggggagctactgagcagaccagaaggaatagcaaagagacgcaggcaaccccgcttcccctccccgccctgccaaatgccagaggatgaacccgccaaaaataaaatacagccatgattactggagcagaggtcaaagctgaaggggcagttctcctcttgaccacagaaagccagcaccaactgggattatctgccagccactcatctccagcagcctggtccgcagtgcacaactaggccccagccacaaccagccctgtgcaggagagtccaagggtctaggacctgccccttccccagagcctgagaccaaggctggcttggcttcccaagttcacagctttggagctgcttgccctgttggacagtgcagtggggtcctgtggctccaattcacacagtttagaaacaattccttcttctgatccaaatcccaggccagagagacctgtgcctagctagggtgtaacacaaaccttcctacttacaattcaaacaatatcagtccaaatcctctcttcactccttcaagagcaagggcatgagattatctatctatctatctatctatctagttttgctttgtttgagagagtctcactctgtcacttagtggcacaatctcagctcactgcagccttgacctcctgggctcaagtgatcctcccacctctgcctcccgagtagctaggattacaggcctgagccaccacacccagctagggcacagtatttattaaaaactttattatcatcttcctggtgcttcacctgcaactacttcatcggatctttctccaattttttgatgtaggcattctcatacccattttgtagataaggaaactgaggctcagataggctacacaaccactgggggcagagctcccatcttaagcccgtatgcatcttgatccagagttttccatcgtagcttgtgatctcccatcttgattacttattttgtgccaggtcccgggccgggcctgcaaaggtgaataagacagtccctccccttagggagttcacagtttagtaagggagacagactgcaacacagtgggacagcagctctgacctctgaattcgggttggtggaagtaccatgggagtctttgtgaacatctccatcatcactgccccttcaccccggctctatttcctagcccctctggttccttctcataggctgctccttcttgtccttccttaagacagacactagctgctggcttccctcccatgcctttctttcctcctgttaatgaggtctgaacccacacacctggcaggaatcttggcaccctacctgcttggagaggttgccttagttgagtaaacttccttggcttctggggccccaggggagaggctagaccctgactgcagccccaggctggctcaggtggaaagtgggcacaggggccccaacgctgagcaggctggtaggccctcaaaaggcttttattgaagcctgttaaagggctttgggcttcctctgatgaaaggcgcttaagtgcatctggttatgattacaggggaggagaaagccaggcggtctctggggggttggaccagtcatctggctctgccttcctcagggcagagctggctgctggtgaggccaggaggccaggtgtgggggcaggcaggaagcaggaccagtacaaaactctccaactctctgaggctcctgaccccagcctctgactttgtcaggctggactaccagaaacagcatcggggctcagaagtgccaggctcctttgagaaaatcaagttcagagtggctgctgaccacccctgactcacagctcttcactgatctccacctccctccatctccaaaatatcctcccaagaacccctgaccctccatctaccttctccactgctcttctccctcggaggaagttaaaataggcttttgccacaagggtttctgacagtgataaaaactaaggaaatgcaaactttcaaaagttaaaaaacctcaacgtttgctttctctttttcaactagccaggtattgtttcccataaaacagacatcgttaaggctgtttcacgtcactgtaactgacaaccatgccgaattaagggaagagattaatatgaacgtaacgtggctgccctggaacgtcatcgggcagtcccaagccactctgtgcccggcgcctgtccctgcgcggaactccacgtgtgcacaaaatgctctggggaggggaggatcggatgggttaaacacagtccgcggttctagaaacgaaaatacatttccttattcccgccctgatttaatcctgctgcgtgttattattgtcaagtctcttcgcaccactgtttctaaaaagaaaacccgtgggtctgcgcggccctcagccgcctgctcggcttttattgtgcacgcagcctggtctgcgtggatccagcacgtcgtgaccgcctcgcaggcgcgcacggacaccctcggattggcatttctataagagctgggcgcattgtctctgcggcgacacacacacacccacacagataataaagggccacggactcctgaccaaccctcctcgcaacccataattagagatgacctttgcgaaaggcaattaaaatatggtaatgatcgatgggctcgcctgtttccaaaaaggaaaatacacaggtgttggcttcaggaggctccacctggccgggccgcgaggcctcctacagctcatgaatgaactctttctcctgggaagcttcgattccccgctacctacgctagcgctggctcctctcctccctttcccctcccccaccagagctctggcagccaggagcttgctggcggcggcggggctttgtcatcggaacgcacacacagacacgcacacgcgcgcacccggccaccacgggaccgcggcagccgcgtccttcctcgctgcgcttccttccctgccccctcttttaaagagctcctccagaccctttcttttcttccgtcctttatgtgtgcggtccttttgcatcaaggagctcaggaagcattttaggggggccttccgcggagcgccggacagctcctgggaggcagaactcaggaccctacacgcgcggagaggacgcggggacagccgggctttgttttgtctcttgcctctgccgggagggcggagaagcctcggccgagctggggcccactggcgaattggcggcggcaaacacccccctcctagcctaagtggaacctgaaactccggacttggtccgggtggggcacaaagctacgtggagggtctcccagtccacaagtggctctccccacacagacaaatgtgcagtgtcattatggtggctcctgttgctcgaggcctcgggggtgctccggcggtgcgcgcacacctcacctccacaaggcacggagggcgagaggggggccaaggggctggggctccccggggggctgcctggaggagacgccacatcgggccttcccgcacccccggctgccttcctggaccgcgagcacggagccagggcggcctctcgcctttcattacggggcctacgaaagcagcagcccaggcaaatatgtagctattaaaattaatcgccccgcgttgtcagctgaacataatgcaaattatttatgggctgtctgcgcaatatttatcatcgtgcaggctccaggcgcttcgtgcctcctggcctcccccgcccgcccgccctggccggcgcagggcgaagctgcgcgcaggctgcagcggcctgggggctctgggaacccgagtggggttccaagggcgaggccgtgcgtcaggccgtcttccaggccgagggcctcactttagtttctgccattcagtacacatttatcggaggcctattacgtgcaaaattaggaggtccgcgaaatcggggtgaaaaccaatttggagaaatctaaaccaaacagatgagctcgggctcgaggggcgatgcagacagaggctcctcagctgcacaagagaattttctctggctcaagtcggtccttcaacctgggaaacccatgtttgctaaagctggattcgctctaggagaaacagggagcatctgatgtgctcaacagattcgagtacaacgctatcgactggaacaggaattcggtgtccttcgagcctcaaaacttgtttgctgatcgcagataacagattaactgttaattgtcgaaatcggccaaccatttagtttatcactgttgggggccccttggtattcgctgcactttttatatgtaaaaacagtcttggtacctcctaaacggcttttgtgtggcttttgtttctctttcaaatacggtgttttaaaaaacagcagcaacacgccaccccaccccctcttcaaccaagccttctggtttaaaaaaaaacaaaaacaaaaaccaggaggagaaataatctataggacaatcccccccctactggtcggagctggcgttggggctttttacgcagatcgagtcgcccagggctgcggaggtaaacaggctttctgcaccgctgctaaatgaatcacgagggggaagaaccgagactgctgggcgagggaggcctcgggatctgggccgggagccagggcggggacggcgctgcacggggggcaatgaggtggagacgggaccagggttaaccctggtccaaggccccaaggccagggaagggagagtaaggccggtgggcggtccagccggaggcccctactcgctatctgcgaggcagggtgaacgcgcagcctgggcctccatccccagcgcgcctgggcaccacctggggccggtcacgctgcctgagcccatctgcgaggaaggaggtcacgaggcaccccctcccacagagttttaacaactccaggccttcaagacgcagtagcaggcctgggtcttctgatgttcatttaaagcaaaatgatcgcctttcttcactgtccccaccccagacgccaacaacaccttgcacctagcagaccaagcctgagtcaagacgtccttcggtcctggggctgggggaatggctaccaacgggcatctcttctgcagactaacagaaggggatatagccaggaagctactataaatttatattcttcttccggttttgttttggttttggtttttttttttttgagacggagtttcgctcttttgcccaggctggagtgaagtggcacgatctcggctcactgcaacctctgcctaccgggttcaagcaattctgcctcagcctccccagtagctgggattacaggcgcccgccaccttgcccggctaattttttgtatttttactagagacggggtttcgccatgttggccaggctggtctcgaactcctgacctcacgtgatccacccatctcgcctcccaaagtgctaggattacaagcgtgagccaccgcgcccagccttcttaaaatgtgatttgacccaatttaaagcctccctttcttccccattaacctccagtttttgacagattttcttagaacattccaaagattctctcattacttcagaaacttatctcgaaatgatgtaaaaggaggttcaaaatattaggttgcttttgggttccctttatctcgaacattgttgcgtagatttgagaaagggctgatttctactttgttttctaatcagcaagtcactggtttttctacctaagagagactgaacattaaccacagtgaagcagaagggttgagccgcatttacaaagtgccttcacattttggtcctcagaaacccatccgagggggacagagtaggtgttactgttctgattttacacatgaagagactggccactcgcccccacaaatttctggaagctagtcttcctcactgaactggagccagaagccatgtgaagccagcctgctcctgcctacaccctccttcctccaggtcaatgtcatttagaatatattgcatccttttcttggatctgtctgctaggacccgggccaccctcctgctggaggcaaccccgacagcccatattttaagcagctcttttcacagcctgcaaacctcacggattgtctcttacaactgtctgtttactcacttccctccacccagtcaattccgactccaggcccgggaggacaattttaaagtgtttctgcagacagaccctctggccgcgccggaagtgttttatggacctgtgagccgagttaatcccaggaggcgcggctggattagtcccgggtatgggtgggggattcatgtgtttaggtttaatccccatggggggggggcgtaaggagaatgggggtcgggtggcttcagcaatgtgtgccccctccccattaaactccgagatttgcgctagagcggatggaaaccgaggcacgcagccctcgaccccggccaggcgtggagtaggggagcagggggtgccccgcgtgggcgcaccctaagaaaccagtgcggacatggcgagcgagaccagagcgcagttgtgtgtggtttttccccaggtttttattcttccagccctgtggaaaggaggagagccgcaacccggagagggagccggaaagaaacacttaatcaccggcgtctcgctgctcgtcacgcgaagatggcagcggctcccctgggtttcaaggttccgggaaaggcgtgtgttctgccttaaggcgcgcgggctgatgcgctctctccctcggctcggcggccggctccggctcacagagcctctctcaacgccggcaagtgcagccgggccgcccagcccccaggccagcctggccccctctgggcctggggttggcgagggcagctgggcgtctgcgctgcccagcccagccgcggatccatggggtttcgcgagctgaaagtaaaggcttgagggagtggggacacccacaccgacccgcggcacgcaggggagtcaagctgcggccaatgcaagacgagcagggtagactactactagcggtggccggaggctcagccaccttcgcgggagaggggatttaccgccaccctcatccacgcgcaggccccaccgcccggtcctctcctctgatccccgggccattgcgaaacacggagcgaacaggtcctcgccagcagccgtcatttcccgggaagatgggaacccacaagcctgactgtgcttcctaaggatactagcgtgcgcgcagaccttggggggaaagagggcagcgcggtctccccgacccggactcttccctggcgcagcacacaaccgccacgggcttccgaagcgcccgagcggggaggaggaaggaaaagcggaggcccgggaggcgggctgcgcgcttggaagccgtgtgtgtttatgtgtctgcgcgcgcgccctggccggacgggtgttgaggggagagtgatcgtgagcaacccggaaccagcagtcccaacctggactgacgaactgggctctccagtcctgggccgtggggctccatgcctcgggctggcgggacaagcggcggggagcccggagcttcggagccgccgccgggcatctagccagctccgcgggagaagcccgggggcgcgtcgggagccaggggactggtgtgaactagccgcccccgcaggcggacgtttagctccggcacccgggagcactgacactgggcgataaggagttcctcggcaatcggctgtccccagtccccagtcacctccggcggacgtgaccgccggatgctatgcagctaggtgggccaggggggcctttgcattgccttccctgaccccttccttgccgcggaggagccacagtaagatgcctctgtacgactctccagaactttcttttgcaaaataaaggccaaatgttgggccttctagtctcttcatattttcctttggaaggttggggtccaggcagtcctctcgaaacaacccccaaacagatcactttcattacaaaacgctagagaggcaacacagccctatttctctctctggtcaatccaggccctatctctccctctggtcaatccaggccctattatcccaagctgtgcggctttgggcaaaccgcttaacagttcgaaacctcggagtcctcatctgtaaaataagaccaatactattatctacctcgtagggttgttctgaggataacatgcctccatacataaggtgcttagaacgctgcctccagtacaatgctacgtgtgtttgttactatgatctggcactccctttggatgggtagggagtacaaagttccgggttaaagttcctggaagtttacatggagccagtggtcttggcagggtggaaagggcactattgtatggccactgaaaagtgaaggccaaatgccctcaaactgtctaggtctccactagaccgtcccataaaggcttgtgtgtgtgtggtggtggataggagggagagtcctttttaatggtgctcatttagactggattaatagcaagttccgtcagggctcaggcaccattacccactctctccctgcagccctggggaagagcgctggtttccaggacctccagcctactcttccaggacaccttttttgatggctgaaggccacctctttaaatcagttctcggaggagttggccaaaagccatgtcctctgggatgtactttggtctaacactggtgcagggctggcgtatggcaggccttgtccctgggccgctggcgggccacattttactggtgcacagatgcaaataccacttctgtagacagaatcggtcagacttctaatttcaaaaggcttcccattacctttgaaatggcgactctggcaaaaaggggaggagttgcggcaaataagagcctagggaggcctcggcctcccctgcttggcctctccagggtcacccataattcattaggtgaggctgccttttccttttcaaacacaacgcaaatggcctttgccttaagtggctaccggcgtttgcctaatcactgaaatgtgctggcagtgcgctctagctctcagtagatccttatcggaactgtgcgtgccaagctgccagccccgagaaagacaaagaacacgggcgcctccaggtttgcttctgaggcctcagggtcacctctggggcttccccttcacagcctccggcccctacaagacgctcccagccagcctccggaacaaacccgcagccctaaatcagaattccagttctcgagcgccacccggagagttcacatttcccctcctccgaggccgcgtggtgcgcaagaaagagcccgagggcggcggcagcacacgtctgggcagccccctccccgtacccagcagcgtgtacgcaggaaaagaaaaagccaagagaaaaacgtggactgtaaaagccaaaacgcagaaccatctactactaactaccgacaaccccaggcgggagtttgcaaggagtaagcaaccctctaatagaaactacaactaaaataattcctctcttcgcgttctattaaggtcctggaaggtggaacgcaaaggggaccctgtcttcttaggacacagactggctgcgccgatagtgctcagccccgcacctcctgagcatacatttaatgttaggcaaagagcaagtttcctatctaccgtttgaccacagtttctcacagtatttctaattgattcaacgtgtattagattgaaacaaaaatgatcttggttggaatatacacgggcaacctgtatttagatggggtaagttcctgcagctatctgaccacatttgtctggtccctctgagaatccacgttttctagcccgagaaggggcaggcggccctcatggcgcctccttcggcggtttcctggcgaagcgcccatcctccccaagcaccaggaacggaggccgtccatattaatactcgcgggcagcctgttctgacctatactgtcattttttccatcggtcgggatcgggctgggggtggggtggggcgggggctctcctccgaggggctcagcacggatcgttgggttttccccggcgaacttaacacggaggcaaaaggggcagatggaaaccaggccccggctggccccgcgcgcgtaagcgcggcactcagcagctcgacgcaaagccagggctggattttcgcggcccgggcccggcggccgcccagcgcccgcgcgatcctctctccttcgggttgagcaaacgtggtcgcctaattccgcccgggagacagcagctgtgcggcgagagggggagaaaaaatatcgcaacttttccaacagaaagtgtgtgcgcacacgagaggtgaaggcccaccccgattctgtgcacgtatcgacacagcatctaatcagtgtcactgccaggaatacgcttccgcggcgggcgacaccgccgccctcgccaacctgcaggagggaggggggatgcaaatggcgtctcgcgtcgtcctagactccgcgcagcacccgctaccgcgactccaagcagacgttgcagcaaactggggtgcagcgtctggggacgcgaacgcgcaggcggcccgagcggtcgcagggaagaggaactagcaccactccccgctacgagaccgttccccgcccccacctccggaagagccgcccttactcgactggggtgaggggcgggaaactttgcaagaagactgttccgcgccttccccgcgtggcacctcagaagaacgtgggtgggtttcccgtccgaggccagaccacgctaccctacttttccaggtttcggacctgaacctcgtggactacgggagggagagtacatttcgggccactgcggggggcggagggacaccaaagacaggcgtcttcaagggttctggcagatggccaagtttgtgtcctttccctcccacgctagagtagcgcacgccactttggggaagcgtgagaccgttcaccaccggccacgaggccaccaatgtcttccaggtggggccgatggtttgtctgcagcactcccttccgccttgcggtcctcgcctggctcccacagtcctggggagcccccagagctagcccgcgtcttccctcgcccgctcttccgggggaaagggaggctgtttgtgtggtgtgtagccccgctccggcttgcacccccgcgagccacctcgcagccctccccggcctcggcctcacggatcccctcccggagtagccccgcgggcccccccgccatgcgtaatggggcgcccctgggacgcaggcggggatggcggttccggtcgttccgggatttgcgtgcaagaagaaaacaaggccggcgactacaagagcggcgactccattcttggggttcagacgccctcgcagcctccgcgtcggttccgctctcgccccgggagcccgcttccgtgtccctgcccccgccccccaacgattcctcgtccggcccgtgccgcaccacgcggagctccgcgcgccctggctcccacaccggtccctccataactcgcgctcctccctcgctccgggctcggggagccgctcgctcccagcgcccagagtcagccggttccaccttcggctgcgagagccgccgccccgcgccacccccgcccggcccggcccttgtcccagcccggctcccccgccagctgcgccgccaccgccgcacgtgacccgcccccgtcgcggcttccgctgagctgcctgttccggggcacaaacaatttttgctctgacgcggggtctctcgggggccctggcgtcctctactccctgctccccaccccaccccaccccctaccttccgggtaggagaactcaaaacaactcgctgaccttcgggccgaccagctccgtcttccactgactccagcattccgttcaaacccagcagccacggcttctaagatttcactccgctctgggctgggggggagggggcgagttctccgggagggggtgtctcagatcgaaagagccacttcacgctctttctcctcctccgaggtgagtttttagactatttggaggccttggggaaacgcgagcagccgcgtgcaaaggagcccccccgccttctccccgcacatgcagccttgtctagtgtgacccgatttccagggtcagcagcagagggcctggccagcttcggaaatacc

SEQ ID NO: 2358 - DNA, 126085 bp, Homo sapiens; identical to SEQ ID NO: 2357

SEQ ID NO: 2359 - DNA, 210253 bp, Homo sapiens
tcctcccgtgtaagtgatgctaagaagcacaaactgcattttgaatctaagtccctgtattttctgtgaaggagctgtaagtagggtgggacagagatggcacctgggggttctgaggcacccgctcctctctgagacagacagggatcaggagccggactgggaccagaccaccagcaacacaccagaggatgttctctaaataagaccatggcacttaagaacattaactaccttctcatcttctacctcagtttctcactgcttatctacataaaaagtaagcctttcccactttgggcatttttcctggtttatttctggcttattatatttcttacaaataatggataatgttgcatgttctataaaatacaatgctaaaaaaggaagtttttatttgttttttttttaagtgtcctgtgttaaagaaatcagtgataccagtcaatgtgaacagtcagttttaagattctatgatttccaataggtattcaggtacagaaattttgtttttaacctttgtagtagtgagctggagaatgaaatggtcacatagactagaagatattttgttgtgtttacgcttttacaaaatagatttggcccttactaattgatatcctttaaaaggaagttattcataacctgtatttcattttattcccacatactatatatttatcttcacttttaaataactctgtgttgcaacatttgctctcataattaaggggatagtctcaatgtttcccagaggataatggttcaaagtgtttctttcaccagagaaatgggcttttactgttatgtgtttctgttttataaatgaagatattattttccacaaacttccccaaatagaagcaagagcaatgtttctgagataatcttgtcggttctatagcaggatggaaaatcagaggagaccaaattgccccagctgtgtgtttatgaagcacagtagctattcaacacgtttaaaacgaagacagggagagtgtgtgcttgtcaaaggggccatgtgatttgtgtctgttgaatctgaatatcaataaggcaaagcgtagagcagctgccgttgaacaagacaacttggcattagcacacagtgttggataatctgggtcaccttctgtggctgcaccagtgagattgttacttgtacggtttacagttgaacatatattagagactgagtgaagaaataagtaaatgctgtgggtaggtagctgatggcacatatagaaaaaccaagtcaaactttaaacaaatgatcagtataatacttgactgcaacgcacactcacaaaagattttttttcatatatatttactaaagagttgttatttaaatagttatttaccctccttgaaacttaatgtgggccccaggcaatgaggaatgaggaagagaagtgctgtgtttagttgtgcaggtaggagaagaaagggagaaaaagaaataagtcataaaatgaatgtgaagtgagtttatggtgcattttatggcaaacagctttgtcattcaatgtaatatatatggaaattcctggagtttgctgcagtttgttttaaaggaaatgaatgtatgatatctttaattaaaagtatagtaactatgaattgataaatatatatcatttgtttttgctctctttgagtaagtgattttattgatagattctaaatactttgtaattattttatttgttctccagcatagtatttttattcgtttaaaaaagtacatttgaagtctcattttcttcgatttttaagcaggtagacttttgtctgtgttgatatatttattggcaagatataatcatattgctttcccaatcaaaacacgtagtttagaccttgttagctgagtttttttcccacctgactttaaaacaatctagcatcagccttcctttctacccttattacctagtattcttgacacaaattctgtgttccagacaagtgaataacataatatctagcagtaaaaattgctaacattgtgttaagcattttctatatcatatatgtcatttacttcttgcaacaaccctataagatagatactatcatagtaattcacattttatagaagatgaaacaaagattcaagtcactataccagtgtacctcaaactttgaggcacctcagggagctggaatgcctggttaaaatgtgcagcctctcaagtctagccccaggtacttagtagatcctaggaaactataatttaattagctcttcatttcaaatacaggtaaccagaagctctgagctatacaataaatctttattaagaacctactacataatgatgctaggaatcatcagaatagttaaatataaacatatctctctcttcaatgagattatttaggagaaaagataaacactatgagctttataactgttgtcactcttatatacataataaccctgtcaagtagaatttattattaattccattttgcagctgaagaaactgaggcacatagaggtttattaatttgtccaaggccatactactagtgaatggtagatctggaatgtgaacctggagatctggctctggagtgtgggctcttagcttgcatgtagttattcccatgaagtgataatgcataaggactttaagtgataatgcttaagcagactttattatgttctgcttggaacataatagcaaacaaagaaatgtccattatccaggtatggtggctcaagcctgtagtcccagcactttgagaggctgaaatgagttcacttaagcctagttcaagaccagcctgggcaacataacaagacctcatttctacacacaaaaatataaaaaattaatggggcatcgtggtatgtgcctgtagtctcagctactcaggaggctgaggtgggaggatcgcttgagactggaaggtcgagactgctgtgagccatgatcctgccactgcactccagcctggtaaaaagggctacaccctgtctcaagaaataaaaagaaagggagaaagaaatttcagttattaatatcatattaattgaaggaatcaatgattctttcttcgaactttgaaatatgttcccttaaatttaagagaaaataatcacctccagctccatactgtattttgtatctaaagttctaccttgctcagctaccaggggaacgctgtttatgttttgatcaacctttatgtccttccagttgaggacatgtgacatgaggaatattagagcagagttcaggaagtgacattccctttctgttcctgagcaggtagacattctcctaacttggagttgcaatgaatttgtcctgattgtttttatacctgttccttgattttgcaaaactggttctaatgtgtgggaccaattaaattttaataattcaagaagagctattattttttgcttctgatgtattaaaagagaaacttattagagtgagactctcctgtgatccattattcagagactgttttaaataataacagtactttataataaactctttttgggaccttgatgtatgaatctgttctgaagggttttaaagaaacaaccataccatgaattagaaaagtaatgtctatctctctagtcctttataaatttgggggtaaacaatattttcaatgtaaatgccacatcgagattaatttaaaagtaactgttttaatctacgtttaaagtatgatcacaacatgtaaaaaaaatgtggtttgacaaaactactttagagttaccagaacaatgttaaagagtttggggtagcatccagtcttccaaaaaccattagcaattattaagtaattgatttgaatggcattattttaaaaagtactttctaaagtactaaaagaatgaagaacaaatagagattaaataagaaataattgaatttgcttaatatgtcagagaaggctgatgttattcattagggagtaatcacatactcttaaaattctacatgtgtagaaacattgaaaactttgatcgttactgtgcaagttaatatccttgcagtggcattttgtaaagtgcctacctaattattagtgtgagaaaaaggtatctttttgcttcctcataaatgaaataatctcatcagtttacagtaaaatcatcactactccatgaaagttacccagggtttcctacattacatagcagagttaactgtggcttcttttattagatacttctcttagcaaaattttctggagaattgcatgcttttttttcatcattggtgattttcaaaaattatcattcatggtctcacaataacaaatactggaattcaagtggacaagaaaagttagagtgagtgtttaagcaaaccgtgctacatctatataatggaatattactcagtaataaaaagaaatgaactatcaagtcacaaaagcacatggagggagcttaaataaatattgctgtgtgaaagaagctcgtccagaaaggctacatattgtatgattccaattttatagcatcctgtaaaagacaaaattatagagacatggaatgatcagtggctgccagagaatcaagggtgtagagaagaggcacaggggacttttagaatagtaattattctgcataatactttaatggtgcatttgtcaaaatgtacagaattttacagtacaaagagtcaatctaattgcatgcaaatttataaaatcatttaggaaatcaaggaaatcccaggaagtaattcagactctgactcaacaatctaactgcattacaaatgtatgagataatctcacagaaggggttggggaaaaactgttcacctaagtagtttatgtacatttccttagatattacctgacatgctttccctgttctagtatcccatccaagatatcacagtacattttgctgtcttgtattttgaggttcctcttggctgtgacagttcctcaggctttccttgtttttgatgaccttgaaggttttgagttctggccaggtattttatagattctcccaatattggagttagttttgtgttttcctcatggtgaaactggagttatgggctattggaatgaagaccacaaaggcaaagggttatcctcattacatcatatctataatattatcaatgatttatacaatcaacatgatatgtgactgctgatattgaccttactcacctgggaggtggtgttatcaggtttccctgataactataaagttatgtcttttattcttctccatactgtactcttagaaaaggaagtcactgtgtgtaacccacacttaagaagtttggagttatgatctctctcctggagggaaaaatttacataaattattcgaaattcttctgcataggagatctggctcttctctttcatttatttatttattcaattgtttattcatatcagtatgaatctattgacatttattttatactctgggttataagtcaatactattttattttgttactcaaattattccatctttggcctgtgggagttcttttcagttggctcctattttcttttcacgtactccccatcaatgtggggtgctttttaaaaaaggattttcttcctttatggctctacaatccctttcagactgatcttgtgtatttcctgacccaatcctagcataaatcaccatttctccaaggagctctgtttccttttattagagaatggtaaccaaaaccaagatctggatgtgaggtgtgcttgttgctgctggggtgtcaggtcttttaggcaatctcagctgaaagagcacagaaatatgtctgtgtactagtccgtgtatatacatgtttctatagatatctctatatgtaaatctgtgtctgtctgtattaagctaaatatgagttcatattgatgcctctaactccatttccacatggatcattctagctgtctccccttgcttatctgtaaatttcaacagtgagaaacctgatttccactatctgccatttattcacttgtttaaattcagtatacatatatagcggtattggactgttaacccatactcctatgggaaacaactttaactgtttaggtacagtacttatagctgtttcattttgtttttagtttttcagaatccacttgtttccaaaactacttaggtgaacagttctcccccaaccccttctgtgagattatttcatacatttgtaatgcagttagattgttgtgtcaaagtctgaattacttcatgggatttctttgatgtcctaaatgattttataaatttgcatgcaattggattgactctttgtactgtaaaattctgtacattttgacaaatgcaccattaaagtattatgcagaataattactattctaaaagtcccctgtgcctcttctctacacccttgattctctggaagccactgatcattctatgtctctatagttttgtcttttataggatgctataaaattggaatcatacaatatgtagcctttctggacgagcttctttcacacagcaatatttatttaagcttcctccatgtgcttttgtgacttgatagttcatttctttttattactgaaaaatattccattatatagatgtagcacggtttgcttaaacactcacctactgaaggacaactttgttactttcagtttggggctattagttcctagggctactgtaacaaagtactacaaactgggtggcttaaagcaacataaatgtattctctcatagctctggaggctagaagtctgaaatcaaaggtaagaagccccttgcttccactgagactccacttggaatccttacctgccttttcctggcttctagtggtgtcattcagtcccgggtgtttcttagcttgcaactgcatcactccagtctctgctactatcacatgatattctcactttatctgtctacctctcttctattcttcttataaggacgtcagtcatattggagtagattcaccctaatgaccccatgttaacttgattacatctgcaaaaaccctatttacaaataagggcacattcacaggtactgagggttaggactctgacataccttggggacacaattcaacctataacatctactatgaataaaactctgatatatgatttaaaaaacacttggttaataccacttttattgggtaaaattggtttacaattgattttttaaacatagtaagtgcttggtaaatatttgtggagtaaatagttgttatgtttcaagagacattatatcgatatccttgtattaacatgtggtagaagaaagattatgctaaacaatgtgcccatattgttctcttattttccccctctttacactgtccctaccttttacatattcagcctttcactttgaattaagtgttcagaaatttcctcctatgtaaatttgccctatgaaattaacttagagtctgatcaatatgtaaaatagcactagaattaggtgtaaacatgcctccatatttcctcgggacaaatagtttagctgtcttccatatgtgaatgttcaattttttaacctactttttttcacaaactgcattcattacttggggcaccaaaagattactttcctttattattgattcaaaacagtgattgcaagttattttactgtgcatgtgttatttgttgtgcttattaataaaatgtcatcttttattttatgtacatatttttgacttaacaataaacagtaaaatttctgaaaggaagaaggtactcagtcatctagtattagatcctattggttgctatggttagcaccctttatcagtcatctagtgtccttcctagtttaataaaaagtagtgattccttcaaagtttcgttgcaacatgctaagtagattgtcctatatttcctagtttttatcttcagaaaagttttattaaaagcaaaaccaaaggcagtgtacttttaataataacactatgggattcagtcatgctgtatcccatactgctgtatcccatactgctgtatcccgtacatgtaggaattagcatgactatttggagttgaatggtttgacgggaccaaaaattttactggttttagaggcaaccaatgtaaagttagttgtccctagccttaagataggataattaataaatattaaaatttactatttattccataatttttttatttacttatttatccaataagtatttattgagggccgtaaatctatatatctgacactgttctaggctccaagggtacagtagtgaatagaagagaccacaatccttgatattgtgaaatttacactttagtggggtaagagagacaaaaaccaaataaataagtaaattatgtaattgtgagctggcaaaaagtgctatagaagaaagcaaaagatgagtaacagagagcagctggaccatgaggatatcacagtgaataatattttgataaagaaaatagcaagtgcaaagaccctgaagcaggagcgtgcctatagtgtttgagatactgtaagttgtccaacataactgaagtggattgagtaaaacagggcaaattaggaaaggtgtcaggggttttacaataagtatctctcattcttgcaatcatactacatagtagctattaagaccattaggacaccttaagcaaatgacagcctagggtacatactaaaaacacagctacaaggggatacaactgagatttaaaacaagtttgtcagattctaaacctcccacaagctcacaccagcttatttattccaaaagataaacattgaggaatttaaaaggccagttattaaagcgttggtggcttaaaatcagccacggtggaagtaatttcatcacagaatttggcaaacactacaaatcagtgtttgggaagatttatttttttaaaaaaagttagtcctaaataataaaagttttcattctacctttaaaattttttcagggtaaaatgtttatagtttcaaccactatcccattcttgtgactaaaatctgccaaagcaggaatggctgatatgtaacctagattaaccgcattgtgtagtctttttggttctccacgtaattgtcctgataattcccagatggatgactcttttctctacattcagaattcttggaacctttaaatacttattttactttctgcaaattagtgagagcagagtgctaatgaggctgagtttacggttcaatctcaacacaattcagtttgctttgcacagagaccagctctgtacaacaagcaattatgtctagtcagatggtctcaaatttgtagtttttaatacaaggagagaaaatgaaattaactcaacaaattaagcaacaccattgaaataatcagttgcgggtttgcagcaataactttttcacataggtgatgcattattattattgtgtttctgtctataattttcattatctattcttttaatatagctgaagaataaatatttatattcagcattaatttttatatgagttgtgtcagtaaatacagattctggctctggcccacaattagttgtgtatctataaatgcatcatttaaactttctaggtctccaatttctcacttgtaaaatgagggggttatattatctaattaccacgttttttcaaggcctacattttatgatttcatgattattctaggtaatcgaatcatagacattgatgagcagagtgtttttagtgaccagtcactctacatgatccagcttccactaggttatattgcaacaaaaaacaaacccaacatcttagtgttaaaacaacaaggtgtatatcttgttcccaccacgtactgtgtgcaagttggctgcagctctgcctcgtttgtattcttcattgctatagtgaatgtttgtcccctctccccaaatgaacatatgtatattgaagccctaatctccaaagtggcggttttagggggtggggcctttggtaggggattaggtcactagggtggaggcctcacacatgggattagtgcccttgtaaaagagacctccaagaaattccttactccttccaccatgtgaggacatatggagaagatggccctctacctatgaaccagaagttggccctggacagaccccatatctactggtgctttgacctaggactttccagtctccaaaacaagaacaacaacaaaaattctcttgtttataaagccacttagtctatgatagtttgttttggcagcctaaacagattaagacattcattttaggacacaatctgcaggggcattcccttttagagaacactgttttaatggcagagggaaaaaggtaatggaggaagcatacaatagctcttaaaagcttcagctcagctttgacatacctcggtttggctcacatttcattaacaaaagcaggtcatgtggctaagcttgacatcaatggactaaagtccatattcaggcataaaatatttggaacaaataatgttttctactccatcttttttcctctttccaacttccagggatcaatttataaacaaatttctttaaataaccattaaaataaatattagaaatttaaaagacttgacaaaactattatttcagcaactatatattaagcagttaaaatgagcaaggtccactgttctccaggcacgtacactgtagtggggtgggcatatgtgtaaaggctgtccagacatttttgcctaagaaaatcatcacactttttaaaataatgtcagaagtctgtgcatggatctggctactattttcacatgtagatagaggtagaaattttattccgaaaaataaaactagtcttgtgtatgaagaaatgttttctgaaagaaaatataatcaagcttgcttcgaaattattagccctaatgaaagtagttatattttgaggttacggtcaactcagatttggcaaacagcatatacagtttgtagattaggaattcctatttctctttaacctcatttcacttatcattagcacctataccagaggttgggtaaggaaagagaggaaaaatgaaatgtaaaattttacattttatatatcaatgcctgaaaattacatcaaacacaatattgcaaggagctacttaatactttcacagactaggagccttaaaagaagcctttacagcctactcattatagtattgactgtatttctacaatttctcctaaagtaatcttaaaataattaaagcattactttctgtaattataaactcaaataattatagatgtaaatataaattgctttctcttcactaacctcattatatcaaatttttttttgtttgttttctggctttttttttttttttaacaacccctctatggagcaactgaaatcaggaaatgtatgtgttgtttaactctttctactcagctgcttcagttagcaggctagctatatgaactacttgaagttcagaatagccatagaactaaggcaaagtttgcataaacgtagttttttctgtaggctggtaaatagcaattgtgtccatgtagagggactcaatgtcaatagtgaaagcagcccactaccccctacccttttattctcatattccttgtttttggagataatacatctctaaagcctttttttttttttaaattagaggagtctatgattcatgttttccttgcctaccagatacaaccaacctctgttacccaatttctctatgtcagacattaggctgaatgtttttacatagtttatctcatttaattgaaaccttgtgatgaagattttattattcccattttgcagagatatctaaggcttggagtgcacaagtaaagccactaaattgttgatttagatacttaaattattttttaatatgagtagttttcacacaaccatatcacacggtcagaatttggaaataccagcgtcaccattcataagaccatggacaatttaaaacttttggtccttctgaattaaacagtcttctatagatacagcatggaaactctgcaaacagacttttggctttatgaagggaagcattaatgtaaatataattgttaatcgtaaatcagaaaaacataagggagagagatgcagtgaaaagatcgtcaatcaagcttgtaagtaggttccacctgtgaataataatctattgctcaaaccataagaaatacaggtattaaagataatttatcatgtattcatcaccagctacatgtgctacaagtataattttaaatatcaacatactgtatgccctcaaagggaatttgttgtgtgactgatgatagaatttcagagagccaagagctttgggaataaactggttttaaaaaatccagatatcataccaaacatgtattctatcaagtacatttctttaaggtattttttaaaactctaataggcagtaatgcgtactggaattgcctaggttacagattgtcacaaaaatatgttttattaattcttagggtcagttgtagtccttgccatcaatataactattttttaaaagaaggatagtttttattatgtcctttttctagtagatatttcactgttaattgttcatggctggtaaactcatatttatgaagactcaaacatttatttaactcaatatgcttttgtttcttcctgacatgtatgtaatcatattttataaagtacattggtcagtgagattgtatgtatgacatcggattaaaaaatttaatatgtaaaataaacacatcgggggcggtcattaaatgatgggtttctgtgctacaactcctgatgctatgatttcactgttcctgtgtaggaccaaaaaatcaatttaaaaaataagtcttagtaattgtgatgcatgtcatttacagactaggttttaagagacactaatccataagttaacaaagtgaaagttggtcgattattgattcttaaagtgtggcaaagactgatgtgagggaacaggcaagaaacaaccaagggcacagtgcatttgggacttaatagaaaaatgaagcagtggggagcgatgtgagatgagggtgtaggggcagtgtctgcataattaaaggctttaaatgctataatgaattatcttatactagagttttcttgtagtcagaggttcccaaatgttttcacactgtggcctgtagagagaggataatatctgtgcaccatacttgctcatgtagtcaggactgttgacaaccagaggtgatcacttggtggcttttgcagctctggcaccctttagcctactcttcacgtgttgggaagtgccatgaaggggggttgaaagccactgaaggactttaaataggaaccctggcatgctcagacttggccagaatgagaagggaataaagaagggaaagcaaggctgtagttagagagacctagcatgaaatgatggagacctcaaacagcgtggtcctggtaaggaagaagcagagtgggcttagatacttcaggggaacattaacttattgtttaatgagaaatgggtgagagcaaaagggaggatagcgaagaatgatttccaggcccctagtttatgtatcttaaataatggtatgactttatctaaaatagtaatgcacggaaaatataggatgaattgttacaatttaaatctctttattttgaaatattggagggactttcaggtgaaaatatccagcaggcagttggatatatccctccaaagttcaaaggggagacccagttagaagataaagagtataataaaaaaaattatagactatataaaacttgcgatataaaatattaacttgctgcttgggttaattacatttttataaataaaatataagctattcataaaaatgaaaaaaaaaagaaaatcaagtctctgaaatttctactgaggtaagaaatcataatcattccttttaaaaataatttattcctttaaaaaataactatgtcacataattgaatttaaaatgtatttgttagttgttttttaaataaaatttcagaataataataaaaaaagaagataaagagttgggtccttacttacaaattcagtaactatcatcaagtccatcctctggactacttattagaataagaagagagaacacaaaaaatctagagcgaagttctataaaataattttacactatggattcaaggcttaaatatgagtgttcctactcattggtccagtaactcttctaggagaaatagttgaaaatgagagcaaaaaatagcatgtgaaggaagccgtatgttatgtataatagtgaaaaattagaaataaccttaatgttattaaccaaatttgcacgtttatactaataaaatgtttgaaacataaattgtgttgctttgggatcaaagaaataaacacagtccagtaatcaaaagtaaattaaagcaatttaaatatttcctgcagtctcttaagaaacgcacacatatacacacatatacaattagaatataaggcacagagaaatattatttctccattttatgttctcaatgtcttgtaaaactattatttctcaattgttatgttctcaatgtctctcactacttcctaaggtctaacctctgaaaaaggttggacctttctcttgaaattctcataggttcttttcttctctcagaaataaatctctactctttcttatataagtcccctctcctgggttcccaaattttgtttatttctttctggttgtcttgattctgcatcacaaaagcccaggaataaagctagtgaaggtacattttttaatataggtgtatggaagatgagcaatcagagccaaaggtacaccagtgggcaaggaagggggaaagaatctcaacacttagtcaaaaggtcatttttgttttccaaaaaggttaagcaaaaataaaaaaaataaaaataaacacatcaggatgtcaaatcttatgtaatctacaatatgcaatttgtggtgtaaaaaatatgcttggaaaaaacaaagaaaaattctggagggaaacattttagaatttttttttctttttttttcctatgttttttggggggaacagatggtatttggttacatgagtaagttctttagtggtgattgtgagattttggtgcacccatcacctcagcagtatacactgaacccaatgtgtagtctgttatcccgcatccccctcccgccctttcctgccgagtccccaaagtccgttgtatcattcttatgcctttgcgtcctcatagcttagctcccacttatgagtgagaacatatgatgtttggttttccattcctgagttacttcacttagaataatgttctctaattccacccaagttgctgcaaatgccattaattcattcctttttatggctgagtagtattccatcatgtatctatctatctagatggatagatatatatcgatataccacagtttctttataccacagtttctagaaatttaatagcaattatcactggacattgaaattacaagggattgcaatatttttctttaattttgttataggttctacattttctgtaagtaggccaaaaatcttcaataaacataaaacagattattatttatattaaaataaattttattttaaaaataatttagttattcaaacaataaattttaagtcacagagctactaacagaagtagctatatatagacagaagtattaagtaaatatttgctatttttaaatactgaaaagttatattagaaaaataccagtttcaaaaatattcaagaaacgaaagatagtttatttcaattataagctatgtgggtttgaatcattttacttaaattctatgttttctcatctgcctaatgggaataattattttaaactgcataggagtgttgtgaggattaaatgaaaaatgaatgtgtgacactctatgacgtcttaacttgatttgatttatagtcagacttgagattcacaatagacttcatcaagcaccaattttacttgtcttgaagaaaatgcacaggaccagtgtcatagcatgcacaatgacaacacagcagaggtctcctgattctcagacacagctttggatgtcccagtcattctgcaccctgggtgtgtgtggccacaaggaataaagctgattgaatacaacttcagctcgggaaaatcatcagctctgagatcctcccttcagtttttatatcaagccatgtgtttgtgactgagtagtcacatctaatcaggtttatgtgattagccctatttcttcagggcagctccatttcattagttcccaattactcgttaaacaaccttgacaatgagttacacatgcttagtcatttccatggaactctcatttatcttgcatcaatataggtaaatatctaactattcctcagttgctgctgcaaatcagaggtctagtcttcagccatttccagagaggaggccaaagaaacagctgttagtcctttttcggtatataaaatgctcaggatagtgcctgacacgtagtaagcaaacaaaaacttcacagaatcattgaatttgttttttcaaaattgacaaataaagtgcatattctgatattgtaatttaaaaaaataatagaacaaaggaatccactgcttggttgtaatatcttttcttcattgataattttcaaaatgattgttgctaaaatcatatgcctctgtcaaattcctttcacgtcaaataaaattaaatcctatgatgtccttgaaatcatgttgtgttacaggtcagtggttatcatagatgactttaaatattcattacaggaatattgagggatgatggcaagtcatggtcttgagagtcgttgctgaaataggctattggagtgtgagttggtcattaaactgtgaaggatcattcatgtcaacatgaaagtccccttgattaggaagttacctagttggtaactgggaatattggttgaaggaagtgaaagtgtagtgaaaagagaagtttgtccaagagcacggcttataagagggttatgcaagaagatggtagctaaactattttttataataaataaccatgaatttgggggtcagagagtgaaaatagagagatgatggggacagaaataagggataagagaatagatgaggcaacttgttagaaggccttgccctttagagaaaaatagccagtaaaatactcctctcagtgggatgtacaacagactagttagaagaatgtcaaattctcatttttaacacatcagtgttactacttataaagcctctctgccttgccagatcttcagttcgattttattacttttatagcttagggagtagaatggtagcaaatattacaactgggctatgaacagatataacatgtcccacattggcctctctgttgaagccaatgtgatagaaacaactcttcttgaggcatcgcagtccagacgtttgatgtggtgactgacagcaaagtgaggcttaacctgtggtgtggtgaagcattctgtgcagcagtggagcacaggtggatgactcaggagactaagctccttctcccatatttaccaaggaaggccatgccaggggaaacacacatgctgagtaaataatgaaagagaatcaactggatagagttgaaacattctcaataaatattaatttttaacaattactagttaatttatttagttattctttgaatttgagcagaatctctttctctcctttttttaattccttgggcttgtgtgtgctctcaagacttagaatgtgaggtcacaacgtttcctgtgatacagacttgaaagagtataggcctttctctgtactcattgtagctcagtactattcctagcttcttagccccttcatggctttttaaaggaaggaaaagctaattattggtgctccaggactgggcaaagccgagaaaaaagagatttttcttttccttcatgtggcatcagtttgattgcttgttttctagaaaatagagagaaggttacctatcaaagggcacagtcttttcccaatagcaatcgtaacaacctcatttattgagaaccgaatacttagaattgtatacaaactctgaatcgtataaaactcctgcaatgtacctgttatctatactttaaaatagcgcacaattattctcatggaagttaagtgatttgacaagttggcaaagtaagtgacagagctagaacagaattaaaacttcttgttattcccactaaaccacctataggtcttgataaccatagaccttagaaaactaaacatttactaattgtttatttgtaatttatcttcccaatactaatgtaacagatttcaactttctgtccaaattaccctaattactaaaaggcctatacacctgtaatgaaacatgaattttgaaatacatttgcacagaatataataaagttttcttagagttaaacttcagtactattgtaggcgcttagtgtctgaagaccactggctgccttggatgacctctaaatgcaccctccagctctgtgatttaatgaagaaatcactgacatagttcccatgttttgcattataatttcataaaatttttgtttatatctgtaatttaatgcaaagccatatggttatcagaaataatggatatttaatttgattatttaagcatttgacttattttgtttcattcaagggaaaaagaaaaactattttgaattctattaattttctgcttcatagagaattagacatttatgaaaaaagttcataacagaagttctcaaagtaaagttaggttgatagattcatttaatgcacaattcttatacacttataaaatttcaaaaattcatatttgtatcatatattcataggtcacaggagaggtaaaatgagtacgtggaatatggcctgaatatataggagctaattagaaaataaagtaatatgctatattttagaaatgagaaaagcagaacttggtaataaagggcttagtttgataaaccatgagttgagaaccaaaagtggttctggcccttggaactgcaaaatagtttcacctactgtaaccaggctaatatattgctcctggtagcctgctgccactccaaaattttctcctcagagtttgtcatttttgtgaattcaagctcttcagaatgtttcaattacaaaaggacaattttacattaacccatcaacatagacttactttcagtttcctaacttaaagtagggacttgaaagaaaaagatctaaaataggtcaacggtagagagtttgtgggggattgtaagcatgtgaaattgatgatggtggtctctgtaacgggatccctgatggatcccacagcagcatggaggctctgacttcttgcaagggagagaggcgctagggaaagaagatgttagagacagtaacaaagcaaaatttcctcatgtgcagtttatccaaggatggctcacaaatagaattattctactcatgaaggaaaaagaaatacaactagccaaatgatccacctggaattatttcctccttagctacacaaacaggtaaaaacaaatccatacattacattttacaattatattctgaagaggtgtccacttctgagcaagatggagtaggtgggactggattcaccctccagcctgaagcaataaaaaaagcaacctggcaacacatatgaaacaatggtttccgagacatcagctatcagagaatgaagagtagtcatccctaagaaatggaaaacaaacaaggtgagccctattgcttgaacttactaccatgagagagtttccgggcaacagcacagggagagggattcatagagagccgagtgtttgaggagacccagacagatgaaattcatgagacggagtacctgaggggagagctgcacagagacagaccagagatctgcagaagctccttttagtattcagctgagtttatatcagcacatgcatgtaaggaaagttcccaagacctgggaaagaataaagctgaaatgattagagataataatgcccagcactcacagagggccaagaattgtacctgtgcccagtagccagactgaataacttcatgatttatgaaacatttggtaggatattgcttcggtagttacaaatattctcctccagattcgatacggtcttgtgctgcttaacaaatcttaaaagcaagacttaaaagaaccaaactgtttctaaaaaactgcattgcagaacacagctcaagaaggcatgcatagaaacaggaaaataagacccaaatgaggagaaaaataaatcaatcaaaacagatcataaattgatccagatgttagaattaccagataagggcaccaaaacagttattacaactgtattccagatgttcaaaaagttaagtagaattatgagatatgagaaagattcaaatcaaacttatagagaaagaatctacaaggtataagacgaaaagtacgttggaagagatgaatgacaaattagacgttgaagggaaggttagtgatttgaagacatagcaatggaaatgatccaaaattaaacataaagagaaaaaaggattagaaaacaaaacaaagcaaagcaaacgaaacacccacaaaactgtgacaactttacaaagtctaagatatgcaaaattggactccctgaaaaagagagtgagaataaaaagttttgaagaaataatgcccaaacttctctaaaaaggatgaaaactatgaatacataggttaaaaaaaaaaaaaaacttgaatttccagccaacagcatgtggagagtgatccatgtagagcctaatgtttgaggagacccggacagatgaaattctcgggacagagtacctgagaggagagctgcaacgggacagaccagagacagaccaaaaaaacaaaagcaaaacaaaacaaaacaaaaaacaaatcccaagtacaagaaacacacacacaaaaccatacccattttctttcttaattatatctcttacttttctctcattctgtcaataagcaggaaatgttttcctgaaatataattatcttctctaattcttgaataatattttgtttttgaaaatattttgtctgtcttttttcttctatggaaaattgtgctctcatttcactctaattttggttcctctgcaggtgctccctattttctttctggtttcttaatgcattttctttatcttcagtgtattgtgatgtgccttggttggggatttatatttactgtatctttattttttcaaatgttatttatgattcttaagactttttgagcttcttgaatgtgaagtttcacaaacctcgtgggtttggggaaaatttgaaccatttatcactttgaatatggtctcttcgccattctctctgttctgtctcagtattcctattagatgaatatcagaaccttttcttctatcattgttgtctattaatcttactaacatattttcctttcatctatttcttttcagctatgtctaatatgctctaatttgttgatttagttttaaatgtcagtgcctacattttccttttcaacagatctgtttgccttttaaaatggacctattcttttttatataatgtgctttatttttcatattacaatttaaaattttataaagatatatatcttacatagttatatatcttctctaaagttatatatcttatgtagatgattatatatctgtagctatttaagtatatagttgttatatatagttatttttatctagttatataaaagttatatttgtcagtctatcttaagggttggggatctaatctatctatggtttctgctaacttgttccttgtttgtttttcttatgacttataattttttattttgagtctttcttcaagaggtttttaaaaacatttgttgtatttatcctatgagtaccttttggaactgcatcctggtcatatccctgtagaacattttttgctgtgcttttgcaaagtagccaaggataccactggctcaaaatcagttttttatgttccctttcgtgtgtgtgtgtgtgtgtgtgtgtgtgtgtgtgtgtgtgtttgaagagaagtggatctcagatcatatgggtactgtaaatgggatagatgcagagtctcagggttttgatttcctggaggtaggatgtgaaaggacaggaagtcattagcttcattgttgctcaccacatccctgacagtaggaagattattttttaggccttctttttccctgaacagctcagtttcacatccccccagctcctttccatgaccattaaaaaccaaactcttgatgcaagggatccgttttttcttcttctctcccctctatcagccaacaggacagacacagtatgaacgtccattgagtgtcatgctgattttcagctctttcatcccctgtgttacctggtgatctccctttccttcacttacatatttaaataatatttgttgtatttgattcattatttctgattatttgtaatgggaggattttaagtttatgtacatttgccctctcactaaaaatagaagttaattatccattcactaaaataaagatatctgtgttaaaatgacatgctttttgtccatgcttttgcaggacaatttccatgcttttgcaggaaattgtgtttcttgtgcctggctctctggtactaaatgtatttttaattgtaatgagctctaatcaagaaagaatttttctttaaaataaatggctttcaaaatgagaaatgaaactaaaatatactgtggacattaatcttctcgattttatacttatatgacaatctcacagactagttcaacgtttgtaaacttgcatttgaataggtaataagtactaaaaataataacttcaagagctaggatgatgacattttaaaacttaattagtaatatttaaatttccatgcaagataattcatttcttggacaatatagtctttaaaaacttcatttaaataaagatgttaataatgaaaatacttaaatatataagtgagtggacatgtgtcttttatcccattctaacgaattgatttttactttattcaacactgtgggataataaacatacggcactttgcaagtattttattttagcttttaattacattgggaaatttaatatttcagtatttccttaattttctaagattagttggttacatgttttatcaaattaatgtttgtgattactgcgaaaatcttatactcaaagtagcttcaaattactgttcatgataaaatttcatttgattgacttttatctcaattcaataatcaaaaattcatgacactgttggattttagttcatgctgttatctttctacagtaaaagcaaaattagttagagattttatatttatttcaagatgtcacatatatttgtcttttcagtttccagagtccttagcatgcatagtgcttaatagagcacattcctggacagcctgttattattcattgaaattttagattgcatatataattataatgcattatatgtacatacatgtgtacatacaacattgcaagtttcattccataatgctctttgctttcccatctatattctccaggaaggcttgcatttaagttaagatctaagtttacaaagacacaacttaccagaatctctgggacacatttaaagcagtgtgtagagggaaatatatagcactaaatgcccacaagagaaagcaggaaagatctaaaattgacaccctaacatcacaattaaaacaactagagaagcaagagcaaacacattcaaaagctagcagaaggcaagaaataactaagatcagagcagaactgaaggagatagtgacacaaaaaaccctttaaaaaatcaatgaatccaggagctgattttttgaaaagatcaacaaaattgatagaccgctagcaagactaataaagaagaaaagagagaaaaatcaaatggacgcaataaaaaatgataaaggggatatcaccaccaatcccacagaagtacaaactaccgtcagagaatactataaacacctctatgcaaataaactagaaaatctagaagaaatggataaattcctatacagcatcccaagactaagccaggaagttgaatccctgaatagaccaataacaggctctgaaattgaggcaataattaatagcctaccacccaaaataagtccaggactagacagattcacagccgaattctaccagaggtacaaggaggagctggtaccattccttatgaagatattcaaatcaatagaaaaagagggaatcctccctaactcattttatgaggccagcatcatcctgatacaaaagcctggcacagacacaacaaaaaaaagagaattttagaccaatatccctgatgaacatcgatgagaaaatcctcaataaaatactggcaaaccgaatccagcagcacatcaaaaagcttatccaccatgatcaagtgggcttcatccctgggatacaaggctggttcagcatacaaatatcaataaatgtaatccagcatataaacagaaccaaagacaaaaaccacttgattatctcaatagatacagaaaaggcctttgacaaaattcaacagcacttcatgctaaaaaaactctcaataaactaggtattgatgggacatatctcaaaaaataagatctgtttatgacaaacccacagccaatatcatactgaatgggcaaaaactggaagcattccctttcaaaactgacacaagacagagatgccctctctcaccactccttttcaatatagtgttggaagttctggctagggcaatcaggcaggagaaagaaataaatggtattcgatcaggaaaagaggaagtcaaattgtccctgtttgcagatgatatgattgtatatttagaaaaccccatcgtctcagtgcaaaatctccttaagctgataagaaacttcagcaaattctcaggatgcaaaatcaatgtgcaaaaatcacaagcattcttatacaccaataacagacaaacagagagccaaatcatgagtgaactcccattcacaattgcttcaaagagaataaaatacccaggaaaccaacttacaaaggacgtgaaggacctcttcaaggagaactacaaaccactgctcaacaaaataaaagaggacaaaaacaaatgaaagaacattccatgctcatggataggaagaatcaatatcgtgaaaatggccatactgcctaaggtaatttatagattcaatgccatccccatcaagctaccaatgactttcttcacagaactggaaaaaactactttaaagttcatatggaaccagaaaagagcccgcgtcgccaagtcaatcctaagccaaaagaacaaagctgaaggcatcatactacctgacttcagactatactacaagcctacagtaaccaaaacagcatggtactggttccaaaacagagatatagaccaatggaacagaacagagccctcagaaataataccacacatctacaaccatctgatctttgacaaacctggcaaaaacaagcaatggggaaaggattccctatttcacaaatggtgctggaaaaactggctagccatatgtagaaagctgaaactggatcccttccttacaccttatacaaaaattaattcaagatggattaaagactttaatgttagacctaagaccataaaaaccctagaagaaaacttaggcaataccattcaggacataggcatgggcaaggacttgatgtctaaaacaccaaaagcaatggcaacaaaagccaaaattgacaaatgggatctaattcaactgaagagcttctgcacagcaaaagaaactaccatcagggtgaaaaggcaacctaaagaatgggagaaaatttttgcaatctgcacatctgacaaagggctaatttccagaatctacaaagaactcaaacaaatttacaagaaaaaatcaaacaaccccatcaaaaagtgggcaaaggacatgaacagacagttctcaaaagaagacatttctgcagccaacagacacacgaaaaaaaatattcatcatcactggccatcagagaaatgcaaatcaaaaccataatgagataccatctcacaccagttagaatggcgatcatcaggaaataacaggtgctggagaggatgtggagaaataggaacacttacactgttggtgggactataaactaattcaaccgttgtggaagacagtgtggaaattcctcaaggatctagaactagaaataccatttgacccagccatcccattactgagtatatacccaatggattataaatcatgctgctataaagacacatgcacacatacgtttattgcggcactattcacaatagcaaagacttggaaccaacccaaatgtccatcaatgatagacaggattaagaaaatgtggcacatatacaccatggaatactatgcagccataaaaaaggttgaattcatgtcctttgtagggacatggatgaagctggaaactatcattctcagcaaactgtcgcaaggacaaaaaaccaaacaccgcatgttctcactcataggcgggaattgaacaatgagaacacttggacacaggaaggggaacatcacacaccagagcctgtcgtggggtagagggagaggggagggatagcattaggagatatacctaatgtaaatgacgagttaatgggtgcagcacaccaagatagcacatgtatacatatgtagcaaacctgcacgttgtgcacatgtaccctagaacttagagtataataataaaagaaaagacctaagtttgttttacttgagtgtttgggaggcaagtattttttttcataaatgatatgtaagaactctaaattctcataaaatcataaacatttttcaacctcttggcaggctatagaattgttaatcctttttcaatggtctttaaatgttgtcatgttgccttctagcttgtagctggcccaaggcctgagtgagggtggtgctggattgtgtcgtcagggtactaaacacctgagtcctaaggatcaaagctgaaaaccaaagtagtgtgtcaaaacccaagaggcaggcaagagcaagggtcagaagcaaaataaggacaactgagagcaatgtgggatatccagcaggttagagcaattgaacttgaagaagtaacttggggctttgtcttgtaggatatagattccgcaagtaaaaaatttttgagccaaagaaagagaggaaccagacactcaagaacttcacagtatcactgagttgtgtgtctcatcatggtatattttgtagtttatatttcactgataatggaatgacacaactcaagcctttgtgtctgcagcacttcagcatttaatagctgaaatatatttgagcagctttattttggtcaccctcctttcttccacccacatgattaagatttgttaatggagatatttgtcagactgtacaagattgtgaattagatcttctctgaagtgcgacatatggctgaggatctaatcttatttctgcctgagaccttgtgtacctaggatgatcctaataaagtattatgtcttcataaagacaaaagccaggcttactgtgaaacacagcatcacatagctggaagagagctactttggtctctactattagatctaagaaagatagcatcttaactcttctaagatttaaaaaaaaatttaagacaaagtaaggcataatccttcattaatagattttatagacagaagactataaaaatatgagcactagacttgagaacctgagttctagaactgtctaaactacaaaatacaaattgtttaaatctctcttggactatttttctatctgcaaaatggagacacaaataatgttcatagtatattaacaagaaacactttttcatcacaggtaaaatcaggggctctagagccagactgcaggccttgaattctatctccactacttaccagatgttttgcctcagaaaattacctttgcaagcctcactttcttcatctataagatggaaataataatggtacttacactattttatgaagcttaattgacatcatcatggtaaatgatttaaaaagtgccaaactgtacctggaatatagtaaacagtacatttaaatttctacttgtgttatccaactagatcactgaatttccttcatattttcttgtatcaaaactgtcttgctacagatccagaagtcagttgtatctccaggtaagaagagagtgatagacttcagaactaaagtgaagtgatttatcattgagatcccatttatccgatattggaactccaggcttttaggaactgatctgtctggtaaccaagttgatatggtttggctgtgtccccacccaaatatcatcttgaattgtagctccgataattcccacatgttgtcggaggggcctggtgggagataattgaatcatagaggcagttcccccatactgttctcatggtagtgaataagtctcacaagatctgatggtttcataagggggaacccctttcacttggtcctcatttctctcttgccagccaccatgtaagacgtcccttttgccttctgccatgattgtgaggcctccccaggcatgggaaattgtgagtccattaaacctctttttctttataaattacccagtctcagttatgtctttaccagcagcatgaaaacggactaatacacaagtctcctccttgattgacttcctctctttattctctagtcctattaggtgagtttgttcttattatcttgttcttgctatattgggcttttctaatcctgagctctagttttcctatgactgggccactgaatcttgtggcatgggtcatctgaaacgccatcaactgcttgccataatctcaattctgtcccgtgtttgcaccttgtccaacactcctgatatccatccccttctaatgattttcttcatgttgattatctgctcctaattgttcctttctagacttgaaaaatattaaattgtgctattatacatatattagttgtctttgggagttagagtccacaagattttttggttaattgaatgtgttaggaaaagatgaggaaggatccacgatgaacctgaggattctggcttgatcaattgtatggccagtacttccatcaactttctagctgaggtatggagtatggcaggaggaaaagtactgcatgggagtgcaggatgaaagatgaccagtagcgttgctatgtttgcaagttgagttagaatggagatgtcagatagtgtgatagccttcatgctgaggaaagagggatgtgctagagattacaacttgggggatatcaatctatacgtagcaagtagagatctgatgattgaggatcacccaggtgagagtccacagggaaaagggaagagggcccctaaggtccagtcattttaaatgacaactgagaaaagagaattcacaaaggagcctatagaacttagaggggaaaagaaaaaagtcagaaaagtatgaagctataaaaaagaatagcttttaagagatagagagataagataattcaaatatcaagacttcaagtaagaaaatgactccaaatgtgttattactggggaccctggccagtaggttcatggggtggtgaggacagtagccagatggcagttggctgtgcactgagtggaaactgagtgagaatagatggtgaacatagacaactgttctgagaagtctggctgtaaagaggggaaggcagatactacaggagccatagggaaataaaggagagataaagagggttatgttatgtactttgcttcttttcttttgttctatttttagcaaaaatgtgaacatgcttacatacttacagagaaaagagaaattgcagatggaaaataaagagaggcaagaccctacagggaagtaaaagaatcttattctgagcacgctgaaattttatccttggataaagagacaaaacctagtagcctggttaataggaggaaaacaggaatagatgtatatggatgtagataagtctatatcactggtacagggaaattaaagaaggtacctctaacaggttctatttactctgcaagtaaattgcagacgatgaaaaagtggggtaagaggattaaatgcttcaggcgagaggaacctttaagtagtagttttctccacaaattttggaggttaataattttcagtgttttggacaaaatgaacaagttgattctaaaattgaggagaataacaaagaataaaactggctaaaacactcctgaggaagaataatgacttggagggaatatgtcctaccagataatatagcaagaattattataatgctataacaattttaaaaggatgacattggctcaaggggtaaatatataaaacaaagactcagaaacggccatatataagtggaaaattatacataagagaaatggtattgccatcattgggaacagaacaaatggcattaaaatttttttgcccaattatttattgatattgaaaacatagagttgatcttcttctcatttatacataaaaactaattccaaataaattaattacatgggaaaagcaaaaactttatactttacaaaagcaaaagaatatttcattacctcaatgtaggaatacatttatttaagacaaaagtggtaattatgaaaaaattaaggataaattcaattacattaaattaactataatagtcaaaaatactgtaagtaatgtagaaaaaaaatcaacaaactgggagaaggaatttgcatggcatacagtcaacaagataatgatgatcttagtatgtaaagcactccttcaaatcaatgagaaagtgacaatggaccaattaataaaatggaaatgagacatgaagaactatttcacagaagaggaagcacgaatggtcaaaaacataagaaaatgcagtccatctcactagttatcagggaaatgcaagttcagatcacagataaatgccattttgcatctagattggtaaaaatgattacatcttacaaagccaacctgacagacatgtggaacaacaagtaagagtgactcttacatagaactaatgcatgtatccattggcataagctctggaaagcaatttgaagttattttataaatttgaccataaatttactctaaattgactaagtaattccactcctacacacacactaaaggaaaaatcttcaatgtgtatgtgcaatcgtgtacaaatcaaaatatgtaaaaaaagttcatacagcaaaaaacttgaaaaataaaagtatttttgccttgacaagaaaaggaaaaaaaaaactgtagtatatttatataacaggttgttagagaatattgaaaatgaatgaactactgttatgtgcaactacatgcataaattgttaaaacctaagttgaaccaaaaaaggcaggactccatagaccatgatgtgctatacagacgtgcctcattttattgtacttcacagtaatgtgcttcacagatactgcattttttttcacaaattgaaagtttgtggcaactcagcatcaagcaatagcatgtgctcagtttgtgtctcggtgtcacattctgataatttttgcaatatctcaaactttttcagtattttgttacatgtgttagggtaatctgtgatcaatgatctttgatgttcctattgtaattgtttttgggcaccacaaaccatgcccatatggcaaccaacttaattgataaatgttcagtatgtctgactgcttcactgataggctgttcctctgtttctctccctattctcaggcctccatattccctgagactaaacaatattgaaattaggccaattaataacgctttcaatgttcaagtgaaagtaagggtcacccaactatcactttaaatcaaaatctagaactgattaagcttatggaggaaggcatattgactaagataggctgaaactaatcctgttgtgccaaacagccaagatgtcaatgcagaggaaaagttcttgaagaaggttaaaattgctactccagttcacacacaaatggtaaaaaagtgaaagagcctttttgctgagatggtgaaagtttgagtggtctggatagaagatcaaaccagccacaacatttccttaagccaaagcctaacccggagcaaagcccctactctcctcaattctatgaaggctgagagaaataaggaagctgcagaagaaaagttggaagctagcagaggttggttcataaggtttaagggaagaagccatctccataacataagagtgcaaggtgaagtagcaggtgctaatgtaaaggtgcagcaagttattcttaagatctagctaagataattgattaaagtggctacactgaaaagcacattttcagtgtaggcaaaacaacctcctgttggaagaaaatgccatctaggactttcatagctagaaagaagttgatgcctggcttcacagtttcaaaggacaggctgactctcttgttaggggctaatgcagctgatgactttaactgaaactagtgttcatttatcattcagaaaattctaggccccttacaaatggtgctaaatctactatgtctgtgctccataaatggaacaataaagcctggatgacagcacatctgtttacagtatggtttactgaatattgtaagcccactgttgacagctaatgctcaggaaaaaaaaaaaagatttatttcaaaacattactgctcattgacaatgcccctagtcacccaagatctctgatggagatgggcaaggatgtgaatgtttttatccagcccatctatgaatcagggagtaatttcagctttcaagtcttttttttttttttaagaccgagtatcactctatcacccaggctggagtgcagtggcgcgacctcggctcactgcaacctctgcctgctgggttcaaatgattctcttgcctcagcctcctgagtagctgggattacaggcatgtgccaccatacccggctaatttttgtatttttagtagagacggggtttcaccatgttggccaggatggtctcaaactcttgacctcaggtgatccacctgcctcaacctcccaaagttctgggattacaggtgtgagttaccacacccggcttcaagtctcattatttaagaaatacattttataaggtgaacactccgtagatagtgattcctttggcgattctgggaaaaatccattgcaaaccatctgggaaggattcatcattctaggtgccattcagaacatttgtaggtgcctcattaatgcagtaggtagcatggtagtctcataatctgaagaaacattcatgattcatgggaggaggtcaaaatagcaacattaacaagagttggaagaaattgattccaacccttatggatgactttgaggggttcaacacctcaatggaggaagtaactgcggatgtggtggaaatagcaggagaagtagaattagaagtggacctgaagatgtgactgaatagctgccatctcatgatcaaagttgaatggatgcaaagttgcttcttatggatgaaaaaaaaaagaattttgtgaaatgaaatctactcctggtgaacactgtcgaaatagcaacaaagattttagaatattacataaacataactcataaaacagcaatgaggtttgagaggattgactccaattttgaaagaagttctattgtggttaaaatattatcaaaaagcacagcatgttacaaagaaatctttcatgaaaggaagagtcaatagaagcaacaaattttattattgttttgttttaagaaattgccacagccatctcagccttcagcaaccatcaccctgatcagtcagcagctgtcaacatggaggcaagaccctccaccagcaaaaagattatgacttgctaaaggctgagatgatcgttagcattttttagcaatacaggtttttaaaattaaggtatgcacattgtttttgcaggcataatgcaatggtacacttaatagactacagtatagtgtaagtataacttttatatgcactaggaaaccaaaaatattgtgtgtctcatttcattttgatatttgctttattacagtagtctggaactgaacctacaatatctctgaggtatgcctatatttgtaaatcttagggataaataaaaagtaagcaatataaagacctaaaaaaggctaatatacacaagatggggccaaaaaatggaaggcaaagcctgcaatggtgagctaaatgttaggagtgaagtctgagtctgttcaactgtctctgatagagtaattgacaaaataaagaatagaaaattcagaataaagttggccaaagaataatatttatgccataaagtcgatgaaagaatataagacaagatctcatggcaaaatgtgggggaatattaactagggacacaagagcccctttaggtcagcttgggctaaaatctgctagtgttagaaaacacatcaaattaaaatcagaaaaaacaaacacatttgtgaaactaaatactcctgtatgcaactgaagggaagtaagaaggtatgtcaagttctctttaatagttccagatactttcccaaggcaccacaaatcacacatatttcctgaatgtctcatctttaatgaagctgcactaagtagaagcattttgtgtgtcatcaacttggtttccagccattctacttttccattatcagttatttgctaaaataagacccaggctcaaattaagaggccaattattcttttatttatttatttatttatttattattttattattattatactttaagttttagggtacatgtgcacaatgtgcaggttagttacatatgtatacatgtgccatgctggtgtgctgcacccattaactcgtcatttagcattaggtatatctcctaatgctatccctcccccctccccccaccccacaacagtccccagagtgtgatgttccccttcctgtgtccatgtgttctcattgttcaattcccacctatgagtgagaatatgtggtgtttggttttttgtatgaaaagaagatcttgttcatttttcctgtttctttttactctgaagtaaaggagatattactagtagcagtagaatataaaaataacaaataattgtaccatcagatgactgtatctagcttttgacattgtttaatattatctaccatctagctttactctccccaacaagtctattaagtgtcaagtcatctcaaagtcaaatatcatgaaattcagaccctgaaaaaaaaataagcgacttgtcctagctagattgatgatagaatcaaaactaacattcagatcttttgactcatgctttccttgaatcaatctaaataagccactttagatttcacatgtctagtttgcctttatctaatagctaaacttatttttattctaacattaaaagagaatattatgcatttggaaaaaatgctgttgaaaacatacattgaagctgagagtgttggtgtgtgcctgtagttccagctacttgggaggctgaggcaggagtgtagcatgagcccaggagttcgaggttgtaatgaactatgatcatgccattgcatgccaccctaggtgacagagagagacgccatctcttaaaaaaataaaaacataatattttaaattagacattgtgttttggaaaaatggaagagttatactctaaagatctttcaacaaatcttcagtatgcctttactaaatggagaagctatgtattgatatgtggtaatactattggtggatcagaaagtattaggtaattctaggtcattatgaataccaactgaaacagttcttccccaaaatcttcatagcacatctctcaaaaatggaatataatatactctttaataagattattgtctaattttttaacataagttaaatgcaattagatatttgattttctaatggttacattttaaaatatattgattttgattttgaataacattaaatgtttttccacatctagggaggacacatctatgactagcagtggcatgtgctcaggaaaggtaaatgtatgtcctggttcaggtgtattctcacttaacctctatgattttcatattcttcatctaaagttagaggagtttatttagatgcctctgtggtagatactatgggttgacttgctcagccttcatcccaccctccacctatgtggttttctatattgtagattctggaaggctaaaactacatttctcactttccttgcagtagggttctacacataaattaggtttcaccaattaaaaacacttggaaggcagaagtgaagtggaaatcattttcctcttttggctacatctacaggcttgcacagttatgatgacatgaggatcttggcaacagcattccattgtccactctccagctacctaagtgtcaagaggcagttttgacaaaggcagtgccaatcctacccattcaccagtgttcattcacttgctttgtgaatgttcagggaccatggcaatggtggcagtgacacagaggcagtcctaatccttggatcatagctatgaccttgtgttttgtattcgacaattccagcttcagcctgagagttctgtagtgttctgttagtcattactggaaggccctgcagagcctattctttcagccattccagggatgccttttgcatcttattctcaatactaaatttatttctacttaaaatacttagagttggtttttatgtcctgctctgaaacctgatatctaagtttgctgtgtgctctaatgttcttaggttactggggaacttggtgtgttttctaaaacatagtctccaatatttatggtaatttcttaaataatttaagtttctttctatgtagagtctatttgtaatgtaattttattactatcctataattatccttgttggtgttgagtacatgggagtcaagtgtataaacatatttgttaatgaatcaacagcttatattttcaggaattaggatagctattaggtgctattaaaatagagtatacatatatgttccaaaaaattttatgtactgatacaatgaattagaatgtctgaagtagatataagagtgtataattaactgtattttctaaaaggattttttgtatgaatatgaaaaaatattatttatatatacatatatatagagagagaagagaaataattatgcggatgactgctaataatctgtgatttttttatgagcgtccttttacagcattcatcttgggttaaccattacaacacctgaataactatttgatatttgccgtcacctccttaacgtcttgataatcaatattaactgcacatgaacactttacattcttcttgagctaaaactattcaaataccttcaatccttgtgaatattttcccaaattgcaaggagttcttgcaattcctctattctttatattttaaagaatgtaatacagaaagatctacataatataggtgataaattactcactttggaaactgatatttgagatctaattgaaaaaaaaaaaaacaaaaagcaagaactgagcaagcctgcaacattatcagtctcaattctgggaatatctttgttactgaattgtaaggagtgcaaccaaggatggatgataggtggggaaaaggaagtatagtgttcagtcctaatattggtaaagagtgcctggaaacgaacagcaccaaggaatgtaagcagaggaataggtcagatccaggaaaggaagcagggtagggcacatacaagaacatgtttcagaggaagcagctggccagcagctgctgaacactccagaaacagagagattcaaattgctatatagcaagctgtaaagtccaaaatgtaggagaatgggtgggtcccaggtggtctgagggaaattgaatggtcaaagaagaaaagtcgtgaaaacagtccagccaataataaaaaggataaattaggataaaacaaagataagatatctgaagtatcaggaatgagtatctttttgatattgaaggcagatatcctgtcctaaattttgggttttctattatactttggaaggaagaacttatcctacagtaaacagtccaggctgagcagaaaactgaaagtactacgctgagatggaatatatactcagaggcaaaaagcctgtcatatccattgggtggcaagcttaggattgtagtggagtgttatgtggagcagtcaggctctgggaagataattttgtgctgagagcaagacttaggcacagaaacctcaagggacaaggatcaaagaagagagaaaaattggtcctttgctgaaaattcacttgcaccaaaaagaaaatcacacagaaaggcatgaagtaaacatccaaagtcaagtagagaggggtctctgtctgtgctttcttgccatctacagtcattttcacagcagacaaaagcccacaggtgctcatttctgaagcagggcaaatgcaattagctattacaactcaatagaatgatctgtattctagtcacatcatgttgttagttgtgtttcttagcagcacactgaaaaaaggagtcgatttgtgtggcctgaccatttttccctcttatagtaaaaacaaatgttatgtctgaaaatttagatatttttacctttattttatttgttctattcaaagatattttgaatataagtggtacctgtaggcaaaaatcaactaacatttattaagcacctttttgcttgcattttacatataatagtttatgcagaactatatagttttcacagaacttagtaagttctcatagaactgatagtaaaacttcagactaagaatcagtattgcagagttcaagcttcagatgtatttctaagcagctaaaaccttgagcaaattacttccccagtcattggtttttacaactgcaaatgaggatgttaaaagctgttttacagcttgtttggacaggattaaaggggtttacatatgaaattctgttaagtttaatgaatatttattaacaaaataatgtttgccaaacagcatgcaaaggcttttgggatgatacaaaggaaataagctgtggttttggccattgaggtctgagtctaaagagggagactgaaatatacactttaaaattagagaaaatgcaggaactgtgagagtacagagaagttcagtatgaaagtaactaaaataatagccacatccaatcactcttgatgttcaatgagttattttctctttttgtttaaattatttctaatcaaaaggcaaggaacagaaatgtccattatcactgacaggtagatgatttacagttgtgaatgatgagttactcattaatgtattagtactggaggtattacgatgcagtaggtcagagccccaaggctcacagcaggctcttgtccattgtaacttaactatataacttggaaacattccagatcctctctctccctggtccttccacttactagctacgtgaccttgaacaagttacttaaactctcttttcgagctaccatttaacccagcaatctcattactgggtatatatacctcaaagagaataaatcagtctaccaaagagacacatgcacttgtatgttcattgcttcactattcacaatagtaaatacatggaatcaatccaagtaccattaatggcaaataggataaataaaatgggtatatatataccatggaatactacacagccattaaaaatgaaatcacgttatttgcagcaacatggatggagctggaggccgtaatcctaagcaaatgaatgtggaaatagaaaataaaatactgtattttctcacttataagtaggagctaaacgttaagcacacatggacataaatatgggaataatagacactgtggactacttggaggggggcatgggctaaaagctacctattgggtactatactcactatgtaggtgatgggatccttactccagtcctcagcatcacggaatattcccatgtaacaaacctgcacatgtactccctgtatctaaactaaaagttaaaaaacaaaacctctctgttctaatttatcatctacaaaataggagtaatgataggttgtacattgtaagattattatgaagattaaatgagctaatctatataaaaatttttaaaaagtgctagtaaacagtttggacttaataaatgttatctatattcatgaatgtcatttttactataatgatggtgatgatgctttggcatatctttttgtaaaatagagaataaaaagatttatctattagttgtatgatgaggattaaaatttaaaatgtctggtttaataggtccttaataaatatgaactattatgataatagtgattactactaaaaatcattccctatatatgtttagcatttcacaatataataaatgcttttatgtaaacaaataaataaaaaatataaatttataaacatataaaaatgtgtgtgtatatataggatttacagtatctacatatatgtatatatgtgggtatatatatgtgggtatatatacatatatgtgggtatatacatatatgtatatatgtgggtatatatgcatgtatatatgcaggtatatataaatatacagtatatatgtatatacacaaacgtgtatatgtatatatttatgttacatgtatatactgtaaatcatatatacacatatacacacacacaatgacacacatatatttatatatttatactcacatatattcatcagtgtgagtatatatatttatataaataattcacaattgcacaagagatgaacaggccagattgttctattcctatgtattattcacatttcatagtttgttcattagactactgtggtcttctacagaagatctttgaatttgaatgtcttactacgtctttgctgacacacacacacacacatacacacagtttctggttggtatgtggactaacataacaccttctgtttaattaattctgcattcttttctcctttcgtttcttccattgctttcctacttccataagtataacactggaatccacatatttagagaaatttacggccaggcgctgtggctcacgcctgtaatcccagcactttgggaggccgaggcgggcggatcaggaggtcaggagatcgagaccttcctggctaacacggtgaaaacctgtctctactaaaaatacaaaaaattagctgggcgtggtggcaggcgcctgtagtcccagctatgcgggaggctgaggcaggagaatggcatgaacccgggaggcagagcttgcagtgagccaagatcgtgtcactgcactccagcctgataacagagcaagactacatctcaaaataaataaataaataaataaataaataaataaataaataaatttacttatgtactgtagttgttcaagatgaaggttacacacagagaactgggtatgttatttatgagcatatttgcattcatgtagcatcttaaatgtagttggcaaccctcttctagcacaatggacacctgctggactaacaatatgtttatacaaggaaagtgaaaaatatctacgtttgcacactggctgatgaaatgaaaatagtttaaaccagtgatttttgtgtatagctttcttttaacttttttatttgggctgagaaccatgtgtgcaatggtatgatgtttataaacatttgaatgataaatttctctatgcacagagttacccaacagtgtaggtttacaagaagacactacattattgaaaacaaagtaattaaattttcgaggtcaaagttcaaggaggatcctgcccttgagactctctttccctcctcaaggagaatgagaagcctcactgggttggcaattttcggaatagaaaaatataaaaaaaaccctgacatcttccaggcctaggaacacatcgtcttttgtcttcgccctcaccaaacctatgcagaatgttgtggcacctaaatccccgtttctgggctggagactcagcattatctcttgtcaggaagttgtcagatccctgcatctgcagaccacagataatagggaaaaggaacgtcaaggtaagatctgtgtaattaattagcttgttgagcaaacagttgaaagggaaatgaatttattaatttttgaaatgtatttttaccagattaagagaagctttagagttctatcaaaaaacttccagatcaatcaacaagtgatacatatctatatctatatagatatagatatagaaaattcagtgaataaaaaagaagttacatactaataaatatattagcatattctatctggttcacctgataaccatatttgcatagtcatattagttcaataatgacttttgtttttaatagaaattaaaattacatagggcagtttaggggagtaggaaatatcatatgcttctctttgcattatgtttgttaatatcccattggccaaagcagtcatgtagccaaacctgacatccacagggtagagaaatatattctcccatggagatgaagacactaatgaatattttgatgaacaataatctcacctatgacacctgccattcatctgacatagaaatttccgatgaattaaaaatctaaacttaaaaagctaagctaacttttaaattttaatggttttatactgacacaatttcagacttctaaagttgttgcttgcagcattagtcacagtagccaagacatggaaataacttaaatgttccttgctggattcatacagaaaatatgatatacatatgcaatgggatattattcaaccatcaaaaagaatgaaattctgccatctgtgacaacatggatgaaccttgagggcattatgctaggcgaaataagtcagaaagagaaatgcaaatactatatgatctcatttctatgtggaattttaaaagtcaaacccatggaacatagaatagaatggtgattaccagagcctgcagggtgaggacatttgagagatgttgatcgaggaaacaaacgttccgttgtaagatgaataacccctggaaatctaatgtgcaagaataattttgctttccaagattatacaaaatatttcttgtatttcattaaaaattcatagtttttaactcttgttgcaactactttatttttttccggatttattgatgtacaattgacagataatattgtacacatttaagatgaacactatgatgcttagatatatgtatatattgtgaaatgattaccacaatcaagttagttaacacatgcatcacctcatatagttagtgtgtgtgtgtgtgtgtgtgtgtgtgtgtgtgtgtgtgtgtgtgtgttgagaagatttaagatctactctctctggaaatttcaagtatataatacactattaatattatttatatcttttaatgggaaattccccaattaccagtgcttatctgtttcttatagatttgtaggagctctttatctgttaaatatgctggattcttttgctcatcttttaaattttgagtgatatatctttctttgtacagaaacttaaatttcatatagccaagtgtaagtaaaacctaaggcttttctcatagtttctgctattcttttctgtaagtcgtaagtaaattatcacatcatagattttcccataaacaacataacttaggcatgttgctccagatttgatgagatgaaaaaatttttaatgtccctgaaaaaatatgtgtatataatcaatatacaaataaaccttagcaaggaaagataactacatagtaactgtttattagttgctattcactgaaacaaaagaaatcatagaaactgaatgaatatgcaacctctgtcagtcataaaacattgttaacaggctgggtgcggtggctcatgcctgtaatcccagcaatttaggaggccgagatggatgaatcacctgaggtcaggagttagagataagcctggccaacatggtgaaacccagtctctactaaaaatacaaaaaaacaaaacaaacaaacaaaaaagctgggcgtggtggcaggcacttgtaatccgagccatcaggaggctgaggcaggagaactgcctgaacccaggatggggaggttgcagtgagtcgagatggcaccactgcactccagcctgagggacaagagtgaaactccgtctcaaaacaaacaaacaaacaaacacccaaaaataaaaacaatctgttaagatagaaaaaatataatatggctacaaaataatgacaattatctattcaaataaaataaaagagagcacttttatattgtgttttttacacatagcaacatttaatattattcttgtatttttcattatctgtaatatatcaactgcattaatccctttccacaatattttatccagttaaatttttttacacatagcaacatttaatattattcttgtatttttcattctctgtaatatatcaagtgcattaatccctttcaacagtattttatccagttaagtttttttattttttaaattgacacatcattgtttgtattagtccattctcacactgctataaagaactacctgagactgggtaacttatgaaggaaagaggtttgattgactcacagttcttcaggcttaacaagaaacatgactgggaggcctcaggaaacctacaatcatggccaaaggtgaaggggaaccaagaactttcttcacgtggcagcaggggaaagagaatgtgtggtggaggggaagtgccacacacttttaaaccatcagattttgtgagcactcactcactatcacaagaacatcatgggggaaatctgctcccatgatccaatcacctgccaccaggtccttcccccaacactgggaattacaattcaacataagatttgggtggggacacagagccaaaccatactgttgtacacattttttgggtgaatgtgatattttgatacatgtatacaatctgtaatgatcaaattaggccaattgagatatacatcacctgaaacatttatctcttctttgtgttgggaacattacaattctttctcttctagctatctaaaaatatgcagtaaattatggttaattataatatcccttatttactatcaagtactagaatgtattccttttatcaaattgcgtttttgtacccattgaccaacttctctttatacctctttgcttcctttccctttccagcatctggtaaccatcagtctacctccatgatatccacttttttcactcccatgtataagtgagaacatgtgatatttgtctttctgtgcctggcttctttcacttaacataatgacctccagttccattcatgttgccgcaaatgacaggatttcattctttttgtggtatatatactacacttaaaaatccattcatctgttgatggacacaggttgattccatatctcgcctattgtgaacagtgcttcaataaacgtgggagtgcaaatatctcaagtctttaatctattttgagttagtatttgtaggtctggttaaattttaaaagggtaacagattcattaactagcacagttaaaaccagtttaaaaacgcctggctaagatttgctaaaaacctgactaagatttgctaaggttcttggatcgacatcttccaccaaatttgggaaatatttggccattattaattcagaatatttttcctccctgttctttttctcctctccctctggtactgcaattatatgggaacctacttggaattatcccacagatcactgcagctctctgcagttttttgaaatattttttctttccattcttcagattatgtaatttctgttaatcgtcttcagatatgtgaatccttccttctctggttccaatgtactgttcagcccatcaagattattcttcatttcagatattttacttttcaattctgaaattctcattgggtccttcttatagttttcatttctctgcaaagttttctcattgtttactcatattcattcttttatttaagtccttgaaaaatattaagttcttgcaagctaatttcaacagttatgtcatttcaatatttatacttttttcttgattataggttagatctaataatttttattgtatattggacattcagacgataattaaaggggttcctgattatgttaacttcctttaaaagatttggaattttgttctggcaggcagctaaaatatgttttttccctgtaaatcttgattttattctttgaatgcttttattttgtttttgaatgtatggcatctttctttctgtataatgtggtctctactcctaaagaaaggcctttctggtttctcaatgcttgagatgtttagtgtcatgtctctccctactggctgagctggaactccaactctctaatttctgacagttttgtttatctctcaatctctcagcagatgatatctgctaggcccctcagagacccatgatgattaatgagtcttttgagcccatcctctgagtggctctttcttctctggtgctctggcctataaactctaattgcttctgctgcctatgactctgacctcatcctcttcagctcagaaacattgctgctcatctcattgtattccttctgtctgcccacagcacaaaagccattccaaatccaaatcccaggagatcactggtgtatttatgtgtgtttcacatctagcaaaaatcatagttctgcactaacagtgctcagttcccaaaaatagaaacctcatttatttcctacctttttttttagttgtttacatcaggagggcgagtcttgtactagctaccctgtcattccatcacaatggccaaactagtttggtttcacaaaaggcatcaaatatttcctgtgtgtctttgtgttaagcactattttacacatatgaactatttattatctcatcataacaaatttcggaaaagcttggggttgacggtaaatgctatgtcaacacagatcagccaaagacacagtttcagacactttctttctctcagctccaaagctgtgcctgcataaaactaaaataaacagatggaaagcaaaacatgctgaggggtacaaaaatccacatgtgtggagaaaagtaccagaaacaacatctaatttttccattcatatagactctctaagagtgaaattatacttcatgaatataaatatccaaacaaagacaaccagctgaagcaaagtagtgtttgcatcaacttccacatatttgtttagactttcccaaataatgtgcttaattaaaaataaccttcaggtgcaatgagttgagttgttcagtttattcaaagtaacttgctcttatttgagtgactagatgcatttttatttttgttttgggtgaattcagtatcctgaaaatggccaacacttatttgaataatttaaattatttcttttcaaataaaatgtttaagatataacaattgcttcttacactaacattctaaaaggataatcttagaggtgaactgaggtcaattgccatgtataaagcttattctgacttcatatttttgaagattagccttttatttacaacaatttttctactcaatgcatcattgctacaggttttggtttaagaagtaaccctagatatatcttaagatcttcactaggggacaggggttttaaacatcattgccatcatcattcttgcatcatatcctcatcacatgagctttggttcaaaaatcagattttaaacgatttcaaagtcagacttttttttttttgagacggagtctcactctttcgcccaggccggactgccgtggcatgatcttggctcactgcaagctccgcctcccgggttcacaccattctcctgcctcagcctcctaagtagctgggactacaggcgcccgccaccgagcccggctgattttttgtatttttagtagatacggggtttcaccgtgttagccaagatggtctcatctcctgacctcgtgatccgcccgcctcggcctcccaaagtgctgggattacaggcgtgagccaccgcgcccgtcccagatttttatatgtgtctgttggaatataagaaccaaagcaccataaactccagctataaaatttgcttgttattaatacacaaagaaagtgaatattaagagacgaagtctgagccaagaaaataaaaaaagtaattatttttggtttaatttatacatgccatttttgcacaaaatagtgccaaaatttaatgtcacattcaaactttaaaattcattgaagcaaactctctctgtttagagatgccatgatattacatggagaacaccccaatgacttcaccaaaaaaccattaaaattaataaacaagttcagtaaagtttcaagatataaaatcaacatacaaaaatcagtgatgtttctatacaccaatagtgaattgtctgaaaagaaagcaagaaagcaatttcacttacaatggctacaaaaaaaaaaaacaaaaaaaaacccagaatgcctagtaataaatttaaccaaggaggtgaaagatctctgcaatgaaaaccaaaaaacattgaggagagaaactgaagaagacacatatatctcatgttcatggatcagaagaaataatattgttaaaatgtccgtacaatgtacacctctgcacctgcagattcagtgcaatctctatcaaaatagcaatgacaggtggggcacggtggctcacgcctgtaatcccagcactttgggaggccaaggtgggtgaatcacccgaggtcaagagttcaagaccagcctgaccaacatggtgaaaccccatctctactaaaaatacaaaaattagcttggtgtggtggcacatgcctgtaatcccagctactggggaggctgaggcaggacaatcacttgaactcgggaagcggaggttgcagtgaaccgagatcacgcctttgcactccagcctgggtgacagagtgagactctgcctcaaaaaaacaaaaaacaaaacaaaacaaacaaacaacaaaaaaccaatgacaatcttcccaaaatgagaaaaaaaaaatcttaaaatttgtgtgcaaccacagaaggccccaaattacccaagcaatcttgagcaaaaataacacggttggatacatcacatgacctgacttcaaaatataccaaaaggctagagtaaccaaaacagcatggtaaatggaataaaaatagacacatagactaatgaactgaatagagggcccagaaataaatccctgcatctacggcccactaatttttgacaatggtgccaagtatagacaatggggaaaggacagccttttcaataaatggtactgggtaaactgcatatgcacatgcagaacaatgaaactagactcctatctctcaccatatacaaaaatcaactcaaaattgattaaagacttaaacataagacctgaaatgaaactactaacagaaaacataggggaaaagctctgtgacattggcctaggtaaggattttttttttttgtaaaaaacctcaaaagtctgagcaacaaaaacaaatatagacaaataggattacatcaaactaaaaagcttctgcatagcaaagggaacaatcaatagagcaaagaggcaacctatagaatgggagaaaatatttgaaaactctacatctaataaggggttaatatccaaaatatataagaaactcaacaccaacaacaaaagtaaacccatcaaaaaatgagcgaaagacttgagtagatatttctcaaaagaagatatacaaatggccaacagataaatgaaaaagaagatgttcaacatcagaaatcatcagggaaaggcaaatcaagatgacagaaattttcacctcattccaattagaatgactactgtcaaaaaatcagaagataacaagtgttggtgaggatgtggagaaaagagaaattttacactctgctggtgggaatataaatgagtacagccattttggaaaatattaatagtttagagtttcctcaaaaaataaaaatagaactactgtatgatccagcaatcccactactgtgtatacatccaaaggaaatgaaataggtacttcgaagagatatctgcactcctatgtttattgtagtaccattcacaataaccaaaatatggaatcaacctcaatgctcatcaatttttaaatggatttaaaaagtactatcacaagggaatgttattcagtcataaaacaataaaatactgtcatttccaggaacatggatgaacctggatgacattatgttaagtaaaataagtcaggcttgggaagacagtgcatgatctcactcacatgtggaatctaaaaagttgttcttgtggaagtagacagtggaacagtagttgccacaagatagggaggttagggaacaagtggggataggagagattggccaatgggtgcaaagttatagttacacaggaggataagttctggtgttctgttgaatagcaggatgactagagttaacaacaatgtattatatgttccaaagagaagtttttgaactcattacaagcaaatgataaatgttatcagaaattgactttttaaatatgagactataataggacctgataatatcttctaataaatgaatataggaaaatcaccttgatttacactaaaaaagacaatattaaacaaaggtatattattgggaaattctctaaaatgctcaatgatggctttaaaaatagaagtttggggggctgaggtgggcaaatcatgaggtcaggagtttgagaccagcctggccaacatagtgaaaccctgtctctactaaaaaaaaaaaaaaaaaaattagccggacgtggtggcgggtgcctgtagtcccagctacttgggaggctgaggcaggagaattgcctgaacctgggaggtagaggttgcaatgagctgagatcatgccactacactacactgcagcctgggtgacagagtgagactccatctcaaaaaaaaaaaaaaaaaaaaaaaaaagaaagaacggagaatattttttaaatattctcctatttgaaaatagaatttcttaatacttttgagttcaaacaatggaagtaaagagatttggtcaccaatttaaaaactagtttgtctgtgtaattacaatttcttttctctctgagtgtaaacaaaatatttaggatcagtttattgcttgtaatgtgtcatcatttctctctttctttttttttctcacccatttaatttgtttactcttttttcccctgtgtttccagcaacataggaggatttagaaacaaaactgtcttgggcagagggagatgatggcaaatggatgaaaaactggcttcttgtttttggtggttactatagcaataatcatgatgggagatttttagccgcaagtggtttctataacaacatgatagggtgctttagaaatagacctgaggtaaacagattctttaagggcctcttaaccccttttatcccacaaaattagcatcctcttggaggatgaatattagttggcttatttgatgaaacgcttaaaatcttgcttttgttttgtaaagattaaatggttaattattctataaagacctggccttagccaatcagctcttaggctccttcacttcaggaaataattgatagcatccctactttatttctgcacagcaaattcaaatagccttaaagatatgcatttcatagtattcaccaaaaattggaaaaccataaatagtcctcgtgagaaagtgtgttcactctgacatagatcactcaagggctcttgctttactaatacttcatatacactatgatttcacctattgggctccctgacaggtggagcttttcctactctaactaatggagtctgaatactcatcctttattaggctattcagtgtgtgccagaatagacctggtccctattgagttataattcactaggtattacatggggaagtttagtaattttttgaatttattaaattttagtatcataaaaactgacatagaaaaaagcaaaggcctccatttcatacataagcatccttcaggagcccttataagtgaaagatcaaggggaatttatgacaggaatgtggtacaggagtagatggtggtaggcaggaaataatttttcaagagaaagaaagatggaaggcttaaatttagttaagtagttaaacagaggaagatggggatcaagtttggttgactttaatagtgagttattgattatctactctatgttgtacactataggtatatacaatgttgaatagtatatgggatttattttaaaaactaaattatcatatcaagtaaagcactcttattaaactattaattaaattaattgatttgaagtggccatatatttacaagaatgatttcatttatgttatgatgtctcatgcattttctacagtagagccatccttatacttttattcttttctattcagttaagctgccaattcaaaacatcagatattctctttcaaatctcagaaggatgtcagcaaccatgcatctccttctctctgatttcaaacagtacaagctattcccatttccctggtgttttgtgctcagcaatgaagcctcggaattcattacgtaatcacttgccatagccttctggggtggagtttgccaaatggatccctgggagatcaagacccattctccatgtgtgccatagggctatgcacatgagctgaggcatgtctgtattcaccaaggccctgctcagaacagcatgtgccagaatacactgggcaaggagccattcataaattcttgaaaaatcttatccagaccaaaggcacaatggcattgtagttgttgtgctcattgccatggggcttttagctgaataaaaagaaaataaaaaatatattcatgatgacttccaagttatccagtaaccacagtaacctaggttttccccaaatttggtccacaactttgagtcacctgacagaaacaaatcattctgtctttgttcaagcatagtgagccatagagtgagtgaaacaaatttccctgggataaaaaccaatgaatcagcaaagcaaacaatcatcatatatttattttactattagaaggtggtattcaaaatgtcatcaaaaccaaatacatacctcatacatacaggcatactgaaaagcatatattatagttcctgaacttaaagagtttgtttgctaattgtaaggacaagtcttcatatatggcatgaagaacactttaggttgcatatagataagtgttcaattgtatcttaacaataataaattctgtggctgctcaggccaggagctcaaggggtatgtaaaaatatgaggaggattaatgggaaaagtacactttgcattggacttctaacaatttgaatatacatcacagttaaactctcagaaagtattctgagatatttttattcatggctactataagaagaatgtcataaagaagataatttaaattctggaggaataatgtcttactcataaccacacattatttttctagactttagttctctgtacaaaaatgcgagaaaactgttgagagttgcactatccaacacagtagccattaatcacatatggcttttgagcacttgaaatgtgactaaaattaagtgtgctagaagtgtaaaatacactaaggatttcaaaggcttaatgttaaaaagtgtaaatatttcattaatagtttttacactggccaggtacggtggctcatgcctgtaatcccagcacattggggggccgaggtagacagatcacttgaaaccaggagttcgagacaagccccatctctactaaaaatagaaaaaattagctgggcatggtggcacatccctggaatcccagctactcaggaggctgaggcatgagaataccttgaacccaggaggcagaggttgcagtgagccaagatcgcaccactgcactccagcctgggtgacagagtgagactctgtctcaaataataataataataataataataatttttataccaattacatatttaaatataatgctttatctatatttggttaaatatttaaaattaatttgcctgtttgtttttcgttgttaacatggttacagaagacttaacattccatatgtagctcacattatacttccattagacagcactggtataggtgcttgctatttaagtgtagtatgtggaccaacagcatcagtattacttaggagcttaccataaatgccaagtctgaggccccactcctcctgactctgcaaggttaacaagatcctcagcagttcatatgaacattaatgtttagaaaatgctgatctagataatgttttagatgtttctttttatgactctgtcttccttttcatttggatttttttcaaataaatattttacagtctgggcatcctgacctagcacatattagatgcataaacttggggaagttatctgacattcctgaaactcaattccatatttataaaatggatgtaatacctccaatcccataatttttctataggggttaaatgaaacacaagaattatgaaaggaaccaataaattggagaaatttttataatatcaaaaataatattgaaaaattagattattctaattattttcattcttatattgattgccaatactattttgatgtacagtggaatgaactagagttcgaagggctgttttcatttattttacaaatgtcacttttttaacattaattgtgtataataaaacttagcacactgataagtctctagtagagatattaaaacttttggatcttcttttagaacaaaagtgttgtgtagctaaattttcctgcaccatcattatataattgacattgaaattatatctgttcgttgatcgattctgcaaaacatggctttatggagcgggaaaaaactttttcgtctttgttcagaacacttttagctttactgtgagaatttcaatttgctagaggcaaataaactagtaaaatatgtctattccatagtaaaaggggtcattcaaaagcctgtccttattaaaatatacattgattataataaggtcagtgatttcaggcctgattagctttaaataaatgtaatgtcaaaggaatataattagttcctcattaaaatttttcatgattgacagtgagtaaaaatgaccttcacaacttgcatcatttagtcatgttctaaggatgacaaagggcagggcatcttctatgaggtaaatgtgtatgattgcagcctgaggcacatgcacttggtcccttaccctacctaaccctaacgcccaagacctgatccaagccagaccctgtgcttaggtgtgtaggctgtgtaaaggaggacccagaagctttgattctcatggggatgctttgagagaaaaagaaacctttgaaccggcaggacctgatttcatctgtgatgatgctgatgatcagaaattatatataaaagcaaatagcaacgtgcctatcagatataggggatttaaaatatgttgacagaaaactttctcagtgaggccactgaccttctaaagaggagctaatagtagaatagggatattaagatacaggtgatgtcaatgaattttggccaaaaccaatcttcttacctggagtaagaaagtcgtgtttcaaggagtttgcatgagtattaattgtggttgatgatgatgggaacctgccctgattattaggtatgattctcagagaatgtgtgctggtgctaagcttgcatttctcagaacccccaaaactctctttgcaatattatatagtttcattttcttgaacttattcatttgttaaatatgcatttactaagcaccaactatgtacatggcactctgctagtcaatagacaaataataagatatatgtactttggaccctgcattgaaagaaaaagcaaataatgttttttaaaaaactactttatgcttgattgttataaggaactttatgtgtattatctcttttattcctaataataataagaacaaggatgattgataatgctcactctgtgccaagccctgttaggcattttatgttcattaatttaaccctttataacaactctatgagataggtgccatttttacaaaaatggaaactgaggcagagcgatgttatcttgataaaactcatagacttagtaagtggcagagccaggatttaaacccaggcaccaaacttcatgcgcttatccactatatatatggctccacatcattttctttagtaatcaggacactgaggctcagtgaaaatgttttttcttaaagtcacagagatggtaaatactagaaccaaaatttaaatctctgtctaccataaaaatgtcctcttctcactatattaaattggcctcaatttagtatttaagacaacgtgtacagtaggaatacaaaggaaaaatggtcttaaaggagcccatctacttcttattttaactgctccatgtggattctatcacgcagtacatcaaagtaagtgatttaaccaatcatttgttctgcttgattttatcaaaagaggtcaaagtaagaatttcacagcaaggcttaaatgggaattcaggtttccttgctcactcattcattattcaacaaatttctattgactgccttaccatgtgcaagccattttggctatgtcctgattaaagatgtgcccctcctgcaccgcctccctccccaccccaatcctggaactaaatttcattctctgcagaaagccaggctaaagagaattcagcaaaccactttattctcataaattggcattcttagacctggaaattttgagttctatctccagtagcattgtttataccttctatttcattctgattacatttcattagcaaaacatagcaaatgtttataaaatcgtcagtcttctaggtgaaacgatgtaagacaccattcatttgattttttggaaatatcaaattttatgttcacaattcctctattctactctgattatttaggtaaaattaggttaaatatagataactatagaattaaaatttaaaaaactgtgcctttacacgtttggaaaattactcaattttttttcaaataacgccaaccatatatattgaaaataacattattccataccacaggtgacatattcttttcctatccctagcagcgacttccccaagtccctgcttgtctcaacagtttgaggaaaaaaaacaccagaaatatacatgttccagaacaatgaataaattcccaaataactttatatacattagtgaggatacaatgaggagtgtttatctagctaaatatgaggcatattaaaaattgctactttaacccagatatgagcaataataggagttttatctacgcctccttcctttccttctgctgacaaaggatacatttaattcttgacgttaatatcagttaaaatgagatctagagacagatataattagagagctagggagagaattaagttagtaaatcttaagaaaagactgagtatactgatgataagaggatatttaaatagaattttgaaaaagatcaaggatcaataattatacatttaaatatacatatatgtatgcatatacatatgcatagttttacataaagaaactattaaggtaagagctatggctttgacagttaatactcaagaaatatttactgagcacttggtataaataaatagatatggagcacaatacaaagatacagcagatgctctgaacaattaagtccttatcacaactcaaattccatagctagcattttgctgagccaagaatttaaatggtacttaaaatttatagaggccggggactgtggctcaagcctgtaatcctagcactttgggaggcctggatggctgaggcgggcagattgcctgagctcaggagttcgagaccaccctggcggcaacatggtgaaacccccatctctactaaaatacaaaaaattaaccaggcatggtggtgggcttctgtcatcccagctctttgggaggctgaggcaggagaatcacttgagcctgggagatggaggttgcagtgagctgagatcatgctactgtactccagcctgggcgacagagcaagactctgtctcaaaataataataataataataaataatttaaaaatgtataatcagatgttaaatattttcttgcaaaaaacaagggagctggggaacagaacctttttaattcaatttcataattatttttgtccgatcctgaccattcccaggtaatttacaggaagggcatagttggcaccttgaattagtccattgttaggctttctatgtaagggtactcgtgtttttttgtttgtttattttgtttcattctctttcttaaaataaaattccttcagtgaaaattattagtgacttgtacctttttaattatttttattgctatgttttgtacttgttcagtaaattttctattaagaactcaaaactatttctcaacatcttataaaggtaagagctagcatttaccaaacacttacgatgtgtctgcaaagcatttaaatttagtgacttaattctcacacaccaaaaaaaaaaaaaaaaaaaaaaaaaaaaaaaaaaaaaaaaacagaaaccaaggctgggagaggcagagcaggcctggtacccatctgttgccccttcccactgtattatcctgactcgctggtaaatctcctatgattgctaaatagaaaagtcaatgaaaagattgataataaaaaccactgaatacaactttcagattcttgattgatgattttaaattagagaattacctgtttcatagaaaagtgcaatagaactatcaaggacaaaggaataaatactacttacaatagagaaattaacatgttcttccctgaaagtcttgcaccttgcactgtttcattgctctaaataaacatactcggcctcataatgaaacaaaattaccaatatggctattttccaagtcaatttaattattagaaaatacatacacacagatgcatacacacacacacaagaaatatatttactgttatttgggtcttcatcttccttaaaactggtcaaatttgtttttacttctcagcagacaaaaaaactttattttagcactagaaatacttaatgcaaatatagaaataattgcttatagtaactatataaaatcttttcttttctcttgtgcagaggttttcaaattgctggtctcaaaccctagctccttggaggtgtctctaggggaggcaggagactggtctgactgggctccaagggaccttccctgcttcgacctgagcagatctgctttccaattgtgtacattgggattcctcatgacattttccttgaaggaattctgctgctcttaaaaagaaaaaagaaaggaaaagagggaaaacaaaaagtctgaaactcacagtggtagaatttcttaaaacagccagtagatggcaaactttactgcaaggaaacaattttgcagcctatataatttggtctgaaaatagcaattaaactctacatccagtaaaatttgctatcctgtatataagtcttctgttaaatcaggaaacaaaattctctatggtactttctctgggaactaaatttcaattataatttaaaatatcctataacttctttctgtgtccatttaagtcttgctctgaaggtattatcactatgaaaattattgcattgttcactgaaagtacatacaatgtgctaggtatagtaatgtagatgacgtagttttttcattaggatgaacccaactatgtattttattaatgagtttggttgaggcagcacaaaggtcacaaagaaagatttttaactttgtcctcatttataaatttaatcttgttactttttatttccttgtagattccttttgcaataaaaacaacaccaggtgcctctcaaattcttgccaaaacaattctacatgcaaagatttttcaaaagacaatgattgttcttgttcagacacagccaataatttggacaaagactgtgacaacatgaaagacccttgcttctccaatccctgtcaaggaagtgccacttgtgtgaacaccccaggagaaaggagctttctgtgcaaatgtcctcctgggtacagtgggacaatctgtgaaactaccattggttcctgtggcaagaactcctgccaacatggaggtatttgccatcaggaccctatttatcctgtctgcatctgccctgctggatatgctggaagattctgtgagatagatcacgatgagtgtgcttccagcccttgccaaaatggggccgtgtgccaggatggaattgatggttactcctgcttctgtgtcccaggatatcaaggcagacactgcgacttggaagtggatgaatgtgcttcagatccctgcaagaacgaggctacatgcctcaatgaaataggaagatatacttgtatctgtccccacaattattctggtaagtgtgatcatatctgaatcacagatggtgtagttagctctttctaagtggcagaagcagaggtgacattttatttttcacacaatcatttatgaaaatggccaagttcttgacaggaatcaatcactagatagaaactccctaaactgctgaaaatccactgaatgcactgaattctaagtggttgcctgctgtcactgttgctgttttaaatggagctctacatgatttaaaactggattcagtctagaatgaatgaggtccaagagaaactcaagggcagttcaggtttcctcatcagtgcatgttcctttcattccagttcaagcctgctttctaatccccaaagcctggcactgcaaccttctgggaaggcagtttggaagttgatgggtttctagtgctgacttgagtattatcaacagatcagtggtagtaaagctgatggagcatggtatatcagataaaccacgatttttattaagaaaaaaagcctgttcttgttttacgtcttagagcaaacaattgtacctcatatttatctatctattctttacaatgtttctgttgatagaattttattttaataataaagtaacaagttgacaactcatcattaccaagttacatgctattcagcctcttcacactcagtatttatcctccctatccttttgaatcactgttactgttttaggtcaattcttcacgatggccacatttcttgctttgctttattctttggcttttccatttacttgtaagggggtaacttacctagcctatgctttctcacatgcattcattctaacttctgctcaccactttcttacagttcctgactcatatctctaagacaccacacacattttaataccatgttctcccttagcacttgccgtttttgtaccttcctgaaagccttcctgaggctttcagcttttaaacttgccttcttctcccaacactttcacacttagttctttattttgtcattctttttccaagtgttaagcaatatatctatttggaaaatatttctcttcaaaatttgcaccagaaccctccagcatcattttacttttaaacattctaaaactatatattttataaaatagacacattcctagttgctctaaaatgaaatttttcccctctccctcctcctttacatacaaccagtcttcagaatctgctgttttgacatctaagatatgttccaaattgagctcatccattcttttccttggttaggtttatttcaactcttgtgtgtactactacacaacctcccagacgttctacttatagcttctaccttctcgaagttgttctgaacactgcctttgaaataacttttctaaaatagacctatgccgtagttctgaagagccttgagagcttcccactacacagagaataattttagcctctccctgaaagcacttcacaatttgggcccatgacagtggccatgtcctcacacattccaccgaagccttctatttcctctaataaatcttcttcatttcttatacaagtcatttctttccccctggaatgtccttcctcacttcacaatgtctactctgaagttctgctatactttttaagacctagttcaaatatcacccaacacaagaagtgtttccaggttcctttccagctggaataataattccacactgctgcagtaattatattcattatgtttgtactagttgacacctgtattaaagaatcccctataattctttcctattttacatatatctatgtttttgcacccccccccaaatgttagtttctaaaggacagagtattgttttatatttattctttaattcatcaatactttctgagtttctattagatgtcagttagtggattaagaagaggagtcctcggccaggcgcggtggctcacgcctgtaatcccagcactttgggaggccgaggcgggaggatcacgaggtcaggagatcgagactactgtgaaatcccgtctctactaaaaatacaaaaaattagccaggtgtggtggcgggcgcctgtagtcgcagctactcatgaacccgggaggcagagcttgcagtgagccgagatcgcgccactgcactccagcctgggcaacacagccagtctccgtctcaaaaaaaaaaagaggagccctcttcctccaagagcctgactcagtatttgtgagtaatggctgcttaatcaactgttactaaattgttctaagttttacaattcttccatatatttctgggcacccttccccatcctgaaactcaggtaaatgaatattaaataagaattcactttttgtattattttatgtatactctatgatgctaaaatgcttatgtcaaatggaaaattattttatcaagtgacttaattgtcaatactatctaaaagttataggaaatattttaaaagcttataaaacaatagttgtatgaaaagctccttgtttgtatgccatactgaggtgtctctttctttggtggagttatggcaggtgaatttcaatattttttaaatttttgaataaaaataagaaatttttgtggggctggcttggaagtgctttgtttacaatggtcacatttaaaaatcaatacagttcattaagatagtgtcttccattttctgcttctatctcaatattgtgaatggtgattaaaaggaatagatataaaatcaaattaatgtttcattcatttcaactatagtattgtgtaatagtcttatatttgtaaaaaaaacacagcttgcaaaactatattttacaatgtatgttttttaaatatcttaattaaattggattttaatgaatcctttcagtcgtctaaatttaggcataaaagatggaaagggtggccaggtgtggtggctcacgcctgtaatcccagcactttcggaggctgaggccggcagatcacgaggtcaggagatggataccacactggccaacatggtgaaaccacatctctactaaaaatacaagtcccagctactgggaggctgaggcaggagaattgcttgaattggggaggcagaggttgcagtgagctgagattgtgccattgcactccagcctgagcgacagggtgagaccctgtctcaaaaaaacaaaaaacaaaaaacaaaacaaacaaaaaaaacagctagaaagagtatattctaaatgtgaaatgtagtcaaattccatcataaggcacttcaccttacaatgaattcatttatactgtaggttgtatcacatccctgtagggtccaatgggaatgagtccccttttctcactataacacttaggtccacaatgaggatgctttccttgtcaatccctgatataatagtgttgttccctatttgactatattcttcccttgttttctatgaaatcagctacatgttattatttcaccttttcaagtgacatatataaaactttcttgaaaacagaatttaaacaagagactcataaggcagataaaaatcgggtctattattagctggttaggcttgttcgggtaaaaaaaaaaatgcagtcataggcttgctcaccaatctcctacacaagtagaatggcctgtgttctagtagctcatgggtgtttctcagccctgactactcattagcaattacccagggagctctgaaacagaggtgctcagactctacttccagagggtcaaatttaattgatgagtctaatgtatagccagggctggcggccaaatattaagttcatgtgagctttatttggaaatttttcttgcaccataccatcatttagacacacagggaagtgtgtttatttcattgctatcccatgaccaccagtgtttgtggcagcccaggccaactaacgagaaccccaaagaaggtctgtagaaccaagggaaaagccaaagttgagaaggaaagaaaaaagaccatcagcaatcagcatggatgtgctggagtgctctgcctcaacttagacctcctgatgaatcctggaaactgtattacaatgacctagctgctgtgcaccacatccaaatttagagtgatcataaagaactcctcttacagaaaaaaacctgtgttcctctgagcagcaaagtaagaaaaggtaataaattttaaaaggcagagaggtagaaggggaaaaagagctgtagcacatagagagggttcacactgcgtgaattctcctctgtgcactccattatgcttcatgggcagtgattcatgaactacagaaatggtctcagagagagccactgaagaggctggtgagaatctgctgtgcataagcaaaaactccaattgaagctgaaagtaagtggatgcaaacttttttaatgaaaagaatattagctctaagcatgtgactgcttttagttcaatttcatgcaatgaatcatttcataattgaggccttctttaaaattagccagattgattaatgtacatttttctcattcagatgcctgcagtatgagaaaaatagggctgtaagagggcagagaaaggccagttcaatgtatgttgaaacaaatcaatgtagaaaaatatcttattcctctattacaaaatagatctttggtataaaagtaatcttttgggaaataagaaaatgcactatattcaatgtacttttcaactatatgatgaatttccttgcagaaataaaaatgtacaaaaattcatcatatagtgaaggaaatgtatttgtacttacagagtagttagaagactagttagttcatggagactagttaggaggccattgtgataacccaggtataaggttttaggacctggcctgggagagtggccatgggcatgaaaggaaagagaaagtataatgtctctagaaacaagactcacttaacatttatcaaggtcagagtattttcaaacttattgtatccaaggaaaacttgaaaactctgatatgaaacaaatgcattaaaagtttaactggcattgtcaacttaataagcttacaatgtagatcaatgggtctcaagtgttggcatgcatcagactcacctatacagcttatcaataaaatactgttttcagttcaacagatctgaggtgggggtccaagaatatgcatttaaaacaagttcccatgtgatgctgatgctgttagtttggggactacactttgagaaccactgacatagacagttatgtggatttccatgtgacatccttgactgttatttcacaaagtccatgaggcaaggaaacacaaatcaataaaagcaggcttttatataaagcacttattgctagtaacagttctaggtacttgatgatatgatttgagtgattgcctcctccaatactcatgtgttggagacataatcaccaatgcaatagtattgggaggtgggaactaagaggaggtatttaggccatgaggatggaaccttcaggaatggattaataccataataaaaagggctttttggagtgggttcacccccttccactcttatgccatgtgaggaacaatgttcctatcctctggaggatgcagccttcatggcaccatcttggatgtggggatttaccagacaccaagcccactggaaccttggtcttgaacttttaaacatccggagctaagagaaataaatttctgttctttataaattacccagtcctatatattctgttataccagcaccagatggactataagacacatgatatggattttttaaatatttgtcgaattcattagatcattaatttattcaacacatatatattgagtacctcaatgaattgggcattgttctatgttctgaaaatgaaagcgtaaagagaagtgatgacaaagtctcttacattctgcaaggaagagatagatgtctataaaacaagtaatagatatactgtatatagtaggttagagggtaataactgcatggagaaaagtaaaacaaaataatggtattagggattaactttaggtagaatgatcaagaaagtcttcactgagaaggtgacatgtgaataaagttctaaagaggagaggatgggaaccaaggaaatgtcttgtggaatagcattccaggcagaggaacagcagatgcaaaggccctgaggtaaagagtccttgcaatgtttgaggagcagcaataaagttagtgtgactggagtgaaggaggaaggagataggtcagagcaataatgaggtcagactgtttgggaccttgtaggccattgtaaggactttggcttttactttaagtgagatgggatgttattggagagttctgagcagagaactgaaatgatttgacttacattttaacaaggtcactctgcttattatgttgaagatacactgcagggggcgataagcatggaattcaagtgtctaagggaggttaatacaatagtccaagaaaatccactccttgtgggagagaagagtgaaagagacctatcaagttttttgtttctttttgttttaattttttttttcagatggagtctctctctgttgcccaggctggagtgcagtggtgcaatctcggctcgctgcaacctccacctcccaggttcaagcaattctcctgcctcagcctccttagtagctgggagtacaggagcgtgccaccacgcccagctaattttttgcatttttagtagagatggcatttcaccatgttagccagggtggcctcgatctccggagcctgtgatccgccgcctaggcctcccagagtggtgggattacaggcatgagccacctcgcccggcccctatcaagttttaacagtaactttctcccctccctgttccacccttaacatttaagatggaaattaacaaagaaggatcatggatcatgcaaacaaaatgaaagcatgcctttctctctctgccctctattgccctctgatggcaatgtctagattattcagaacaaatctgtcctttagaatattctaacaagaatgcagtctttcttagtagcttctgtccaccatattgccatgcagtgtctttcacgtacacaactgcaacatattttacctccctgggttacatgatggttactcatttaaagtgtcctatcagcacttcttttacttttaatgataattcctgttcctcttgggccttctccaatagtcctcatccatgctgatgcataagtctaagaggtatgatgtaactgacactgccattacagtggcacatatcaaagacataattcgaatttcagtcgttgtggaggtttgaatctgggcttggtgttctatcttttctaaatatattttgatcaactaaatcactttgaaggcatctgtggcaaataatatagataatttaatggtcatgggaaataatttgaggaaaataaaatatgttattaaatataagcttatttcatgagaaataatattattatatcaaagaaaaatggttgtttttatatgcgcttaattatgaaattgataatgttttatggtgtcttataaagaaaattaaacacttgttcaggcttttgctcagaactagagtcatttgaagtagtttttatgaataaatgaagtttccaggttttgacaaatgtttgttgaatgagtgcacaaaataacaaatattcactcagcaaatacttatatttgcaatgcactgggcattgtgcggacttcggagatgtaaaagtgactaagataaaatgtattcctgacaaaatgctcacaaattattctgggatcaggaatgtaaacaacaattaccatctgtctataaacatcatgctgtggaagaacaaagaaagaagctggtaatgttggttggagtcaggaaatgttcctaggaaaaaaaatggcctatgagtagagcaaaaatgcatccctttcagaatgtaaaactgaaacttgtatcttcctcctacatttactattattatttgaacaataacatgttgaatatcaagggagaaggactgcagagatattttggaaaggtgttgctatgatctgaaaagtttggtccttccaaaatgtatatgttgaaatgctgtccaaggcgatgaaaaggtgaggcttttgggaggtaatttggtcattgcggggaagctctcataaataggctatgtgcccttataaaagaggtccaagagagatccctcaccccttctaccatgtgaggacatagaaagaaattataatctatgagccagaacgacagctttctctctgacatgtgactgctatttctcctagtgcctacctagttatcagcagggtgtgtgtgccagtccgaatgcaaaggggatgagccaaaaaatatatagtaatataaagaacggatgtggtggaaagacaaatttggaagtagaagacagggattccaggctcagcctagatgttctctagtggtttggtactgataaataacaattatgaacttccatttcctcattcaaagattggcatggtaatacaacctaacttttagggtcatgatgagaatgaaatggattaacaaaagtttttccatagactatttaggctatgaaagagttaattgccaatatttctgtctcttaaaacattgctactaatgaatacctatggtatctaaacaatgtttgcctttgttttttacaggtatcattttcttatatttgaattgcattcaagtaatcttatacctgattacttgaaagtattattttttgaatactgttagaacccaactcaggaatagattaactgaagttcggtcaaaatctctctgccacacttataaatttaaagtgtaatattttaatatgtgtaggcaagaattcaacttctaaaatggccatatcataaaataaagaactaagaaattactactattttaacaatttcatatatttaggaatagtaattatcctaatgaagagaaacataagaaagtaatttgctatgattaaaacataattatggaagtacgaaaatatataatgtttaatactgatgtatttaacataaaatgagaatgttgtaatttttctataatctttcaaaaaaacataaaattaaagcataaaccattcataaaagtagtgtatttttcaaacatagcatcttggagtctctgaaatgggttactccagcttttaaaatttgatatatattttgctattttcataattcttttaaaaagtgtgggtgtatatatatgtataaaatatagaaagtgtagggggaaagtcattcgtttaacttgggaaaataatatattactatcttgtaaattttatgatatttatgatgcaagtgaagtgggagaaatggcatacagatggatttagagaaaaatggctggagaagaggaatgaagaatgagctcacagaattagaagaaactgttctccaaacagacaactgtaatcattagatacaaggaagtaggagaatttcctcccaatgccccactcctagggctgacaaagagaagacattctttctcttcctagaattagtttcagcctccatgatattctgggaagatggttttgaaactgtcaagaacattcttaaactttcactgatggtaaaatggtaccaaagaggacacaatgtgaaaaggattaagaaaacctgaaaaaaatgtttaatatggaaaccacaggttattacagttttgtctagcagtaaagcaaaacttgtagaaacaaaaaggattataatagtcacaataacaaaataataaaatataatcaaatagttaaataaaataatgacaaagcattaataatatttataaagacaaattttctgtatcatcagatttaatacatcatcagtcttacatacatttcagatatcattaagaaagaaaaattatttggttaagttgtaacaagaggctaaggcactgctgattgtaaagtgcatctcggttctagagagttaaaaatgtgagggagtaaaaaaggagtcagaattgacaaaattcggcagtccttcagagatagaatcctgggcttgtaaaatctgctttaagtgaatgattcaaaaagagaattttgttatttttggtgtccttaggaaaggtgtgtctaaattcacaagccagaaatctcattggctaaaacgccaaagatgttcccactgaaaataataattatccacgtttaatctcttacaacatcttgctaaacattgttatgcttatgttattaatcagagcaggaagtcatccagcctctccttattgctttaggatgttaaacagattgactataatatctaggaggagaacttactgtaaatctatcactataatgaaaaccgaatgctacagttccacattgctctgatacttgtgtcaccgacttgcactgataactgttgtacttgatatacataaaaagccccaaaatagcatacataattattattcaaaagaaaaatattatgcatagaggcctgttaggcatcacatacattgaatggaatttgaaatttaagatgatagtctgaagccagactacaattatttccaaagcgtggactctgcagataatgagaaaggcattcagaatggtttatcaacaccttgctgcgtgcatggtgtgctccctgcccactgtaaagaatgatgaagacagcgtcaaagtcaagacctgttccatcctgataggatataatgtccattatcttgtggcacggaatcttaacatggatctctaaatgccgaaagatgccaattggagtgcaaagtctctaaatactgatcacaagtttggggcacaatcattctgaaaccataataggttttaaacatttgccaaagccacaaatttgacttttgggcttttgatttatggcttgtggaagcactgagaagctctgtttggcatacagtttgccttcctgtagaggtggttgattattccatagctgtgacttgattattcatgcattcaacatttattgagcactttttaaatattcaagaatatgtgctaaatgccacagatattggtgttaaaggtcaaaggccctgacctcaaggagctcacaattttgtagataaaatagaaaaataagcaattgaggacaatatatatagacatttatattaaggggaattttgagagcacagtgaagcagcattagaggcaaatataagtaactatagtttccagaatcatgggatacacaaactggatatttgggaactaactggagctagcctggggaaggagggagtgaggagtggggcattacaagtaagggaaatacctatatgcagcctggagtcttgagatacagtggagctgtgaggccactgctgtgggtggcaccagtagaatctacatcttttagaagcttctactgcattacaaggcaattatgctttatttcagagacagggagatagagaggggatgatgtcaaaaatttaagcagacgagggtacaattatatttgtactttatagtgatcacatttctatagaaatgtagagagtgattgcgaaaagagaagtcaataatagtgagagcagatgagacatgatgagggttgaattaaggtcacagcaataaggatggcaccttagatccatttctaagagagagatgatgagatctgatgactaattaggacacggggaatagtggcaaataagatgataactcctagaactatggcttggatgacctggatgataataccattcactgagaggagagttttggcagggatgggggtggcgcaaatcagcacaggtggggagatgaaggttatcattatttggaattgtggaatgatgcctgtattagtccattttcactctgctaataaagacataccctagactgggtgatttatttaggaaaaaggtttaattaactcacagttccacatggctggggaggtctcgcaatcatggcaggaggtaaggaggaacaagttgcgtcttacatggatggcagcaggcaaagagagagcttgtgcagggaaactccccctaataaaaccatcagatcttgtgagacttattcactatcacaagaacagcacaggaaagacctgcccccatgattcaattacctcccacagggtccatcccataacacctgggaattcaagatgggatttggatggggacacagccaatgcctgtgagataactcaatgccattgagatctcaatgcctgtgagataactgaagaagacattctagacggtatcaggaggatgatctgggccagacgcagtggctcatgcctgtaatcccagcactttgggaggctgaggcaggcggatcacttgaggtcaggagtttgagaccagcctgaccaacatggtgaaaccccatctctacaaaaaatacaaaaattagccaagcatgatggcatgcgcctgtagtctcagctacttggaaggctgaggcatgagaattgcttaaacctgggaggcagaggttgcagcgagccaagaaagcaccactggtggcaaagtgagatgagtgagactccatctcagaaaaaaaaaagaaaagggtgatctggtctggaggtacagaatgctaatgtatatctacattcgcttatgtgaaaacgtcacagggaaaaatctttctgacttctgtgagaatgatcacctgtttctctacctatagtctcttctcaactacgaatagataaaccaaacattttttttcccaatgcacctttaatcccatggcttttgctgaaacttggcatttattcaatgaaaccactttccacacaatcctctttgaagagtccttatctccatgattcattcttaaggccaagagggaaggttggctttcttgctgaaaccactgttcccatgagtccactagtgggacatttaacttcagttttaaaaggatggcttccttgggtggacaagggggaaaaagcattccagacagagatcagtgtatacaaaaactttgagtggtagaggtatatggtaggtttgaggaaaagcaaacagtctggtatgacatatgactagcatgtagaatgatgacagaattttaataggagccattggaattgtatggaccatgcttttggaattctgtgagcttcttattctcagtcaccttcatctttattccactgcagccatacattgatccaatttcaagttagaccctggcgtcattcaaacctgctttacaacagaaattgtcaccacatcctgaggcttctcatttcctttctactattgaatttttagcagaacctctgtcgcctggcctttccatacccatactctctctcactccttctctatcttgacatctccccaacaatcatggacttaatgagaagcatctcaagaatgtgtctgtcattgctctctaaacattcttgtttttgaccttcaactttccagtagtggaaagccccattttctaccttcttctcgtctagctgtaaagctattaatccacttcaaatatttattacctaattttagctatatatttgctattgctttgtggctttttctacattaattgttgatttttttaaatggtatttgacacgctggctgctccaaatttttccagtctctatattttatactcccagtaatgtcatttatatttattgataagtgaatttaaggttattctaaattctcttttagagttgtctttgcttccagtcacttttcaaacattttttattctacctaccctgaagaattaagggtggaatgcaggaaatgacaaacacactatagtaatacctaccattgatgtagcatttactgtatccaacctcgttgttagtagtgatagagcagagctcagtcctggatggtctgtcaaaaaaatttatgttctttccactcttccatgaccttagttatgccaagtaaaatagccatggaaaatctcattcacagactgcagtagaaatagctaagcctcaaagagcaagccacttacctagaaacaagtgctattgcaaaaatttccattttcaccgacataaatttagagttttttattttttaaaaaacaatcaaatttaatatgctagcttctcttttaagttggttatttgttgaatctagtaacagttgtaaataatagatggtgttagaatatcctgctgcattttctgtagagaaaaatgggcacaaatcaattgaactactactgacttctgagttttttgaaagtcttttaataccattttaatatataatttattatttggggttagaaacaaagaaataaagatggataagtatagatattcttccttttgtgtcttttaaaacctgtatgcaaatgcaattattgcatatcaaatactattttggcacttaataaaatagtttgttatttaaatactactacaacttgtataaatcataaacttattttgcttagcaaataatacctactaattttggggggataagtacagtttttttttaacataacattaccttaaaatgaagtgttaatagcttctaatgatgccattaattacattgtcaccagtttttgtatttaagggtagtattttacaaaaagaaaaattaagataaaaatgtctatgcaaaatgagcacttagatcaataattgcacattatatttgtacaatagattttttgtggaaaaaagtgttttttctctagcaaatacttagtatgtatcaggtactgctataagtacttttgaacacatttaattagactaagagtcctatgagataattaccactatcgtctttttcacatgaggaagctgaaacatggaaaggctgagaagcttgcccaaggtcatacagctaataagtggctgtgccaggatcccgacccaactgtctggctttggagtctgagctcttacccactgttctctctgctcctttactaaattaagtgtttaaaaataatggaaaaacatcgaccagccacttttaggcttccaacaaaagtgcagttaacaataaactttgttctaaaaatgacttatttgttttcacggactaaacaccacaagctgttgtatgcaataattctttgtaacagctgctctgccttgtgcaacttcccacaagcacaccaaaagttaatatcaattacaattaagggggaaagttattttgggtaacagaacatttgacaagtgctctggtaaacaaagcattgtcaaattgctaaattatgaacactttgctaaaactttttctgttttttctgtgctgacttttttaaaaggtgtaaactgtgaattggaaattgacgaatgttggtcccagccttgtttaaatggtgcaacttgtcaggatgctctgggggcctatttctgcgactgtgcccctggattcctgggggatcactgtgaactcaacactgatgagtgtgccagtcaaccttgtctccatggagggctgtgtgtggatggagaaaacaggtacattttctctggcgttgggtgattggcttagaactccctgaccatgaactattttaccactctgttgaatttagagctctcacgttctcggcttaaaatttggggtgtaactttatactttaactgatgaaaacattcagatttcactaaaaagggtattcttggagaccatctgtctcaagagggaagattttacaagtcattcttgtaatagtttagaactgcttatcctatggaaaatggccaatttttcaattccatgaaataaagctgttgtagataggaaaggtgcaaaaacagagctagagattattatatatgtgtacataagtttgtatctatatgtcaaggatataaatcagatgacagcaataaatccttttaaagtgttatataaaccatgttggaaaaggcagtgatatttaattacttatatcttgaattaatttccatgtgttcagggaattgggtgaatatttttgagaaagcataatggcgagaaatagccatgtgattctgcttcaaattgaagtctatcattggctttcaggcaaaatagaacagcaataaattacatctcaatatgatgaatataataaatgtgtgtaacagtaattgagctcatataaaacatttttaaaagaactttctaatacttatttaagccacgacactgaagaactttctaatctttatttaagccacgatgctgagttaccaaatacataacaatttttaacaagattagcacttaaaattatcgtttgattcttcgacagctcagtggaaggcaagataagtatttatgtttccatattacaataaggagtctaaagtttagggaaatgagaagacgcccgcaagttcacacaattaattctttgcaaaaggaagaccagaatggttttcctttatttagtaaataagacataatttatgccaaatctaatttcaaagtgaatcagagtcaaaaggagagcaataaaaggcacatatgcttcaaaaatttgcaaaaataatgacttttttttttttttttttttttttgagatggagtcttgctgtgtcacccaggctggagtgcagtggtgtgatcttggttcaccgcaacctccgccttccggttcaagcaattctcctgcctcagtctcctgagtagctggtattacatatgcccaccaccatgcctggctaattttgctatttttagtagagatagggtttcaccatgttggcgaggctggtctcgaactcctgaccgcaggtgatctacctgcctctgcctcctgaagtgttgcgattacaggtgtgagccactgcacctggctctcaaattttaatagaacaatgtggttgtacattctttttaaaatataacttttaattacattccatgtcttgcctttgacttttagttgtaccccaataatgctctaggggcataaatctacattcctggagacaggtaactggccaacacagagacagacaggtcacaatggaagtttccacacaaggcctcctagaggaaaaggaggcttacccttccatacttcactgtttccagaaagcatcaggacagaaacgacacaactttttgattccaatggaaatgtaaacaaggctgaaactttgctatcttttattctcctcacttgaatatgccatgaataatttccctattgtaccattatctcttattgcctaaatgttgagatgatagtcataagatcaatccaatataacctgactttatgttcccacaaaaatttaaaatgtttgctatgagatacattggaaaatcagaactgaaaaaaaaaaaaagaacttcttgcataccaaaggaattatgcaaatggagcttctaattccgtgaggtccactagtcagccagccaagccctttggcaacagggtttttgtcgctaatgttttacctatactagatttttagtaggtattttttaattgaacaaatggaatactgaatagatttctaacaacacatatgaagattacagtcacttacaatatttggtttggtgataaaaacacacacagccatagcgaagaggactctacctgccttataaattcatagatattcttttcccaagaccctcattttgcctaagctgagtgtgcaggtacattttttacaatactaaatccttgaggagaccccgacctaaattaaaagtctcctcttaataaaatcaacaactttcttcattagatttgtattttggggctatttgataattccagtcattccgttaataattagaaatagtaaggcctaaatattcttgcaatctaaaaataagagaacatcgtaagtcacaattcatttaataaaggcttttcctgagtttttcataatttatggtttcacttttcatatggaaccttattaatgggctctctgtataacagagtgccatgatggtataaatcattctctaccaccttaaaaaatattaacaattttattaagtgctatttagtagcaacatatttagtacttcagatatgtggaatactgtgtctattctttatatgcatacttaattgtcacaataaccttgtaatataggtactatattcaatttatgaatgaagaaactgaactaaatagtcatggtttgcatgaccctgtactttaaattttttaaagttaataagacattaatatggaaataaatcatgcattcagtcctgtatagataattccccagagtttttgaggtagtaagatgatgccatgggtcttgggttgatagacagttgaagaaacagtataaagatatctgatctcaatatgactaagagttgacatgaaaatttcatttactttccagatatagctgtaactgcacgggtagtggattcacagggacacactgtgagaccttgatgcctctttgttggtcaaaaccttgtcacaataatgctacatgtgaggacagtgttgacaattacacttgtcactgctggcctggtgagtgacaaaataccttccaccaattatttttcatttgtttagaatacacatatcgcttatagcaaatgaaatgaaaaattattgttgttaaatgttttaaatcaatttcttctagctaatattgtttagttttattcttcagtgctcacacatatttactgctatactaaatgttgtctgaagtaggttaccaagctgcccaatgatcataaccctctagaggaatagaagggaaaaatcaatggaaagatgaaattcagcatgatcttcatggagaaaaattcactggaagatgctcttttcttccaagatgttctcttatatggcaggaatatatagaaatccatgaaataatgttaaactattagaaacttgtattctcttaggcatttgtaaagagttatatttgttaatataataaaaagttaattatctataaaccataattaaagtttacatatagaggataattagacgagtatagaggtgatacaagaatcaatagaaaacagtatgtaacatttgtgttacattacaggccataggcaaatattgatgctaattttgcaaaacaaactgcctgacatacagctttgcattgcataacaacattttggtcaatgacggaccacatatacaaccgtggtcctgtaagattacaatagagctgaacaattcctactgcctagtgatgtcatggctgtcttaacattgtagtatcactcactatccatgggattgtggtggtccctcaggaagtattccaaaagaacgcattgttgtcataggagatgacagcttcatgtgtgttattgttgctgaagacatttcagtgggacaagatgtggaggtagaagacagtgatattgataatcctgactccatgtaggcctagactatggtgtgtgcttggttcttaatttttaataaaaggtttaaaagcttaaaaaattcaaaatagaataagatgtaaagaaattatttattgtttatttatttatttttattttttgaaacggagtctctctctgtcgcccaggctggaatgcagtggtgtgatctccgctcactataagctccgcctcccgggttcacaccattttcctgcctcagcctcccgagtagctggtactacaggtgcctgccaccatgcccggctaattttttgtatttttagtagagacggggtttcactgtgttagccaggatgggctcaatctcctaaccttgtgatccgcccgcctcagcctcccaaagtgctgggattacaggcataagccactgcgcctggcccataaagaaattattttatacagctgtacatgtgtttgtgatttaagctaagcattatttaagagccaaaaggtttaaaaatttgaaaaatttataaagtaaaaaagttctagtacactaaggttagtttttaagacagaaaattttctaataaacctagagtagcctaagcatacagtatttataaaatctacagtagtatacaataatgttgtaggctttcacattcattcattactcattgactctcaagagcaacttccagacctccaagctctattcatgttagtaccctacacaggtgtaccacttaaaaaaatcttttatactgtgtttttattgtaccttttgtatgtttaagtatgtttagatacacaaataccattgtgtttcaattgcctacagtattcagtacagtaacatgctgtacaggtttgtagcctagcagcaatagactataccctatagcctaggtatgtagtcagctataacatttaggtctgtataagtacactctatgattttcacaccatgatgaaattgtgtaatgacttacttctcagaacaaatgtttgtctttaagtgatgcatgactcttttttaaaatctaattctcattaggattttttgataaaaataaaagacacagcatctcctatctcctcttgctttatttactgggaaaaaatgataaacttatgattactcaaggcctagttatataagcttactgatcatctgtctctctctccccactaactttattgtctaagaaaatgataatcttgtgggtggaaaggaaacctggagactagtcaatctaatcagtagtagcttctggttgaaagatatcctattgcctaagagacatttaacatctttggttaaatacattttataggaaaaataaatgaaaatataaaatgaagtttggaatgctgtggcttggaaatctatatatgttatgtcttcccacttgcagataataaatgaggaatatttgctaacctttggtcatcaacttgacttaaaactgaaaatttggctgggcgcggtggctcacgcctgtaatcccagcactttgggaggccgaggcgggtggatcatgaggtcaggagatcgagaccatcctggctaacaaggtgaaaccccgtctctactaaaaatacaaaaaattagccgggcgcggtggcgggcgcctgtagtcccagctactcgggaggctgaggcaggagaatggcgtgaacccgggaagcggagcttgcagtgagccgagattgcgccactgcagtccgcagtccggcctgggcgacagagcgagactccgtctcaaaaaaaaaaaaaaaaaacctgaaaattttccaaactatgtagtttcatgttcttgtcaccaaccaacactcatgaaagatctctgtccagaagcagagggcggagtggatggtttaggagtaggatatgtttcctgtttattaactgagtgaactcgggtgagtttcctcttcatctctaagttcctcatctgcaaaagagggataaaaatactttacttgtagtattattatgaaaagtaaaattgtaaaaatagagccttgcacatattaagcactcaaaaaagggcaactatgtagcaaattctataccatgaggtggaaattatgtaggagggcgagagtttgtaatggagtcaggcagttaagaacatctacctcaagaaacccaattagtacatgttccattcattcatggattcaagcatttaagccacatggatttcagtggctaatacaatagggatctgggaatataaaaggtatcgtcccttcctccaaggagcctaaattctagtagcgagacatatgtcaaaacgtatatagtacaatttttggtacaataagaggctatactaaattctgtaaaaatgaatagagaagaagtgcagggatagcttgatcaaagaggcaccattttagataagctaaagatgactaagttccataaatgtattcactagctgtgtgactttggacaaattactgctctgagcctcagtttcctcatttataatatccacaggatggagctgtttcagagataaatccagtaatgtatataaaactcctggcttatcctggaccacagtaagcactaagtaaaagttaaataaatatcaaaattaggaagttgtgtagtccattacttatttaataaatgaagaacggaaggagaagaggaaagaaagaagcaagaaaggtggcaggcacccatagaaaagagcatgtctggctgggcgccttggctcacacctgtaatgccagcactttgggagaccaaagcaagcagatcacttgaggtcaggagtttgagaccagcctggccaacatggtgaaaccccatctctactaaaaatacaaaaaaaaaaaaaaaaaaaaaaattagccgggtgtggtgttgcatgcctgtagtcccagctactcaggaggctgaggcaggagaatcacttgaacctgggaggcggaggttgcagtgagccgagatcgcgccactgcactccagcctgtactccagggcgagagggtgagacttggcaaaaaaaaaaaaaaaaaaaaaaggagaagaaaagaaaagagaaaaaaagaaaagagcatgtccaattgtggaactttgaatgattgcaaaaatactggactgtgtagggctggaggtagaaacattgaactggggagcaggactaaagccagatcacaaaactccatatctgccctgccaactacggggcagagaaataacaaaatttgctttgttaatttcaaaagagttccctggcttcatggcagatgatcaaagaaaataacactaaaggcagggaaatctagtgagtagattcctaggtagtttgaagagatgagcctgtttgctagaacgaagacaacagtggttaaggttggggcgaggggtagtcctgagagtcacataggagctggaaatgatgtggggagtgagaaaagggcacaggtttaggacagttctgcctctgggtttctgccttgggttactgcatggatggtaattttgcctagatagaacatcctgaatacccttgtaacctatcttgctgttgtatacaaagataaaagttaacactacaaactactctatatctaagaaaaggagaccatttcttcagctcatgacttcactgccacagaacacaatggcaagaatccactgatgtaattgcctagggtcctcatttcagaagtaattaataattacaagaagtgtcagtcaccttaaatgcttactttcaaagatttcctgatgcccagatgtgattggaattgttaacaaacataatataagaaccccagggatgtgactcagtatcatgttgtttatttgttcagagttttacagaaaaatttgttaaaactattgaatacagtcttgactgaaggagtctatttatatacatggttaaagaaagcagcaaataaaatccccacagggcctcagtgttggggacaggactggcaagactataaatcagaatcttcctaatgttcacgattggaatgagataatgcatgagccagaaaagcaaaaaaaggatttatgatgattctaaattactccctaacctggcttatgtgtgtctcgagtcttagaatgagaagaaaattgaaaatagtccagcctttcttcaataagtccattgtggcacaacaaataccagttaataaaaacttattgtaaaaactattatttaatgtatttgaagaaccttaagtatgaaataataatattcaaaaggtagacattcaagtttaagagactctgaatgatctttgttgcggggggtcactacaaaggattgttgggtcttgatctgacatgttattttactttcctttttttttttttttttaactttttgactctaagtttcttcttcagattgttgagaaaggccccaagggtctttttgtaaaaaatatattacactgttgagctgcagaatttatgttgtggttatgatttaacatatgatctcatttaggtgtttattaaaactaatacaaaatgagcaaacacattacaatctcattatttgcttattaatagtcaattccctggtttatgtgctaaactaggattataatctaaattgttattttcaatctttgagtagtactagtgattgaaggtctactgcttacatattgctcagtcctggactggtaaataaaatgaacacagtctctgttttgtgaagcacacagcctgctgagggaggaaaccatatacacaaatcaatatatatttaaaattacaatgagagcaatgaaagaaaagaattgggtggcatgagagaaaataaggggatcttatttatatctgcccatgatggaaagttattctgagaaagcaatacaagataaagtctgaaaattgagtaagagttagccaagaaaacacttgaaggagagttttctagaagagagaaaaacatcacgaaggctgtgggaatgcagggagtttttacagttatgttaaggatgttgaattcctttctatgtgaaaggggaagttgttgaatgattttaaagtaaacacatactatgatttagtttacaagttttataattctcaactgtaaattgtttccaaaacatttctcagcagagttaaatgatattgcaaagggccttaggcgactgtgaagttgaattgtgtttctttaaaaatatgaggtggctcacgcctgtaatcctagcactttgggaggccgaggcgcgtggatcacctaaggtcaggagctcgagactagactggccaacatggtgaaacttcgtctctactaaacatgcaaaaattagccgggcatggtggcacacgcctgtaatcccagctacttgggaggctgaggcaggagaatcacttgaacccagcagatggaggctgcagtcagccaagatcacaccaatgccctgcaccctgggctacagagtgagactccgtctcaaaaatatataaataaaaaaaaaaaaaaaaaaaaaaactttatacatttcttttaccacgttacaaaacacttgatattatcctattgaccatcagtgttatatgtgcatcctactaaatttacattttggggcgagcagtatacatagtatataaatactcttacaaatcaatatggaaaacaacctaatgaaaaaaacaggaaaaaatatgaaatggtaaaaaaaaaaaaaaacacccccaaaatgttcagctcaatattaactggggaaaacgtaaaccaaagtaacagtgagatactatattttatccaaccagctggtaaaatttatatatttggtgatagcaaaggttggcaaacgttttgagccacattcacaatcatccactgctggtaatgtgcaaatggtacaactagagatgtttggcagcttttattaaaattaaaaatgtacattacttatgacccacaaattccatctctaggcataaactgtagggttaaactcaaaacgcttacacagacagccatgtataattgtgtccgaaattggtgggttgttggtctgattgactcttcaagaatgaagccacagaccctcgcagtgagtgttacagttcttaaagatggggtgtccgcagtctgttctttctgatgttcggacgtgttcagagtttcttctttctggtgggttcgtggtcttactggcttcaagagtgaagccgcagacctttgcagtgagtgttacaactcttaagatggcacgtctggccgcgtctggagagttgtttattcctcctggagggttcgtggtcttgttggtctcaggagtgaagctgcagaccttcatggtgagtgctacagctcataaagtcagtgtggacccaaacagtgggcaacagcaagagttatttcaacaagcaaaagcacaaagcctccacagtgtacaacatgacctcagcacgttgccactgctggctccagcagcctgcttttattcccttatctgccccccgcccccccaccccccccccccgcccacccccccccccccgcccacccacccacatcctgctgattggtccattttacagcgagccaattggtctgttttacagagagctgattggtccattttgacagagcactgattggtgcattttcaaacctcgagctagacacagagtgctgattggtgtatttacaatcccttagccataaagattctccaagtcccactagattagctagatacagagtgcctattgttgcatccacaaaccttgagctagacacagggtgctgattgatgtgtttacaaaccttaagctagacacagagtgctggttggtgtatttacaatcccttagctagacataaatattcttcaagtccccaccagattagctagatacagagtgcccattgggcatccacaaaccttgagctagacacagggtgctgattggtgcatccacaatcccttagctagacataatccgtactagactcaggagcccagctagcttcagctagtggatcccacgcaggggccgcaggtggagctgcccgccagtcccgcgcagtgcgctggcactcctcagcccttgggcggttgatgggacccggcgccgcggagcagggggtggtgctcatcctggaagctggggctgctcaggagccctgggggattgcggggggctcaggcatggcgggctgcaggttccgagccctgtcctgaggggaggcagctgaggcctggcgagaattccagagcagcactggtgtgctggcactgctgggggctcctgcgtaccctccacagctgctggcccgggtgctaagcccctcaatgccgtgggcagcggcgcccaccggccgctctgagttttgggccggcaagcccacgcccacccagaactcacgcagccccgcaagcgcccgtgcagcctcggttcccacacacatctgtccctccacacctccccgcaggctgagggagccgactccattctcggccagcccatagaggggctcccacaatgcaacggtgggctgaagggctcctcaagcgtggccagagtgggtgcccaggcccaggaggcgcccagagcgagcgagggctgcgagggctgccagcacactgtcacctctcataatgatattaattgcaacatcacaatagcaaaaatgtacataaaacaaaggttaaactgtaagacaatggttaaggcatggcacatctatattctgaaatacttggcagtagttataaattgtgagttagatctatattactaacatggctagactgtgcaagggagtgaataaagcaagttgctaaagaatgcagataatacagttccagttatgttaaaacagtcacatacactaaaactgtatgtatttcttacagttgctcgtatttataaaagcaaagaaaaagttcaagtagagaactttcattgatatttaatgttttaattatctataaagtgacaaatcatgttttactgttcttattcctggtcctaataaaataatccagctaagtccatgcaaatttaaaacaacctcttattctgtttcattgaatgctatgaaataaggatttacctttactttgagttttaagagaatttagtttggttttgtggatatttgctgacttttcagctattgaaatatttttaaatacaaattcacaaatgagtatttgaaaaattggaggctttcattaaaatgttcaggttaaatccaggttatcctgacatctaattttatttcaagtcttattaatcaaatttttctttaaaattttttggtcaaaattatttaagtgattttactgatactagtacttgtttccactaagcctcctcttaccagattccccttaccagctccttgagggcaggcacatcaacttgctaaatcaatgccagtatagcagtcaacctccttttaggcaaatgctctataattcaacacctttgacttagcagcttctctgaattttcatcatgcaggatacacaggtgcccagtgtgagatcgacctcaatgaatgcaatagtaacccctgccagtccaatggggaatgtgtggagctgtcctcagagaaacaatatggacgcatcactggactgccttcttctttcagctaccatgaagcctcaggttatgtctgtatctgtcagcctggattcacaggtgaggccaaggagatgggatatgacttgactttctggtattttatggcagaccatggctttaaccaaatggtgtattagcaggaagagctgtactgtgtaaactctgctgctgtggtgcaaagggtcccccttgtgggcatgaaaagtatcttgtttcacatttcagaattcctcaaatcacgagagaaatattaaagagggataaaggaggaatgaaagggatgacatttttatatgctatactgggaactggagtgcatctcaagttctttacgttacacacagaaaatgttgaaatttttatgctatcaaatttgataatgatgttaaattttatgttattcaaatttgctagaaaagttattgtacttatatttacactgggaaaaatgacctagtctcaagtaatcttcctcaacgattctgtagctaaagtcattccacatatcaaatttaaattactctttttttttcacaacttgcttacctaaaacccagaggaaatttgcatgtatgttatccaatgaacagttttgtattgtctgctttctgttctgaaaattttcagaattattgaggcattccccaattcattaatggctagcaatttacctacaattgcattgatatcactgagaaaaccaattacaatctagatctctatcatatttctttctcaatagattaagtgatgcctctggaaaatatatcagttgttgttgaggatttctgagaaaagtaaatgagaaataagaaaagaagggggtgtctatttacacttaggattctctttcaatgtttcagttttgaaatttaatggtctttgatttgtggcagtgtttgctgcaaggtcgataaaaaaaatgtttatttccttattcactgacctttcaaggagaacatacagtaaaaaaattccccaggtgtcaatatcaggaaagtggtattttccctgaacaacttctatcatgcatgctttccaccctagtttaaaaaatgcatccaaataaatcttgatgtgactcaactgattaaatgcatgaaataaatcttgtaatatataatatttcccaattatgtaagctgctagaaataaatatgagatctgcaaacatacaggtctttctgaaatatatttgtgtatttacctcacctctggggatatttaaatttcctgtttctgtttcttactattgcctcttttcaaaaatttgtttctaaattatttgattttggtctagtgtatgcattttcgtcagctactttatatttttcttggaataaggtgaaggcattataaattattttttaaatattggttttagggtcataaaggggtgattctgtgaaagtcaaaggacattgctaatattacctcatcaaataaaaggaaatgggtgaccccttgaatctgcagatctaaaaggagagacagtagaatgttccagaaaagtgttgggcttgatttctgaagagctgccaggaatgactatatgagttaagatgtcctgactgccccaaatctctgtggcttaatgcaatggtttatgttttactcatgtgaattccaaaactgggttcccatcatcagttgtcctacaaatggcaattcagggtcacaggctcctctatgtttttcccccgcttcaaaatgttacttccaaatttgctgtgctcttatgaagcaagctactggagaaggaaagaaaatggagtgtgacacctgcagattttatgggccaaccactacaagtaatgaatatctcttttacccacatattactggtcaaatgtaatcatgtaactacatttaattgcagaaaagacgagaaaatctagtctttctgtgtacctaaaataaagagaaaataagttttgcaaacagataaccaatttgacacaatagctagaactggtacactggggatacgaacctagatcttctgattctaagtttatcctcctgcctactatgtcacatatttttatgtctacacgtttttctatattttgtttttaaataactttttaaatgataatagtatatttatgtgcagttttaagaaatacagggaggcccatgtatgctttacctaattttcccaatagtaccatgttgcaaaactatagttcagctatcagacttgcatattgacattgacaaagtccacatccagaacaattatcatcacaaggatgccacctctctccttccctgcctcctcatcccttatccctggcaaatactaatctgttctgcacttgtataattttgtcattccaagaatgttatataaatggaatcatgcaatatgtaaagttttagaataagagtttttttttttttccactcagcatcattctttggagatttattgaggttgtgtgtatcaatagtttgttccttttcattgctaagtaaaattcgatggtatgtatatatcaaagattttttaaccattcagccattgaagggcatctagattgtttcagttttcggctattaattcataacagccgctgaataaagctgctagaaacattgttgtacaggcttttgtgtgaatataaatattcacttctctaaggtaaatgcccaggagtaaaattgctggttcctatgatagtttcaggtttagttttctaagaaactgtcaaactgttttccagtgtgtctgtaccattttgcattcccaccagcaatgtacgagtgatccaatttctttgcattctcaccagcatttaatgttatcactgttttttttaatagtcatgttgataggtatgcagtgatatatcactgtggttttaatttgcatttacctaatgcctagtgatgttgaacatcttatatgtgcttgtttgacatctgtttgtcttttgcaggaaaatgtcaccccatgttttttgcctatttcctagttgagttgtttttatttttttaactgttgagtaattttccacatacagaccctgggcgttttttgtgaggttatacctaagtatttcattttcttttgagggatagtaaatagtattctgtttttaattcagtttctacatattcattattagtgttgggaaaggcagtattgtgcatgtggcctttgaaacccctactcagccacataagaatgggccttgggcctagaacacttccttcccaagagataaagcgtcctcgcagaccatgctggagttatcaccttgtgtgggaatatctttccctgtttcagactcaatatgtactccctcgttctgcttaaacatatgtatcatatggcacctagccagccccactgctgtaactttcttctgcggggagggcaaaaggttcttctgctgcagcatgaaatggttgcatgctgccaactgccccgcatctgctgaaaggaggccctgctgtttatggggactgcttatggggtcaccacatagctgaccttgctctgtctcttctctatgtgagtaaagcattgttccatctagtacttgactgtgttgtgttttccttggtaactccaatactaaaatgcagtggccaaacgtgtccagacttttactcctggtaataagcaacagatgccacttgccaaagagctagaacataaaaatatgattgtttcttggttgttgattgtgtatagtgagactttgtttaactcacctatgagatctaggaattttctttttgtagattccagggcattgtctgcatggacaactatgccatctgcaaagaggactggtgttatttcttcctttacaatatacatgctgtttattttactgtgttgagtacgagttgtgagagcagacgtcttgcttcattcaccattttagagggaaagcattcagtcttttaccattagctatgaatttttatcgatgctctttttcaagttgaagtagttcctctctactcctaacttgctaagagtttttaatcataaatgggtattgcatttggtcagatgcattttctgcaattgatttatcatgtaagtttcttatttagcctattgatgtggtagattgctctggttcattttcaaatattgaaccagacttgcacatctgaaataaatcccacttggtgtattttttttcagtttgctaatattttatgacttttttgcttctaagttcatgaaagttattggtctatagttttctttctctctctttttttttttgtactgtctttgtctggttttaagatcaaggtagtattgacctcataaaataagttggaaaatgtttcttaattttctattttctggaagagagtatgtaaaattgatgttaattattctttaaatatgtagtagacatattcagggaaatcagctgatcctggagattccattttctggatcttttgaattgcaaatttaatttcagtattgttatgagactatcaagaatacttattttcggcaatttgtggatttcaagggattggtcctttttttttctaaaaattgtgtattttgctgtcgttggatggagtatttctatatatgtcaattagatcatgttggatgattgtagtgatcggatcttctatattgctgatttttctgttgaacttctgagcataatgttgctcataatattgccttattactcttttaatggctacagaatctgtaatgatttctctgttttattcctaattttgactatttatatcttttctccccttttatgtccacctttttacaggtttatcaattttactgattttttttaaaaaaatagcttttggtttcatttattttctctgttttcctatttgcaattttattgatttctgttcttttttatatccttatttctgtttgctttgggtttattttctgttttttaaatttatttttatttttctagcttcttgaggtaggaagttttattactgatttaagaccttttcttttttctaatatataagcattataaatttaactctcaatagtgcttcagtagctgcatcccacatattttgatatgccatacttccatcttaatactgttctgtgtatttttaaaattcctttttgacatcctttttgacctatggatgatttagaaataagaattgaattgtttaatttctgtttagaaatttttctcttgtctttctgttattgattttcagtttgatgccattatgattagagaacacattctgtataatttcaaataattcaaattatttcaaatttgttggggtttgttttttggcacaggatacaatctatcttggtaaatgttccatggttgcctgaataaaaattaaaaaacaacatgtgttctgctattgtttagaggcgatttctatatatgtcaattaaatcccattgactgatggtgttgttcacattttgtatatccttactgatacagaatagcactgtctagcagtccattacttgtttagaggagaggtgttaaagtccccacctataattatggatttgtctctttcttctttcagttctatcaatttttcttcacgtattttgaggctctgttgtttgatatatacacatttagggtcattatgtcttcctggtgtgctgatccttttatcattaggcaatgattttttttctcatattcttttcttgctttgaaatctagttcatttgatattgttatagccattcctgcctttaaaaaaattatatttacacagcatatatttttccacccttatatttccaacccacttatgtcattaaatttgaaatgattttcttgtaaacagtatatcaaacagcaaattgttgggtcatgcttttttaattcatcttgccaatttctgccttttaattgatgtatttagaccatttatgtttaagtaattattaatattgtagggcttagctctatgattttattatgtgttttctgtttgattcctttctttctctttacttcctatgaattagttgactatttttgggatttcatcttgatttctgtatagtgtttttaaatatattactctgtgtaattttcatagtgattgctctgggtatgactgatcacagcctattggtttcagtattttaccacttcaagtgaagtataggaatttcacttctatttaggttttttttttttgccttcttcactttaaaatatccttgttttgaggatcagatggtgttataatttttattttaatcattacatataatttagaaaactcatgaaaagaaggatactccattgtgtttacttatgtgtctattctccattgtttgtcctccccaccttaggcctcaagagtctttctttttttttttaaatcattttatttaggtttacagagctttctttagccattctatgagggtaggtatgctagtgacaatttcttttggttttcctttgagaatgtgtttattgcacattcattcctgataagtagttttattcaatgtggaattcatggttgacagttcttttctcatggaacttgaaaaattctacacaacttttttttctgcaccccatggtttcaaatgagaaatctgctatcattgtaaagtggtgctgggtgcagggtttgggggaaggaaggccggctcggcaggaaggcaggtttgcaggcttttgctcccttttccaaagaccaacaaagagaactttcccaactcccaacccaagcccttttggaactgtgtgtggttgttggcatcctgtggtgcctccttgccatccctgccctttccatgcctggcaacgggtctttgtggctctgcagaatggagatttaaacccaagttcatggcaaaacatctgaagttcatcaccaggactgtgatggtataggaagggaacgtggaaggtgcatagaggaccctaaacagaatcctcactacggatgggctcactgaggacattaagcttcggcggtattatgagaagccatgcggccggcgacagagggaaagctatgaaaagtgccggcggatctacagtatggaaatggctcacaagatcaacttcttgatgcgaaagaatcaggcagatccgtggcggggctgctgaggcgggcagatccgtgggtgggctgctgaggcttgtggatgggacacccagtatgaaaccctcatccagttttgtctccatctcttttttttatacaatcccatttcctattacagttctgcaataaactcagtaaactcaaaataaactcaatatgtttgcaaaaaagaaaaagaaaagtggcgttgccctataggtaatagattatttctatctaactgctttcagtattttttctttgtctaattttcagcaatttatttgtaatatgacttggtgttaacttatttgggtttatcctatttgagatagtctcaccttttaaaatcagtagatttatgtcttttggcaaatttgggggcttgtcagccaatttttctttgcatattctttcagatccttttttatttttccccacttctgggactctaatcatacaaatattgggtcttttgctatgcttccagaggtttctgaggctctgtttttatttttgtttcagtctattttctgccttttgctcagaatgagcaaattcttttgatctgtactcaagttcattgattctgttcttttttgtctcccatctagtattgagcccattcagggagttacttcatctattgttttttacaagtctataatttccattttgttcttttaagcaacatatgtttttgctgatacttctgttttttcttcatctcaggagaatttgtaattgctttttaaatcatttttatgctggttgttttaaaattcttgttagataattccaatatctgatttatctctgggttgacatcatttcattttattttctcattcaagttatggttttactgatccttgtgatgacatgattttgaattgtatgctggacattttagatattaagttaggagactccatgtcttctttgaatttttgaatttagcagacaatcacctttttaggttttaagaacaggtcctggcctacttatgtggactgtgggtccaatgatcagtttattttctgattctttgctgtgttgttttgacctccttggcttaccttgtgccattgggcctcccaggatctctactgatgatccctgagtggtcagaaggtgtttccttaggtgagaatgttccatgtccttctgagaaatgggagtctttgatttatggagatgaagaggctcctttagtgggtgttgtggtgagcttctccctgtctctgggggtagagagcatttcctaggctgaatacctgttgtggcataatcccctttactgatcccccactcacagggtatctcttgatggaagtggggagtctcacaactgctaaggaaggaaaacacttcacataacaggccattgtggtagcataattccttttgccatggcccccttgcctatgatgcctctggggagggggggagaagggaggctcagcaacagaggaggtaagctctttctctggctgctcttttttcttttcttttctttttttctccttctccttctcctccttctccttctccttcttcttcttcttcttttttttttttttttatcagtagggctttgtttaattctctttgcccattcttccaggctcgccttgtgttgtaggtgggactctcgttcaatctggggaaagaaagagccaacctcggccaccttctcttgtttctgttgctgaccggggatcagcaaacaccaggacggaggcacctccttgtgttatgctggaggttataaaaagccctgatgctttgctgttagtcctggggcgtctaaccagttcaccttcctcttccacctttcagagttctgtttggttgttacatgtagtttttagtcatgcttagtggggagaaacagggagagagaagtctatgctctcttgtccagtctaaaagtccctatgtaacatttgttaaaaacacttgtgttatagtagtataaagaaaaaaaatttttttaatggcttcaggtagaaaagcaagtgttaactttctctttatcttcctgatagtaccaagaagttcaaaatatcatttatttttatcaatgactatatttataattaattattaataaataacttactatttcccttgcctttcttccatcccgaatagttggatattcaactttatttttatttgttatacgtccattttatattctgcagatagaaaacatacagtttacttttttacatgctatgtgtatttatagctctattggttgttagattaaaataaaatttccattatgttgaaaaatgtatttgtgcatagtacatttactgacagctccattcaaaagaacctttccaagtgttaaatacaggtataaactgttctttttttgtattataattaagaatgtatttattactcttcactacttgtgtaattaccttctatattgaaaatatttgcatatgtaacgtaatttttctaactttttataatgtaaaaatgatatataccagagtagaaaattaactgacagtctcagaattatactcagggagttagaaatagagagagcatgagaccatggaagatgacaaatgaaaacaggaactcaaggaggcagagaatcctagtgagaggaatcaagaccccctgaaggaggattaacttttattcaaggtttcttctagaatttccagccggtaaagcaagttaccatggcccagagaaaccaaaagtctcatttggtaaggtaattgagaaaaatctaaagatccatttagatattttaatgactagaattgaaccatgcctctagaggcagtagtggttactattctctaattctccaaaatcatttcaaaaaaaaatttggcaaaatatgctcatatcttgtcataactatttgtgaccatagttgcaacactcaaattaaaatgagaatgggacattgccacttgatttaaatgtctgtgcatttacttaaacctgcacatccacataattttaatggtaagcaaaataaatttataattggagaaggcctgtagttgaataatactattcagtccattccaaagtcagtaaattatctttattttgtatgaccacccttgaccactactagaaggaatgttggctgcttctttgtattctgtttgagctttccagtccggggcactgggctcagttctggggataaaatgatgagagtacatggtctcttcccaagggaaaatgaaagaacaagaggaaaatgatgcgcaaagtgtaagacaatatgataactgtcacagtggagccataaaaaggcaccattagataaatcaataaagaggaacttttgtgctgtttatgccagatagaagttagtggaaattataagaacccaaacagcttgataaattcacattttgaagtacaaatcaacgttactactgaaacttttacaaggatctcatgacctgtgtgcttacccttgaaccatcctgttctaaccagccaagtgaaattggaaacaattgatatgtctttcacgtgaacatttcatttctatttatcaaactatactcatgataatacccttaacaagtttccaaaccatctcatccaagtccaattttcatttctaactttccctcaccaactccaattagcatgtactccaactcagaggaacaccctccctggtctctggaacgctacattgttgcctctgaggctgggattttattctacttcacccatctgctctctgtatggaaagaactgagtgcagcaggggatcctatgaagtcctggcttcaaacctcgggcaaaaatatcgggtttcttaacaataaacaccccgatgagagccacctggcaaagtgactgcacacagggctttcgttctcaagttcatccgcttcaagcacaatgttgctaaaaatgaagcgttcacttttccttaaaagtcaaatcctgtcactttacctaaatccaactaaaatagccatagagggccaagcatatatcattcaaagcttcatatagtcatgaaggaattaggcaatggtacagtcaatatctcctgctggaagagaaattttcaatagaattttttcatttgctgacttcacatttcaggagcattgttcctagaaatgcacttttttttcttacttacaatttcaaatttgagaatataaatcctaggactctcaaacagatatttgatatgcataaataactgtaactctaaaagatgaaactttgcttctatcctcgtttacttcataaaacatcttttcaagattcatctgattcatttacctttgcctttaccatgcatgttaatttctatgaacaaaactattcatagtgtgtataactatttacgcttgtactccttttgattttactatgttagctgcaataactaggacaggtataccacgttatacatacattaatttaaaaaatgatttttgttgattgcttactgcctattatttagaaagatattatagcaaggaggaaaatttaaaggctaatatttggaagaccacatacagaccaaaacagaggcagatatgtttgtagaccctatgacagagatagataactatggcatcaagggccttggctgctgtctcaggttggcattcctctgttgacttgtaatcacacaagtaagggaaaagctctcaaatgaataatcagcagacaggtgccaactcttcaacttaagtatgctgaccaatacgtattagaaaaaatttctgaaactaaagaacaaagccaggaaatccatcattaaagtcttgaggtgctgtcctggcaacttagaagacctgaaaggtagattttcataccagagttctattttgatgagagagatgtgggcctcacccatttaaaagagctttcaggagagtaatgtttcctgagaatagccaaacgtttgttagagtaagaagctgatgaaaatgttcattggggaggttgaggatattgggagttgtcctcacagtagaccatcctgcgagctctcatatgacgtggtctagtgtgtgtttactactcatgaggatgcccatcttgacatcccatgctttttttctaactacccaagatcccaaaatgttttttattaagcatgttaatcattaagtacaatattattgacctacacctgacctaataaatgattaattatagctcttttcccaatgtctactacttagtttgttgagagagtctgtcttctgatattaacacagaagaccctcagaaacacccctctcctcctgcatcccctccccaaccaccatgacacgcacattcacctagagcttcacttcagtcccaagcaacccagttgcgagggcaagaaaaagtatccaaaacctcttcctgagaccaaccaatcctcttcctgaagaattacatatccctttctcaaaagaggttttattatacctgccattggcaaaaaaaactacccccttagtcattacttaggaaacaattaatttctgaagaagctataatcagcattgattacaactttccctaaagtacatcaggaacaataccactatgacttataagtctgcttacttcagtcacccactgaagtcccagcgtcccagttcatcatttctggtctttatcccagaatgctctctacataccctaatttcatgcaattttctaccccattctgaacttctctctgtatgctgaagatttaataagcccaattaccaatatcctcaactttttttctaaatgtttccttcacctgcttgcttaagctcaaatcatgctatattctcagggtaccatttcttctgcaatcttcttgaatggtggttgtcttttattcttcttccaaatctcatgtttgactagtcccaaaggtaagctaaatgtcctcatgtcattgcttcatctaggaaattagtcttccatcctcattcagaattttgtatccagcgaaactgagcctcataaatgaaggaaagacacaatctttttcagacaaacaaacgctgagagatttctccacttccaagccaggactacaagaactgctaaaaagcagctctaaatcttgaaacagaacttcaaaatacaccaaaatagagcattcttaaagcataaatctcacaggacccataaaacaataacacaatgaaaaaaaaccgcaaggtatttatacttttgttgacagaaaatcaacaaagaaacaatggacttaaactatactctaaaacaaatggacttagcagatatttacagaacgttctacccaacaactgcagaatatacattctactcatcagcacatggaacattctccaagatagaccatatgataggccacaaaacaagtctcgagaaattttaaaaagtagaaattgtatcaagtacactctcagaccacagtggaataaaacaaaatcaactccaaaaggaactctcaaaaccatggaaattaaataacctgctcctgaatgatcattggatcaacaatgaaatcaagaaggaaatttaaaaattccttgaactgaatgataatggtgacataacctatcaaaacctctgggatacagcaaaagcaatgttaagaggaaagtttatagcattaaatgcctacatcaaaaacccacctcatgttgaagtacatgtctttgaactgcactgctcactacctcttttggttgcaacattcttcctacctcacggtaccttctcctcagtcactgattaccttaatatcttactcctgtcatcattttgaggatttcagcatccgtgtagacaaccgatacaaaccattatctctgttatttgaaatccttatttccaatgactgtgactgccatgccacacacacttctgcccacttctttggtcataacttaggccttattatcgctgataaccttcctaaaaacatcactttaaatcattctgttttatgaccagaacctccaattattccagttcatatactttagaactttttccgttgagcctagtctgttgtcttaaccactttttttccagtcattgcctcacttaccttctgtctcagctaaggtttcaaggtccagcactataattattcccttgcatataccttcggctcacctgattctttctctcttcattgtacttgcctgacaaaggtacaattatggttaaatcaatcctctaccttctccacacttacaaccaatttgaatgtggttggagaaaaactcacaagccacacactgaactgttgagtgtcactttaaatttatggtgccaaatctcatggggcctttagcactagataaaaatccttctagagctctacttcccaagatgagcctttttaaatcttctatttcttcaaacttccaatacctcctccctcattgttaccctaagttgatcatcaagtctaatttcatcaggaaaatagtatcttcctgccaccaaaagtgttgtcagttctgaggtttgatttttatcctttttacaagctcatacgttatcctgttcctgttttgtgaatgctggcaaaagacataaaactttgtgtcaggaaaaaatgcacaaccagcagcatgagcctcaggtttacatgaattacccttgcacccaactcccacagggttggtactacatgggcccagatgagtactgcacagacagatttttgtcgcaactgatgaacatcaagttggggaattcatcgcttttacggtaagcagtaagaagcctgctccttgtcccagagggagacattacttcattcttcagagatgcttgctgcaaaaccaaccccaagaaatgggcaggtaaagatcagtcagggccttgcattcttaggattcccagtaagaaactgccaggacacacagggcccatgatgagttgcttcttccagcaatccatcccatgaccccacttgttcttggctgaactcgaattttcatatgaatatgccactccatgagccaccctgcttaatgtgactgacagagactgggattaaatctgttcaatttgcctcatgcagcatttaattaaggagactatcaagaggactctaagcaataagatgaagtcaacctgtagtatacatttcaactctactccccagggccctggactcagccaattgtacataagtcccaggggcaccaatcatcatcttaactttagatagccagaaagtagtctaaagccagtcagttatccattgtgacccacgtaagggagcttagattgacatactgatctttgatgtcattaccaataatgacaggggcaataaacgagcaacactaacccccaaaggagagacattcccccacatacaaacatataacacaaagggacagactctagttcagaatttctggttaaaattgatttatacctttgttacattggtttggttaattcagtacaacagaagcatcgcttgcagctcccattgccatttatggcaacacttaagctgcctgagtattaggaaaagcgtatgaatatatgttattaagattgaggttgggcacagtggttcacacctgaaatctcagtgctttgggaggccaaggcaggaggtttgagaccaggttaggcaatataatgagactctgtctctttaaaaaaaaaaaacaaataaaaaaactgaaacaaagttgtgggacctatctctttgtacgcatacaaggctgaggaggaggcagttcaggagcttccattagtggtgtcagctatggtgaagtagtttaggaccagccaagtttgcaagacttttggtgtttttataacacctggacagggatgacaaatcctgtagtgagtttagattgtcaactgcagctgctcctagattcagctagaccatacaattgttttgccagcctgcattgctgaatctaaggaataagaagcctaagtgcctctctcccctgaactgcctggggtttaaagtgatctgtgctcgggtgctagaattgttattctccctccatggccatgaaactagggtgtcccaacccagtagctataactttacctcttctccaatcatctgctcataccaataccttttgtccagagaggtcagacatgaataggaataggtcactttaaaaaatatttactgagattcattcattatatttcccacttagtccagttaggttactataagtaattatactagttggtgaatagtatattcaaccagtgttcattgtctttatgatctaagaccatgttaattcaataaaagaatccaggtagctacatcaagttaagtttgaatctcttagtctcccctttagatgtggctgcccttcaaagtgtgtacaaatcaggctgacatgaggttgtcactaggggaagaaaatacacttcaggttcataaatggtcaaggcataatcatgaattttcaaaataagtttacataatttttctacccatccatcttgatcattacctaggagttggccaacaggagacaaatctttcctgcccatggccatatttaatgctcaaacagccttaataaactgttttaataaaatctgtgggccagaaagaggcaaagaaggtagatacagaaaggagggagagtcagaaatcttcaggattggtttccaaaaagtctattccatatctcaatgatgccagcagccttatcagagaatgataagagtgtggaatgtccattgaatatgtttactactggcccattgctaggtggcctttatgacaaaaatacaccattgtcagattgtagatggtcttgaaaactgaaaataagaatcagattatcaaactgaaatagcagcaaaataatctaaaaatatgtcaatattagcaaggcaccaatggtagtcccaagagagggtcagagatctgacacagccaattttctagaagtgagcagggaaaatgctccttgtaatgtggcctcctttactgcaaaacaatcaggccaatttttggcaggagtctcctttggtatgcagtttctagattagaaacatatagtcctttgctgtagttcgtggtagtggatatgttttctggtaagaggatggatccagataatgatggaagccatctagatagatgctgggtaatccatttgattctagttgttctcattaggggttatagcaacagccaccagaaaaccatactatcccccagttgggagtgcaaggaatggaggatgatggggagattagcctatgggagtggacgtgggaaaaggcttggtcctttctaaggggctggtgaccaagtgccagagctgcttcctatccatgtatatcctgatatctgatgagtgtcagggcccagaggaccccttttttcttgccccccctgcatgccattgtgctctgccctgtcaaagggtagtcaccaagcaagaacagtgccacacctgagtaagctagtaacttgagatctcatataacaatgttatttcttcttaaagaagttgatgttgtggaatagggagggggaggaatcaggggtcatagagggagagagcagctcgacactagtaaacaaggttttacattcaatttcactttcaattcaatttctcttgcttgtggctcaatcaaataaactcatcatcatcaaataaaatcatcatttttttttctaactaaagttctatattgaattgaaatgatgtcattgttgactccatttatttcatctttcagtactccttgactcagctgtcacagatacgttgccttctggctggagccacagggcttgctgccctattgtcataataatgttttttcctcctcccacctagaggagagctagaaacaaccaaggcaccatataaggctgtttgttttaatcccaatctgattgatgggcaggaccttgggggtcttttgcttccctctttcacctaccatttcagtgggagtccagggaactcatcttctacatctgaacccatcccaaaggctcttaacatttttcttccagaaagacatgtctctttcaggatctcatctttgttgccataactgttgggtctgagatttaattttaccctgtttataaaggaatgagttagcctgttactgtttcatggatgctggcagaagacactaaactcttgggtcaaagacaaatgactatattactcacagcacagcagactgcatgagtatcatgtttatgtaggtttcttttgcattcaagtcttacaggggtgatttgctagatggatggtgtacctgcagtggatttgcatcacagctgaggaacaatagcttgataaattatctgttttcatagcaggcagtaagccaatctgttttttgtcccaactttgaacctcatgtttcaaagttgcttgctgcaaaaaccaatcctgagagatggcctgggtagaatggtaaggatcttgcattcttggtacaaccaacaagaattgcagtgatcctcagtgcccatggtatatggactctcccaacacctacctatctatctgtcactcatttacttgccgcctcccaattcctgcctatgtttggactacttttccattacaacattcccacctgaagtttacttatgcatggcaccctgttcattctctatgattcaggatctttagcaattattctttatacatcttgcatcattgattttccactctattctaaatcattctaattggcttgcctatctatcctctggaaaaaaaatgctccttagaatgcatacacctcctcagatatcctcttctgtattccaccctcctctaaagagatgtgtatacttactctctactttttcacttcccggtaacctccccattaaggcagtttttgttacttcggtgaaaacttccctgtcaacaatttccatttgctaatctaaaacttaattttaagtccttatcttaactggcctctagtttacagttgttctctctgacctgctggatataatttctttatttaacatctgcccccttttcttcttgttcactatcattctattgctagcatatcctctattttctagactctaaatgctggagtcccctaggattcaatccttaaacatattttttcaccccttggaaaatctcatgtaatctcttgactttaaattttagatagatgtttacaacatctaaatttttgtctccagccctagctcctctcttgaacttcccttaacttttgtatttagatagctaaaatgattttcaaacataacataacccaggcaaaactttttatttttttatcttcatgaaacccaaaagaaaaaaattaagctaaagcaaacaaacaaaataatcacaaaacaaaacaaaaattcacaaaacgacaaaaacacttcttccccatctcagtaagtggtaacagcatattcacccagttggtcaggccataaattcaaagccgtatttggtttctctctttctttaatatcccacatctgattcctccacacagtttgttggcttctcctttaagctgtgtttcaagcacgatcatacttcccacctctaccatttctactctagaccaagccactgtcatgtctcacctcaactacttcaatagcctaatgttttggtgttcttccattcttgactttctaaatcagttctccacacagctttggtagtaacataatatgcatcagatcatgtgagtcttccattcaaacagtccagtggctcacatgttctcaataaaacttgtactccttaacatattcttggaagcccttgtgtgatctgtccttggttatcctctccaaaatcacctcctgagtcctcactctcttcactgtagctaggctgggggtcttaaagttacttggttaggccaaactcatttctgccttaggggttttacatttatttttccctttacctaaaagactacagatttttgcatggtgattccctcttttaaatctttattcaaagaccacttttccagagaggtctatctaaacctcccacaaaaatgccacctctctctgcaccccaacacatacaaacacatgctctatttccttacccttattaatttcttcatattacttatcactgtgtgatcttacgcacacacacagacacacacacttccattaatttttaatctcccctctctcagtccttactagaattgtccaccatgaaatagactttgaacatcttgactactatagctccaggacctagcacagtgcctagcccataacaggaggcccaaccaatatttcatgaatatcaaaatgctgaaatcaatcagttgaagcttgagagaaatctcaggactctcagttgtaagcattgatcatcaacccacatgtcaggtaaagttttgcccttagcagctaaaaactttaataaaccttttgaagattctttcattctcctaatccggaagtaactagatgagcctcagaattcttgctctaattatagtgtatgccatattttgataaattaagttttccatgccacttgacatatcataatttgaaaaatgtgttctccttatttcagattgatcttccattttcaagagtatctaacaccttatctttaagtttctcagttccattttcttcctatcaagaatctaaggatttatttattcaaaaattcaaagatattatatgagcttacatttttatgagaaaggcttttgttaaaaatgaaacctttttttatgaactctttttttaatggatcatgacaaacctataggggtcattactggaaatgtgattaggatcatttgtgcaatgaagcacttcctagcttaaggcaaatttggcctagctctagcctgctgtatcctcccggcactatctttgagtcaagcgtatgttcttagttaattggcttatggcaaaagtaattttgtcagttagatgtttccgtagagctgcccttgctgagttagtgtcttaagacagagccacaaggttttgttgacatgtaagttttctggttgttttttccatttttacttcctgacatctcccatagtgttttaaaaaagaggaatggtggctagaataaagttatgtatgggcaagccatttttggcacatgcgaaaccatcaattcttcaagtatcaaacaatgatatagatgtcagccaatagcgtaagatttttcaaattcgatcaaacaaaatgtcctgctctccacaatctaatatttcttcagattgaatttagagtttagatcaagatgggattactattacattttcccaggtggctatattgatatcttacagctacagattaatctttctccattttttcctctcttttctcttccttgtttgctcttacctcctctttctctcaattataatggttcttaatgaattcattatgtaaaggattctcatatccaaaactctatgaaccctttccaacaaaagggaactagacctacttttgatgcctctaagatgcagctatataaatttcagacctgtttttcactcctctcatggtagtctgaccccaataaggaagagggtctgaatgaaacatttcataagtgtcacagataatctactgctgaagctgtatatgtttattgcttttttcaaagagtttcttcagaattacccctttcaaaataacagtttactctctactgataaaactgtaatcaagatctggttatcatcttttgttaacattttattgaagtatcacacacagataaaagtgtacacataatatatttatagctcaatacatgtgttataaagagaacatgctcatgtatctagtacccagagcaagagcatggttaaatggatgctactttcttttgaaggagatgactagtgccagtgtagttagtgacagaggcaaaattcagttcaatcatcaaaacattttcagataattaaaactgtctacaaatgagacaggcatccttgcaaagaaaaaagattctatgtgattagagttgtttgtggataggaaagatggaattcttgagtggttggttggactggatgacttccttgggtctttccaaccaaagatgtacgtaaaatcaaactctgaagatcaatgttctaatggtaacatcaaggcaattataaatgtacataataaaatagtattttctaaagatcagtgaaaatgattcttaggagatatttaaaaatcatttttcttttcttttctttcctttttttttgagatggagtctcgctttgtcgcccaggctggaatatagtgccacgatctcagctcactgcaagctttgcctcctgagttcacgccattctcctgtctcagcctcccgagtagctgggactacaggctcccgccaccacgcctggcaaatttttttgtatttttagtggagacagggtttcaccgtgttagccaggatggtctcaatctcctgacctcgtgatccgcccacctcagcctcccaaagtgctgggattacaggcgtgagccaccaagcccggccccggccaaaaaaaaaaaaaaaaaaaaaaaaccatttttctagctcattcaggaagtaaattaaaagaatggtggaatgggctttttgctttccatatcatagactattttaagttaaggatactatcagtgaagtctggatgaaaggatataataagtttcataagatggaagatttatatctaagcttgttccttgcactgggtaagctttggcaaacagtgaaattgttacatctcttcctgctaatgataacataattttatttcagcacaaaggagttacctagataattagtataacaaaatttttataactgttgccctcaaattcaacaactgaattaaggattcatctttgtgcactttttcatgagaaagtttgtttctttcatattctttaatacatgaccatctcactttgtgatttaaatgttttaattactgcagtgatttaatacgtcgaaaaagaggcagataaagaaaaaaatgatcgagattttctacttaacacctcggttctgcagagcccaaggtgattaaattgaaggcagcattcctttagagtcacctatgagacaatagtctggaatattatcaaaagttttggcaaagaaaatcatttttggggtgggaggttaaacagaggatagggcttcaaaatttatctatttatttgagtgagttttagcatcattgacctggccaaactccaacacaattcattatattttgcctgtctcaaatgcccttgaaattctaatgaggccctatatttctcatcttaacctactttcataatattgcttgaagcggccatccagctgtggtcattcacttaagaagaatctagatttatctagcagctaagggtatccagtatctctgatttccccacagaagcaggaaggtcagtgaattcgttccagtgaaaagatttgaacagcttacacaaataggtaagaacatccaaataagataatccaatttctcaagcatttctcatagtgctcttagtaggaaaaatgagagacacaagcaccaagctgggcacttaacttcaatcatagttaaattttgtaaagcccccaaaaggtaaaatgctacaagaaattaaaacaccaggaagctctacaccaagatgctttcctgatcatctgaagccttttttgcctttgaattctcatagttggctcttgtgtgctttgatccatcctgtctgagtgcatctccatgccaaattacacaaagcagccctgcaggactgacaaggcccaggagccagcgcaagtgtgtctggcgcatctctcgttgttgaactgtccttgttggtgaggattttttagcatgcaaagtgtgtccttagaagcagtaggaaaagggaagagattcctcagctcttcatatgttttctttcatgaccccaatatcgtatctgacaaccattcccatttgaattattactcttagatcctgaacaatcattaattaataccatctttgtgagcgttcatttaagcaataccactctagggccttcaataccactctagggccttcagccagcttctattaaatgggttcctcattctggtttactctcattctcctccttttaatattttagcctgttcaggcattatgcattgggagaataagagaatttttcagtgatttaaaggaatatatataatagaaaaataaaaggagactagattattactatacttgaatcattcaaattggcataatcctcacttacttcgtatctcataggtaaattcaaattataataaacatgcagacataatcatcaaacatagaattctcctttcagtggcacagaattggtaattattttctttaagtccttacagtgatatcttacaaagatttcctccgtgaagcattcaggcatcaatttaatctgcatatgtgtaactaaacgtgtttcctcaatgaacacaattacttttgttctttgtagtaaattctctcactataatacacatagtttggtcaaattaagaacctatagaaaatgattaaagacacaagaggttacacatgcagccttcaatttgacagatgacagcataactcattgcaatagtaataatgagtattgttcctatcttaatttaatatgaaaactttccacatccacttaactaacatgaaaaattttagaaatttacacactgattggtgaagtcaactacataccaaccattaagataattgacttccttaaaaatgtaagttctgcactccttattgtgaggaagccaaataatttatgggctttaagcagtaaattcttcccttgcagatgtgtttgatgctttccaaagggtctctcctcctttagactggaagaggtttggctcaggatgtaattttcgaacacataaggtgtgcctagcactgagctgggcagtcccttaggaagcaaagtgaggagaaactgtgatggtgacggggagtagggactgtggattcagaattcttagtgtaacagccaattattaatattatctgtggccctatatttcttcatctacaaaatatagacaataacagtaacctaacttacagggtggctggtaatgggataaatgagttaatatattcaaaatgcctagaacagcacctggtgcaaagaaagttcagtgtaagtatttgccatcattaaatatccccctagagggcaggtacttagggctcatgactgtatttccaataccttatactgctcctggaatagacttgataaccaataaaatgtgataaactagtgatgaaggaatagataaatgaattcagagaaaaactcttcttttgaataatatacagctattttaatttgataattcatccagtaatttatttatttactgataagaaaggaaatctcagaaaatatactataataattattcaaagacagcaagacgtttttcaaagaaacatctgggtttaaatcagtctgctttaagtatcaaatgaatgtgtttattcattatgtccaccagaagctgcaaaatagaaaatatgcccaaagtaaaattgtcatagaaaaaaatcagacacatataggtatccagatgtccaataacaaaaaattctggtcacatattcagcaaagatttattaggagcagactctgtgccaggcactgttgcatgccctgaaaataataagcagacaataatccctgcctttgcacagtttacagtcttgggaaggagagagacaagaaaggtacacacataaaaactcactttcagggcacgttttgcagctctcctaacctcactgacctctcaggatgcagacctgctccaaatcatccattctgcaggaactaaattaaggttcttctaaaacagaagtacaaaattggtaactaccctcaaaaatcataggttaaaattatttgtcctctacttttggtgcagaattctggacttctgttcgagaatcactcaagggcttgaatgggcccaaagttacattttgagaattcttggccctcctgtgctattttctttcaccagttcacccttcatcccacacatatccctggcttgtaggatcttttagtcaaaacacaagatgtctataatagagtttccataggaactcaaactaaaattgttgatattggggaaagctaaaatagggatcatactaacaattctttactcgagattttctaagcttcatctctgaatcatcagataacctcaagcagaatgcaactggacccgctacgctctccattctctgcctcttgcaaatgcctttacatgactatgaataagtgtacctggagctggtcctgaagcaagaattaaggagctgctacatacacgatttctccactttttcaatagaactgctacttaagatactctttgttgaattctcaaatgtcccttatacaaagacccttttcagaaatttcacagttaaaagttgaaagaaatgtcttttgacaacctgatatgcagcttcctcctgttgaacactgtgacgtaaacagactcatgatatttctctttctgtcttggctaccatgaagctcggagtttagtttttcttcctccatgccagtgtttcctgagctttggttttctggaacattttctctcctctttatacatcttcaactctattaaactgctctggtatttttattttgttttactgactaccagtttaattggaactataccatttagtgtaaactaccacaagtcctttgggcaaataaagagaatatataagcaaataaataattatgaacaatggctactgagccttaaaaccagtggaaggttataagagctttttaatagactcaaataagtttaatgcagaagttacaacctgagggccttgggccagattttgctcttggatatggtttattcagcagatgtaataattttaaaagaaaaattagttaccaacatccttaagttagaaaatttccaataaaaacctgaattgcttacctctctactttctgtgccagaccttgttttaatactgaatcttctaaaaaatcctctaaggtatcaccattctcatcatcccaaatctcacaaatgaggaaacaaaggcatggagaagttcaataacttattttacaggctcacacagcttgcaaatggtaaagctggaacctaaacttggaccaccaggctccaaacactcccaggtggtcgtgctattacctggaaagaatgatccaaaggcttggacccacatttccccctgacaacaatggatccactttccaacctggcatcaatagctggaagtgaaaacagcatgtctctttcaacagtcacctggtgtttgcaagcgtttccgtttaagacccttgtcttaattctaagctgagagcatattatcctgagatgggagctgcatcttaaatgtattttcgacatcctgtaggtttagtctttgcttgaagttaattaacattgatgagtcccacaggtctctatagcttcctgtgaagtcctcaacattgacaataaaatggccaaatgagaaccgaaatacatttcactgtagcacagcccataaaagcagttttacctaaattattccccaaagcatttcccacttaattgtttagcatttacggataataaggacatgaatgaccacatttgcatatttatattgctcatttgccctgtgtgccgtagtcagtgctttagaaagatttgtgtgccacctgttctctgtcagttatctcttctctctgttaaagattcttggatagaaaaaagtaaaactaaagctaatctccttcattaaaggtagagagacttttaataaaacgagacttgctctgcacttcagaggataagcagaaacctttgaaggattttctgtctgaggagtttccagggaggaaaggatatgatttagtcagctagtcagctaagctcattaattctggtaacttgtttctgaaaaaagggaattttcctgtgaaatgctgctactgcaaactaccctcccccagctcatatcacaacttctaacccttgagacaaacctgctattgttaattagtcgaattagttgtacaactgtacattatcattttttaaagttgtcttactgattctcaaattgtattttcttaaaaagtagttgagaattgcttttccaaaacaatatatctttaaaagaacaatgtaaatagacaaatgaggcatttcttgaagctgctttttggtattccctttgatattctatcaggaaactatatgtctaatatgtaagaatatatgtctaatatgtaagatattaaattgtggagtgagaagtaggttttcagatttttctcctcctccagagtctttctcctcatacttctcctcctgactcctcagggtgccaagttcaatagtacaagtgatatatacatgtacaatatacaagtaataataacatgttagaatatgtattattgttatactattatatccttgttattattagggttattatgattactattataatcttttggtgacctttaattctggattgcaggggactatagagagttggaggagactactcagaggcattggcaggtatactgaacgcctcaagagctcctagagctgacattcataataatcactttaggtatgaaaatacatagttaacatttaagattctctttttaatgacccaaaaatgatagagaacagttcagagctttaaaaaaagaagttaactacaatcagaagtggttaaaaaacaatctaagggcttgaaattgtaattgagttagattcaattaccttgaaaattatcaaaaaggaactatccatttcccagcaaagttgttgatctttattcttctaaagcaatttgtacaggaataaattctaacattcatatgtctaggggctaaaaccgacatgcggatgttagaatttattcctgtacaaattcccccagtagtggggggtaaaacactacccctgaaatcacatacccctggattgtgttcaccaatgttcaaataccagctcttgccagtttcttgctatgtaaccaagaactggttacgtaattgttctgtgctaataatggatctattaataaaggatcaaacgatatggtaaatatacagctcctagaacaccctggcacatagtaagagctttgcaaatatctgttattattattccacatctttgtatctcttatcatactctttaagatttagaaactgttgagatttttcaaacttgtgaggacccagttaccaatctctcagtcaatttagattgcagaccaaagatggagtctcccttagcagagctaaaagtccctgcatctctgcatgcaaagtagacagcacttccctgaattcatatctgtcccagaactttgatttaaaaaacaacatgatctggaagttgcattaattcatttttccacattttatttctcagaatttaatcacatggtcaaaacggactgcaagaaataatagtctatatcgtcttaatatagccatcacgtgctcctctttaactctggaggttctttatacaatctaagaaggggagaatatacatgggggaaaataagtcatctctattatgttgagtgttattgcattctctctttgaaatattttcagggatatgatattaagctcttttaagaaaatcggagcgaatattttccctgcttttatcctagtaactgtcaattgttaataattttatagttattataaaaagcaattccatagtaatagctatgtttttctatagccatgagtattggctacgacaatttcatttgtttactttctccatccaagttaacagtcttccctgatagaaacatttagatcacaagtagctcgctttctctcactcaacagttgacatcactccattggtccttggcagtagaaccatcatgttcacattcttgttcccaacataatctttttctttttttgagacagtctctctgttgcccaggctggagggcagtggtgtattctgggctcacttcaacctccacctccctggttcaagcaattctcctgcctcagcctccggaaatataatctttaaagcacaaagtctggagtattttggcaaatgtagctcaatgtagctaatgtagctacattatgttaataaagctaatgtagctaatgtagctacattcagcaaatatagctaatcaggaacttaattcttttggacactgtttgtagagaggcatgttttcctctgccatttgtctttggtaattctccctttcttctagatttttgtatatctttttaagtgtgaatttaacagaaagttccctgtgccgctccatagaattctctaaatctctctacatcttttttggagctatatttgattttggcacctggcgtactaaaaatgacttgaccttagatgtattataaataatttaataatgtttccaggaaccttcagttaaaggaaatgaatgattattttatttaattttatccatttattctacaattttttattgggtgcaacaatttttttctaaaaagtttgtttacatgaatacaagagccttctagttattttttaaactgtttttactacaaaaagaatacaagtttattaaaggaaaatttgaaaaatacagaaaggaaaaaaacacaaaagcgtggggaggctatttctattgccaccaaacgaaaataatatatgtaatatattagcagattctcttctgaaattgtatcttcttttttccccaacctcccctcaccaaactgagtattagtatgtatttatataattgaaactgttgtgtaaactcatctctctctctctctatatatatatatatatgcacacacatagtatttaagacatgatcaaattacataaacatcattttaatgtctccataatattcctccttatggatttgctttattatcccctattcttggacatttaggtagaacctactactcgatattatatataacactgcaatgaacatctgaaatgaaaattattttttgatggatttctggaagacaaattactaaggcacaggatatgagctactttaagtttcttaggatcaaataaatggcaaaagcacattttaaaggagataatagtagggcaaatgaattttctcaaaataagccacttaacctaaacaatgtcatcattatatcctaaacattttcgggagactaagaaaaaaaactcaatttcacagcattacaataaagcctgagtttttaagaatgtcaaaaatctcatgtttttctctcttccctattcatcaagtttcctcttcactggtccaatgaaatagagccacagcacttttatttaaatctctatttctcctgcattcccattagtgaggaaatcaatcagcagttaagaaatcaatcagttaaaagaataattaaatagccattccgaaaagaaaagaagtagaagataagatggctatggaagagtttataatctaataatgtagaaatcaatcacacatttaaaaacaaacaaacataaccatgaaattcacccctgaaatgcttcatgagagaattgctacatttctttatttttaaaatgaaattaaatattactcttattaattttctctttatctgtcccagggatggcaactgtccttaaaatttagaaaggacaatggcagcaacaacaaataaaaacctgattttaaaataggcaaaggacttgaattagacatttctccaaagaagacattcaaatgaccaataagcacatgaaaagatgctgaacatgactagttattagaggaatgcaaatcaaaaccacagtgagataccgcttcattcccattaggatggctattatcaaacagaaaagttacaaatatcaagtgttggtgaggatgtggagaaaatggaacccttgtgcattgctgttggcaaggtatcatggtgaaatgctgtggaaaacagcatttgactcctcagaaaattaaacatagttattaccacatgattccacaattctgctggatacacaccttaaagaggggcagcattattcacaatagccaaagataaaagcaactcatgtccatcaatagatgactggctaaacaaaatatgatatatatggtatgaatactatataaatataccatacatatatcatggaatataattcaggcttaaaaagcaaggacattttgacatatgctacaacatagatgaaccttgaggaaatatgttaagtgaaataatccagtaacaaaagacacagattttattattccttttataaagttcctggagtagttaatttcatagagtcagaaattagaatggcgactgccaggggctgaggggaagggaagcgagaatttggtgcttaatgagtagtttttcatttggaaagatgaaaaagttctggagatggatggtggtgacggttacacagcaacgtgaatgtagttaatgccacagaactctatacttaaaatgatgaaatgtcaattttatgttatgtatattttaccacaataaaaaaattggatagggctattggtttcagttcatcaatagttgtttaagtggtctctcagaggtctaggtggcatgtcttcaatctttttatgttagacataggagctgaggcattttgttgcagtttctaaagtcttgaaaacttagttttcagtgccctggcatccaggagccactccaccaaactccctgccaccctgctgcgtgctgaatgaaaatgatgtgagatctgccacagctttgtttttgtctctggtacatcaaatgtgcaactcaaaacaaaaacaactgtgaacttccttttattatggtattattaaaggattggggaggagtggcaggtgggactgagaaggggaacaggagacactgtagaaaggaagtcaaatctttaaaagagataatgttagcttctgcttcctgaaagaagtataggaagaagagcccagagaaggggtgtttgtgtgggggggagggggtggggcgggaaatataccagatataattgtgttcttttattaagtcactacattataaacacatttataaaaatgtgttttaaataacaatagagaagttcaaacatagctataacaattaaatattctgtgctcagaggaggtaaatggatgaatagacagcagacatttttcccatatgccctcgcttagtgccagcagtgggaagggtgcttatatttgaattagagactctgagcaagccaagaaagctgaacaatagctcccaacattctcctgggcagtagaaagatgacaaggtcagaaggcacatttgattgtttttcatatcataggtatgttcagcttttccagggctccaaggtttgacccagcatacagaatagaaagtgaggcagaagttactcggttcccttcattgtgcataacatgataccttgttttgtttacccataaaggtcctctgttgacattttaaaccagagtaaatataatacaaaaaaattttaaagacgtgaatttttttaattgtagctaaaatagcaaatcaaaatatttaaaattttccttcctcatcccatgaaaaagataactctaggagcttctatttgattcttggtgattgatctctttttaggtagagacatttcctgttaaaacttccatttctagcccgaggcccttaagaataggctataataggcattaataaggttatacaaatatactcacttatgcattgtagcttcatatattttgtgacaacattaaaaaaaattctaaggattgctgaaatactttctcaagaaactatttctccaggcaaagagttgcaagcagaaagtttcatggtagacagcacaaaggagtacatgccaattgtaattagaacaagcaggagaattcgcttggagaccagaaacacaattccttttatggcatattagaagcatcccaatcttcctcaatagtggtgttcatcaaacagacaacattctgaaattcccttaagagattgctggagtgaaaataaatttgtttttagtgtgatatcctcaggacagaaaccttataaaatcatttgccttgttggcctgtccacctcctataataaccattgatcccacaggctaatttcaaccaactttgatagaggggcaaagagtctatagctagacagaggctcataaatttcttgtggtttcttctgtttctttcagaagagttgtttaatggtatcattttgaagagtataaaaaagcaaaccaagtttctgctgtgaagttgtcactgtaatggaagatgattacatcagaagaagttcaaatggaaaaaaaatgtttgtagttgccttgtggtttcctgataacaagcaaagcaagcaccatatataacaccacacagtggcaggcatctttacttctgatagttgcatcctggaactttataataaattcgactcttgggttttgcacatccaagtggctgagtttttcttgtttattggagttgaacttaaccagttctcagttctcagaagtgtgctgacataattgaaaggctttcaaagagctgatggtgagttagtgaaggaaaaaataagaattcagaaaaaaatattaagaaggaagcaacagaccctcctacagtaatatacagcagggtgacaactcaagttcaagtctaggatagagtcagtatctgagagggtccaggtctcgatgtggtaggagatctgcttacagaatttgtagctgaaacttggggggcccagtgcaaaaacaggttttattctgaggaatgtattcaagaaactatgagaaattaggaatgaggccagcagagggcttacaaggctggtacagcatctcgtggtgtctaaatcctagggaaaaggggaactcaagcagctgggtagcttctcactacatgcaattagaggtaccagggtggtgctgctagtacctgaaggccttttggtccttactctacacttcctctacacctgaggtcctaagttttcactctggtgacaaggcaaaaaaacaaagatatacatacacacacacatacacacacacacatatatatataatttccttctttaaagtgagaaaagggctcaaaatctgagtctagctaagacctcaaagattgtatggctgaatgagaaaaccaggttaacaggatcataattatagacagctggaataagtcttgtgttgaataggaactgatactataaaggtaactcagataatttgtttccataattttcatctttcaattctttttacttgaacatgctctgagctgtaaagaaataggttacacagcactgggtattcattttccaaactctgctagcaatattgttcaatctcaagaaaagacccaaggaactaaaagggaaaagagaaacaggataaatattttttgatgaaactcctattttataagatgcaaaacataaaactatggggctctaaagcctcacctaagtgaatcaatatgactacagagcttgtaataaaatacaacactaaaaatactatgaatcaaacataaaatatgcaaagttcaccagatcttcagtggactagggaagctgtccttgcaaaggaattaagtattatttgaaatgagaaagtgtaactgaagagttgggaatttcattttctggagctgccacaacagtgcccaagtagggaatcagcttataaatgcaggtagcttgtaaattcggcacttgatgaagtaatatccagggaaaaggtacttaatgttcccaggggaatatatgttgtatgaatgcatatactgtgcaataataacaaaatatatactacataattagactgagtatatattttacaacataaatatagttagggctgttaatcaaattaaacaggacattttaaaacacagttaagaatgcagagaggaaaaaatagattaacatctaaaagcacatgcaaaagaggcacagcaatgaatgcaggaccaaaaagtaccaaaaaatagtattgcatgcacaatgtgttatctttctttctagaagtagtcatggaaactaatataaacaatgacttctgaaagctaggtttgctcctcctaccttaatggcttcagaatctcagcttctactatatagtagatggaaaattctcaagtgaagcccagcaacagcatagcaagagaagggctggctacagtggctcagtagctaatatttccagtgaaatagcgaggctgttttcagtcttcctttacaaatctagatgaatatgccaggcactctcattaatttcttgaaaagtagtcattttttttgaaagataaaacattcagtaagaggtgaaattaatggagaaatattctcactattattttactagaaaaggtataaggatttaaatgatttgaatgaccaaactctctaccaaaaaaagtatcacccaattagttcaaactaatactatagaccatgcttcacccgatgtaatttacatattattccaatcatagcccactataacctctgctttcatcaacaagaatagagtttttataaagattaaggcacatttatctgttcttctgcttttttcaaaactgcttaaatctataaatgtatttcaatatgtatcgagaaaacagaataaagttaagtgaatgtataggaataaaaggtgcttctgttaaattttttacaaaaactacgataatgatcttaagactagttttagaatctccctatatataaatagtgtttagtcatcgtttcttaaactttccacaaaatttatagcggtttgggtggcactatatatagttgaccctagaacaacatgggtttgaactgcatgggtccaactatatgcagattttcttctgcctgtgcccaactatgtgcagattttcttttgcctgtgccatgctggagacaacaagaccaacccttctacttccacttcctctgtagcctacttattgtaaagatgctgaggatgaagacctctatgatgatccactttcacttaatgaataatcagtatattgtctcttccttatgattttcttaataacatgttttcctctgaattactttattttgataatatagtgtataatacatataacatgcaaaatatgtgttaatcatttatgttatcaataaggcttccagtcaactgtaggctattagtagttatgttttgggatagttgcaagttatatgtggattttctactcttcaggggtcggcatcccagcccccatgatgttcaagggtcaactgtataccttttatatctacataccatagatattgtaaaactacctacattcacaatgattaaaataagttataattatgtattaatttatacactcaaattataattaatgcaattatgatacaaatttaaattatataattttaatttatttctttaatttttatagatttattatgttttttgccattccttttcaaggaatcttttctgatttcagttttattaaagtcactttcaacacagggacactatttctgtttaatgacaggattagctgccagtccctatttctccagatgtggagataacatttttattcagcagggagtctaaaccattcacagaaatcccattttataccataagagcaagcatattaggttgcactcaaataagatggggtatctccaagttatttctctattttatgcctcggttagttcctaaggcaactaaataaataaataactctgacttaataggcaatcaaggagcatcgtttgtaccatatggttggcatagtaaccctggggtattgttactgctaccaccttctagagaggaggaaggctgggcctcagaggttaagtaacttgcttgagattacagtttccacattaagctggaatctaaatacagctgctaatggatgtctccagagtacatgcagcagaaaaactaaaagaaattactgttctatctccatcagtgaaaattttatgtaaattagtaaatgttatgtaacccaagattattgagagtgagagttgaatgaaataactttctacaagtttcttctgacctccaagtaatgtacataatatctgaaactatttgaaaccctgatatttaccgtacaaggaagcaaaaaaacaaattattcataagccagaaatgttcccaccttaggtgcatgcttttggcagcctgcttagaagattgcatgatatgcactaaagaaatgtaaaaaattaacagagcagattacctggaaataagtcccaagttggaacatgagataaatactgtataaaagttaggtggtgattcaacatacccctctccctataatttttagtctttaaggaaccccaggtcttctctgtgctccagtgctccctccttatgcccatgactcaacacctactgtgtgccagcacggacctccctggttcattgaatgcaaggttcattcagcatttaaaattcaattaatgtaattcaccatgataaaacaaagaaggaaatctatgtgatcatctccatagatacagaaaaaaatgcatttaacaaaactcaacattcatatgataaaaacgttcagcaaacagaattaaaggaaacttcctcagcctgaaaatgaccatctacaaaaaaacctagagctaacatagtaatggtgaaagactgaatgcttttccccagagatcaagattaacacaaaggtgttcattcttaccacttctattctacattgtattggtgatcctggtcagtgcaacatggtaagaaaaagaaatagcagttacatatattggaaaaaagtaattaaaaccccctctattaacagatgacatgattgtttatacagaaaatttcaaagaatttgccaaaaagagactagaacaaataactttaacatggtcacaggatacaaagtaaatataaaaaattagttgtttttatacgctagcattgaacaatttgaaactgaaatttttaaagtactattaatttttttaaatgaaataattaggtatacatttaacaatagtagcaagattagaatgccaaaaactacaaaacactgataaaagaaattacataagcccaaataaatgagctatatttcacgttcactgattgaaatactcaacgttgctaaaatgttaatttttgcaaatttaatctctgcattcaatgtaatccaaatgaaaatatcaataggatttttttttgtagaaattgataggctgattctaaaatttgtatggaaagccaaaggaaataaaacaataaaaaccaatttggaaaagatgaacaaagttgaaggactcacactatctgacttcaagatctgttatagaagcacagcaatcaagataatgtagagttggcaaaggatagaaataaacacaataaagaatgcagaaataggctcacacacttatgattaattcattttaaacaaaggtgtaaagcgaatctctggagaaaaggaagtcctctcaacaaacaaagctagcacaatgcatgcagccatattgcagggaaatgaacttcaactcaaattttatacaatcaaatgcaaaaactaactccattaaaactcagatttaatataaaacttcgaagagaacacagaaaatatctgggatcttgggctcagcaaagatttttaaaattatacctaaaaaagtacaaatgatataagggaatctgataaattgcacttcaccaaaattaaaagtttcagctctttgaaagacacttaaaaaaataagaagacaaaccacagaatgtgaaaatattgcaaaacatgttttttcttacatattgatattcagaatatttaaagagctctcaaaactcaagaatgtaaacaaaccagtttaaaaatatacaaaaaatttaaataaatacttcatcacataagatagcaaataagcacatgaaaagatactcaatatcaataacatgtccattgaaaccacatgagatatcactatgcaactattaactattttatatacatgtattagtgtatgtgttgagagagagaaggaaggagagagagtaggttatatgtaataatcgacaataccaaatgctggagaggatgtggaataactctgatgctttggtggcagggatgtaaaatggaaaacagttgggcatttttttcttataaaactaaaaatacacttactgtaacacactgagcaatctcactcccaattcatacatattacccatgagaatgaaaacatacttctacccaaaagcctgtacacaaatgattatttcttctttactcataatttcgaaaacctgataagaacccaaatcttcatcagttactgaatggataaacagtcttaccttcttgcaattgaatgctactcagcaataaaaagacccaaaccattaacacatgcaacaacaaagaataatctcaaaatcatttttctaagtgaaagtagcaaggttcaaaaggctatatattgtatgactccattcatattgcatctggaaagggtaaaattctagggacagtgaagagatggagtgttgctgggagctggaattagggcatggtattgaaaacaaagagcattgagaactgttttggaggggaaggaagtgttctacagctcgattgtggtggtagtcgcacagtgtatacctttgtacacctaacatgatgaattataagtgaattacatatcaataaactcaactttaaaaaagtggaagtgacctggacctctgttgcctctgagatgtccatcctaaccccagtttctcactcttcaccctactgtaatccagtttctatctccaccactgcacaaaaaactcattttgttaaggtcagcaaaaacattctgattgcaaaattcatcctcagttcttcttatgacttctcacaacttttagcataatcaataacttctcctttgaaatattttccctttctcttccacaatgctgctctctcctaatcatgcattcttagcgtgatgaaaagttcctcaaccccctaaatattggtgctgcttagattcccatatttagaatacctttctcattttctatttacttatgactcgtttgttttaaagtaaagttgagcattgtaaacaagggcatcacttttgtattttagggtatttacctttgtatcaattggaagataaatttgaaaaaggcaaaactgaaggaaggcgggtaggttgggagatgatatggagaagtgatggatatccaaatagtagggctttggaagataaggatagattaaagagatgtagaagaaagaatcagtagggcttggcaatacattgaacacagctaggacagggaaatagaattgttagatgaatggtcaaatttatggtcaatttatacaatctgaataatggtggagtcattcggcaagtcagcgaacataagaaaaggaagaggtttgggtataaagtgattatttcagcttggaaaataataagtttgataatcctatcaggaagatatttaaagaaatcaatctgtatcccagggaaggagtagaggcactatatatacatatttccatttatatgacattctggaaggggtaaaatcccaaggacaacagagataatagattgccaggagctggggtcaggaaatgattgtgtgtgtgtgtgtgtgtgtgtgtgtgtgtgtgtgtgtgtgtaatatgcagatatagactatatatgtgactatatatatgtataatagttgtctatttctttcagaagtaaagaaggattcaagtctccatgtatttctctatgttattctctccacttgcaatgctcaccttcttcatctgttatttccaattcatcctccatgaaatgattcagatgccatctacttgaggaaatcttccttgattagccccattccctcaagcccacctttatcccctaactccacgctgttagatgcacatttttggacattttaatgtcacatttataacactctaatgaatgtagcatttagggtactttaatgcaactgttgattagtttagttgtcattttcccacaaaagattgtcagctccttgatgtctttcatctgtggaacatgagtgttttttacagtgcctggcttataggaaatagtcaaatagggttgcagcattacactgttggaaagaacatggtgtaagaaatcaagtagatatgagtttgaattttgactctgctagccatagtctgtgtgcttggttaaatcgttcaatctctttgagtttaggtttctataaaatagagattataatgctactttcctcatcaagtttttgtcatgtattagtaaactactgccgcataacaaattttcccaaaactctgcaacttaaaataatgtccatttattatctcacagtttcagtggataatggcttagctgtattctctgcttcagagtctctcacatggctacaatcaaagtgtcctccagggctggggtctcctctgatggctcaacagggaattagtccacttcaaagttcatgtgtgtggtttttggcaggtacaaattccttcagggtggttagactgaggatctcagtttcttggtggcagtgagccttctctaacaatggcagtttgaccacagtcattatgaaacagagtcttctggcaaggtggaagtcaagatcttttgttacataatcactgaagtgatatctcacgacctttgccatattctgttgattagaagcaagttgctagttccagtccagactcaaggggaggggcttatccaaggatgtgaatgcctggacatggggatcattgggagctatagagtcatatagaactctgcctactacatgtgaggaccaagtcaataaaaccaaaagattcactagatgcctaatattatacatggcaagtgctcaaacagctatttatgtccaatggataaatgaactcatccatcaatcaattgttctgcaattaaccggagtaaccactagatggtggtgcatccttcacagcattgtgccataaaagtagggtcagagattttgaatgtaagagctttttttttttttttttttttaaaacagataaggtcttgctctgtcacccaggctggagagcagtggcgcaatcttggctcactgcagcctgcagcctcgacatcctaggctccagcaatcctcccatcttggcctctagagtagcagaaccagaagtaaaagagcatttttttttttttgatgatgatgatgatgatgtaatacacaaagacacattttaaaaacagaaactatacactcctaactaaatctcttttgtatctctggaactcttacaaaacctatcctgcttcttccttccagagtaaattataaaatgtgcaaacaaaataaacagaaactcctctcctcactttgatgtacaaggtttctcactcggatactatccagccctgatttaaggtttctcactcagatactatccagccctgatttaagtttccttttgactcttaaagacttaaaagcttttgtgtttctgttttgaaatatgtctgttatctttttctaaattaaagtaaaacatattcattgtagaaaatttggaaaatatagaaaagaaataaaggaagttaaaaattctaatcgcacacctaaaaatactttagtatatctattctgctttccttcccttcttttcctctctgtttttctctattcttcccttccccaacacacacatacatatacacagagaaattgaaattatattatatatagttttgtatccgaataaattgctacctcacaatatctttaaacttcctttttgtaatacaatttttgagtccttgccttttactgctgtgtttaagcatatatatagctattattataccatttgtagtgccttgctcctaccttctcattttctgttattgtagagtgtgggtttttttaaattggtgttttaaaaataatttttgtattttttgtatattattttgttgatgtttatctccaccagtgttctggaatttccatattttgttttcattaggctacttttaaacttaaaaacattttttaaatgttttaatctattctcctctaattaccaaggtcaaagtgaaatcatattgttttgattgcccactatgtaagacaaagaatttagcatgttttaaataaaatttcatcttttccatgatagcatggtctttgctaacataatcatgagcttgggaacaaattgttgtcatccaattattattttaacattttggaaatttatttttgaagaataaccttgaacaatttgtcgtattttgtgtcttctgttttgcaaaatgatttagccatactttcaaattgaactggttttaatgtttatgaccagttctttaataatctgcccactaatatttgataatgtactattttatgctatttaactaatattcttcccaatgatattataatttttcccttagtcacatgaagtttatctttaagtatttttaggctatgcacttatcataagtagtatctctttctgttatctacaaatttgaatgacagtttctctgtgcacagaatttcagggtctcagtcttttatattcaaaatgttttaactttaattctattattttgatattcttttggcatttatttgtatcttttaaatttgtttatttttatgtcttttaaaatattttaatataaattaatatttttatgttttccttgtatccacagttaatttttattattgtttttcttctttttgttttgttttctttttaacttttattttgggattaggagtacatgtgcaggtttgttatacagttaaactcgtgtcacaggagtttgtcgcacagattattttgtcatgcaggtgctaagcctagtactcaatagttatttagttatttttttctgctcctctccctcaacttaccctccatccccaaggagtcctcagtgtctgttgttcccttctttgcgttcatgagttctcatcatttagctctcacttatatgtgagaacatgcagtatttggttttctgttcctgcattagtttcctaaggacaatggcctcctgctccatccatgttctcacaaaagacattaccttgttcttttttatggctgcatagtattccatggtgtatatgtaccacattttctttatccaatcacagttaattatttcatcattatttagatgtatgtcgtttaaaattaatgttgactaaaagatagtcatccattttaatatgctgtctcctgtcttattcaacaagaaaaataggtcagctgtcttttattgttaatccacttcaaagtattttgatttctctctcagttacatttgaaattttaaggtctaatttctgttctctagtccctttatctctgggatagtttctcagttttgttctcttatcacagatgcagttttaaaatttttattgaagtacaataaacaaaaaattacataaaccaagtatttagcttaatgagttctcatcaactaaacatatctgtataactaattcctagatcatactgctttgattatctgcagtaccagttttccacttttctgcccccaatgtagattttaatagcactattgcaatgctagttttagtttattcttgttattttacactgcatccttttcttctctgtctgtagtccttaatcccatcctgttgtcttttcagttattgttttcatttttgtgtctttttactttatttccacagaaatcaagttttcacacatattgtcatgaaaataatgtagtattctaaaatgttcttgatgttttgttataagccagattttgggttttcttcctttagctctttagcgttatgttccctttcttttgtggagcactaggaatacataatgtatgtatgtatatgtatagatactcaaacacacaacatgtgtctgtccaatcatcatgtattccctcttgctttacctcttcataaaagaacagtggtttctttaataaccttcttttcctagcagccaggtacattagaggaggctgacttcattctcagttccaaagaataatcctctttcctcccacttcttgccattgatccatttagagatgaatatgagtaaaggtttgctgatggcttctcgggaagttctcatttgttctttaggtagagacatcagggggacgtgaatgaggaagcatgtagatagagtgctacttgcaaccatcctataacttcaaaaatgtctttgaggtaaagctgaaactttgaccagtgaagtgaagaagtggtagatatctgagttcttgatctttttgagtcttcaagataaccctgctgatgttttttttttcttggactttctccttatatgagccaataaattttaatatttagggaagcttcatttaggttctctattgcttgctgccagatcatcctaacttacacataactacaatctgatgttgaaaggaattagttttctctttctctctctctccctctctccccctgccccgctcttccccacatctccttagcaagtgcacaaccagacctagtgtttgctaacaaaataaatctgtgagctgtcattagccaggttcactgaccaccttgaggaacagtcaaagctccacctcagatacatagtagaaattgctgttcaagttccggtagttggtaaccatctgttgtaataatactaaactgtactaggatctaaccagtttcacagatacttcaaaccaagcagatatcttctctgtcacttgtaagataaataaaatatagtcctctgttgcttttgccttgttttgttctgcaagttgtcatttctcaaagcatggagaagacagagtataagaatgacaaggaaaatagtattcagactagctctgtaaagcaactgagtgaccatcagctggctctctcattagtgcagacccagggctctgagcctaattgcatattgcaggatatgaaaaccacgtctctgtactttcctaaaagtagtggaacttcggacgcctgtagtcccagctactcgggaggctgaggcaggagaatggcatgaacccgggaggcggagcttgcagtgagccgagatcccgccactgcactccagcctgggcgacagagcgagactccgtctcaaaaaaaaaaaaaaaaaaaaaaaaaaaagtagtggaacttgtcagatgacgttagtcaccatttctgttgctactttcttgtttcacactggttttgtttaattcagcacctttggttttatggttaagcattttctccaattcagacagtaagttatcttttcattttatctgttactattgtgttacctctcatctttttcttgtcttcatacacattttaatgggatattgacagtaactgttaaatagatgatgctatagagtggatatgtgcccctgctaaacagcaattattattgttgtttacatgtttcaaacttgtttacattgcttcaatatagctaaacttgtgatagatataactgtaactaatttgtatttgggcactgccagatctaaatttaagttctggcactaccactgtctaattctgtgacttttggcaagtttcataagctgtcaaagtttcaatttattcagcttaattacctcactgtgaggttgtgagaaatgaataatacagtaaaatacttagcaaagtgagctgcacaccatacctacgcaatagcagtagctattgttaataatgtgctcgccctcgccctctccctctccctctccctctccctctccccacggtctccctctccctctctttccacggtctccctctgatgccgagccgaagctggactgtactgctgccatctcggctcactgcaacctccctgcctgattctcctgccttagcctgccgagtgcctgcgattgcaggcgcgcgccgccacgcctgactggttttcttatttttttggtggagacggggtttcgctgtgttggccgggctggtctccagctcctaaccgcgagtgatccgccagcctcggcctcccgaggtgccgggattgcagatggagtctggttcactcagtgctcaatggtgcccaggctggagtgcagtggtgtgatctcggctcgctacaacctccacctcccagccgcctgccttggcctcccaaagtgccgagagtgcagcctctgcccggccgccaccccgtctgggaagtgaggagcgtctctgcctggccgcccatcgtctgggacgtgaggaacccctctgcctggcttgcccagtctggaaagtgaggagcgtctctgcccggccgccatcccatctaggaagtgaggagtgtctctgcccggccgcccatcgtctgagatgtggggagcgcctctgccctgccgccccgtctgggaggtgaggagcgtctctgcccagccgccctgtctgagaagtgaggagaccctccgcctggcaaccgccccatctgagaagtgaggagcccctccgcccggtagctgccccgtctgagaagtgaggagcccctccacctggcagccaccccgtctgggaagtgaggagcgtctccgccccgcagccaccccgtctgggaaggaggtgggggtcagcccccgccaggccagccgtcccgtccgggagggaggtgggggggtcagccccccgcccggccagccgccccgtccgggaggtgaggggcgcctctgcccggccgcccctactgggaagtgaggagcccctctgcccggccaccaccccgtctgggaggtgtacccaacagctcattgagaacgggccatgatgacaatggcggttttgtggaatggaaaggggagaaaggtggggaaaagattgagaaatcggatggttgccttgtctgtgtagaaagaagtagacatgggagacttttcattttgttctgtactaagaaaaattcttctgccttgggatcttcttgatctgtgaccttacccccaaccctgtgctctctgaaacatgtgctgtgtccactcagggttaaatggattaagggtggtgcaagatgtgctttgttaaacagatgcttgaaggcagcatgctcgttaagagtcatcaccactccttaatctcaagtacccagtgacacagacactgcggagggccgcagggtcctctgcctaggaaaaccagagacctttgttcacttgtttatctgctgaccttccctccactattgtcctgtgaccctgccaaatccccctctgcgagaaacacccaagaatgatcaataaaaaaataaataaataaaaaataatgtgctcaatattctgcatattttaattaaatagctgttagaatttatatttacaaaatgaatggatctctaacataaatttaacatttcaaatatttcttttattaacttaactttaaaattagagggatttttattttttttaaccaaatgacaaattccagacatttagagaaacatattaccctatagttgtatagtgctttatattttgccgaatagagcactttatattttctaaaatatttacatattaattaccttttccagttctcacaacaactaaaggtaggtggtgcaaaggtgcttactcccatttcaccatgaacaaagttaaaactcagagaaactacatggctcctgtaggatcacatatttaactggagccattgctgggacatttgacctccaaacacctcctctctcttccatatttattaaattggcttgccaattaatatatgtaaacctagtaattaagaagctaagtcagcctatgtttgctacaatatgccacaggtaactttttaatcttaagattgtactaagaaagaatgaagtggaaaaatggttaaagcaaagacaaaatatggaggaaaatttcttgttgcatatttaagatattctttttattctatgaaggacataatgaaatctactcagttaataggcagcatatggtataatccaagtatgttagagatttcgggttttggccaaatagaagttttaaagaaatattttggtgaagtagtttctgccttttatcaagaaacctctatcaactaaagttatttcttctaaaagtcactgccattttttaggaacagtttaaatgccaatccaaagccagcttctttgaactgacacatttacatgggtagataaaatttgtgtctctgaaagtgttttatttcctgcgatcagagcttcttagcttttccagatcaaatattcctgtgaaaatttgttgaaattttagaccagttctgaggaagagtgctaacagaattacctggtatgctcataaaaaatgcagctatctgagcccgatcttgattcacagaatcagaatttctagtgatgtgtcctaagattttgcattttaatcacacccactcccactaagggactcttatgatattatattttatagagtcaatactataaattcttcccccagaaaatgcaaaacaacaaatcaaaaaatattacatatattttcaaatgatttacagacctgtcatgtccattcatggatacattagatatctgcaaatgccaggtttacaacctttgcattgaataaagactaaagttgtcttccaatacattaggctctttatgcaggagaaaagactgaatgcatgttcattttgattacagcatttcacacatttcatcaagatatatactttatagcagtactgtattatataataccgtacactaggaagtaaacatagaaagaggtattcacacttataagagttaccatgcagttgaggaaagtaaatcacaaatattaaaaaaaagaatacaatgtactctgtgctgggttccatatggataagctcagatgttcaaggacaaacatgagtgagagttaccaatagaaggcatttcaatatgggtaagtaacaattgggcagaactgtgaaagaaagttgggatttttaaaaaactgaagagaaagtagcagttgagcagaactctgaaagaaagttgggattttgaaaaaacgaaagagagagagaaaactttgaatgtgttttaaattttattctactaaaatatattttaatacaaccatttatgcagtaagcaatgggaaataatgctgggagatgaataaaagccagattgtggagggccttgaatgtcgggccttaccaggtcaataatatacttggcctttgatattttcatggctgtacaaaattaaagtattaataaatttgcaaaaaatgacaaacagcactgctaaagaatgtaaagccagttcttaccatggcagagagaaagccaacatttcttagaacagcaacatccaactccatacaagacaggtttttataattcactttaacttaagtgtttaatcattcacttttgacaagacaagggaaaaaaggaccaagcaagagcagagccctttctgatgatttactgatcaaagccaattaggatagttctggttgaactgggttgagtttctctgaaattacttttcaaagtaaagtcaacaagagtgagcatgtgcagtgctgtactttctacttgttagtccgtaaaataactaaaaatcacttacctatatccactgagcttcaaagtatgacttttgaagtgcaaaatcaagtgaaatgtgaaactgaaatgcaaggctttttgcagctattttgtctttcgtttgaagatctcagaatactttccacacaatagactgaatcaaatcttcctctgggctcagtattttttttatctgagctaccatatggttttgaacaaatatcaggtctggagagtgtgtatatgtatctcttgcatcagaactttagaatagtataatcataaagtagagcaaagaatggatgctgaagaaacaattccatgctatacgctgtacacacacaatcttaatatacaaaataagttaccaacatagtaacaccacatttttctgatattaaggttgacagtgacccacataaaagagcttttggcataacacatttttataattcttgtgggaaaaatgttttttttaatcatttcacatttaaatatttcagaaatatattacacattttcttgcatttctggtttaaaaatgttgcatacaattttgtatcttattgacgacaatgttattatttattgtcctatgctctatagattttgattttgttcctattttcaatatcttcaaggtactatactttttaatattattttatgccagctcatcatattattttttcggagggagcatgttgtagagaacaaatgacttatctcaggagtcaggcagactgagtaccaaccacaagttggcttggtttcatcatctgtgaaatgcaggtagcaatacatgcttcatcattcattagaatgattaaatggccacataaataaagcacttaccacagtgactggcacagatctgagactcaggaagtgttagttctttctctttttttttgagacggagtcgttctgtcgcgcaggctggagtgcagtggcgcaatctcggctcactgcaagctccgcctccaggggttcatgccacacacctgcctcagcctcctcagtagctgggattacaggcgcccgccaccatgcccggctactttttttgtattttttagtagagacggggtttcaccgtgttagccagaatgatctcgatctcctgacctcgtgatccgccctcctcggcctcccaaagtgctggcattacaggcgtgagccactgcgcccggccagtaagtgttagttctatccactcacattcattttctagttctcagctgtcatttcctgctggctgaaaaggtacacaaagttatcccttatccttttcttttgctgattctattccactgcaagctgaaatatttgataatcaagcttgctttaattgtatctaaaatagtaatgaatgatggattaaggcctgaggaaatagttaacaaacttcgccatctccagttttaaacatagacacttttaggacacatcttcgttcttgattatgttctgcatagttgaggtcacgtacagggactgacctccagaaaagtaaaatttaatggtaatcaatacggagaaaaattgtggacatgatgaaatctaactatgtttttaagcaaataaaaatagagttagtgaattatggcaagacaagcaacatttgataagcacctatgacctggaaccacatgctatgaacaattgcctcatttaatccttattagtggccttctaaagaagttactgctcttccctttttacagattttttaaactgtgacaaaattatgaatttatgaaaatgtcaactcttatattcagcatattttccacttataaattctctacttagaaattattcatgcggcatattctttacttaaaattatgatagaatcttaggactgggagaatcactagaggccattgaaatacataacataccttttcttaaatttcgatgataatatccatgctgaatgatgattctctctaaatctgcacagcttcaatgtcaggaaacatactgtctcccaagacagctggttctatgcttgatgagcatcaactgctagaagattctgcacagtgagcataaataaaccatccaaaggcttcttactgttggtactagttttcacagttagaaacaaataaaacataaaattccatgtgttagacctttagctacatgaagacccttctgatatgccctggtatctgcttttctcctggttaaacattcaattttctccaataatttctctaatgacatgatttcaagtaaaatcactatcatattagctttctttattggagtgtccatatcttatcgctgtctcctaaaacaaaaatatttcgagttcaaattgggagttagaaagggattttcatttcctttgccccagatactatcatcggtcatgacagccccaatgtcacataaaatttggaaagtcacatcaccatggatccatatttcaaagataagttgaggtaatacagaataaagtaaaccataggctgctgtacattatgtaagtgttaataataattattagtaaattattatcaattgaaactcataggtcttcacccaataagttgtatctcttctatccagttttgtggtttcttcacctcaagtgaaaagagttaactctttacttcagattatagaaaactgtcttctttagttgacatgagatccctggcttgcctgctttatatctattccattctgtcccaaccaatcctattctatagtttcccccattcctcattcatttttctcctttccttttgtacatcactctgatatattagctatatagactcatttacatgtattcatgtaaattattaaggtttgtgtataagtatatattgtgttaaagttctcattttctttcttccttttttaacttttagtttaagttcaagggtacaagtacagatttttttacataggcaaacttctgtcatggggggctgttgtacagattatttcatcacccagatgttaagcctagtacccattagttatttttcctgatcctctccctcctccaagccctctaaaggtacatctctttgttgtattggagaagaaaacctttttcagcctccccctagcagagcacccctcaagtcctattgaccaggattgggtcacatgcccatgacccagctgtaaaggagtgtgtgaaagaatatatttgacatgtgtattctatacggtggaacacatttctctctgtaaggaacaggcatgggacatgctggggaatgactactagaggtaaccataatttctgcctaaggatggtcattatttttaacaggttcatgttgcctataaattcaataagtatgccttatatatttttattcaagtaatatttatccaagttcacttatgctgtctacaaaaaagttggtgaaactcctttgaatgactagcatgctccaagcatttatagttatctcatttggttcacacaaaaataattgtttcataggctttattatttctactttataagaaatttcagcttaaataaattagctaatttacccaagttctcatagcctagtatcaaagctccgattaatataaaagtcagtgtcatagtctgactccaagtccatgtttattctacttcattattttgattccctgagggctattagaaatgcctctccaagtaggtccattgatcagaaccctgaatatgttccctctccttcttacaccaccttcaccctgtagcccccaatagatacatttcctcctttggtcctcaaggctgttgtctgcttaggcttccccactactataagcttggataaactgtatgcttcaaaaagcaagattatatctatttttcttcactatcatatctcctgcactcacatagtggcagtcaaactaaggccttgataaataagttttaaatatgaatgaataataaatgaatgaatacatgcactattgcaatgtctcttgcatcacacgttttctgccttattactggtttccatcacaacttatctgacctcagttacctggcgattattttttttaacttggcatacactgcccatgataaggcactaatgactatttcatgatacagttactgcccctctcaggtaacattttcacctttactgaggcttctaagagacaaggtctcaacctaaaggaattgctctgattgtgagaattttagggagtatggtagttctaggggcttcatgacctctcagcttatactgcctatgtgaaacctctctaggtcctcaggttcccctttaagaaaatgttaaaaagaaacaaaaaagaatcactttttttgtttgtactctaagtgtatctcaaacacctcacatattcaaattattctcttgtacaaaattaaatgccattggatgtagaaggagtggagcataactggtctttcatagaggctggaatttctctgagagcaccacacaagtaactcttgccacagtctcaattaataaaagcctttactcttttttcttaatttttctttcctttctatcccttgcatagatacttaatagatttgaagttgccattaatttcttaaccactattcaaaaggaaaacaaacaaaagaaaacaaaaacaaaaacagcatttcctttgttgtaaagcaaaataaaatcaggccctaattttccacaacagaagttgtccaaaatacttatctgtgtttagatttcccaaaattcatttcttcataataatactgtcagcgttcagtgttgtgatcataacattcactagtgtgacttaaaaaggggaggcaccatgtgttaagcagggataggatctaagaataacaaatctgcctggtaagcagcacaaatgagtcttacactaagccacactgatccagcttggagggaaatgagtcaaaaccaagtccccatactctctacctgcgagaaagaggtgacattgaagaacaagcccacacttctggatatggtccaaaatgatcagaaactcactctgtcaacctagtaggtgtttggatggatacctcttttttaacagaaagatgtttggagccaggacacatggttttcacattttaatggcaatgctcataggtaactaactctcttcttatatacgctaatttgcaacatgcttagtgtttttaagatgtttatttagcaactattgtttaatgctataacagatattactatcaaatgaaaattcaaacttttgagaaaggaaaagtggatatatttatgcattgagtttttggctttagataatttctactttgatttctatttattaaaatttttaaaatcctaagtcaatcaaaacagatcaagatgaaacttcctcatttgtatatgtctttgtatatatgtctagtatatatatatctagggtaaattatataacttcatattagatatttcattaaccatggcttcagcaaagtgagaattatgacaaaaatcatcttcatatccaatgatattaattctaaatataaagtctacgttccttttatccattaatatgatttattctcaaggaaatatgagatataccaagtggtagaaatttttgctatcatgattatttttgaaatacagtattattatggaatcagatactgaactaaaaaaattttaggaaagtaaaatgaggtgacagtttttaattaattaaattaattgactttaagcaaataacaataagcttcaagtaatccatcccatactataaataattgcacataaataagcaatttgtattcaactaaaatacccaattaagaagactgaatggccccaatggtcccataaatatgtcctaatccttttatcttgattgacaacagatcttgttctttgcccagctcctccaataaccaataggagacatttttatcttttttcccacttttagttttctgggttcatcaaataaatatgttggactttattttacattggacatgtcaatagaattgattttaagtgaagtaaaagcataaatcgctgtttatcattctacttttcatacctaattctgtttgctgttcttcggactattgatcttaatacaggctttctctcctttttttgttctttttaaagtgatggtaaaatttaaaacttgcttttctgtttatatttaaagaaacacataatcaaattattgacattttatgaaagatcaaatgcataaattttagcaatcataagaaaaaaaacagtaggcaatggtatagaaagcatgaccatctgcacttatttgcccacaaaggataaatgagagtgtactgtaaattgtaaagaaataaacatcttatttcaagctctaataagcttatgtgtcaatagttttaatagctgcctagttggtcttcctgtctctactttcttcccacttcattctgttacatatccctgtgaaggtgatctttatgagaaaccatgttggttttctgtccaacaattacgtatgactccccactgccagaaaataaataaatacagctaaaaacctcgtaagttcccagaccttctccactctggctacatttaacctttgtgtgtttatttttctaggtaaattgtacatgccaaccagattgccaaactcattgtcacctctaaatgttaagctttcccatcgatgagtgttttgtttattcacttatttacacacacaaagacctctttttcttttttcttttttttttctttttcttttttcttttctttttttttttttttttttgagacagagtctcactctgtcgcccaggctggagtgcagtggtttgatctcggctcactgcgagctccgcctcccgggttgacgccattctcctgcctcagcctcctgagtagctgggactacaggcgcccaccaccacacctggctaattttttgtatttttaatagagatggggtttcaccgtgttagccaggatggtctcgatctcctgatctcgtgatccgcccacctcggcttcccaaggttctggcattacaagcatgagccactgcgtccgcccacaaggacctctttatcaacttgacctatatttgaaaacctatattaaattctatttctataagaccttcccagccaggcctgaagagatacccttctccagaggctctgcagcagctactgcccaaactattcacttagaatctattgtgtactgtctagtgaaatctcttcagtattgtcttgacttgcactatcatttagtttttcacaaatttgtcttacttttcctttattaaattcattgaggacagggactagttcgaacttcatgttatctgcaatattttatacatgatatgtaatcaatatttattgatttgacttaaatttaatatgaagatttcatatctaaagatgtttcattatctatcattcaaagtatttttcctaaaactttcctaaatatgctctaatgttgcctgagttttattctcatatattatcgacatctgctgggaacatactatgtacaatgcattttcataaatatatattttgtccttccattatattgtaaatacattcaggctaggtctacgtcttctagtttgtagtctgagagtactctgagagtacatcatagagtagctattctataaattgagaaaatggtcaattgaaatttcatctaaggggtcaagatatggttgctgtcaggtaccaaagtgaattatgaaagaaataaaaacacaagatgttaaagtaaatacagataacagactttaggtttttgaaaggtttatacttttttattttttattttattttatttatttattattttgagacagagtctcgctctgttgccccggctggagtgcagtggcacaatctcagctcactgcaacctccgcctcccagattcaagctattctcccacctcagcctcttgagtagctgggattacaggcacacgccaccacgcctggctaatttttgtatctttagtagagacagggtttcaccatattggtcaagctggtctcaaactcctgacctcatgatccacccgcctgggcctccaaagtgctgggattacaggtgtgagccaccgtgcctggccaaaaggtttatacttatgtcagggatgtgtgaaaattcttcagaggcaatttgaaggagtgggtctataaggagatttcgttggagaggcttgctgctgtgttgtgagttgaaccttactcatcaaattgagggctggatgccacattctaaaccagagtgaccatagcttccaggagtgctccagtgtcatctaaagttggtggaagggaaggaacaggaaacttagactagattctccacctgcctgaggaatccaaagatgaaaaagcgtgatgactcttaacccgaggtgtcaggaaagagagagaaagaattgctgctgtgctgtgttggaaagtaaatgtgctcccctcctactgcaggttaagggtacgtgaatcctgtggtctagatggggaacccatggtaggagcattagtaggcagtttgtgtaaaaatagttcttcccaataggcctctgttggaaggtcaaagaatcccactaaaagagttgataaagaaggaagaaggagtaaacgtcagtaaaccaatagcaaaggggttgaggaaggagcaaatatgagccgccagtaaaaagagaggcaacgtctgcctgccttcacagttctctagagtgagtctcagctgcaggaatagagtgggctccaaggaagtcataagtgtcccttataacaaataccaactttaaacacctcccagtctcagaaaccatggagccatattgtatcagtcaagtgaataatttctgtgcccccttccccctttttttgccaccaagttcagtcttctaggggacaaaacacataaatctgaagatggagacaatggaaggatagaaagagggaagaaggcttccaaatcttccttcaagacagcctgaagttagcctagcagacaaagacgattttattctaaattgcattgaaatttttgatcattatatgtgactgaccattcttattgctttgtttttttttttaagagatcgtgacactactatctaatagtgagccgaaaagtcctggggtctgctgaagacttatctagaggcaatgaaacccttccccagttaaatatgtttcaagatagggtaggagaaaaaatcgtgttttgcttttgttatgccatatcagttgttcaatagttttaccctcaatcaaatacttgttattaatttttttgttcttaaaatcctttgaaaatcaagtttaagtaaaatatcttctaatacaaaagtttcaacttttcatattcagttatattaaacttgtattggaacacccctttagaatatactgtagtttacctgtaattcctgtgtcagttttctgtgcttcccaggataattgtataacaaatagattacttccattcagttctattctttctatccatcaaacatttaatcattcatacccttagcactgtacaggtgctgtgggcgtctctaagaaagattataatatgtccacggttttcacagagcttgaaatatttttgaattgacaaagcttgtatgaaagtaatcccagtacagtaaaatataagtacagtagagtccaatcaagtgcctagacgtgtagatcataaatggcagtacatcgtcagattaacatttcatacgtttgtctaaaagtttacacaaaaagatcactttggttttggatcagattaaatgcattatataaatatttaatcactttaggaaggtcatgatgaattcattcattccaaaattaattactaaatggtgaatacaagccaggtactatgctatgttttagacatatattggtgaataaaacaggcattttccttccttcatggaaagcacaacttgatgagattctagactaatatgctgtccaagtaaatttctcatataaaattacgcaatttacaggacactacacatgcccacactttctaaatagtctctctcaatgactacagtactatttgaattttgtcattagagggtaattctttcctactactttttagtattggccaaaacttattgagaacttgttatataccaaacaatgttatgaatatttacatgtcttaactggtttaatctttaaaagagcctcgtgatgtaaatactattattaatcccattcatagatgaggaaacaaatatagaaagtatatgtgacctgctcacaatcaagcagcatagctggggttctgatccaacattatcaatataggaatctttggtttaaatttttaaaaacacacatttgggcatagagttaaatggaaaaataagacatgcatattaataacaaacaataaatgagaatacactaaattattaattaaaaaactgtgtgtcagattggattcttttttttttttttttgagacaagagtctcgctttgttgcccaggctggagagcagtggcatgatcttggctcactgcaatcttcacctcctgagttcaagagattgtcctgcctcagccttcagagtagctgggattacaggcatgcgccaccatgcttggccagtttttgtatttttagtaaagataggatttcaccatgttggccaggctgatctgaaactcctggccttaagcaatccacccagctaggccccctaaagtgctgggattacagttgtgagctaccgagcatggccaggttggatttttaaaacctagttaatttaggccaggtgtggtggctcacacctgtaatcccagcactttgggaggccgaggcgggtggatcacgaggtcaggagatcgagaccatcctggctaatatggtgaaaccccatctctacaaaaaaaaaaaaaaaattaaccaggcgtggtggcgggcgcctgtagtccaagctactcgggaggctgaggcaggagaatggtgtaaacccgggaggcagagcttgcagtgagccaagattgagattgcaccactgccctccagcctgggcgacagagcgagacacgatctcaaaaacgaaaaaaaaaaaacaaacaaaaaaaactagttaatgtagggtctgatgttagaagtgctttggaacttagacttcactctttctacacctcaatttactctgtgaaagagaactaagaatatctgctttgaaaacctcagaaaattgtagtgagcacaaatataataatttgaatgaagatgttggggaaaccataaagtcctacgcatatgtctgttcttattgttactctttgttcatttgaatctccctggaaaagcaacagccacgcttattaaaaggtgttatacgtattcatattactttttttaaatgaattctaataattccctaattagatatattttttgacttggaatcagaaaaaaaaagtagaaagtgaagttaaaataataaacaggaaaggagcttgttatggtatagacatcatgttttacactggcattgcagggaaggaggaaatggggccttccattcaccttagaagtccttcatggtgagagttgtttggactatttatatttctggcaaacttttaggaattatggggaagtataaacaagatataaggcaaaatcactgtttccaagtagaatagagtgaaatctgcagccagggacagaatatacaatgtctgagaaaaaagtctcgaaataaataaattgtatcttacatcagtgccaagagcgatcttttttcttgtttttgtttgtatgatattcagtgctgcatgtatatctgacagtgatagttggaatcaatcacagtatttggcaaattattcctagaggaagaatacaaagcctgccatgactgcatcttttttcttcatgacacaggtggaatatagaattgattttacttttccttattaagtgtttacattttactccattacagtcctaaacctgagctattcatgcacttctgcaagattatacaagtaaattacgtgaaacttctatttttgatgtgaatatatataattttagcccttttttattatttaacaggaatccactgcgaagaagacgtcaatgaatgttcttcaaacccttgccaaaatggtggtacttgtgagaacttgcctgggaattatacttgccattgcccatttgataacctttctagaactttttatggaggaagggactgttctgatattctcctgggctgtacccatcagcaatgtctaaataatggaacatgcatccctcacttccaagatggccagcatggattcagctgcctatgtccatctggctacaccgggtccctgtgtgaaatcgcaaccacactttcatttgagggcgatggcttcctgtgggtcaaaagtggctcagtgacaaccaagggctcagtttgtaacatagccctcaggtttcagactgttcagccaatggctcttctacttttccgaagcaacagggatgtgtttgtgaagctggagctgctaagtggctacattcacttatcaattcaggtcaataatcagtcaaaggtgcttctgttcatttcccacaacaccagcgatggagagtggcatttcgtggaggtaatatttgcagaggctgtgacccttaccttaatcgacgactcctgtaaggagaaatgcatcgcgaaagctcctactccacttgaaagtgatcaatcaatatgtgcttttcagaactcctttttgggtggtttaccagtgggaatgaccagcaatggtgttgctctgcttaacttctataatatgccatccacaccttcgtttgtaggctgtctccaagacattaaaattgattggaatcacattaccctggagaacatctcgtctggctcatcattaaatgtcaaggcaggctgtgtgagaaaggattggtgtgaaagccaaccttgtcaaagcagaggacgctgcatcaacttgtggctgagttaccagtgtgactgccacaggccctatgaaggccccaactgtctgagaggtgagagaaagctgagtgctatggctaggagtgccatgcctcagagcagagcagaaacagcaaaaacagccagactgcttctgcctgctatgaaacataatgaccccacaagacttctgctgctggttgcccactgatgagaaagaaaagaagagggcagtgatgtgcgttaattaattttgagtggattcataggacatcagtttcactcatacagagaagtaaaaaaaataagcagatagctcttttccaaagaggttttcatctttgtgtttgcaaaatgctactgcaattttaccattggtcacatatcagaaatttattgtaaatcttatttgaaagagaaataatcttttgaaaaaaaaaaaccttagacataaaatttgtcagtgccacatactagcatgatatcttgtgcatagtaaattctcggtaaatattcatttccttgctctcctttccatgcaattcacacttgctccacaatcataattaagcatagcgtttttataaaacgccaattttattcaaaggtatcttttccaaggttgccctggagaagacagataatatactaggtgtcttaagaaaaaaaaaaaagaaaaaaaaatgtggaaagtaacaatagtagaacttggtagatgccataaactaattgatctaatttctctagtaaaccacagtttgcaaagtatttcaaaatccttaacttccaacattgttctagagattgctgttgatagtgatcaatatatacctgtttctttttattattattatcatacattgaaaaagtctgagaggtaattgtaacggactgctttgaagttcagctgtaatttaccccaagattttagagtaacttgaagtaggacaacatctggtaagtagtcttctctgctttatatgaagtaaaattaaaaccagtcttagcctatactctattccatgttcaaatgtctaagaattattagaaactactcaagggtttcccccgaccacaatattcattacaaatcacggacctgtttgacaatgaagtatggtatctactagctctacgtaatattttaagtagaatggcaagttgttttgtgattttttttaaggagaaaaagggaaattatgctgaggcaatgttcactttttgaagaaaaatttaattgacctaaggcaatatttttactacatatacaaaataacaaacagatgctgactcattttgactggcttccagatgcagtgacccatgaggttaatactgaccatggtgatgttaactgtcctagtaaatagattcaagagatgccaatccactgggttctggttttctttattttatccaacttggaaaaccatgaacttttcaaaccaagttcctgaattggttacccttcccccacttctcccagtttccttatactccaacattatttgaaactgcttaaccctcaagaaaatatttgacttcaaaagatcactttacagacagagagagttctgtgaaatcttttctttctgaaaattcttggtataaatttaaggaaaattatatttttcatatcacctcttcattataaaattaaaatattctgtattttctgttatcttgaaggaatgtttcctggagagtttattcccactaaaaactgcttttaagtggtaatgagaacatggagtctttctgctactgtacatatacgtgcaagagggaggagacatactaaaaagcacaaaggcaaacttcagcccattcatgacttgcactcatatttggctcaatgttttccaaccatggtatacattttaatgaacaaggagactggatagaggattttggtggctgactaaacacaaaagacatagtgatttccaatgtatcaaggttgatcttttttaaataatctaatttctcaacagaaagagtgctgaaaaggatttaactaagcttaggtcacagaagtgtccataaggttctctcagcatatcttgtgttgactgtttgtaagaacatgcagcattcaagatactactactcagaataaatggcatcacctacctcttgctctctggtgaacatttgacttacaaaagcaatttacatatctcttcttttcagccatatacctagattttgagaattttattctcttagaattatagtttcctagatatagaaaaagattcattctatgactgaatttttaacacaattgtacctgccaaatgtagtggctcaaatctctgctcaaacaccttcacaaatagagagatcactcactccatcttgccaaaaattgcccaaaagttatttccttatattgaaatagaataggatttgcccgtagctttccttcattgaccttgttgcatttctggaacacatgcaaataaaaatctcaacttgcctgctgcttgagaatacttaatatctgaagaaaagtatctcgagccatctaaaccatcacttctattcaggctaaacatcctgtttcttctaatgtttgccatatgacatagttttccgacacttcatcagctgcttgcaggttttggaatatatttgcttctttgtattccttctaagatgtgatgtctgtatgtgctggatgatacagtgacacacagggccataacctcccttattctagataatgtgcttctgtttttcagcttaatacaacattgactttttggcagccacacttcgtgattgcgtcactttgtatcattgtcactcatgatgccacatagtcctgtttctcccactctaatcttataaacgcacatttagatcgaagtggctcttatttattcttgttaaatttcatcttgttgtattccatcaatcattaaagcttgccaaaattgttttttatctgtatgtgttgttcctcttcatgacatgtcaaccacttgtatgagtatcacccttccaaatccacagccaagtcatatgtcttcaggtgtttctaaagtcatgtagcaaatcacacatgctgattagttgcttgtgatttctgagaaataggattgctgaagaatcaggcttctgagaaaaaaaaatactctgcattttggcttttaatccagatccacaaagtgatgctgaaggcatcctgggatgaccagcaggcaccccgctacccctgaggttgagtgattctgggcatatcttcaaacctcaggggcttcaagggccaaattttcttattaagcattttatctcatatgaaagtgctgcagtgtattcagagatgttaacctcttcaaaggggttattttatctaacagtacacttttgaaagctaccggtagttgcctggagcaggtggtctccaaatgcagattcaaaatgcaatgttcctgtattaaatcaagtcagagttctgaaaatatagccttttatgcagaagatcttcaaacacagttgattgtctaagcaagttttactatagttaagctaaactaaaatgtgtcttacctttgcccaaacttcagctgggccatatgatgacatttagacatgctgaaatatgctctttttttctggttagtactgggatataaaatcttgaagacagcaatatcttgaagacagtgatcttgtcaagttatcaatgctttctagactgcaaaatcaatggtcaattctgtccccatcttacttgatttctcaataccagttaacacaattaaacactccctcctcctgaaaaactattttctcactaggcttatgggacaccacactcccttggttctcctcttatcttactggctactcttgcatcatttcctttacctctacttgtctaatgcccaaggacttacttcttggacctctcattttctctatatatactcattctcttggtgatctcatccagtcttgtggctctaaatatctaatatggtttggatgtatgccccctccaaatctcatgttgaaatgtgattcccaatgttgaaggtggggccgatggaaggtggtatatactaacaaatcccacattatcagaacatcctgcctgaacctctatatcaactgcccactagtcacttctgcttggatatccaaaaaggcatctcaaatttaatatggactcccacctcacccaaaaatcttttcctccagttttcttccgtatctctgcaaatagaaagtccatgcttccagttgcttaggcccaaagccttagagatgaacttgctccagaaaattctgttgtatctaccttcaaaatattttgaaaatctgaccacttttgaccactttcacattaccactgatccaagccattatcatttctctcttgagttgctacaataatgtagtataactttgggcttttgctcagatatcactttctcagagttcctccctgattgttctatttaaaattacaattccacccctccaaatcgccctattccctttctctacctgacattttatactaaaggatttctcaccatctgacatattatatagtttgcttccttgtctgtgtctggtgtctttcctccaactagaatgtaagcttgatgaggatgggaagttttcttcctactatgtcacccatattttacaatgtcagtttttatttttatacatctcaagagttttcttgaggtgatgcacatcaatagcattgccacagatgagcatcactaactcctctgaccacaggaaatgcagggtgggtttaatactcagctttgccccaagttctctgtttcctgtgcctttcctactcccaaccaggaccacagaaggaagggtccttctttttccttgttcaactgccttgcttcttatgtgagatgtcatcccaagagaagatttaatcatctaattcttgatttctgttgtcccaatttatgttatttacagactaaaaacctgaagtttagaaaggttatgtaactagcctaaatcacatgttaatagcagacctgggacaaatacattccaggctctaaaaaatttctttacaaagaataattaggtttaatgacatgtttgcttcagcatgcctctaagtagcaaagattatgactccctgcacagtccacttgcagagggttgcatgaagtgcccttgtccaaaaatttcttccaccaggttggagtatagtagtgtctgatataccaccattaaggcccatattttagggcagcaaaggggagattctttagtttatcagtgcagagatctttttggtctgttttgtgatcaatatgcctgaagtgtaaactacaaaccaaaatatagttattttagggttaaagtaaactcagaagtccagaaagaggccaaatcattattctatttaataaacctgtcctgaactttaaaagctatgtatgagtgtgtatgcttgtgtgcatgtgtgtgtgtgaaatgtataattttcgtcttccatcccttctgtcttttgagccttaagatgtttctttttttttctcctcctcctctattttgacattgaagagtatgtggcaggcagatttggccaggatgactccactggttatgtcatctttactcttgatgagagctatggagacaccatcagcctctccatgtttgtccgaacgcttcaaccatcaggcttacttctagctttggaaaacagcacttatcaatatatccgtgtctggctagagcgcggcagactagcaatgctgactccaaactctcccaaattagtagtaaaatttgttcttaatgatggaaatgtccacttgatatctttgaaaatcaagccatataaaattgaactgtatcagtcttcacaaaacctaggatttatttctgcttctacgtggaaaatcgaaaagggagatgtcatctacattggtggcctacctgacaagcaagagactgaacttaatggtggattcttcaaaggctgtatccaagatgtaagactaaacaaccaaaatctggaattctttccaaatccaacaaacaatgcatctctcaatccagttcttgtcaatgtaacccaaggctgtgctggagacaacagctgcaaggtaatgattactcatacaaactaggtatatactgtatgctaaacttttactttattaaaaagataacttattaaaaccattctttgtatataaagatgatgttactgacccaccagtatagaataatatttcatctatattgttccaacaagactgtgaaatttacattgagccatagaaatgaggccttgatcttactggtatcaggatctatttaactaaccaaagtaacttcggctataggcttctctcaccctcacagcaatcaaattacttaggtataataatatttcaattcctaaactcctaatggcacaccagaggtttaactgaattaactctttttggatgatattgttaactttattttaaatgcccaactactattgttttgaacttttattaagtcagaaacaacaagagaaatctgagaggtaatttccttctggtagttgaaatcttccgaaatataatttctcaaagcccaagctttactttaaatattctatgtgctcttctaagagctgcttaaatacaagaacttgtcagctctgcatgacctttcaaaggaaaaaaaggaaacgcatttctgtgtgttgagcgtttgttgagctccaactatggccctacactaagcttggttctaaatatacacaaatgaattattgtaacatagttatggaacattttcaatgtactaggcactattttacatggattaatccacttagttctattgaaggactactgtggaaagcaagcattattgttgtcccaatttacattatttacagatgaagtaactgaagtttagaaaggttatgtaactagcctaaatcatatgttaatagtagacccaggacaaacacagttcatgctctaataaatttctttttaaatactttcattttgaatactttttgtgagcaaccttgtgagaactcaaataataatactatgtctctgattcagaggcagaccaatgtgggaagggcactcactgagttgggatccagaggacctaagtaccaagtttcactgtttcgcttctgtgtaggatcttgggcaactggaaacaccttctttttatcatctataaaaccaggagtaagaatcccttcctcaaatgataattagtgcatgtgaaaaagtgcctggtaatttgtaaattacagaggacactgctatacttgaaaaaccctccttgtgctatggatcaattttatatcttttctctctctctgccaccactctgcccttttagaaaggagttggtaatggcagtagtcatttttattctatttagttaacaatggatcttaaaagtttaaaatgtaaagatgcagggaaattagcattttaaaaaaacagatatgtggtttcaccgtcaacatttttctatttagttgccagtgctttttatacctttgatttcttttctgctcagtccaacccctgtcacaatggaggtgtttgccattcccggtgggatgacttctcctgttcctgtcctgccctcacaagtgggaaagcctgtgaggaggttcagtggtgtggattcagcccgtgtcctcacggagcccagtgccagccggtgcttcaaggatttgaatgtaggtagagttcaaacctaccatctcaccagttaagttgcgacatttgagttgttccaagagcaaacacagaaaaagagtatagacaaagccagtttattaaattaatctatggttgtttcccctatgcgagtaggctaatactgactggcctcttgcctcatcctgcccttggtggctgtctggataggaaatggaggtcacagcaacactaaacctagatgcttaatcatttaaaactgatttcctgaaaaagaattaacaaggcaatatttgaatttccttccctcattactgggaacacagaataaatatgtgcatgttacgcattgccatttattaactatgaggcctcaggcaattcatgtgatctccatcatctaaagcttcctcacctgtaaaatagggagaacactttctacttcttcggtttctttgtgatgattctatgaccttatctgtaaataatcaaacatgttaggcactcaattaatgatatctatgagaatttccctcactgtgaaaagttttcctgtccatcttctgtactacaaaaaacaattttccaaatgttagcaatttgaatactatacagtattcacaattttgacatatccacccactaactatactgttatttatattctgtcttctcacctacttcaaataattcacagtccagttaatagccaaccctctaagtttgcactgaattctaatttcttccccttattcaaagattgtgctcctaaaacttttctctcacacaccagtatcaatttttccatcattacaaaaaatttcttttgacacttcctcactcctattcctaccagttaccatcccatttctctgccttaaagaatagggagtaaaaaaccctttaatgtgttgtccgcaatatgcttctgatattctcactccattctctcttttgctccatacagtcaggcccacacaccaccacctccctcctgaactctcttaacccagagattcacaggtcacctttgtcacttcattcaggtttctacacaaacatcctccaacttggctttatttttatttttatctcttattgttccttgatattttgttacatatgcattgatatatttgtctatcatctctttcatcatgagaatataagcttcacaaggcaagaaacttttctatgtggtttcttgctcataaatatttgtaaaataaataaattgatattattttcttcaaatttacttaatattttcacttaactgctgtggacattaagtacattatcagcttactataaaaaaaatacatgctggatgcagtgactgacacctataatcccagcactttaggaggcagaagtgggaggactgcttgagcccaagaatttgagtctgcagtaagctaggatcacaccactgcactatagcctgtgcaacaaaacaagaccctgtctcaaaaaaaaataaaaataaaaataaaaataaaaatactgcactaaaataatggaatggaactagaggatagtttggcttaaggtcagtagcaatgacatactatctagactgggccccgaagtaactgagaaaaagagaaaaatgaatttacttttatgtttctgtacttcaaaatcatattatttaaaagacctgtatgaaatacattacactgtatatacacttggggaagttctctagaaaaacgtatatacttttatgtttcatacttaagaaataggtaccacacatgtatagaaaacatgatgcgttggcataaataaggtaaattggtttttaatggggcactaaattttaaatgatactttttcattctacttctttaattattctaaaataatttcttaattattaattttactgttgatcttttgatagaaatactaaagttgttagtctcagctatgttctacctggtgtccgaattgttttgaatattttcacaggaaaaatgaataggatttctaaaaacagtggcagccccaaaacagtatgcacactgctctgcaatctacacatcaaacagtttaggagctggacaaacatgtgtcagaaggaagtgaagtgaacttttactgctacaacattgccaatagcaaaagactagtaagtccagctctgacacccccagaaagtcccagtagcattttttaagtatagcttatcttagtgtagagagaaaacgtaaataaataggtgtacaataggaattataaatcaattttctaattgacaggtatgaacccagaattcacttttactactctcataattttaattttatgtaatcttatgactctattatattttctttccaactaaaatatattgaaaagattaagtctaatggaacaagatactcttgagagtacagctgataaattgctctgagtttgcctttaggactttaatcatctctgtatcgtaccaagatttaaacatttacaactcaccttaaatacaggtgtgcttattatggtaaagttccccaaagaaaaggtgaagtacaaaagtgattaggtatatcgtggtttttacccagatcagaagacatgatttcagtgtgctcagcagagttagtaaatatatttatatagcattatagaccatagtcttcatttcagagttggagaattttggagattttttattttaacatttacttaaaaacatgtaatgaaacacttgttgctctttttttccctaaattcccaactccaaacctggttgaaacacacacacacacacacacacacacacacacacacacacacacacatagtaaaaaacaataagatcaaaggaattgatttatttaattaagtcaaataatacacttgaatgatacactgaaattttctcctgctgtggtttctaatcattatctcacttttcaggatacaggatggagttattttcatagagtattcatttaattatgtttactgagcacctactatacatcagggacacacaggcttaggcataaggatttagtgataacctagacacagaggatccttggtttcataaagcttatgtcctagtgcagaaagacagtgaaggaacaagtaaacaaataaacgtaattttaagtggtaatgggagctatgaagaaaattaagcatagacagtgaatgcagggaggcggtttttttaacttggatagtcagggaaaagcttctcagaggaggtgacatttgagcgatattaacactaagaaaagccaagtataagaagatctggggaaataatattcttggtataagtaacagcaagtataaaaggcctgcgctgggaacaagcttggtgtatcttcaatgaatggcaagaaattgtggctgtggcctgtgaatgaattggaattggagagttaatcaggggccagatcatgtagatgcttttttttttaacatggcaaaattttgtcatgaattttttttttttttgaagagagacggggtcttattatgttgcccaggatagtctcaaactgctgacttcaagctatccaccctcctcagcctcccagatagctgagattatacccacaactggctcagatcatgtacactcttgtggttatgtttagaatttaggatttcttttaaagatgataactaatggagcttgactaaggagtggttgttatattgatctgcagagcagtagaagcagggacactaagaagtaattagtcttaatgaaagatgatggtggttgggtgtagtgcctgataatgtattaatagtgttttcaggtcatttgctactgaaaagtgtgatacaataaaagtagataattggccactgcattgagtaacatggaggtcattcattgtaaccatgaaagtggttttagtgaagtgactgggacaaaagcttgagtggcatatataaaagagaaaaatgaggaataatagagtgagaccatggggatataaaattagtaagttttgctggtaaagaaaatagacaaaaaagcagcaggattgggggatgtcaggatactgtttcgtgtgtatttttattttttaagattaaagcaattacacatatttgtatattgatgggaaacaacaaaatggaaggggaaatgatgatgcaagaaagaaaaagaatgcatagaggaataatatgtttaaaaggtgaaaagcagtaggacccagtttataactggtagagttgaccttggtgggaatacagacaatacgtctattatagcaggatagaatgcagtgtggatccaaataatattaggtttacagatttgatggatatctgaggtagctctgttttttcaagaaaatattaggtgagatcataagctgagacagaattagatattttaagagacagaacaagttgtttgttaatcatcttatagaatggggaaaaaagtttttaatagagaaatgcaataggattgcccaaagtgctctgctcacatatagcatgagagcaattgatatggttgtatatgaaagtacttgggtgtagatacagaatttgcagcttgtcacataattggagttttaccaggtaagtaaatcagtcatttggaatgctacttttaactgcctactcatcagcttaatcagaagccagactccactgttaattttctgggtcaccatagctagatttgtgatttctttttgctcaatttatttatgtgtaaaatgaattatcaatgctttatttgtgggagcaaatgcaaaataaaaattggcatgcattaggatttcactggaaaagaaatgtatagttttggttttgctatcagaccatcccagtttgatattctggctttgttatttattaattacatgaccatgaacaaaattacttaaattctgtgagtctcaacttcttcttccataaaatggggataataataatacctgtattcaaaagtttgatattagaaataatataaaagcaactagcacagtatgtaacatgtatcaaatagtcaatatgcaatgttattaacacaatgatcattactattaataacggtaattaagcaaactatagatttaataaagttattgattattatcaccttctctcattaggtattgcaaatgctgtttttaatggacaaagcggtcaaatattattcagaagcaatgggaatattaccagagaactcaccaatatcacatttggtttcagaacaagggatgcaaatgtaataatattgcatgcagaaaaagagcctgaatttcttaatattagcattcaagattccagattattctttcaattgcaaagtggcaacagcttttatatgctaagtctgacaagtttgcagtcagtgaatgatggcacatggcacgaagtgaccctttccatgacagacccactgtcccagacctccaggtggcaaatggaagtggacaacgaaacaccttttgtgaccagcacaattgctactggaagcctcaactttttgaaggataatacagatatttatgtgggagacagagctattgacaatataaagggcctgcaagggtgtctaagtacaatagaaatcggaggcatttatctctcttactttgaaaatgttcatggtttcattaataaacctcaggaagagcaatttctcaaaatctctaccaattcagtggtcactggctgtttgcagttaaatgtctgcaactccaacccctgtttgcatggaggaaactgtgaagacatctatagctcttatcattgctcctgtcccttgggatggtcagggaaacactgtgaactcaacatcgatgaatgcttttcaaacccctgtatccatggcaactgctctgacagagttgcagcctaccactgcacatgtgagcctggatacactggtgtgaactgtgaagtggatatagacaactgccagagtcaccagtgtgcaaatggagccacctgcattagtcatactaatggctattcttgcctctgttttggaaattttacaggaaaattttgcaggtgagcataaagtccatatgaagcttggtctttgaagctatactctgcatcactgttcttgtcaaattggaaagctctctcctcaaggtatacatatatactgtgctgaacagggtgacactggtagcttctgtcacaatttggtcatgttcagatgggatctcacttaccaggatattctacaggtcagaaaggtagtgtttaaatcagattttcagcaaaatattttctcagtcatctgtgtgaaaatatgtctcatgaactgtagccccagggtctaacagtttcaaggcctcgggaaacaaatgcatttacaataaatgcaaaagctgaaatgtagtattgttagggaaggcatgacttctattgctaaaataatgccttgagctatttcaggcaggtaaatactctaaaatcccgaaaacagtacattaaagtatacagctgactcttgaacaacgcaggggttagaggtgctgatgtgcagttgaaaatccacatttaacttttaactctcccaaaacataacaactatcagcctggttgaccacaaaccttaacaataacatagtcaattaacacatattttgtatgtcatattctgtcttcttactataaagcaagctagagaaaataaaatgttattaagaaaatcataggaaagaaaaaataaatttactattcattagtggaaattgatcatcaaagatctttatcttgattgtcttcatgttgattaggatgaagaggaagagaaggggttggttttgctgtctcagtggtggcagaggtgaaagaacatccacatataagtgaatccacaccattcaaacatgtgttgttcaagggtcaactgtaatttcaaaacagtggaattataattctcagacaaatataaaataaacatgttttaattattctgtcattaatgaggaaactagtaagatataaaaactaattcaaaggacaatctaaagaatatgtatacgtatatatacaaacaagaatgagtgaatgaatttattaataaatacaaaactgtttaatatcccatagggcaagaaaactagtatttgaagtcatcttcaatactgtgataatcatttgtatggctcactacagataaactaatttgcattttgacgaacaagattttcatattaatattgttttctacaacttacagaattgtaataaggcacagaccactgcaaaagtggataatcctggatagtcctttatgtaaacccagcagtgcattgaaagaatatgcagtgattttttttgcccatttcaaagtatttcacatttttctacaactacaaaagcagtattttagttcttgtaactacctccatttcaagctatataaacagagataagaaagactatttttcttctaagtcacattgcttcagtatttccatgtaagaagttattattgtttttacaacttacaccgctttaaatttactaaataattgagtcattatggggaggtgagagggttattattaacaagtaatacattccagaacttcggcaagaacacctggaatgggttggcagcctgtagacattacactaattcagaggtggtaccttaattgcatgaatctcctagcaaacataacatgtaggcatacctataagaagttgtacatctctccttaacagttactgttctgagcctgtgaaagcaaggcactgttgtaggtgctaagtgttcccaacaggtaacctgcctgtttaaaagcaagaagaattcaggatcaaatttagtatatttcactgtgaattttgataagtaaaataaacacataggccctagtaactacttctccagaatttttttctgcctaattcattaaagtcaagttctgaaagatgaaagccctcaaaaataccttctaatgagattcaggaattgtttattaaaaccaagatgtatacaaagcttcatatttgcattgctaattgacctctttcaaagctggttgacatttttggctcttttgaaaagtctttatgatatccttctttttaaagtagaattgattagctcttgcgggaagagacacacttagcatcatataagctagtctatccacattagctgcagcacacacaacagaacaaaattcaattcattttacacttcctgaatatttattagttatctgataccatgcacatacacagtgggtcaaagggcctaagcaacactattaaactctttaaatatcagtcccttcacattactagattttgtcttacagtgaagttccgcttagcttctaatacttgttccgccttttatgaggattctttaacatgtaaagctttgttgccatatcagagagccacactctgaattcacatgcagttaccatcgtgtgctatatacaaagctcctggacagcatttggcttgcattcttcgaagctatgaattattacatagggagcagcaagtcttggcagggcaactggagttcagctctgaaagccaatagagaaatcacatgagtgcttgggtagtagagtgctgtccttgcttcctggcctttatagagatgcaattttcctatggcctttattgatttattagcaaagcagcagcaaatctagttatagcaagttcttttccaacccaaaatttattgccaccccatggcatagatcttatctcacaaacgaaaactgtgtagaaatggaagatgtatagccatgcttgtcacagaaccctccagcaggagctttttactggagaaagtgattcttgcataatgcagcacaattaagcatttgtagctcctccagcctgagtacttaattagcttggcattgactacatacatgaatttatcagaaaacttttcttgaatgagatgaacaagatgaacagctgtggctcttgcttttatctctctagacagagcagattaccctcaacagtctgtgggaatgagaagacaaatctcacttgctacaatggaggcaactgcacagagttccagactgaattaaaatgtatgtgccggccaggttttactggagaatggtgagtcacattagagccttctggaagagaattctgagctaaagaatgatgggattactcaaagttcattttctcctctaattttttatctcagttcccataggaaaatctatgctgaaatagaggttcagacagaatgaaacaataaaaaagaagaaaaactacagtttaggtcaaaggggagaacattttattagacaaaacttcaaatagggaaaaatgatttttaaaaaatgtataatgtgctatttttctttcttataagtacttctgaattcatgtctcttttttgttgctaactctaatacatgatgcaaatatggttgctgtcgaggtaaaataaattacaactaaaagattgcctcatagaattgcctacaacccaaaagtatatataccttatccatatgagtctacttttcccagagaaactcttcaactgttcttcacctcatacaggaattcttaaaatggagttggtcaatggcttcaggcaatctgtgacctgctgaaaatacaggaaaattagaatatgtatttgagtggctaggggtaagttcaggggtagaaataatgcatactgaatagcttttatcagctgcttaaagggatttatgtccccaaaacagttatgaactggggctctatagaatacagatactatataagcagataattgttaaccttttgttttagcactgtgccatgcaccttacaaataccatctctaattcttatagctctgtaaagaaggtttcatgatttttattttgcatatgtgtaaactgaggctgagaggttgagtgacgtataaagggcctatccacacgtttgctgcagtaaggttgagctgccttcaaagcctctgctcttctatttgatgtgccagcataactgtatgaataaatctttgctcaacacaatttctttttttttaatgagaaaggtgttcttccatctcatgtatcatcgagggtaagataagtgatctctgatcaaacttcctacattgaaaaaattaaataaactgagctcagacatatttgacaaagatattttgactgactcaatatttcccataagcatagttaataaaataatggatatgtgagtgctccctggcaagtgccctttggattaattggaattttctgttttctagctggcctcttttgcatcacaaagacacaggtcttttgccatttttacaaaacagcggggagtctagggtatacctgaatttgacccttttaacgttcattttcatttgcagcctgccttctgtggttggttctttgtggtacaggcattccaagtctatatgtgcatgaaaggagatagccttgagtcacattctgctttctgttgcaccaattttggttctgcaacttattaactgagatcgtttagttgtattccaattccatgtatctttcaaaatattgcaaatattttcttgtcattaattttgagtaatccaactattgtcaagggtgggttgcttcctggttgaacgtcacactttctgcctaatggcacaatgcatggaactcatccaaaaccctggattatttttctctgccactcacacattgtttctatttacaacaaatatctccctgtcttctgatatttattagtttacaaaatttatatttgacatttaaattcagatatatttgaaatatagaaagaaaagaaagcttagagttttccttcttttcccaggagacttttcaactggaaaaacttacatgatgctagatatttctaaaacattgaacctgtgttcagtagattctatgctttcaaagtccttaaccatcattacttaattgactagatgttaatggatttatttttacttttcatgcattaattaacctctaataaaaatgccaatgatgctgataatacatgtgtatctattgttgactgtttagttcaacagagaaataggtgagaaagtgatggagtagttagaggaagacagaaaatagtgggctatctcccatggcctagggaaatgtgacttccatcacatccaaggatattgaaaagctatcctcaaataaattggcttctctcctgccttggttaaaccttcagcttaatagtgtcatcctggcaggttttgaatgatggatggtgtgaacactctggcccacccaagaccgagaatgcttggcaggctcctgagggttgtcaagttttgctcagatctaatcagagaagtctccctccagtccagaagcataagccaaaaaaggaaaacaaaatgtctcagctatgcttggtatccaaagggataaggagctgtttttcttggaagaaatctttgttttcctttataccttgggctggccttgccccactacctcaccccctttcattttgagcctagtgattagtctctgacccatacgtgcaagttttacattttggaaggtgagggaaagaataagggaaaattaaaaattgtttacatacaatttcaacattataagctgcactatagagatcttggagctaagattttatataaattttcaaaagtaaaatagccgccttagttgctgttctatcccaaggtcttagcagagtgtttgtcacatagtatgtgttaaataaatatccactgtgtgactgaatacatgattggtgacttaatccatgaatatacagaaaaacaaattcttgctggaaaattagtttaaaaaaatgacaatatcccaggaagaagaaaacttcaatttacctgagacttgatgtcacttgtcttggaaaatttggcttttgaaagtcattctacctcaacatttcagaaattatgcttggctattggaacacagatttattagcaagtacaatcttctaattattgatttttgcttttgttataaaaaaaggatttccacagaaaataattcaaaatctctcagaataaacctctcctcttcctcctcctcctccttccctccttcttttttttttttttttttttttttggtttctctttggtgggctttttccttagcctgagggctctgatgcatgaggatcctgatagcctgaatgtaggtctgccctgcagactccagatggcaaaatacagcctctctccttgtgcccctaataaactgaacatttatataaggtggcaaccacactaatgctcttgagcattgacactggtgtaggcatggcccacttttctcttggtttctaaatatttgcatctattttctcattctaattaattccgtgtgtatatgtatatatatgtgtacagattatttccattaaaccccaaatgtgttaaagaaattttaagaaacatctccgacattatcaagtatgtataaagtatgtgtggatgggtagataagactgtgctgttccagagagataaggcaaactttttcttcccatttcacaaccaatgtattcaacagggacctgggtttctgctgttctgtttattttgaaggtgtgaaaaggacattgatgagtgtgcctctgatccgtgtgtcaatggaggtctgtgccaggacttactcaacaaattccagtgcctctgtgatgttgcctttgctggcgagcgctgcgaggtggacgtaagcagcctctccttttatgtctctctcttattctggcagaatctttttcagcttctttcttacctcattttgcgtatgaatgacgagccagttgttgagtggggtgaacaggaagattattaacatacatttgaacattcccaaatgaaaaaaaaagccattgaatttcaagaaatgccttgattcattttagatctctggggaagaaaaaggaaataaaaaccatctcaataattaaggtaaattcaaggcttattttaaacatatcagaagcactttgtctgtgtataaaatattttcctattctaactttaaatatgaaaaaagtgttcttaatataactagaaatatctccttattgtgtgtatttagtacaaacatattatcattctcaacacttctatatgtgaatgaccactgcaatttcttcccactccatttctgggtattttcacattttaagttgccctccatcactatgattctattttcatttctgttctttcattcttatctattatttatgacacaaaaattgagaattacaggccaggtgtggtggttcactcctataatcccagcactatgggaggctgaagtgggcggaacacctgaggccaggagtttgagaccagcctagccaacgtggtgaaaacctgtctctactaaaaatacaaaagtaactgggagtggtggcacatgcctgtaatcccagctactcaggagggtgaagcaggagacttgcttgaacccaggaggcggccgttgcaatgagccaagattgtgccactgcactccagcctgggcgacaggtgagattctgtctaaaaaaaaaaaaaaaaaaagagagaattaccgattaaaattactgattatattcatctatgtttttacatgaagctattcaaatgaattgttacgttttctctgatatatgattaaatatataaagagaaatcaggaatttacatcgagtccctaaattgtagaaaaacaattatctagtatcagtactcaaattatacctccctggtataatttctgattccataaaactgtctctctaacaaagttacaaataatcctttctctatttcctttcctgcaatactttcccttttcctaacaaatagaacaatttttctgttgtttctaaatttatgagctccttgacttttctatcaaatggactaatttcagttgcttttcaatgaatatttaataaaaataagcactgtagtttatacataaatttaaaagtatatattgtaaaacttgaattttcttagaagcatggttttctaagatttgcaagtaaatttattttcttaagtatctttcagaaaaaaatatgaaagcatagtatacatcataaccaaaatatatttgacattatgattttttaaaataaatgtatacctgaaataatggatctataaagtatactaagatatgcaaaaattaatatattctttattataaatatttcagagattataaaataataatttaaaaaaactttcttaatgtttttattgtttccaccagtacgttatcatttatgctaaatatctttgtgtagatatacccttccaaagaagacgttatttgtgttcatttaaaggaaaaatagtttgatcctatgaattaattcagaaagcaactaaaataacaatggcctgccaaatgtcattttgtaaatatacgtctatgactttaggagctgtcctggtttgaaaacatgaggacagtttatccattggatgccatctatttagtcccaattaagaaagttgtttttttgtgagaatgaccaaggtaaatttaaatataccattcaaacaaacaaggacaaaataatatccttgttatagagtacatgtagcatatagtatgaagtaatatactacaaaagcaaagaaagtgtattctatcttgcaatagtaatagacaatttttatatagcaaattcatatcctttggagtagtgacaatcatttcaaactgggagcaactaattgtgaagattttccttcttactcatccattttcttcacatccaaggctgaacgtgtgatgctgctgcttcagatgatttgttccaaagttaaattttgtgacaaaagacatggggaaaaccttcccatcaatatttacattcacaagtatttgcaataagcataaaatagattatagccagaccatatgtatagttttcacatttactcccttctagacatacctgtacttatgtacttacaggctgttccaaatgtaatatgttctctaccaaatgtggttaagaaatattcactcacaatttctttctgtgtacaattctgatgcctctgttgtcactgtaattgtcagttgcttttctgttttccaaatgtcttcttgtcataaggtatctgactttaaaaaatgttttcccttttctttttattcttctgtattttccagctgcatgtgtgtgactatggcttttacatatttgcacagaaaaataaaacctttgtttctgtatcttctctttctcatcttctaatggtacttgtacttgtttgccttgactatgtcttgtatgataaaatttccaccagccatgcatacacacacacacacacacacacacacaccacagaagtactggtactgatcttcctgaatcgtgatctctttctgtgaaagtgtcactgtgagtaaacactgtggtatccaagtaaagttgcatgtactctggcaagtaatcctctagttggcattctaaagttgattacaaccctaattgttcttattattggtttacattgtccctgccaaagctagccatagttcaacctggttctaaagaggggctgttttacctaaatgacagaaatttacactaactcctctggaccaagcttctaaaacatagcctatatttacttgaataaaaactaattccattttgctgcgtttttcagatttaacattaaactaaacagggctatgtctctatgtttggccatgcctccttttttgtgtgcgtacgtggcaagtgggtttttatcaccctcccttttgcaaaataggaaaatagagagaataggcaaatttggaaaaatcagtgtttgaggaggagagacaactaagttcaattaacaccactgaggacttactctatgccaggaactgtgataagcctttttaaatactttatcttttcaattatcttttttcaatacaaggtcaaccaaaatctttttatcttccaaattcttcactaaattttcttaaaatatcttttggccatttgtaggtttaaaaatagaaactgttaagctttaattttgcaatattaaaattaaacttcttctgcaaatggtgctgcataaaatttgagtttagtgagttaggcaggaaatcagtgaagaaatctgtttctcaactgccagtattattactaatataaactattttacttctctgcttttgtacttattcaacaaatgtttaatgtatgtctactatttgccatactgtatactaggtcctgggaatagaactatgatttagacacaatgcttgctcaaaataagctgaagttatggtaaggaatgtgggttagactgggtgtggtggctcacacctgtaatcccagcactttgggaagccgaggtgggtggatgacctgcagtcaggagttcaagatcagcctgacaaacatggtgaaaccttgtctatactaaaaatacaaaaattagctgggcatggtggcgcatgcctgtaatcccagccactcaggaggccgaggaaggagaatcactttaacccgggaggtggaggttgcagtgagctgagatcacaccattacactccagcctgggtgacagagtgagactttgtctcaaaaaaaaaaaaatgtgattaaacaaatagtcttaggatgtaactaggatgtaactgagtgccagctgtaagggagcatataagagaggcattttgtccagtcttacaggtgggtatagaaggtcaaggaaagtttcctgaagcctaagctaagacttgagggagttaggctgtggaagaagcaatggcacagtactgtgtgtttcaggcagaaggggctggagaggttgtgcactgtgacagggatatcacagggtggcagtgctgaaagatggggctgtcgaaagaagcaggagtaagcccttatacaccttggcagaggccttggtttttcatcataagagaaatggagaatccttgaagggtttcaaacaagaaaaatgtcatgattatacttgcactttagaaagatcacttgggcttctacatagagaatggcttaaaagaaaggcaagactggacccagaaagacacagctaggaggctgctgcagtgataaagaaagaaggagaatttgcactaccatatatagttgtagagaagatagattttaaaagtttgaagcatgattttttgggagaagctgtgggtctaagggggtgataacttaaatttggtggataatatttttaatatctttgttgattggataaatgaatgaatttaagatctgttggatatctaaatacagttattaatcagtgtgcatattccattctggagttcaagaggcatatcagggtgtatatatttgggatatatattatagatctattgagtgttatattccattctttgtatatgtaatccatttgtattatttatttattgttctgcaacaatattacttcaaacttggcaacttaaaacaacacacatttattatctcacagtttctgtgttcaggagcccaggcatggcttaactaggtcctctgctcagggtctcacaagacagcattcaaggtgtcagccagagatgtggtctcatctgagctgaaccagggagggatccacttccagagtgaactcagtgatcaagttcactgaggctgatggcagaggtagccttcgattcctgaaggcagccctcagctccttgccacttggggctccccaacatggttgcttacttcctcaaagccaaaaaaggagggagagatgccagcaagatggatgttaccattttatataacataattatgcaattgtgtacatataatcgcatacttctcctcacctttgtcatagtctgttggttaagaacaagtcacaggttctatctacactgaaagcgagaggggcacacaaggtgtaaacaccaggaggtggggaccaaccatggggggttcacttaaaagggtgtctgccagctggttgcagtggctcacatctgtaatcccagcattttgggaggcctatgcagtaagatcacttgagtctaggatttccaggccagctaggaagcatggtaaaatcccctttctgacaaaaaaaaagaaaagaaaaaatacaaaaattagtttggcatgtgcctgtagtcccagctactaaggaggctgaggctaggtgggaagatcacctgagcctgggaagtcgaggctgccatgagccatgatggcaccactgcactccagcctgggcaacagagcaagaacctgtctcaaaaaaaaaaaaaaaaaaaaaagtctgtctgccaaaccttctctcacagtatctttttttactgtctgtgctgtattctgcatatattccctattgctatcttccaagcactgatagtccacatataatccactgatagatttttcaattttaaattactttaaaaaattctgacttttttaaatcttacaaatcaatcttttctcctgtttgtgtcctgtttttttttctctataattgctaccttcattttactttcacataattaggaacttatttaatagtgtctttcagactgttgtgttatttcaagctcttggagtgctcaccctcctatttttgtttctggggaattttactcacaacagagtttttcttcatgtggtttgttatttttttatgagcaaaaacaactttaagaggatttttctttttcctggggggtctttgtgtgctgagttgcgtaaatgcccctgactacagtcttagctttagatttttgctaggatgccaggagttccactggtctagtgcctgtttttgtgctcttagtttggggattcccacaacatctggatagtgtaaatttggtctccatatacaatttgggttcaagccctttataaatgtgacacaaactgtctccaacttcatttcttacctgtgctctcacaaactccactctccagccacatgaaactttgcacctccctttgaacttttcacagctgccacagctcttcccttacgtgctgttcctcccacctaacctgtcattcccttcttctctgtttgacatacttttgtccttccagaaatttcagatcttgtatagactcttctaggatcctttccctgattgccccaggaaaagcttactattttattcctgcacttttttgctattttgtacttctttttctagtgcttattatttggtaattatctatgcatgtacacacaaaaacagcatccaataataaactgctcaaggccagaggccatctaacatatctaactcagctctacaaatgtctgtaaaagaatgatcactttacagtaacatggagatcttgagaagaaattatattgcttccttattttaatatttttattttaatgaggataaatgcatagtgtagctagaataaaatttatcatgatacacttatagctaagtgagaaactgcaggctatttaagaatacaaattcatagtggtatttacaacaatgtcaaaagaatagcaactatgtcagtgtgcatttttattttcccttagttgtaacatcatagttatgacagctgctttaaaatccttttcagttaattccaacacctaggtcattttgtgattggtcaccatttattgaatttccttttgtatataagtttcatttttctgtttctttatccagtaattttggattgcatcctggtcattgtagcttatacaatgcagagattatgaatgaattcttttatgtttttcagaaaaatattattattattttattttattttatatttttgagatggagtctcgcactgtcgcccaggctggagtgcagtggcgcaatctcggctcactgcaagctccgcctgccgggttcatgccattctcctgcctcagcctctcaagtaggtgggattacaggcgccggccaccacgcccggctaattttttgtatttttagtagagacgggatttcaccgtgttagccaggatggtctcgatctcctgacctcgtgatccgcccgcctcggcctcccaaagtgctggaattacaagcgtgagccaccacgcctggcccagaaaaatattattttattttggcaggcagtctcttagctgaatcaaacttctagtcctgtagcagtgccctctgtggtgtgtcacagctgcaatctctgctcagttattttgtctttagctgggtgacttggagtgtacgctacatgggcatattacaagggtgaaccagagatttgagcagaaatcattttcagaagttgaggctccacctctgtagctgtctcctttctagaatttttccttcactttctagctgctgtggtgaaccctcttttctctggttcttcaagcctgtaagattgcaaacgtctctcctagttttagttaactggcatggtgctgagcagagactgcactccaaaaaaataaaaatcacatagtgccctccgctctgcttagttcaaattctcatacaggtcgatgcatacttttggttattatctgagtgccctcagattgttgttttttgctattccatctggattttattgctgttatatgccgaagggttactctagtagaagctactttgtccacagaagtggaaactgtaattttaagaaggtaatctgagattgtaatcgcataggtatttggtcccagaacaagatacatggttttccttctgatttctgcactgaccacatcaattcagaagcgcaggttttacttctgggcactacattccggggaaaacattgatgaatgccagggcctagaaaagggcattttagcttattttagcaggtttgttacataggtatattgtgtgatgcgtgatgctgaagtttggcatatgaatgatcctgtcaccaggtagtgagcatagtaacccaacagttagttttttttgtaaacattataaggataaacggatattttgtctagaaagggaagacttaaggaaagcatgaaactgccttcacatatttgaaacgttatcatgagaatggaaaaatagatttgttctatattaatacagaaagcataggccgggcgcggtggctcatgcctgtaatcccagcactttgggaggccgaggtgggcggatcacgaggtcaagagatcgagaccatcctggctaacatggtgaaaccccgtctctactaaaaatacaaaaaaaaaaaaaaaaaaaaaaaaaattagctgggcgtggtggccagcgcctgtagtcccagctacttgggaggctgaggcaggagaatggcgtgaacccggggggcggagcttgcggtgagctgagatcgtgccactgcactccagcctggaagacagcgagactccgtcccaaaaaaaaaaaaaaaaaaaaaaaagaaagcataaataagacaaagggatagaatttattgaaagaagatttcaagtcagcataagaggaagcaagttaacattagaagtactcaataatgtaatgcattgatttgcaccaaacaggactcccatccctggaaacattccaatagaatctgaatgaccgtatttcagaaatagtgtagagaatacttaagcactgattgaaagagagacatggacctgacatttcttaagcatctgtgattagctgattagcacaattcatgcattttctatgtataacatttctcaagattatggcatagattactcatgataacaaaattatgggccaggtggaaaaatgacatttgcgaattttagttgagcaaagtgtagtacacagggctaaataattggccgagatcacctgatactttggagaaagggaggactgggaatgattcatctagatttttcaggtcattaatacgttggaccatgttatagtaaagaaatgtttgagaatgagacatttccctaagaatgtgatatttttaaatgcattgatttattatgctgctttctctgaaactgaacctaacactgtcgattctgccccattcagagcaaggatgggctgggcctggatgtttgccatgtgcttcatatacacttacaggattttctgagcaaacttagaggtctacattgcttcatcctcaatcatttccaaacaagatctgaaacagaatcgaggcatatagccagacaatagcaagagagcaattgggaaagtttgtttaaattgcgcttttcttcttaatgtcatatggtaaaatactaacattagaaaaacattccattataaattgtaggatgtcccttataggaagattaagtgaatgctatttccaccactacatatgccactgaaacattagattgaatcatatgaacttgcaaatatttgacattttgactgataaaaatgacaatttaatacggttaaactgactccataatagatgcctgatatttgcaaggatgcttcttctaaagtttaggttgttaatgcagaagggagaattaaagagttaaaaaggatttcgggaatcatctaatccaacttctttatgtatgagatgaagaatctaaagctcagagagagagagtgctttatttagactctacaagtatcccggtctgtcaacccacagttcaatattcttcctgctgttctaagacgacgaaggaaattccctatcccatttgccagagagattgtgaatgagagtctcagagtactctaggccactgcagagtccctgcatacgtgacctattttaaagctacaaatttataaaacccaatcaacatcagcactgcattcatcaaaatgtagtcttagtctaatgatattaaaagtactttaaagaaatatgatgacgaatatcaattgtcattatataggcctaggatcttagaggatgtaggagacaaggctgagtctggcttgatttcgtgatggaaaaatgaaagcatgtatgagatgaagggaccttacatatcaattttagtaataaatattcacagaaaccttatgggataaatattataatgcccatcttatagacgggggaaataagatttagaagggctagttacctgccccagggccacacaacaaatagggatcagagcaaggtttagaacctgggagtacttacttccaagccacaggtcttcctaggatgcagcactatctttagtaacaaaccctgtaagttgattcctaaataagttacacatatgtagaaatggttcagccactataaaaacctgtatgaagtttccccaaaaaattaaaaatagaactatcatataatttgttaactgtcatatgattcatgattctgagtatatatacaaaataattgaaatcaggatttcaaagacatatctgcattcccatattcatttcagcattattcataatagccaatagatggaaacaggctacatgttcagcgaaggataaatgaataaagaaaataaaaatggaatattattcagccttaaaaagaacaaaattctgacacatgctgcaataggaatgaaccagaagtacattatgctaagtgaaattacccaattatagaaggacaaatattgtttgagttcacttatatgagatatctagaagagtcaaactcctagaagcagagggtagaattatgagtgctaggagctagggggaagtggaaatggggagatgtcattaaataagtatgtgtgtatacttgtgtatatatatatatataattaaattagtatataagtatatatatttatatataataagtatatataattaaattagtataattaaattaatatacataattaaattatatataattaaattatataacatacttatatactaatttagcatacttacaagtatagtagtatactaattataaatatattggtatataaatatatacattaaataactgtgtgtgtatatatatgtgtatatatatgtgtgtgtgtgtatatatatatatatagagagagagacagagagagagagagagagggagagggagagagagagagagagagagacaaggtcttgctctgttgcccaggctagagtccaggggtgtgatcacaactcattgcagcctcaaacttctaggttcaggcaatactccttcctcagcctcctgagtagctgggactacagccatgtgccaccacacctggctaattttcttcttctacttcctcttcttcttattattattattatattattaatatattaataataatatattgttaattattaattattaatatattatcaatattattattaatatatattaatattattaataatatatattattaatattattatattattaatatatattattgatattattatattattaataatatatattattgatattattatattattaataatatatattattgatattattatattattatttgtagagatgaggtctcactcatgttgccgaggctggtctcaagctcccaggctcaagcaatcctcctgccctggcctcccaaagtgctgggattacaggcatgagccactctacccagtggtataaaattttaattatacaagatgaataagttttaaagaacagctgtacaacaattgtgcctacagataataatactgtactgtgcacttgaaatcttgttagcagaatcttatgtaaaatgatcttaccacaattttttaaaaagttacttacttaagacagaatttaaaatacttcaaatggaggaaaaataaataaaataagaaattgttcataaatgttattttgatgcattatcaagcaccaaaattaggtctaatttggttcactaatctcttttcctttcatcttttcatacattattaagatttctgcttcaccaagtataattaatgttcttcatttcttaacgtgaggtcattgctgcaggcttcacggaaatcatgcaacataggtttttcccgtcagaacacattttttcatgtgttctgaatagaatggaaacaggcaacatacagagtggagctcctggattatagatgcaaccaactaaattggttggtttgttaagccatagacaactgtgggaaataactaggttgatgtttgctactgagttgactagctaaccaaatcatgcagcatttttgttagctgtcaaatcaatctcatcatctactaaaatctccctaaaatgatcactgccttggtacgatactggacttacggaaaccggtttttaaaataatgcatttattcattcatccaccatttatcaaaggcctttttcaggcaaagctctgagctaggcatggtaagcaactaaaatatacacaaaaaagtgtgtttgtgctttcaaagaacttaggtaagaaaatcaggtacatagcttcgtacataagagttctctaatttcgtgaatcataaagatatttttaatgtgtctataatgacatatgttggttatgacaaggttggccatattatttcttgtccaatttggagcattttcaaagtgaaagagagcaacactattaataattattctaggacagcagcctaaactgatactgttctgggcaaactaggacatatcctagttattacccacccaggagaatgcattatgttttacttgattctctttaaaatgccattgacatctatcacagatcattcagaaatcaagtctacatgttccaaaccaattaactgacaaaaataactcaaacaataaagttgacagcatcgtgttagttaccaattttcttgaattattttccttattttttgctcaaggagaacttttggcatcagttccatctatgaaaaatagagctgtcaaccaaaccgaaaactgccagtatgcacccagataccatgccgttgtcttgtttaacatgacatgaatttagtttctactaatttttaattttaagaatggtgtgtatacatttttttcttttataacttacattgcctttaggaaatgcagttgcacctcattgaattcattgctaaattttttcttgtgagaacaaattgaatagcatgtagaagactgtaggaatttactatctgaacaattttaaataccaagataattgacttgaaattggcaattgctttaatattgtttctacttaaaacttccatgaatcataatacttattcatggattatatgtgtataattttcctaaatttctttaaattaaaaatgatttttcatcctaaaaggttataaagatcatggctgttatatttttctcacaattgtaattactgaaacacaggtttgtttcatgtaaaccgtagaaatattttggagactaattatagacagaaaggaagccacatattaaatataatatccaaaaccaaataggctatttgcaatgaaagttatttgatgttttggaaattatattcatgattatttcattgtctatttgaatgtattttaatttagtttcacaaatagctacaaatatgttacttttatccacttcccttaacatttctttgataatcctatgctgataacaacagttataaaggaaaactgaagtacttctatatttgttatttaaagtgggaaaatatgtattaatgactgataaatggctgaaattactctagttgatacctagaactcaggaaaaaaattatattttgaaaccagttcatttccttgactttttcagtagccagcatcatcctgagtaagtatatactcaataaatattacctaagtgattgagataatgaatgaggtatttttgaggtaattttgaagtgtcaatttccagctttgagaattttgtttttgtgtgtgtgaatgtttttattcatcctgccccatagttactgaaattaagatgaaaatgatagtatatagtaagtacaaaattgtcccatttccctttcaaatttacaggatgaaaaaggcaaggcttgaccattagtcaccactttgttgatgacagtgtcttggagacaagtgagccacactgtccattaggaaaacatttccatctaagaacccaatgcacagaaaccccattattcatcttgaattagaatttgatataaatttaccctttcccgaaccaatcccagatgcagtcaagatccataaagacatatattgcttaccatgcctagctcagagctttgcctgaaaaaggcccttgataaatggtggatgaatgaataaatgtattattttaaaaaccggtttctgtaagtccataatcacatggacacagccaaggacactctcaaggcagtcctgcaggttatactcaatttgcttaaaaatcgtagtggtttgagaggaggagtggattttctcttcaaagtaagataagtatggttgaattgtagaaaatcatgtccttttcttccatttgctctaaagccagtaagagttgaccactgctgcaatattgaaaagacattttaaagaatatgttgctcattgttcttcgaccctaaaaccctcatttcattctcctttgcctagtcaaatacatttgttctcataatgttccagtaaagatttccttgcttccctcccccacacaatcagcatttggagtgtcttgttgccatacaatcctaagtacgcctctatcatagcatcgtataataatactaatagtggctaatatttgtcgtgtgcttactctgagcccgaaactatgctcaggtcattataagcattattttatttattattcacaaaatcccaagagttaagtaatattattttcctcattttattgatgagaactcaaaatcagagagaggataagtatcttttccaaggctctccaattcagaagttggagccacgctttcagatcccggagcatctgcatctattaccaattagctatactgcaaaagccttcatttgtctgcctcatcctccatcctgagagctataggaaggtggagaaaatgtcttgtttatctttataacttcagtacctggcaatcattcctggcagagtagtgcttcactatttaccaaaggactaaatgaacgaatgaaagaattgtatgtggtgtgcacagaagaaattagaacattcccagggctggcggtagggtagaaaaagcttcgtgcagaagatatttgatccagctcttaaagaataagcaagcattatctcagaagaacaaaaagcacatttctccttgacatgtttttttgtattgttgattgtttatttgctaccaaagtgttaatttttaatttaaacagtttttcactggagaaattagttcacaaataagttgtatacctgtcagcaaagagagcttagaatgtcagaatgcccatgtttttattgatagtgtaagtgccacactgtgtttataattatcccttgcttttgttgattattagttcttcttaacataactgcattttaaatttgtgagagtagaaaagggaaattctggaaaacaaccattaaagccataaccttcctcagggatcaccgaacgagggttatagacaaaagggaagaaaggaaacttaaggcactggtcccaaaagataatcaacgtcaacacacatttttgaaggggccctaagcaatgagagcagaaatatgccaaggaaaaatgggtggtaccagaagaaaaggaggatccaggaaagagctagtagagtttacaagtagaaggagccctacagcagccacaggagtttagggacatggatgaagatttctgcatttgccccaaaagtgccattaagaacactaaagcttatctttttttttacaaatctagttgtcagaaaagccttacaacaaattttctaaatgttctcttctttccaaattcagttgagcctgaagggtttatgctgtccactcccacctattcattgccaattcatcttccctataagccaccttcatctgcaataactgctccccacaggataagctgacattctgggcttctaggcaggaaatccaatgttctgtcctttcataagtcccatggcaatgcagagagctgctggagtcagtgccttccacatattctctacagctgaaagaatgcaagcatcttcccaaagtcaccattccatccacacgtttgtttcttcaatacatctggcaatgggtagtacacagggagagaagaaggagagcagggaatctgtaaaagataacatataattcttatgacaatactttcaaggaaactataatctagctgtcaagaaaaaagaaactacaaaacatcctgaaaacaattaatccctaatttatgttactgagtaaaagcacagtataaattcacagaagtctgatcgctatgagctattgcaagagggaaagttttcatggaggatacggaaattaaagtaggccatgacatatgagaaagattatttatagaacagaaaatgggagcacattcaagagagaaaaatgtcgcaagtaaagatgtgatagtgggaaaaaaaagtttggatgggatgaagaacagagactaggtaggcctgattttaatagataaagaatgtcaggaaatagtaggatatagaagtggataaattaagagaaagattagatgatggattccctcgaccaaactttggtaaaaatccagccagagaagaaagaatcattctataattctgtgatttaggtatatgccatgttttcttctcaaatgtttcctacaggttttgattatgtatggctacaattcactttctgactagaaaggacctactttactctgtttggactgctgtaacaaaatgccattgactgggtaacttttaaacaacagaagggtattagtactggaggctgggaacttcaagaccaactaaccagcagatttagtgtctggtgaggaaccacccatttcctggttcgtaaatggtctcttctctctgtgtcctcacatgacaaaggaacaaggcagttctccaggacctcttttataaggtcaccaatcccattcatgaaggctctaccctcatgacctaattggccccatcttctaatacggtgacattggcgattaggtttcagtgaatgaaatctgggaggacataaacattcagaccatggcaggatcttacaccaaaatggtagcatctttccttcatgatggatttatcaataaaaactcctgaattatattctcagacgaattctttcattttggaactcaaagcaatacaaactgtttattcttccagaattttttaaaatatataatgttatgtagacagaaagtttttcctgagcagatttttttgggagtttggtttttgaaactagcttattaaatccacaaaatcttcagtccaatttttgatttctgctaattagaagttttcactaggcatagttttgttagtaagtcttgctttaagcccccctcttttttttttttttttttttttacttcacttgaatctttctaaagttcttaattgaggattttaattgaaggtttttagacctatgatgctctcctatttctctcaaagggccaaagacatgttttgttctggggaggttcagatatgatcagattaagtcttctttcactaaaaattgagcaaattccctggatcagcatcactaaaaaagagtctctggggcaatagactgatgttattactcaccattttaatgtacataaaattaaggaactatatttactcacttcagaaaatttctaagttgtgcagatcaatataaaaggtgccttatactgagcagtggttggtttgaacatttctgtgattagtgcaatctattttcagagctaaggaagccagaagattaaaaaagcagacccttcactacctgaggggagttaacagtctagtgcacaagaaagcttgcatcagatgaccaggattcttacggtgcctctttcagccaagggttgtgccttctctgatattaggccataatgatcacatgcactcaacatgcaatgcctcatttagttctaaccatcatagtactgttatttccactttacagatgctgaaacgaaggcccaaagaagtgaagtgacttacttggggtcacacagttcatttaacctcaaatcctcatttttttctccagtgtataattttggttttctgtttcctagtttgtgaagtgcaacatttggagactgtttttaagcagactgtcctaccagaaaattctagaagtcttaatatttcttaattgtaaaataagtgttttagaagagatgccattacacatagtttacaaaaacacaagtttatcatgggaccaactgtgtccagggaactctggaatttcttaaagaacaggtctaggggcaaatatggaatgtaaatgggaaagaaattgtaaattttgctctacggccctaataggatccagaatctatttgtttttaccattaggtcctgtgaacactaaagataatcacagctggcaatatgtaaattatccatatttgcagcttcttgaagttaaaggttgtgtgtgtttggctggtataactgcattgccacttaattaccaatataaatgctctcaaattatagataccaatgtaagcccctcaacttaaagatttatttgcagaactctaagtaatgacattgagcttcacattcacattgtgaggtgagctgaagaggatcagcttctgtgtgtaattgtgcatgattagtcttctgccttgaaacagaaaaggagtatttcataggattcccaccatggctggggaggacaggccgtggctggggaagacagaggactactctgatggagaaaatgcacacctttgtaaagaggcactctgggatggaaagagcctggggtgggttatgagagccatgaaggtgatgcacatgtgcataaagggaaagcatttgagtggctgcctcttcaaattaaatattctgtgacagaagagtaggctgcatcctgtgtgttagctctcatggcactgcaagctagagagacgtataacaagaaccatcatcactggtcaatttccttttaaagacctgtccactgatttactcattccattgatcagacattgcaattcacaagctcctattacattctcttggttaaaagtgaggtccagattgggctcgacacatgaatctgtagagctttcccctctacctggcaaacaatccaagtcgcacctggatatatcagaccttactcatcatttatgtccaggagtgctgcatttgttttacaatgccatctaatttgtcagctcagttcaaaaaaatttcagcacctgcaaaacatcatgaactctgaagttgacaggaaaagatggcatgttgtttgaatagttttctcaagatagaaatgtatgagtcttgaaattgtacataaagacaaaagcacagcatgccatgaattgcaggaactcatcgcggaggacatgcctattagaatttatgctacacaaatgcaaaagtatgttcttataaattaaatagtttgacttttccacattttatacacatgtaatgttgtcgttcttgattttgtacatgatagtgtagaataagctttttgccttagactttttataggcagaaatgtgccactgcaatgaaaaaacttaggagcattttatggatgactgtattaccatcctcatcaattggcatttattgaattcaggcaccataaataatactgatatatcttacatatagtggaatatgtgtgtatgttttaataaatgatttaaattattttcaggccatttttacattaatctataaggaaatataagctcctttaaaatggttttgaaacttagtgtctcaaaaggagtacaaaaacaactccgaagttcccctatgcttctggaaacattaaatcctcttggcaatgggtgacatgtgaaaggactccctcagtttgccctgaaatactccctttggtcctaaaaacattacgcactcctttagggagttcgaggcaaaggagccagtgtgttttgagggacaaggtataaatgctacggcatccaagaggattagctgccttttctggaaaattaggaaattgatgtataatttttaattacacataaatttcaaactttccatcaaagtcaaattgtgctgatgtagtcaaacgtaatctaagcattgattcaagaacctgctgatggagtgaaaatacatggaaacttgttaacaggaattacaattatctacatctcagcaaataacgccagagtgtcatgtaatatgctgagctcaggcagcctatagccaatgcagatcttttttttttttcttcaccattaatatttacagttggaagcaaaacatggctgcaatctaagtgctgcacctaacaaggaagttgttggcttgataccttgtttcctgacactgtgaagcactgaaacagctaccttcttaatcatcgcctgatgatattgtgttgaaactggaggggagcacatggctgttttataagagccacaaccctgggagattttcttcattgtttagttgttttacttcttgatagacatactgggatgttaaaagcataggactgaaaattgtgcattatggagttttttctttgttctcctgctgaatttttctaggtctatgcagacactgtttgtaaagacagtttacctcctgacacctgctgtgtgctaggcaccttcctagaactgaaaacaaaacccttccacccatcagcctactttattgtagttattctcacatgcaaagtccaaaaaaaacaaaacacacacacactaagcaaacatcagtaatcagagaagcatgattggttacataagcactgtgcatagtaagagacctgaaatataaaataaccatttttactcttctttcagtctgcagatatgccaactaagggtaatacagttgaaattatggggtagatttggggttacatttatatagtgctctatctaaggatgcagctgtgcgtaattaaacaagccctgataatttggattctaagctgcttactagctgtgtgactttggacaaattgcttaaatcatcttttaaatacatgcaataatctctatatcattagattgtggtgaaaattaagagatgacatctaaaatgccagaaaatattaaatcctcagcttgtagttactttttccatatccctatgttccaccttttagttctaacgtattttacaggtaatcccagtgtagcgaatgaaccagatacaggaaagattaactacctggatcgaatgctcaaagaatcaaagacctagttgtcatctttgtcatagaattaatctatttactctgggttcctgaaactagtaaaagaaccctaacaaatagcagcaaacgaattttagtgaaagagaacaatgaaacatttaatagaagaccaacttctaagaactacttaataaaaatgccttttaatattgaggtgatttctgctcaggtccaccccacaaagaggacctggactgagttgagctgtgttgcaactctttctcgcttgtcaaagttgtagctcctcctcgtgttgctaaatcacagcagatggcttccttttacacccaacgccgtcagtggaatgtaaatgcgtctcctcacaacactgaaaatactgaggctgtgtgtttaatctgtgctgtacaagccgaatgaccctgaaaagaacatgagcactgagcacgtttggagaattggcatcaatccttggaaacaggattggggaggatttttcaggcctagtgactaatcatggttttcttcctgaggctcctaactcagccatatccctgaggacaagcaatctaaatggtgattgaatagaaaagttatagacccaagggaagtatttttttttttaaaggggcagtgggagtgttgtttggggtatgggaaaaagtagagagagttgcgctgcactgcaaaattgaagaggcttagtttatagtttgaacattcaattctatgtctccttgggagttaaaaaaataaaatttccctgtttcagattatttaagtcactaagaggaatactttctctaagcaattacttcaaaattcagaaataatgtaaataattcatgtcagtatgataccaagtatgagacaagaattatccagaaaaaaaactatattttgagagtatgaatagcaaattatagaaataaaatataatcaagcacattagccaggttatctcagcttctttcttaaatagatctccaagctgcttagaaaacagagaacctgatcttcattttattaaaacagtctccaaaaattaaccagtggctaaaggagaagagaacttgtcatgcaatttgtcttttgagccttttgtagcaaaggaacagagttcttgtcacttctgcttcccacctttccttgggcaagggtctcaaactattatttcaaaaaaagatgtggtcattgtgaatatcataattaccctatgtactgtatataacacagacttagagatcccaaagcataaaataaccactttagctttattgtatgatctaattttatagcaggttattaaattctgtgctaaatttatacatagagatggagaaattttagttcagcagtatttttaaactaataggaaaatgctgttagactttatttttgtcccctccaagaataaatgctttagattcctcaatacaaatgaaaacctagcctttgcttctgttgtgcttttgcgtatttaggtgaactgttagtaaagtcatacataaggtttagggtttgtttttattttttttttaatcctgctaactttaaaacctatagacttttaccaaatggcttatgaaagcctgacttctgaaacaaacctttagttctaaaactaaatactatttcaataaatcctcataatatgaaggtttctatctttgctggttgtcaggttgcttggtgttttaagttgctttgagttcatagattttagaaatgttcacttgggatctgaccagcctctcagcttcacaggatccatctctgtttagacataccaagtctcaaactattttgaagagaaaaggctgtgcagtgaaaggctacccattaaagcatgatgtgtgtctttcatcttccactaggcagagttcgaaactgaaagtctgataatttgatgtaaactgacagtgacaatagaaatggctacttttgagattatttaagagaaggtgcaaggtatagacattcatcaatgaaacactaaaggaaaggtttttatttctgtgtttgctttttaaaataagaatagagtaaatggcacaatagattatataaacaaggacttcaatgacaagctgtcaaagttaaaataatatattttacatgggtgacttgacgccacactttatcacttacatgaggggaagccaatttgagtctggtcaataaaacacaacctccaaagttgggcctggggcaaagctgacatagtgtggcagagcctggtggtttggcatccacttctgctgggacacagcaggagttggcactgctaccatctggggtatgtcctacatttaagccctatttgattaatcaacacttatgcaggttgaagggacgatgcattggctctgctctgaggcagttcaggctctagtaatttaatgcaggtctgaggcataaatgggactagtgattcaaaaactggatttactgcagtctcacaactgttgaaaattaaagtacatgtgctgcaagttaggggttactagggtatctcattataggaggctattttttttcagaggtttgaatctttgctgaattactgagagacttattcgaatgtaggcttggaccaaataattttctgataaattggccataaatcctcagtaaaataagcttggtgttctcagcatatctattggctttttgatcatttttatggctttccttttgctggtcaaattatccttatatgctcctaaagctcctctgacatggattaagtcaacacaaaccaatagaccttcattactttggcaactggttttgatttgggggcaataaatatgatgacacagactagattacctctgctgaagggatatgtgataagccgtagggatgtcagggatcctgcattattttttctgcgtaatgtgagaatgaattaatagcagcttttaactagctgaagaaagttggaaagaagaaagaaatctgaatgaaaagagagccaaggtacggcttataggttaagagcagtgacaccagtcgatcataagaaagtccatgaacacccaatgtgtgtccaacaccgtgcaaggcacaggcaggcagggtcagggccaaatatgtgaggaaactaacatgtgatgtgatccatatcttagtgtctgggagaggagataagaccatcaatgagagcaagatttattgtgcaataaaagtgtagagcagagagaaataagcaaggcctggtatagccaaggaaggggtaatggaagaagcaagatctgcaaatatgggggttggaggaactattttccttataaaaattgtttgttaaattattacttttccaacattttgcttggaaaaaaatgcaaacctaaagagaattgaaaaaaagttacaactaatgcgtgtaactctttaacccagattaccaactttttaacattttgatacctttgctttatctctgtccatatacatgtattttttttttgctcagtaattagaaagtagattgcagatgtcatgacactttaccactaagtattttagtatctcttaagaaagaaggcttccttctataaccacaatgctagtatcacactcaagaaatttaacatcttatatactatccatattcagactttctaattgtcccaataatgtcccttatagattttttaaatccaggatacaatcaattgcatttaatcatcatttggcatgtctttttagtatctttttttatctcaaactgtcccctgcccttttaattcttttgccactgaatattctcttgcttttggaattctgtataaaatcaattggcatatttatcccttgtcttctaaaattatttagtatggcagaaatgggatatgaagaaactccaatctttttctacactacaaaatgcaagttagtagacgacccagcagatacataaaaagggaactcaaataatgaagctactatgttgaaaataagtggtataagtcatcagcctaggaaaggaccagtagtgagtacacatgaaattgctccctccattctggccctcctgagagacaggaaatcaggtttcttgacatggtatctagatgggttatatgcccagttttggtaaacactttcctggcacatgagctgtctgccacttcctattctagttcttctccatttgtggctctgcataaggagttatccttctgtaaagtttcccaggcatgcaggaaatatcccagaaccacaggcatgctttttgttctccttaaagcaattggatcatggtgattccttcagcctaaaacatacttctttacctcattctcccagcaacttcctttgagaaacttagcgatcccatgaggcaccttcctttctccttgtttttccttcatgttcacctctaaactaacaccacccatatggaactgtaattgctttatatagctgccccacccccaggcactatcactaaacagtgaattattttaaagataatggttatgccttttacttccatatctccaggatctaatatgctgtctgaaagtttgaaggcattcggtaataatttgttgagtaagtgaatgaaagcatgaaaaaatgaatgaatgaatttcaccaccaacaaactttctgggttctatagaactcttcttatgactgagaagaacttagtaatgtgttaaacagggcaatcagtgttacaagtgtgtgagtcgataataattgatcagccacttgggcaaagcactgcattttatattattgggaagttccagagtaacaaatagtcatgccttacagtcctgaaggaagggatagatttggcttaactcacattgaacaacagctacacattcatgcgcatatgttatgccaggcaggcctagctacagctcttctcaaaaatgtgctggccctggacattgctgtgtaagagttacaggtgagtggagtcacatgggcttctctggagaggctttgcaaagtacagagaaagtttgaattatcttttaaaaagaggagaggcatgattgaataaacggcatgtttcaggatagagaagtggtttggaggaacaggtgattcctgtttgaaaagtggcagatagagagagttgctctgctggaaccccccggccccggcactagctaggctgcaactggtgatgaccctcatgaggaaatgggactcattaataaagagcctcaacttaaaaattgttgggtggagtggcgcacgcctgtaatcctagcactttgggaagccaaggtgggcggatagcttgagcccgggaggtcaagtctgcagtgagccaagatcatgccactgcactccagcctgagcgacagagtgagaccctgtctcaaaataaataaataaataaaatcaaaattggcaatttatatttgatatggacaggtttgatatagttcgttcccacgacttcctagtcacgtaagtacggtcatttttttctgtggggctggatggaggatgtagattctggaggaaataaaagtgtgtagagaatagatgaattacctagggagaggataattgggccaggattgtgactgtgggaatgcagagagagaaattagaacagaattgtaggggaattggttacaaatgggtctgggcatagagtaatgaagagatgaaaaggatgtgctttgaaaactacaagagtttgcagctcatagcactgaatgagttacacgctctgaatctttagttagcaaccactgttttctaaaatgaaataaagagaagaaaagaaaaaaaagggagagaagcatgaatgtccacacagcttttctgagaccaaaataggccaagctaatgtccagtagttcacctaacggaaacaaaaagaataattcacatgtagcaaatgatagctggctcctgcttattttttacctttatttttgtttttaatcctcactagcagctcctgattgtatcacgtgataacgtttccattctagatacgaggggcaggaaaaggtaaaaacaaacacattgtttgttgatttcacaaaaaggaataatgctcgtgtctggttggctccttggtcatattatcccttatctgccactccaattcctgccagcagcacctcagagatggcacctccccttgctgcttccgttcctctgcaggacacatggtgaggtttttattacgtaaaaatcccaagaggaagaagctctgtgttgataaagtcaatagctcattgcatgctgctagacaagctctaacttttaattctcttctgccaagtggcagtctgcaatgtctttgtggaacagacactgttccaggtgccagggaaacaattgggaacaaggaaggcaaatatctgcacctgaatggggcttccattacagcaggatacacacaaaaactctatagacttcacatggtactgaatgcttgagagaatgaaagctgattgcaatcaaagaggatggtcagggaaggtctccccaagaagatgacagcaaatagtaacacctacctagttgagttattaggagaattaaagcattttctgtgttaaaaacatctggcaaaccactgacacagggtcagaagaaatggctagccattatctttcaacaataaatttacaaagcataatgaaatataactgagtttgagctgctgggatttggttcttgtatgagatgaggcgataatttttattcacaaggccatgtgctccaaagaaaacaatgctatcacttataccacctgcttatggagagaaaaatatgaaagcaatgtcctcaaacctctagctgcatctatgcttctgcctaaaatctggtatcctaagtaggagagaggttgtgaattatcagggctttttcttgatacttatttttacagatctaatgcctatgatggctcctgccagggactgtttggcccaccactctacttctagctagcattgtggttacacagtttgtagaatgcagaaataaacttgtctatttatgaccaatgtcacagcacatgtcaaatctcagtgtcactgggccctttccctaaaggtctacaagaggaaatatgtcatgcttgagttaatgttgaggttgattgtttaacctggaactagaattccaaacatatatccttatgttacatcagttttttttttctcatttatctccaatgtgtccacaggaaatttccacagtagctgttctagcctcttccttcctatcatagctataccattccttctggtatggaaatcatatcagaaggttcccaggaagcgtcttccaggctgcggttccctggacggtcccatctcagctcagtttttcctcccccagctattgtgatgacccccaatcagcatagttataagaaattgtaatcacatggtgagaattaatgagaaagcctttatattggattccttctttttccagcaagagacttcaaaccctgctaactgcagtcttacagcccttggagggggccgtagctcaccattgttctgttctcggcaaacccagtgggagcttatctgttttctgggagaagcagagcagccagatgaagagatggggcagtgccaaggagaaaatgatactcagcatgcagtgcagatccctccctcccctgttccctgctgtcggcctgctgctcagagggaaaggtgcctggtggctctctgatcgccatcctttcttcacattcctaagccttttatttggtggaaggagcatctggctggatagcctcctccttatcccaggacacttcccgagttctctcttttggctttttaataccttattttccccttatgactgtaaagtggacagtgtatttatggttgaaaattggctgctatagcaatattaattttaaaaacagagttttggcacatattcaatattactatggaaacggccgcttctaacaattcactcataagatatagttcaaggactgaggtctgtgtgggaggtttttaccatccaccaaattgacgatctacttgtcagaatagcaattcacaagaactgctctccaaatttgtattccttttttaaaaaagttagtggatgagcattcgagagatgcctttattttactttatatatgtagatggaagataaatattccaactggcatgttaaagacacaatgtgtttaaaataatttttccatgaatcactaattctcttaattgcacataatggtcttacttggttatttgatgtaacactaaatacacacacagacacaactagtttcagaaacgcacatattgaagctggaatgtaacctgtaatcaattgacacattcaaacattttaactttccatcttaaactgtctccacatatttctatgtaactgatatacatacaactgaattccaggaaagacttgaagtaattcattccagtgtggtgttttccaggagccagtttttaaccccaaatattgccttcatttttaaccgcaaacatacttctgttggttttataaaacgcaggcatgagagaaaggacctctgggggctgatggttgcagcattagttcttgaattccctcactttaagtcaaagctttcatgtttgcacctctgttcacttgggaatgtgaggttacattttccaaaaaatcctgcaatgtttcatattttttcagagctccttctgatatgtttattgttttcacattatttcaaatgctgtcatcggccctaaatatcatgaaagataggtcctgatgctgacaacagaatttgtctcatttctcttatttccagctcattttgtgttttccaaattagattaactctcaagcaattagtaacagttgattctgataggcccaggttgcacacccttccaccagcgccacatcagcacagtgagagtgataacccgaagcgcctccttgttcacaaggatggccctgagtggatggtaggagttctgaaatccaaacaggatcaagaaaatcaatcaggggaaggtcacttggggtaataaacaagagtaatcacatggatcaaagttcttgtcctgtgcgtatgtcctatgagaagctctttatccactgaatgctgtaattcttagaacaattctaagacgtgggaattgttgtccccatttattatacttatcctacatatactgtgggaaaatggtatatgagcagagctcttaaccacttcattacacagccaggagtggcagaggtagggctgcatctcaggccttgaatttgctctttcattcttatgacatttctgagagaagtgggaaaacagtatatgtaggctaagtatactaaacaagtatcgaaattggattcaaatccctttctgtctgcttagcaagtgcatgctgtttccagttccccttcagaagaaacaagatgaaatttcttttctgggattaagaggaaaacacacattaacctatggtgctagcacattccagcatacaataatcaggatggaagtttcaaaataggttttgacagtctcaccatagaataccatggaataaccttgcttgggtcctatataggccagaacccagttaatgtttcagaataaattctctttgaggagaacaaatgaaacatctatttattttattctgcagatatggagttcaaagtaatcacagtttaaattaatcatacatacaatatacattttttaaaagatgttaatatgataactgactgcagatagcagcatgtcatttttcagaaaaaaaaaaaacaattctacattatatttataattaatttggggtatgtcttttcaggaaaaggttattcaaaagctcagtgttagagcacaaccaatccaaatagggctggccttaaatctcgtcctgcacctggaggcctccatcatcagttcatgtgtcccagcagtttcaattatcaaaagatccatcctagtgccgtatattttaagcacagttgaagaatagtggagcaaaaaaaaaaaagcctttcaaccatgggaatttaaaagcaaagggccctgaagaggcgatttcaaaaccctactcattcagttcactctaaagcttaatgacatgccctatttgatacagttaggggaactctttcatcaaaaactttatatgaggctgggaattgcaatattaggtttgtaggttggctcccttggtcatactgcaacgtcctgagggaattctagtttatcttttaaaagcaaatagaattagggaaaatgataaatggtatactaatgactactaatatgtttgtgtatttgagaacttcctataggctgtgctttttgtattttacattctttgtgttttatttggtcccatcctttgaagtagatgttaatattccattttataaatgatgaaaatgagttcctaagaggtgaaataacttgctgtgtttgcacaagtaattggcagagccacgaatcaaacccaggtctctgcctctgaagactgacctcttaaccacttcattacacagccaggactggcagaggtggggctggatcccaggccttgaatttgctcttttatttttatcacatttttaagaacagcaaagcaactgtagatgaaggacttggttcctcaggagtcccaaaatatgtgaaacaggtcagccctctggttcaacctgaattgaggtactaacaaggactcgggacccacccccatgagtccttcttcctctcctgttgcagcatagcagatgagaggatctgggaagcctcagtttacccaatgtaatcaatctcaggctgaatgagaagagaagggcctggaaaagtttagaaaacagagacaaaccaagtgatttttctcttgtgtgcatgggtgtgggcactcccaactctctcatccaggagaaccgccatttactccaacagatgacatgatttaccagacagattaagatgaaatcaacatctaagaacaagagtgtgcattttctaaagatcattggatagtactaaggtgtttttctggtcagatttcatctgctcttctgtgtcccagccttttgacctttcaagcccaactctgcggttctgttcctctttcccaggccagagttatctttattgataaaacatataattatttacaaaagcatggccacacagtatggatggagagtttgccctctagttgacataaactattttttctaaaaaactactgaactctatgaaattctatatgctttacttcaaaagctccagtcattgtcataacccagaatttttcacagtaatatgaaggagagatggagtagtaaacatatttctaatgatctaatagtactatattcttgaatgtctccaaggcacctaagaccagcttttcccagcctgacctcatattcttcctacacaaacctcatgtgaacccagtttttcctcatgtgagcccaatttcaatgactgacatcccaatccacctgctcatctaatgtggtatcaacagccatcttcatccttcctctcttccccactaccccacacaatctgacatggggtgatgctgaatttacctcagaaatccctgtcaaacattctttcccttcaattctcactcctttgctaaatttagacctaggtaatctcttatcatgactaataagataaactaacttctctgcctccaatttcttccccacctacactatctcccatcctccaccctgttaccagagcttatcaagtcatgcttttgcttaaatatcttcagtggctcctcactgactacaggacaaagtctgagtttagtgtggcattcacatttcttaacaagacccttctactttatagtattttctctcaccaactcttttcaccctttcccaattcaaacatacacattcatggtcaatgtattggtcaatatagtattttctctcaccaactcttttcaccctttcccaattcaaacatacacattcggtcacactgggtttcttactctttccctaaattctaaggacttttatgtcttcttgcgttttatgttttgtttttgtttttgttttgagacagagttttgctctatcacccagggtggagtgcagtagcctgatctcagcttacatcaacctccgcatctcgggttcaagcgattcttctgcctcagcctcccaagtcgttgggattacaggcacccaccaccatgccctgctaatttttgtatatttagtagagatagggtttcaccatgttggccaggctggtctcgaactcctgacctcaggtgatctgcccacctcagcttccgaaagtgctgggattacagatatgagccaccgagattgtctcattaaagtggaatttcctccttgaagtacttgagcatccactaatccttcaaaggacaatcatgtctcattccaatcttgctccacctactcctcaacacaattaattcatcacatggtcataacacctatctgtaatgtattatgattatttgtgtgtgtgtgtgtgtgtgtgtgtgtgtgtgtgtgcgcgtcttcctcttctcctatctccagaatttgagctccagattccaaacttttatttgtctttgtattttcatttcctagctcagtaaatgctcatagtaaatggtcaataagtattgctgattgaatgcacaaactaatgaaccacatttgagcaaggattattgtgagtagatcccagacaatactatgaagctgttaaaatattatattaattgtataataatttaaaccaagacacaggggacaataaaaagagactaaggatagaaaagatatttaaactctctaggatgttaaacacagatttcatttgtaatagattggtttggtaacgtggggatgagtcctagagaaagctaaataagaaggtaaaagagtttactactgatttactctgatagaaatatgtctttgaaaaaatcagtttaaaaattcaaacagtaactcctttctgtctttaatatttctgtgcaactcagtcacagtttcatgttagccattgttaaactgataagagctcaggtttgctaaaaagtgtttgcaaacacatcggaattaacattaatcaaaccactgtgtaaaaataacaactttgagagcccaggatccagctccctttgacagggctctacctgccgttgtctgctgctagatacttggattcagcgttaagcacatgtgcctttacaaccattcaattgccatgttgaatccgaatcagagtgattcctttggaaaccccctgcgagaccagcgtatcacagtccctcctctgtgtcaagaatttttcccacaagacccaactaatttaatttctttcctttcccaaagcaacaaaacaaaactgtaaaataaccatttcttcagtcccaaattagaacttttggcaagggaggaaagagatcatgaataatacgtggctatagatctagaatcattttataaatataagtgtgggctcatcttttgcctttgttgctacatgaatcatctcagtcactgagattaagagactgagcaaatatagtaggtatttcatgccatattttctgactgtagactttagattctagatatatgattatttgtaaatgatttgagaataagaaaatctgactttcttttaataccttggtctttttacagtactgagtggtaccagcttgctctggttggtcttcattcctgagtagttccattgtcctgaatatttatttgcctttgctatagaattcgcatcccaatgatttcaatctttccagttggcagatgacttgatctccgacattttcaccactattggctcagtgactgtcgccttgttactgatcctcttgctggccattgttgcttctgttgtcacctccaacaaaagggcaactcagggaacctacagccccagccgtcaggagaaggagggctcccgagtggaaatgtggaacttgatgccaccccctgcaatggagagactgatttaggagcattgtgtcccttcgagatggggatccacacactgtgaatgtgatgactgtacttcaggtatctctgacatacctgacaatgttaatctgcaactgggattacactggaactacaggaatgattcctttgaccaccttaaaaactttcacagtggttccgctcgacaccattgttttattatattatatcagccaattgcaaaaaaagtctgtgccagtaatttcagccttataattagcaaaaacatcttccagagaataaagtcttctgtggctttagtggctatcactgaaactctttcctcttttcaacctgggaacaaattttagttttcattttaggtttctgtactttctgtagtttctgtgtaaactgccatatgtttacatggaaactacaggaaaaaattggctacatttctcacttctcctatcatgtggtcaaagttattgttgtataccagcgatgggatgtatacttttgtccttcattcatggattcagagaaagctctgggaatgacttatggtccaaaaaagtgacccaatggcaacaaataaaaattgaaatgca

SEQ ID NO: 2360 - DNA, 210253 bp, Homo sapiens; identical to SEQ ID NO: 2359

SEQ ID NO: 2361 - DNA, 276995 bp, Homo sapiens
catgtgcgcgcacgccgctttacgcatgctccttaagttccccgtactccctcggagaccctagctacacgccgaatccgttactccgggttttcgcagtggctcggtggcctaccccgatcgaaaccgtgaggcttttgctgagggagggcaatgggagaggggaggatggacgcagagtttagaagtagtttgccgaggtgcagtcgcacgaatggatttcatcctcactggtgtatttaatagtttgtaatctaccaaacagcaactgccagaagccagtcccagctaacctactggcgtgcacgaaagaacccagcgatgctgatctcgtttcgttatttttctgacttaaacggttaaatctaaacgcgattactaagaaaaaaaattttatacctatcattgtacacagaaaaaaaatagaaaaatgtttatataagcgtaaagctggtaggacaggaaaggaagccgaaacaaaaagtaaagaaaaatccacaaggacaacttttggagctagtgcctgagattttggatttctgagtcccaggaggtgctgatatcatttatctgcggactcgtattatgaagcgcaaggtcctagagcgtgtgattttacaggcataaggaatataagatgaaggctgagacaaaataggatgggtggcctaattttcttcccccaccctctcgtccctcccatacacatacaacctgacaactaaaagggccgcactccatggaagaactcctgcagagttggactccccaccggcaaacaggaggaggctatgaagaaacttgcctgtctccgattttcttgggaattgaaaaaataaaatttttaagcctttcatgaaaattcctagcaaaaactcacattcacatggatttgcacaaagattcatatcacctgtgagactcatcccacaaaaactagccacactgaaaagagagaaaaatgtaaaaccaagatagaaaaaggatggtagtctgcagatattgcaattatcagaaacaagtatatttaaagaaatgaagggaaatgaaaaaattatcaaaaataactaagcagattaaaagaataatttagaagtgaaagctatcattatcttagtacttagaacgttgatggaaatgtgtttttattaaaacagaagggctgatccaagatagaaaaatataaatccaaagaaatagaaaaaattctgataagagcaaataatgaaatagtgaaatatacaataaagagaaccaatagaccaaaaatttgggtgttgggatatgtaaaaggtttagaaacttttggaaagatttgatattgccagttttacccaactcttcaaaaaatttaaaatgggtggcaggggcaggtcacatctcatgagacaagcataatgattatacccaaacttgaaaatacgttgcaggaaatgaacattataggtcaaactcataaaattaggtgcaaaaatcgtagacctacaagtgatgtctttgtggtgtgtgtgtgtgtgtgtgtctgtgtgtgtgtgtgtgacggagagagagagagatacaactgaattggatttaataaaggaatgaaagatttagttagcatttaaaaataaacgtgtaattcttcgtattaacagaatgaaagatgaaaaccattgatcatctcaatagatgcagaaaaatatttgataaatttaacacatgattttttaaaaatctcaagcaaggattagaaaatggcttaatataaatagaagctactgaaaaatttttaaatggagcaaatatcacacttaatgaaagattgaaaacttccacggaatttgagaataaaccaagtatgctttctatcattacttgactttttttttctttttttgagacagtctcgctctgtcacccaggctggagtgcagtggtgctatcttggctcactgcaacctccgcttcccgggtttaagcaattctcctgcctcagcctcagcctcccgagtagtgtgactacaggcgcatgctaccacaccgggctaatttttgtatttttagtagagaggggctttcattatgttggccaggctggtcttgaactcctgacctcaggtgatccacccgccttggcctcccaaagagctgggattataggtgtgagccatggcgactggcctacttgacattttaatagaggccttacctaggagaaataagcataagtaagaaatagaatgtataagttttggaaaggaagactaaaattaatcattatatgttttaagtatgttggtgccatatttagatatttagaaaaaatggttttaaatcctatggattaattacttttgactttttaatttcaatatgtttaggggaacaggtggtatttggttacgtgaataagttctttagtggtgatttctgagattttggtgcacccatcatccaagtagtacacactatacctaatgtgtagccttttatccctcacccccctcccaccctttccctgaatccccagagtccattgtattattcttatgcctttgcatcctcatagtttagctcccacttatgagtgagaacatatgatatttggttttccattcctgagttacttcacttagaataatagtctccaatccatgttgctgtgaatgccattattttgttcctttttatagctgagtagtaatccataatatatatgtatactacaatttctttatctgctcattgattgatgggcacttgggctggttccatatttttgcaattgcaaattgtgctgctacaagcctgcgtgtgcaaatatatttttcgtataatgacttcttttcctctgggtagatccccaggagtgggattgctggattaactggtagttctttaaggaatctcctccgcttttccatagcggttgtactagttcacattcccaccagtagtgtaaaagtgttcccttttcaccatgtcccagccaacatctattattttttgatttttttattatggccattcttgcaggattaaggtggtatcacattgtgcttttgatttttatttccctgatcattagtgatgttgagcattttttcatatgtttgttggccatttgtatatcttcttttgaggattatctattcatgtctgtagcccactttttgatggaattttttttcttaccaatttgtttgagttccttgtagattctggatattagtccttcatcagatgtagagatttcgaagattttctcccactctgcgggttgtctgtatactctgctgattgtttcttttgctgtgcagaaaattgtagtttaattaaaccccatctatttatctttgtttttgttgcatttgcttttgggttcttggtcatgaagtctttgcctaagccaatgtctataagagtttttccaatgttatcttctagaatttttatggtttcacgtcttagatttaagtctttgatccatcttgagttaatttttttataaggtgagagatgaggatcacctccttggttaggtgtattcctaagaattttattttatttttttgcagctattgtaaaagggtttgagttactgatttgattctcagcttggacgctgttggtgtatagcaaagctactgatttgtgtacattaattttatatcctaaaactttgcttaattcatttatcaattctaggagctttttggagtaatgtgtagggttttctaggtatcatatcatcagcaagcagcaacagtttgacttcttcactgatttggatgtcctttatttctcgtctgattgttctggctcagacttccagtactgtgttgaatagaagtggtgagagtgggcatcgttattttgttccagttctcagggggaatgctttcaacttttccccattcaatataatgttggctgtgaatttgtcatagacagcttttattatgttaaggtatgtcccttctatgccgattttgctgaaggtttcaatcataaagggatgctggattttgtaaaatgcattttctgtgtctattaagatgatcatgtgacttttgttttgaattctgtttatgtggtgtatcacatttattgacttgcgtatgttaaaccatccctgcatctctggtatgaaacccattggatcatggtggattatcttttccatatgctgttggatttggttaactagtattttgttgaggatttttgcatctgttttcatcagggatattgatctgtagtgttctttttctgttatatcctttcctggttttggtattagggtgatactggcttcatagaattatttagggaggattccctctttctctgtcttgtggaataatgtcaataggattggtaccaatttctcattcaatgtctgatagaattcagctgcgaatccatctggtcctggactttttttttttttttgtaggcagtttttaaattaccgtttcaatttcactacttgttattggtcccttcagagtttctaattcttcctggttttaactgggagggttgtacatttccaggtatttatccatctcctctaggttttctagtttatgcacataaagatgtacacagtagccttcaatgatcttttgtatttctgtggtatcagctgtaatatctcccatttcatttctaattgtgcttaatttgatcttctcctttttcttgtttaacctcctcactagtggtctatcaattttattcatcttttcaaagaaccagctttttgttttatttatcttttgtatttttttgtttcaatatcatttagttctgctctgatctttgttacttcttttcttctgctgggtttaggtttggtttgttcttgtttctttagttccttgagatgtgaccatagattgtctatttgtgctctttcagactttttgatgtaggcatttaaggctatgaactttccttttagcactgcttttgctgtatcccagaggttttgataggttgtgtcactgttattgttcagttcagagaatttttaaatttctatcttgatttcattgttgacccaatgatcattcaggagcaagttatttaatttccatggttttgagggtttcttttggagttgatttctaattttatttcactgtgatctgaaagagtacttttataatttcagttttcttaaatttattgagactcattttgtggcctatcatatggtctgtcttggagaatgtaccatgtgctgatgatatattctgtagttgttgggtagaatgttctgtaaatatcttttaagtccatttgttctaaagtatagtttaaatccattttttctttgtttaatttctgtcttgataacctgtctagtgctgtcagtggagtattgaagtcccccaatattactgtgttgccatctatctcatttcttaggtctagtagtaattgttttgtaaatgtagaagctccagtattaggtgtatgtatatttaggactgtgatattttcctgttggacaaggccttttatcattatataatttccctctttgtcttttttaactgctgttgctttaaagtttgttttgtctgatatatgaatagctattcctccttgcttttggtgtccatttgcatggaatatctttttccagcccttccttatatgttgagtctcttgaagacagcaaacacttggttggtgaattcttatccattctgccattctgtatcttttaagtggagcattttggccgtttacattcaacattactattgagatgtgaggtactattctattcattgtgctatttgttgcctgaataccttgccttttttttttcattgggtttttattttataggtactgtgagatttatgttttaaggaggttttattttggtgtattttgaggatttgttccaagatttagagctctttttagcagttcttgtagtgcttggtagtggtgaattctctcagcatttgttagcctgaaaaaagactgtatctttccttcagttatgaaccttagttttgctggatacaaaattcttggctgataattattttgtttaaggagggcaaagatagggccccaatctcctctagcttatagggtttctgctgagaaatctgctgttattctgataggttttccttcatgggttacctgatacttttgcctcatggctcttaagattctttccttcatctagactttagataactttatgactatgtgcctaggtgattatctttttgcaataaatttcccaggtgttctttgagcttcttgtatttggatgtttatgtccctagcaaaactggggaaattttttttcgattagtcccttaaatgtgttttccaaacttttagatttctcttcttccttaggaacaccagttattcctaggtttggtcatttaacataatcccaaacttcttggaggctatgctctttttttaaattattttttctttgttttggttggattgagttaattcaaaagccttgtctttgagctctgaatttctttcttctacctgttcaattctattgctgagattttccagtgtattttgcatttctctaagtatgtccttcatttccagaagttgtgatttttttttaatttatactatctatttcactgaagattgttcccttcatatcttgtatctgtttttataattcactaagttggacttcacctttctctggtacctccttgattacttaataatcaactttctgaattctttttctggcaattcagagttttcttcttggtttggatccattgatgttgagctagtgtgatctttttgtgttgttaaagaaccttgttttgccatattaccagaattgtttttctggttacttctcttttgggtagactatgttagagagaagatctggggctcaagggctgctattcagattcctccatcccatggagtgctcccttattgtggtgctctcccccttcccctaggtatgtggtttcctcagagccaaactgcaatgatttttatttttcttctggatgtagccacccagtggagctaccaggctccagaagtgtctgcgcagagtcctgtgatgtgaactgtcttcaggtttctcagttgtggataccagctcctgctctggtgtaggtagcaggggagtgaagtggactctgtgagggtacttggttgtatttttattaaatgttctggttttctgttggttggcctctagccaggaggtgatgctttcaagaccacatcacctccggttgtgtgggaaggatacaaacttgccctaggctcaggcattagatgagccatagagctcccaaagaactatgtgcattgtctttggctaccagggcaggtagagaaagaccatcaggtgggggtagggttaggtgcgtctgagctcagactctccttggtcagtgtttgctgtggctgctgtagggatgggggtgtggttctcaggccaatggagttacgttcccaggggaattatggctgcctctgctgcatgtaggtcaccaagaaagtgagagaaagctggcacttacagacctcaccccgctcccacacagcccaaaaggccagtctcacttccatcatgccctgccaacagcatcaagtttatttccagatggcatgtgagcagggctgagaacttaccctaggctactagcctcccaactgagaaagcaagcacagctttcaggtttcatgcctccccacatgcctcagcttctgtgctgtgtctgcactcccgatttgctccctctcccaggttctgtccagaaactttgcattcaatcaaaattgttcagctggaagtttccttctcttgccatttttgttttgtttttgtttttgttttgttttgttttgttttgtttttttgagatggagtctcgctctgttgcccaggctggagttcagtggtggcgatcttggctcactgcaacctccacctcccaggctcaagcagttctcctgccttagcctcctgagtagctgggactacaggcgagtgccaccatgcctggctaatttttttgtatttttagtaaggacagggtttccccatgttggccaggctagtcttgaacttcttacctcaggttgtatgcctgcctcagcctcccaaagtgctgggattacaggtgtgagccacaacacctggcctctcctgcggtcttttcccagttcccctggcagccctttccaaaaacccgtgtgagacaaagtcagaaatggcttccctggggaccaagaatgcgcatagggctcttcttgctgcgtcttctactcctgtatttcgctcagctctctaaatttgtctcagctccaggtaagtccaaatccttcccctgtgatctggaccttcaggttccccagtgggggtatgtatttggaggcagatgatcccccttttacacattcacactttgggcattcacagtttttccactgtatcccagggcagctatctgcttctttcaaagggtctgtgaattatctcagctttcctggtatgttcctatggtagttcttggagtaaaagttcacaatgtgagcctccacacactgctctgtccatccaagtgggagctgcaagttagtcctgccccctattcaccattttttccctatggagaaattattagttaatgaagttgcaggatgtaacattgaagtacaaaataaaatagtatttaccagtaacaactgtgatggttcattttatttgtcaacttggctaggctgtggtgcccaattatgtggtcaaacaccctgaggatgttgctgtggaggggtgttttatatgtgattaacaggcaaataagtagactttgagtaaagaaaattaccctccataatgtggtaggcctcattcaatcagttgaaggccttaagagcaaggacagttttcatgaagaaaaagaaattatctccaggaattcaaggtagaaaccctaactgagttttcagcttgctgtcctgcggaattcagtctcaagactgaaacatcatctcttaccaggatttcccatctgtggacctgtcccacagatttcagactggccagcccccacaatcatgtgagccaattccttccagtcagtcaaacaatcagtctacctatctaagagcctattgcttctgcttgtctggaaaaccatgactaatacaccagcaatgaaaattaagaaaataaaacttgaaaacaatgtcatatgatttcttcattcatgtagtaccaacatccatgtctctaagatgccaaaagtttttgtcagagaaagtaacaggtgggacaagggcccataagagagagtatagtctgcagaaggccaagaaagaaaggagagctacacactctagaatctctttccagtgtcttccttttgctgatctctcatggccttaacatctttaacaagctgtttcacaagtttatttctaaagatgaaaatgtttttcttcatttattcaatagaatatatattgaacaaatactttgtaccagaaatataacattttaaataagcttaatcataaacggatgtttttcagtagcatcacaaacgtaaaatacctggaagtgaagctaatgaattatgttcaacatttatacacaattctctatgacaggggctggaaaacttttttataagaagcaaatatgaaatattttagtgtttatcccactttcttctgcattctaacaacacgttaaaaccgtaaaaattattttgtgaaccacaccaaataaaccacaggttggatttggcataccaacagccattgtttcctaaccaccacctctaaaacagacttccgagaaattaaagaagacttaataattgaagaaatgtgcttccttagtctgtgccactgtaataagacatcacagattgggtaacttatatacaatagaaatttatttctcacagttctgaagtctgggaagtccaagatcaaggggccagcattcagtgtctggtaagggctttcttgctgtgtcctcacatggcagaagaggtgaatacaccacatgaatactgtgtgctcatgtggcagaaggcagaaggcctaagctagttacttctggtccttttattataaggtggagctctcatgaaaatcacttcccaaaatgccttgcctcttaatgccaccacaaaggggattaggttttagcttataaaatttgggggttatttcagacaataatatgccatattcataaagtggaaaaatccatattatgaatatgttaatttttatcaaattaatctatagaattaaagaatcaacaaattgaaatgcatcaatattaaaatttttttttcaaaagacaatgttaagaaaataaaaaagcaggccacacattggtgaaagacatttggcaagcatatatctggcaaagaacttacatctagaatataaaaagaactcttaactaatcaatgagacgaaacatatatactaatataaaatgaaaaaaatatttaagtagatacttcatgaaagaagatgagcacagggaaagatcttttttatctttaatttgcattttaaggaagatgcaaattaaaaccacaatgagataccactatacatccattagaataaccgaaagtataaagacaaacaatatcaagtgtttatgaggacatagataaactgaaaatctcatacacttcttgtgggaatgtaaactggtatagcactttggaaaatagttgagcaatttccaaaaacattgaatttgcacataccatacaaactaaccattccatccttatccaagagaaataaaagtgtatatctatatagtcttatatacacaaaagatcatgacagatttacttgtaatagccaaacactggaaacaacccaaacctccaaaaaccgataaatggataaataatttgtgtgtttgtataataaaatactactactaccacacaaataatagagcaaattgatgataaaagcaacaacataaatgagtcacaaaataacatgttgagtaaaatacaaaaggactctattctatctgatcaaaattctaaaaactgcaagttattataacagaaagccaatcagtttgttgtgtggagacagctggggaacaagggtaggggaagtgtgataaattacaaaagggcacaagaaaacttttgttcattactttgattatactgatggtttcatcagggtgtacatatgtcataactgatcaaattatacactttaaatgtacacagagtactgtatgacaagcctaaataaagccattaaaaagagtgtcacccagacacgtgaacagagacacacaatgaaacaaaacaatagaaaattcagaaatggatccaaatttacaggcaaatttactatataaaaagataaaatttctagtccatggcaaaaagatagaccatccagcaaacgggaatggataaagaggtgaacatcaaaaataaaagtttcatataaacttctcaacagatctagataaattccaaatggatcaaaggtttcagtataaaaattgaaactatgaaagtactataccaaaatgcaaacaaacttctaaataacagtaaaatgggaaatagcatttcccatgaatcagaatttacaagtaattaagacaaaagaaaggttaaatcaaccatataaaaatttctaaaatttgcatggagaagttccagtataagtaatagtgtattaagtgattcaaaccaactctcctactgagaatgatacaacaaaatgtttttaaacagaacgtctgttctgaatgcgcagaagagctacaaagtctgtgtgtaaggaattgtgttgccatgatttgcaagaagaaagagtcacaaaaagatatcctggcatttgggggagcttctccctaaaaatagttactgattagaaagcagctgctgaaatgctgataagacgagcagagcagatccttagacttgtgagacagaaacataaaaattaaagttataaggacctcaaaaaaggaagggtcctaataaaaatcccatgtgactcagaaagccctagccttgagtaaaagtataccagaaatcaatcaccaatcataagattgaagctcttctttgaaacattttctaggctagatcatacatttggccacaaacaaatcttttaaaatttgaaaagattgatgttataccaagtattttttccaactgaaatggtatgaagctagaaatcaataacagggagaatattgaaaaatttacaaacatatgaagattaagcaacacactcctgaacaaccaatggttcaaaaaagaaaagtcaaaagggaaatttaaaaacatattgatacaaaataaaatggaaacacaaaacaccgaaacttacagaatacagcaaaagcagttctaagagtgaaacttataaacacctacattaagaaaaaagaaaactctcaaataaacaatctaactttccacctcaaagaagtagaaaaggaagaacaagctaagcctaaggttagtttgggctagcaaaaggaagaaaatgataaagataagagccaaaataaatgaaatagatgctagaaaaaaaatcaacgaaactaaaagttgcgtggtttttttgtttgtttgtttgcgaaggagaaaaaaaaagctggcaaacctttagctagactaagaaaacaatagagaagactcaaaaccagaaatgaaacgggaaacattacatttgatactacagaaaatcaaaagattgcaagagactacagttgacccttaaacaacatggctttgaactgcgtgagtctacttacatgtggatttttttttcaatatatacagtctgccctccatatgcatgagttcagcatctgaaaccaaacatgaatgaaaaataagagtattcatgagatgcaaaaccttcttatatgaagggcccaattttaatattcacaagttccacagggcctactctgggacttgagtatgtgtggattttggtacccatgggtggtcctggaaccaaacccctgtggatcctgagggatgactatactatgaacaactatacactgataagttgggtaacttagaagaaatggataaacttctataagcatacaaccaatcaaaactgaatcatgtaaaaaacaaagtctgatctgaactaaaataaaaaaacaaggagttgaattagtaatgaaaaacttcacaacaaaggaaagtccaggaccagagcttttactagtaaatactaccaatatttaaagaacaattaatactaatccttctcaaactgttccaaaaactcgaagagaaagaaatacctccaaactcttttcatgagcccagcattaccctgataccaaagccagaccaggatactgaagaaaaaaaaaaaattacaggctaatatccctgatgaacatagatacaaaaatcgtaaaaacaaaacaaaaagactggcaaattgaattcaaaaacatattaaaaggatcacaagccttgatcaagtggtattttatccctgggatgcaagaatggctcaacataaaagtgacacattaacagaatgaaggaaaaaacatgatcatttcaatagaggcagaagaagtatttgacacaattcaacattcttcaatgataaaaactcaacaaattaggtacagaaagaatgtacatcagcataataatggccattggtatagtttggctgtgtccccaccaaaatctcatcttgaattgtagttcccataatccccaagtgacatgggagggagccagtgggagatttttttttttttttttttgagacgcagtttcactcttgttgcccaggctggagtccaatggcacgatctcggctcaccacaacctccacctcctgtgttcaagcaattatcctgcctcagcctcctgagtagctggcataataggcatgcaccaccatgcccggctacttttgtatttttagtagagacagggtttctccatgttggtcaggctggtctcgaactcccaacctcaggtgatcacctacctcagcctcccaaagtgctgggattacaggcatgtgccactgtgcccggcgggaggtaatttaatcagcaaagtagttacctccatgctgttttcctgatagtgaatgagttctcatgatatctgatgattttataagggacttttcccccttttacccagcacttctttctcctgccaccatgtgaagaagaacgtgtttgcttcccttccaccatgactgtatgtttcctgaggccttcccagccatgcagaactgtgagtcaattaaacctccttcccgaataaaggaccccagaagttattgcatctcagaacttttcccattaatccagtcatacatcatttatatcaatgacatatgtcaataaagaatgtaactaggtctcaatttaatctattggaacatatatctgcatttttctttgcaataggaacatttatttagatttaaatgtccttaaattgcttgtcagtttttacttaatcatatcaaccaggagttggaagatccttaaatttcttaaacttaacagcatgctcttttgcctcccatctggccttctgaatgtagagtttcctttccttagaatattcttcctccagtatgttaccactttacccccattttggtatagtcccattaatctattcaaatagtttcaggttagtcattttctccttgaagaagtttgctgtgcattcatatacaggtaatgtccctcttttgtttgctctcagaacactatagctcccatattaacatgggtgcttgcctactcacctatggaaccaaaatatctatgaggacagaagacatattaattctatttacagctgtatccttaataaccagtaaaatgtatagatcctgataataagtcagtaaatagttttgaataaataaactagctggaaatcgtcaattatacattagtaagaagccagaagtatactacaatactgtatcttgctgatattgagctactctgttacccttaagttagtgtaaagatacaagtttttcattggaggaatccaaaattattataaatcctggcatgatatttaccttcactaaaaattaattatgattcaaaaggatatagagctagattatttatttaaactagggcactggaaattttataaaactagtactcaggtatcacagtagttaagagaataatagtgtactgcaatgaggtcaaaactgaagagggcctacagggtcttttgaaagacctacatgagtgtcagctgccataggtcaggaatgaggacagttccttgtgatttgtgagaaacatttactctatgatcttcagagaaagaccaactgaggaaagcatggttataaagtgacattcaagcccttctcataaaagtcccataaagaaaggacattctcaagaaagtgaaaagacaacccatagaatgggagaaaatatttgaaactcataaatctgataaggatctagtatctagaatatataaagaactcttacaaatcaataataaaaaacaacccaatttttaaagtgtacatcgaattgaaatagatatttttccaaagacatatgaatgccaataaacgcatgaaaagatgctcaatattgttagtacttatggatggaaatacaaatcaaaatcacaataaagtaccatttcatacctactaagatggccataattttaaaattgttgttggtgagaatatacaatgatgcacctattttggaaaacagattgtcagttcctcaacatcaaacatgtgacccagaaattttaatccagtgtatatgcctaagagagttgaaagcacatgttcacacaaaaacttgtacatgaaggatagctgtattattcatagcagcctcaaattggaaacaatgcaaatgtccatcaactgatgaacggataaacaaaatttggtatatccatgcaaatgaatattattcagccataaaaaggaataaaatactgatacatgctacaacattgatgaaccttggaaacatgctaagagaaagaagtaaaacacaaaagaccacatatagtatgaatctgtttatacaaaatgtccagaatacaaatttatagagttggaaagtagattagtagttggtaggggatagagagagaggggaatggggaattattgctattgggtatgggttttttggaggtgatgaaactgttctaaaattagatagtggtcattttgcacaacctcacaaacatactaaaatccatcaaattgcacgtattaaaatggtgaactttatgatatatgaactatatctcaaaacagtataagagactgtaacaacagaaaaatacttatgtaataatttttatgtgaaaaacatagtacttgttgcccatagggcatgatcacatatataggaaggaattgcactgagtaaagatgggaagacattgcacccaaatattaacagaggttgtctctgtgtagtggggtgatgtaagattttattttcttcaattaaaaaacaatttcagctcttctattataaacatgcattttcataatgaaaaaaattaaaaattgttaaaagtaccataaagagagcagatgatgtcatagtgcttgcagactcttctagactttagagtcaaagtcagagcttgccacctatgccgggcaaggaacaagaaaggtgtgtcagtttatcatgaaacagaatgactctcaaaattgatgttgtgtcaggaagtactctgctactggcaagaactttttaaattctagttgggttatacaaagcaaccttgagagagtaatttgagattgaagggtaccgggtgattgctagaactcatttatataattagtgaagaaagtgcctttttagagattctcatatatgagtatggatttatggtgactcagtgccagtcatgtaaagtatatatttttaaattttcctggaccaaataaaacaagatttttagcctcattttggcccataggccctattgatgacctctattctggtgtttcacttgagtggaataaatgtggaggtcaatgaagttggatccataaccccaagagaaaaggatgttgtgtgggctgtgtacgtgtaaaagtcccttgactgtggatgatacaaggtttgtggatggcagggaataggagagcaggacatgatacaggcagacacatgggcttcaaaggagctaatttatttttacattaatttgaagggataatggactggaagtagtactggagaacaaagagaggagggatgtgtagtaggaaacacctatttgagcagctgcaggaaaaacaatatcctcagggaataacaagttttaagttaaggctagaagttggaaggagtatttagtgaagaagttaagagttaggaaaacagatttatcatagcagcaagcccagtggaaaggcttgatggggagaggaggacagggttgttgaggcatagacagtaagaggactaaagctcatgtagctaacaagtactatgggagcccaagtgaattgaaagtgctggtaggtttgtcatggccactgaaaaggctcataatgtgtttaaaaataagcataagacatgagtatgacaaaattggccacaagaaaaagaaattgtcattgatgagaattcaaccttggataatgtttttaaaaatctgactcataattttatttgaaactggaacctcaaatacataaaggtttatcaaatgcttactatgtcctgaattctgtggtaactagtttagtctagcaacacttttaatcttcacaaaatcctatgaaatagataatccaccacttactgttttgtttctttcacttgatttttgtgccttattttcttcacttgaaaaatagggctgatagtaatagtatgtacatcacagaggattaaaagagacaatccatgagacactgtctagtgccaggtccataaagcttacctattattaccattactacttcttatacgactgctaatataatgactattgttcttgccatttcacagatgaggctaagagagattgagaaacttgtccaaagtcatgtcgcacagcgaatacgcagaggagtaagatttcaaatgcaaatatcctcacattactcctcttagctttgctgaagcatttgaatggcttccatttggttttaagatacacaccaaaattctcaacaaaacttgtatgatctaaactgcacttacctctaagttttatactatgtttccctctctctgtgctccagccacaatgatcttcttttacttcctgtaagtcaggttgcttgttctctcctcataaacggttgtgtagtactatctctgtgtcagtggcactcactgtcttacatattttcatccttccatgagaagagttcatcttttctttagggaagcttttgctaacttctctgactaggataatgacccagtcacatgttttcctgaaactgcatacctcttcttggtaacacttaacatagctataattttttttgtgtgtttttctgattagtacatttcctccagtagacacaagtcatcctctttctttattctcctttgtgggtctgacctactatttaacatggagaggctgaaagaaaaaaaattaactaaaattgattgcaaaaaagaaaaggaataaaaggaacacagtaaagtgttaaataataaaacaaattggataaagagtttaggaaatgaagtatttttaaaagagatgaataaaaagtaagaactaagtaaaataatgtaaaaagatgtataaacaagtaaataatgaacttagaagaagtaaaataaaatgtggaccagcaacataaaaacattggattaggcattcaagacaggtgagaacaaaccgtccctgacagctgaatacctaggccctggtttcagacagggacttctgagatgagacaagatccaaggagatgggagcagggagggtgtcagaccatgggctacaagagctttagggagcaaaggtaactattgcgtttgctttcttttgagaagttttaggttgttttgtcaatgacagctaatgtttggcaaagtggtaacacaggaagaaaaatgtatttcttagcataattattgatatggtttggatttgtgttcttgcccaaatctcatgtcgaattggaggaggggcctggtgagaggtgattagatcatgggggtgaatttcccccttgctgttctggtgatagtgagctgatcatttaaaagtgtttggcaccttcccccacctcttttcctgctctgccatgtaagacgtgcttgcttcacctttgccttacaatgtgattgtaagtttcctgaggcttcccactcatgcttcctgtacagcctgtggaactgtgagtcaattaaacctcttttcttcataaattacccagtctcaggtagttctgtatagcagtgtgagaacagactaatacaattctctataaggaagagatctacatgtcttctaacgggcaggctaaacataaaaaggtagtcacagactacgatacttgtgttttgcctggggtgcataaggtgtgtaaagtgaaggatagagtataattaggaaaatagaagagatttttagaggccatgttgggtagagagaagaaagccaatgaggaataaagccaacttctagcagaaatgacagttaagaaaagggcctcagttttaggtgataactgcctgatagtatgccactgattcataagaaacgggaagataaaacaaggggtgagcaaagattttggtgggaaagatttgataactatagaattagtgtagaatattgtaggatgagttcagttttagagtcaagaccctctgtgttcaaaccatacctcatcacattctgttagtattagcttttatgctcctcagactggagtgaaaaatggagagatgtgctcagtgtttcagttctttctgaaaaataattttactagcagtcataaacattttttacactgacaaaaagcacatatattttgaagtaggatgaaacatttgcctgacgaatttaaaaaataaagacatttctcactgattagtagtagctgtgggatatgccttcatatttcttgcagcccatattcaatttcctttgtcattaagaggactttagttaaaaaaaaataataaagaggctgtatgaacctgttttgaatcactataaaattggggttgggtggtggtggaatgactttgtatatctaaccacctagccctgatcctgacatatgctcagtgactgaaagtactattttccttgccctgctcctcctctcttccatttatgacaagaataggtgatgcttcaatttttatttaaccatttttttaaattcctcttccaatattgggcaactacagatctttccaaccaaaatctttgctcacaggaatatctataaaatatttctatatcaaatatatagtggaggatattcttttagaaaatattcaatatatacaggtataattttattttttactttttttaaaaaatatattcctttaggcgatgaaaggacaagccccaggagtcaggatgagtcctaatgccgtcacccagtcacaccgcagtgcttgcctgtgtcctgccggcccgctccttgttgccctgcactgcgcggccgcagcggcaccatgattgtgtttgccgtgctcctgtcgttggtggcgggtgtttgagggaacgagtttagttcttggtctgttattttcagaaatggaaattggcctataccgggagagtgaatcccagacgtggctgcattgtccatggccttctctgtgaaggaaaacctttcttggccaggacttgcagtaggtgacctatttcatcgtcctcgggctaccgtcatggtgatggtgaagggagtggacaaactggctctaccaccaggcagtgtcatttcataccctttggagaatgcagttccgtttggtcttggcagtgttgcaaattccattcgctctttattttctgacgaaactcctgttgttttgcagttggctcctagtgaggaaagagtgtatttggtagggaaggcaaactcagtgtttgaagacctttcagtcaccttaggacagctccataattacttgtttcaggaaaactccattctcagttcatttcccctgaattctctgagtaggaacaatggagttgacttgctctttctttctgaactccaagtgctacatgatatttcaagcttggtgtcttgtcataagcatctagccaaggatcattctcctgatttatattcactggagctggcaggtttggatgaaattgggaagcattacagggaagactctgaacaattcatagttgcttctaaaatcctgttgacgctctgcaagagtttgcagataacatgtacaatctttacagtgggaatgcagtggtagagttagtcactattaagtcatttgacacctcccttatgaggaagacaaggactatctttgaggcaaaataagtgaagaacccagcaagtccctataaccttgcgtataattttgaatattcagtgattttcaacatgatactttggataatgattgccttggccctggctgtgattatcacttcttacaatatttggaacatggatcctggatatgatagcatcatttataggattacaaaccagaagattcgaatagattgaatattccttgtgccagaattagaaaaggggtttggaaattggctgttttgttaaaatatatcatacattgtggtttaaagtagatagcatactttaaatttattaaaacctcacatttcttctctattttgtgtgtgcctatggttttttttagagtgaattacagtattgatgtgaatcaaactgtacagtgtagattccataatatactgaaatatatcatagccatttaataacacgatttcattccctttaatgagtttggaaatatgcactgaaagaaattaaaacatttagaatagcttgtgttatttattatggaaaaatgcactgaatttattagagaaacttatgaatgtttaacttctttacacagcataggtgaaaatcatatttggactgttgtatactatgaacaatttgtaaatgtcttcatttgatataagtatctctgaaacaagaggaaaggtttttaacttcgaatagccctaaaatatggatgtgcttatacagtcacttagttttggaactctttctgattgacagaggatggctgttttttaaccttcttcaagtttggtgacccatactctagtatggatactaaaaatattacatttatgtaagaagaaactagccttgtggagtatagatgcttttaattatacacacaaaaatcattgaggcatgaacataaaatatttttagttcagtaacttctccccctgtgtaaggtactatggtttgtggtccaacttcatcctgtagaatattaagtggaagtggatgagttctactttttggaatggactcatgtctataaagactgacacgttaataataattccgaaaaaatttttctttaaagctcttgtaccgaaaaaatttttctttaaagctcttgtacttagccaatatttaatgtcctgtttacataatggagtctgaaactcagaggaacttcctggggacccaaaaagtataatgtatatcaaatagagtgagatatatattcattctgtatattcaggtcataaaacacaattacatttaaaagaattttagacagaagcgactttgaatatattacagctgcaatgcagaaacacattaaagttttatggataaacattttttccactggagggtgcaatttgtcagtatatcaaaatagtcacagttcctttaatgagtatactttataaataatatcagagagctgattatttccaagacactaacatagaatgctgagcagatttcatgaaactttaaataaatgaaatttcaccaataggaatatgggctttattccacaatatccttatgtggaatatacttacaattaggatcaagtaagctgaacataattttattcttctgttaccttttttggataccatatatgactttcttggctattaatactgcaaaaatatatactaataattcatgctgaagatacagtcctacttataatattattaagttttatagttgttttctttagcagtctatgcatttatttacaattctttatgaaatatggatttattttattagactttatactcagtaataatgagtagtctaagatgaaatgtaaattaaataagcataaaactaacatacatttaacaaactttcttttattatatatatcatatagtatgaaggctattagataatatgtgcttgagatataatactaatgaaacaaattataataaaagctagtatttattaagcactggctaggtgttaggcacagttctatatttattaactttgcatttgtaatttacttccttatcacaacaacctcaacaaataggtatcattttctccatttcacagatgaattgaatgtgccaagatttcttgtccaagtccatacaattaataccagaactccaccgagatggcctggctccagggcccagatttaatcactattctacagctatgttaaccttgttgatgccatccactgctactcaaataccaacgtgttgatttttattttagacacttgaagacaggcactttccattatgaattaatgtttcaaagatatccatcaaatatgtatttgtgttttctattctgcctaaattaatagaacttctttaattatgacttagataaatgaacttgtggcagagcatcttaattgcctaccccagcagctctttccatccctctcagtaacagaacaccaatattttgctggcatattgccacagtataaggctgcattttccagcctccctctcagatattaatggccacataaatgaatgggcaatgaaatgttaagtgtaagtgttgtgtggaacttccagggagtctcctcaaaagcggaggtctgtgatcttgctacacttactcttaattactcttttccactacctgcaatgtgggcatgaaaacagctggagcttaacagccattttggatcttggggcaggataacagaatgacagccagacaaggcaggaactgctgtttcctttaagcccatattttgaagctttctcgcatacacagctgtatctaatcctactaacaagtttgataggttttaagagttcattttgtctatcttttgagcctcggtccaccccagaccacagcctttctttctttttttttctttttttcagacggtaatcgcactctgtcactcaggctggagtgcagtggtgccatccctgcttactgcaaccctgcctcctgggtccaagctattctcgtgcctcagtctcctgaggagctgggaccacaggagcacaccactatgcccaactaacttttgtatcttttgtggagatgtggagatggggtttcgccatgttgcccaggctggttttggactcctgaactcaagccatccacctgcctcagcctcccaaagtgtggggattacaggcatgagccactgcacccaattgatgtgattctaccatgaggtcatcaaatatccttacaggctacatgaactttgaatatgttattaagctactaatatattttatgcttattttttacctcataattttttaaagatcatttctacctgaagtccaaaattaattacttaaataattctacaagtagtagtaacttgtgtagtagtgattagtgattgacttttaaattgtcaattattaaaatactttagtttttgcagattatatttccccttttgtaaccaggaagatacttgttttagactgtgtgtttgtgccctgtcccctgccacccatctgttgaaatcctaacccccagtgggataatattaggaggaggtcaggcctctgggcagtaattaggtttagatgaggtcatgagggtagagccctcatgatgggattagcatccatagaagaagagagagacaagattctctctctccgtgtgtgttctcacaccaaggaaggccatgtgaggttgttttcaggaaaaggactgtttccatgctgctgtaaagataaactcaagattgggaagaaaaagaagtttaattggacttacagttccacatggctggggaggcctcaatcatggcaggaggtgaaaggcacttcttacatggtgatgacaagagaaaatgaggtgatgcaagagcagaaacccctgataaaaccattggatcttgtgaggcttgttcactaccataagaacagtatggggggaaactgcccccatgattcaaattatctcccaccaggttcctcccacaacatgtgggaattataggagtacaattcaagatgagctttgggtggggacacagagccaaaccatatcattccatccttgacccctccaaatctcatgtcctcatatttcaaaaccaatcatgccttcccaacagtcccccaaagtcttatctcatttcagcattaagccaaaagtccacagcccagagtgtcatctgagacaaggcaagttccttctgcctatgagcctgtaaaatcaaaagcaagctagttacttcctagatacaatgggggtacaggtattgtgtaagtacagccattccaaatgagagaaattggccaaaacaaaggggttacagagcccatgcaagttcgaaatccagaagggtagtcaaattctttttttctttttctttttttttttttttttgagatggagtctcgctcatcgcccaggctggagtgcgtggcacgaagggcagtcaaattctaaacctccaaaatgatctcctttgactccatgtctcacatccaggtcatgctgatgcaagaggtaggttctcatagtcttgggcagctctgcccctgtggttttgcagggtatagcccccctcctggctgctttcacaggctggcattcagtgtctgtggcttttccaggctcatggtacaagctgtcagtggatctacaattctggcgtctgggggacagtggcctgctcctagtggagcccccacacagctccacgaggcagtgccccagtagggactctgtgtgggggctccaaccccacatttcccttcactgccctaccagaggtttccatgagggccccgctcctgcagcaaacttttgcctgggcatccaggcatttccgtacatcttctgaaatctagacggaggttcccaaacttcaattcttgacttctgtgcacccacaagctcaataccatgtggaagctgccaaggtttggggcttacgtcctctgaaaccatgggctgagctgtaccttggccccttttagcaatggctgggacacagggcaccaagtccctaggcttcacacagcacaaggtcctggggccgggcccatgaaaccattctttcctcctaggcttctgggtctgtgataggaggtgctgccatgaagacctatgacattccctggagacattttcccccttgttttggggattaacatttggctccttgttacttatgcaaatttctgcagccagcttgaatttctcctcaaaaactgggtttttcttttctactgcatcgtcaggctgcaaattttctgaacttttatgctctttttcgcttttgaaatgaaaagctttaacagcacccaagtcaccttttgaatgctgtgctgcttagaaatttcttccaccagataccttaaatcatctctctcaagttcaaagttccacaaatctctagggcggggcaatatgccaccagtctctttgctaaaacatagcaagagtcacctttactccagtttcccaacaagttcctcatctccatctgagaccacctcagcctggaccttattgtccaatattactatcagcattttgggcaaaaccattcaacaagtctctgggaagttccaaactttcccacattttcccggcttcttctgagccctccaaactgttccaacctctgcctgatacccagttccaaagtggcttccaggtttttggatatcttttcagcaacgccctgctctactggtaccaatatactgtattagttcgttttcatgctgcttataaagacataccctagactgggaagaaaaagaggtttaattggatttacagttccacatgactggggaggcctcagaatcatggcgagaagtgaaaggcactttttacgtggtggcagcaagagaaaatgaggaggtgcaaaagcggaaacccctgataaaaccatcagatcttgtgagacttattcactaccatgagaacagtatgagggaaattgcccccttgattcaaattatctcccaccgtgttcctcccatagaatgtggtaattatgggagtacaattcaagatgagatttgggtggagacacagaggcaaaccgtatcaaggaccctctccgagaacctgacgatgctgacatcctgatcttggacttccagcctccagaaataaatgagaaataaataggtgttatgtgtgccacccagtctgtgatattctgtcgtagtagctcaaactgacagagacaggcactgtggtgtactcttcttgagttcaaataaatttaaaagtattttatgagattagcaacatgatatgatagtaaagaataagtatgacacagccattttctataaaggaacttgcaaacttcctagcttcctggcatttcctctttgctcagacacaagcctagagtcttctgatttgtcttttcccttcccccaatcttaattaattatttattaatacaatttcaacttttagattcgggggtacatttgcagatttgttccatgggcatattgcgtgacactgaggtttggggtatgagtgatcccgtcacccaggtagtgagcatagtgcccaacaggtagtttttcagcccttgttcccctccttctctcccttctctagtggttcccagtgtctgttgttctcatcccatgtctacgtgcactcaatatttagctttcactcgtaagtgagaacatggggtatttggttttctgtttctgcattaattagattaggataatggtctccctgctgattttaaacttgccctctgcctctcatttcaaagaaaaagaataatgagtcttgttctaaggccttttcctcacgatttaagcagggtttggggcaaaaataaaaaaaagacctacagcttcgctcttgattagaagatgaccaaaagtctatgggagttatggaaatcatacaggttttaagattcagccatatgtaataacagtagcaatatattatggttttaataatgctatcttctatagcatttataatatgttcagcactacactaagtgcattatatgtattaagtcatttcatcctcacaacactctaaaataagtactaatgttttgcagctgagagaactcagtcactgtgatattaacttgcttaagatcactcagctgaagtggaaataccaagacttcaactcatgtttttggccttacaatattactataaagtcttaatccattcagataattgttagaattattgcattgaattagctcaatgaaaaatacaattggagaaatataaaatctatactaaatattttttgatctgtactatcagattctctttcttggatcgaagtgtaaatttgtgtaaatcactgttagaatatgcgttgcattaataagatttttatttttttaaccacctttgataagttccacaaaaattttagtagttacctcaaattcttcattttttttctattttatgggatttcaccatgtataggtcttaagatggatatgacaactcaagtttagattcagtcttgggaaataatcactatgtggcaaatttactatctgataagttattgattgtatctagttctcttcacttctggttgctcttgcaggtaaataaaattatccacttccatgtctaccagtggtatgtgaaaggaagtaataggtaggactagaaagatcctttaaaatcaatcaattactccttgtatttttcagagaaaaagaagtcccagactgataaaatagtcttgaccaacataatttacccaaagaaaaggtagaggtgaatatagagcatgcactctagtatcaggagttctaggctaaatcttggctttgcaattgattaatcaaaaatcttagacatgttatttagtctcttggaggatcaagtttttaactggtaaaattagagatattaaagatgatagtatctctcatgaaattgtcatgatgatcaaatgctcaaatataaggcacagtgttttgcaaactattaagtgttatacaaatgtttagctgtaattaatagactttgcttcccaatttggagagaaatgctataaaatgtgtacaccatcaacaatttggagttggttcttgtatgaagacaagaacagaagaaattatagcttctttattacatgttttataaacagttacaggcattatcttaaatactaaataattagactacaattcctgcttcattttaaagtcatatgtttataatctcataaaattatttttagggttgcccagtgcaagtagaacaggactacccccctcatcatcttatttttgatatttttcataaatcacatttaaaatttgaaaggaatgtctaccatttgcccactgccagactcctcttataaggtattccacatgcctgttgccaggtgagtagacatgaaactggattctgggagagctggaatcaaagagggatgtatgctaaagtcagaaaaggacaacaggggaacactctcccatgatacaggatttgataccctggcaaggaccctaggaaacagtgcaagcatgctgatagaatgaaatttgtagtatgaagaaagtgatgagccacaataagcgatgtagaaaatgctagaattgacatcccagagggtgaaataagggattaaaagactaggcaaagtgggcatgctaaagtggatataccatgtatatggaaagatcaccagatacctagtttccatggaaggcctagaaccatcactgtttgcaatcaggaacattttggtgagaggagtaccaatatcagagtcttagcagtagctctcttctgtagaccagggctgatgatagcagacgctatttgtagtaggctgaatagtgcctaccccacctcgaccaaagatgtctatgtcctaattctcggaacctgtgaatgtgtaaccttcatagtttaagggactttgcagatttaattaaattaaggattctgagatgaggagattatcctggattacataggtaggcccaaagtaattacaggggctccttataagagaaaggtaggagggtcagagttagagaatgcaatgtgacaatggaagtaggggttggaatgatgcagcaatgaactaaggaatgcaggcagcctgcagaagccagaaaatgcaagtaaatggattattctctagaggatccaagggaatgcagttcaggtaacactttgattttagcctagtggacatattttggattttgacattcaaatctgcaagagaagaaattttgtgttgctttaggctactgtgtgtggtaatttgttacagtagtaatgggaaatcaatacacttaaagaactgggccaactggtggaaatgacactctaagacaaccgagataaaatggtaatgcttaacagtaaggagtcaggtcgatgcagttacaataaagaagagcaaggtttgagtggtagtcagcagatgtgagacacagagggttacaagagatgatgaccagaacatggtgtccttaggggcaagatagacaggcagccaacacagatactactcagtctatacaatgaaaagaaatcaagaatagatgtccagaaggctgaggccagttgctttagttaaaaattcatgattcctcttctaaatttttggttttcaaaccccaaattcattgactgaaggagaggccaggtctctaacaaaaagggctcttagaaagtgtatgtggtaacagttcatctaatactatcacagtaggactctcctatatttgggtaactatattctgaggaaagataaatatacaaacattttaaggactgcttaaactcagaatctgagttgatattgttactcagagaaccaagaatctcatcacagcccctctattagaatgaagacatatgagggtcaagtaataggatcctggctcatatactgctcacagggtccactggttccaaagatatacttcggatttattttcctagtctttgaaggtatcgtttaaatgggcatacttgatagttgacacaactcccactttggttctttggcctgggaagaaagggtaatcatagcaaggaagtttaagtggaagtttttgaaactgcatccccatgtggccaagatagtaaatcaaaaaacaatattccatgtcaagaatggtagaaattaatgcaatttttaaaagttgcagaattggtgatactatattttcatttgatccactggtctgatctctacaaaactgagatagttcctggaggaatgaaaatagatactataaactccgtcaagtagttgccctaattgcaattgccataccaaataaggtaccttttctagagccaattaaaaagaaattaggtacatgtatctgggaaatgtatttaagtagaatgtaagtggcactaaccacagttctctacactgcacctgatctcaaggatgtaaatgatcgtccttatctctctcctctactgtgaactccagaagaccctcaccttcagctgttcaaggtgatttactgatagcatgacccaggctcccatctgtgaggggtctgagcccttggctcacaaagcccttcttagggcacagcttttatacttgcccatttacatcgagattggtcaacgatgtatcaagagccacgtaggtgggagccaaacatgttcctcctgccatactactagaatatggttaactgacaacctatagctgttgacttattcaaggtccacctctacttttgagccacgaccatgctcttctcagggcagccaatgactgagtaaaatggcagtacatgggcctaatcatttctgcctaaagtaagatccctctaatgggttcttctaataagctctctgctccagaattcccccagttgagctggagagacatttatcagtcctacattgtgatttgcttaatcccttgccaaatgctgtctcctccttttgtgtttcacaggtgttacctcccctcccccaataccttgtttttactcctaactccatctctgtgtctgcttcctaaagaacctgagtgaccagcacaaggaggtagtgtagggtagaggcatgtggatgcatctatgggaatgagcatatggtatgaagatatttttattacttgttgtagtggttttaaaaattcattgataatcttctctggttcctggttcccctcgtcttgagtttaggctgaacctagtgactccattgtaatgaatagaataaagggaaagtggtgatgtgcaactctggagactagtttataaaaggcactgtagtttcctgactcttctctcttgtatagctttctctgggagaagcaaactagcatgtcatgaggacactcaggtatcactggaacagcccatgtagtgaggaacagaagccttcttccaacagcctgagtgagcttggagagagatccttcagtccccagactgcaacctcaggcaacaaattgactacaacctcttgaaagattgtaaactagaaacagcaatttttagttgccaagagttggaggaatttgttaaacagcaatagttaacaaatatagatccccagaaataatccacagttgaagaggcactgaagaaacagagaaaatgacttgctcagttatcatcggtcagcctctggcatcagccacttcagtgatagtataatggttccaaagatagagaagccatgtgggcaaggacagaagctattcatggttccaataacataggctcccattcaccaagcttatctagctactgctgctcctagaagtccaatctgacaaaaatagagcacaacactgaaacatcctttgaggaaagcagtcaattaggccagataattacattagatcctttcttctatagtgcagaaatgggcacatgctcttagaattcagttatgtcagtcacatcctatcccataccactgagcagctgctggcctgacagaatgatggaagcatttgttgaaagtacaactaagatagcagctcagagatgattccttacaagagtggggcatcatctttcaggagatagtatgcattttaaatctgtgaagtatatggcactatgtcccaagtaggcaaatatatgggaaccaaagggtaaaagtaggagtggccctatttgccctcctgtcagagactcggtaggggaacttatgtttactgtccatgccattttgatgcatagaggtcatcatgttttgaagacctcctttcaaagggggaatgcttccacttgggtcccattaattaagctacaactgtcacccgtgcacttcaggttgctcctgctaagagatagcagtcagagagagaactcaacattctgaaagaggttattgagccagatcatcaagcaaaggtaggaccacagaagcttgaaatatgttagtgcattgtagcttgctcatgtactgcttttggaatcctgtgattaccatgtgataaagtctgtgttaacctgctagatgatgacagacacatggtaccattgtccatgtgcctcagtggataggctgccaaatatcagtcatatgagtgagactatcctaaattaatcagccatcagcgaaaccacccactgagtgtagcagaggcttgagcaatccaacaaaaatcagctgaggtgatttagaccacagactcgtaagttaaataaatggtggttgtgttaagtacctaagttttagagtggtttgttaaggagcaagagtgagctgatataagaaacagcttgccaagagaagggttttagaaaccagaatactgtggcttttttcttaaaacctatatgatccaaggatcattttgagaaaatgggtattcgtgcttctgaattaaatattttatcatctaccatgatcccatcctggtgacttgaatgcaaccacaggcgaatcttgaggatttctttattttacattaggtgtaacctgaagtaatgacctagtagcctgctacatgttatcctttcctctggttctacttggacccagcttggaattcttaatctgatggttgtgttcttatgggctccagtacaaacacattttagacagaaaatagactgtaggattattaatcatacatattgtggggtgaacttgagaagtagccctgtacccaccatgcagttatgatctgtatggcttttatttcctttttttttttttttttttgagacacaagagtctcgctctgtcacccaggctggagtgcagtggcacaatctcagctcactgcaacctccacctcccaggttcaagcgattctcccgcctcagcctcccaaatatttggtactacaggcatgtgccaccatgctcagctaattttttgtatttttagtacagatgcggtttcgccatgttggccgggctggtctcaaactcctgacctcgtgatccaactgcctcggcctcccaaagtgctgggattatggatgtgagccactgcgctcggccagcttttatttccttttattgacttattgcactggctgaaactttcagcaccatgttgaataagagaggtgaggagtgcacattcttgacatttccctaatcttaggatgaaaatattctgtctttcaccattaaaaataatgctagctgtggggtttgcttgtgatgctctttatcaagttaaagaagttcccctctatccctgtttttctaagaatttctgtcatatatgggagttaacttttttcaaagggtttttctgcatttaacaatatgatttttcttctataagcctgttgatgtggtggattacattgatttgctaatgttgaaccaggcttgcatacctgaaataaatctcattttgttgtggtatataattctctttaagcttttttaaaataatttttaagaattaaacttgctagcattttattgatattttttgcatttatgttagggagaaatattggcccatagtttttcttttttataatttctttacctgttttaggcattagggtaatgctaacctcggaatgagtctgcaaatattctctttgcttctatttctggcagacattgtagagagtttggatcatttctgcctcaaatgtttggtagaaattatcagaaaaaaaaaagacagaacatggtgcttttatttcagaagattattaattatattgattactaattattgattcaatttctttattacatattacctttctcagaccattctggctgtcataacaaaatactttaacctgggtaatgtataaacaatagaaatttatttcttacagttcttgaggctgagaagtcgaagatcaaggcaccagcaaatctgatatctggtgagagcctctttctcaaagatggcatcttcttgcagcatcctcacatggtgaaaggggcaaggcggctcccttcaacctctttttataagatcactaatcccattcacaagggccccacctcttaatattattactgtaggtattcggtttgaatatatgaattttgggggagggacacaaacattcagacaatagacatattccaattatttattatttcttttacaaattttgtagttggtgtcgctaaaggaattggtccatttcatttaagttatcatatttgtagacacagttgttcatagtattcctttttattgtccatgggatcagtagtgatgacttgtctttcatttctgatattcacaattcgtcttttctctctttttaaatacatgtcattttggcagaggttcatcaattttattgattatttgaaaggatcagctcttctttcactgattttctcttttgttttcaattttattgatttctgctctttattattttcttctttctgatagctttgtattttctttttggtcttctttttctaggttcttgagacagtagcttcaattatggatttgagacttatcttctctaatgaatgcatttagtgctattaattttcctctcagcaatactttcactgtgttctacaaatgttgatatgttgtattttcacttttcactgagtttaatgtgcttttaaaaatttttgagacttcctttttcatccaaggattatttagaagcatgtttttgaagtgtccaagggttaggacatttttctgttatctttctattattgatttatagtttgattttattgttgtcagagaacaaactctgtatagtttttttaataagtttacattccagttccataagaatgtggaaacatagaaacaaatgaagacaaataaaatgatccccaatttcccaacagatgtcaactaatattaatgttaatcaattgatatttctataatatgcttatttatataggtatcattatgcttatctcaatattgtagacaatattgctttgatcttattattctgcttttttccctttacatttctctcaccttaaatatttttgaaagtacgatctttttttcttaaatgtaaaatctcttcacaattaagtacatgattgtatatgtttatcctacatgtcagtaaatcaccaactagaccagttgcagtggctcatgcctgttaccccagcactttgggaggccaaagcaggcagctcacttgacgtcaggagtttgagaccagcctgaccaacatggagaaaccccatctctactaaaaatacaaaattagccagcatggtggagcatgcctataatcccagctacttgggaggctgaggcaggagaatcatttgaacccaggaggcagaggttgcagtgagctgagatcataccactgcactacagcctgggcaacaagagcgaaactctgtctcaaaaaaaaaaatcaccagctattataaaaacaagacaaattatatcacaaaagaacaaaaacatagaaagaaatcataagaaatatatcgacctgtgaaaagtgtctttcttttggtgtcttcacatcctagtcttctgcgtatttatgtatggaacagtattgccttggatagatgcatctcttacttactcttcagttgtccatttgcatattctatcagctccagggatatcaagctctatataattttaattattttaaatttattaagtttttttatggctcaggttatagtctatccgggtatatcttccatgcaagcttgagaataatgtgtattctgctgttaggtggagtgttctatagaagtcaattagattatattgccttatgttgttgagtttattctagattatttctgaatattttgtctaatatttgtatcaaattttgatattaaaatatcaaaaattaaaattcccaactataattacacacttgtctatttgtctttcaagttctatcaatttttgcttcatatattttgcagttctgatcttggggacatacctatttaggaatgcaatatattcttgctttgtgtaatgtttctttcagtctggtaattttctttgctgtaaagttgactatacctaccattaatactagtcaatgtttaagtgatatatctcttaatatcattttactttcaatctgtctatattgtcatagtttgtgtgggtttcttatagacagcatatagttaggtcatgttttaaaatctactttgtaaatctgtcttttaattgacatattttacccacttacaaataatataattattgatacgtttgggaaaacatctgtagttttttttttgttttctgtttgttttctctattttaatttccctatttttttctgaattctagttttgatatatccattttaatatctctatagtatttttgagtgtatccctttgtatagctttttgatggttgctctagataacttattgtatattatttatataaaaataaataattataatttataattattatatatacatgtctatcatagtctatttgtgtcataattttgccaattagaatgaagtgtataaaccttaccttcctttatgcccccttactctcccccatttatgatataattatctcaaatatctcctctacattcacatagaacaatgtcagtgttataatttttgcttcagtgattaaacataatttaggaaactcaagaggagaagaaaaatctgttgtcttcacttgtatttttgcttaccatgtctttctttatttgatgttccaaaggtcctttctttatagtttcctttgtgtttagagaacttttttttaattatactttaagttgtgggatacatgtgcagaacgtgcaggtttcctacgtaagtatacacgtgccatggtggttcgctgcacccatcaacccgtcatctacgttaggtatttcttctaatgctatcccttcctatgcccccaccctttgacaggccctggtgtgcgatgttcccctccctgtgtccatgtgttcttattcttcaactcccatttatgagtgagaacatgcagtgtttggttttctgttcctgtgttagtttgctgagaatgatggtttccagcttcatccatgtccctgcaaaggacatgaactcatccacttttatggctgcatggtattccatggtgtatatgtgccacttctttatccagtctatcattgatgcgcatttggtttggttccaagtctttgctgttgtgaacagtgctgcagtaaacatatgtgtgcatgtgtctttatagtagaatgatttataatcctttgagtatatacgcagtaatgggattgctgggtcaaatggtatttctggttcttgatccttgaggaatcaccacattgtcttccacaatggttgaactaatttatattcccaccaactgtgtaaaagtgtccctatttctccacatcctctccagtgacttttcaatgatcaccattgaaactggcataagatggtatctcattgtggttttgatttgcatttctctaatgaccattgatgatgaacttttctcatatgtttgttggcctcataaatgtgttcttttgagaagtgcctgttcatatccttcacccactttttgatggggttgtttgtttttttcttgtaaatttgtttaagctccttgtagattctggatattagccctttgtcagatggatagattgcaaaacttttctcccattctgtaggttgcctgttcactctgatgatagtttcttttgctgtgcagaagctctttagtttaattggatcttatttgtcaattttggcttttgttggcattgcttttgatgttttagtcatgaagtctttgcccatgcctacgtcctgaatggtattctgtaggttttactctagggtttttatggttttaggtcttgcatttcagtctttaatccatcttgagttaatttttgtacaaggtgtaaggaagaggaccagttgcagttttctgcatatgcctagtgagtttttccaacaccatttattaaataaggaattctttccccattgcttgtttttgtcaggtttgtcaaagttcggatggttgtagatgtgtggcattatttctgaggcctctatcctgttccattggtctatatatctgttttggtaccagtaccatgctgttttggttactgtaggcttgtagtatagtttgaagtcaggtagcatgatgcctccagctttgttctttttgcttaggattgtcttggctataggggctcttcttttaaagtagttttttttttttttctaattctctgaacaaagtcaacggtagcttgatgggaatagcattgaatctatgcattgctttggacagtatggccattttcacagtattgattcttcccatccatgagcatggaatgttttccattttttgtgtcctttcttatttccttgagcagtggtttgtaattctcctggaagaggtccttcacatcccttgcaagttgtattcctaggtattttattctgtttgtagcaattgtgaatgggaattcactcatgatttggctctctgtttgtctcattggtgtataggaatgcttgtgatttttgtaccttgattttgtatcctgagactttgctgaagttgcttatcagcttaaggagattttgggctgagatgatggggttttctaaatatacaattatgtcatctgcagagacaatttgacttcctctcttcctatttgaataccctttatttctttatcttgcctgattgccctggccagaactctgttgattaggagtgttgaaagaggacattcttgtcttctgtcagttttcaaagggaatgcttccagctgttgcccattcagtatgatattggctgtggttttgtcatatatagctcttatgattttgagatacgtttcatgaatacctggtttattgaaagtttttagcatgaaggggtgtttaattttatcaaaggccttttctgcatctattgagataatcatgtggtttttgtcattggttgtttttatgtgatggattacgtttattgatttgcacatgttgaacgagtcttgcatcccagggatgaagccaacttgattgtggtggataagctttttgatgtgctgctggattccatttgtcagtattttattgaggatttttgcattgatgttcatcagagatattggcctgaaattttcttttgttgtgtctctgccatgttttgtatcaggatgatgctggcctcataaaatgagttagggaggagtccctctttttatattgtttggaatagtttcagaagaaatggtaccagctcctctttgtacctctggtagaattcagctgtgattcagtctgttcctgcgctttttttggttggtaggttatttattactgcctcaatttcagaaattgttattggtctattcggggattcaacttcttccttttttagtcttgggagggtgtatgtgtccaggaatttatccatttcttctagattttctagtttatttgtgtagaggtgtttatagtattctctgatggtagtttgtatttctgtggtatcagtggtgatatcccctttatcattttttattgcatctatctgattcttctctcttttctccttcattagtctggctagtggtctatctattttgttaatctttttaaaaaaaaccagctcctggattcattgatttttttgaagggtttttcatgtctctatcaccttcagttctgctctgatcttagtatttattgtcgtttgctgacttttgaatttgtttgctcttgcttctctagttcttttaattgtgatgttaaagactgtcaattttagatctttcctgctttctcctatgggcatttaatgctataaatttccctctaaacactactttagcattgtcccagagattctggtatgttgtgtgtttgttctcattggtttccaagaacttatttatttctgccttaatttcattatttacccagtagtcattcaggaggaggttttctgtttccatgtagttgtatggttttcagtgagtttcttaatcctgagttctaatttgattgcatggtggtctgagaggctgttatgatttccgttcttttgcatttgctgaggagtgttttacttccaattatctcgtcaattttagaataagtgtgatatggtggtgggaaaaatgtatattttattgatttggggtggagaattctgtagatgtctattaggtttgcttggtgtggaactgagttcaagtcctgaatatccttgttaattttctgtctcgttgatctgtctaatattgacagtgggttgttaaagtctcccactattattgtgtgggggtctaagtctctttgtaggtatctaagaatttgttttatgaatcttgttgctcatgtattgggtgcatatatatttaggatagttagctcttcttgttgcattgatctcttcactattatgtaatggccttctttgtcttttttgatctttgtggtttaaagtctgttttatcagagactaggattgcagcccttgccttttattttgctttccatttgcttggtagatattcctccatccctttattttgagcctgtgtgtgtctttgcacattagatgtgtctcctgaatacagcacaacgatgggtcttgactctttatccaatttgccagtctgtgtcttttaattgggacatttagcccatttacatttaaggttaatattgttatgtttgaatttgatcctgtcattatgacgttagctggctattttgcccattagttgatgcagtttcttcaaagtatggatggtctttacaatttggtatgtttttgcagtggctggtatgggttttttctttccataagcaatttttatttcatgtagatctgctggcagcaaattatcttcatttttccttagaatgtcttggtatctgtttcatccttaaaatatttttttttctgaatataagatttggtgttgacaattttctttctgaacttgaaaagtgttttcttatttgcttttcacctccacaatttctgatgagaaattctctgtcatgaaaacagatttttacttacaggtagggtgtaatttccctttcattgatttcaagattttttctttgtgtttaattttcaaaactttgtcaataattttcttagtgtatttatttgagtatattctgtttggtatttgttcaccttcttgaatctgtagttttatgtctttttccaaattgtgatgcttccagccattatttcttcaaatagtttttttttcttttttggtctcatctatttcccctctctttcaaagactctaatcacacaaacagtagatttttttgttatagtcccacagattccttatgcttagtgtatttttttccttctattttctttatgttgttcagattggacaatttctattgttctatcttttatatcactgcttttttcctctgttccctccattctgctgtcaagcttatctgttgaggtttgtttgtctgtttgtttaggttatcgtatttttagttctaaatttttttatttggttcttttgtatacttcttttctgatactttctatttctttttttttgtactttaagttttagggtacatgtgcacaacgtgcaggcttgttacgtatgtatacatgtgccatgttggtgtgctgcacccattaactcgtcattgaacattaggtatatctcctaatgctatccctccccacttccctcaccccacaacaggccccggtgtgtggagactttctatttctttaagaggctttaaaaatttttttcacttcaagaatgtttgtaattactcatagaagcatttctatgatggctgctttaaaatctttgttagctgggcacaatggtgtgcatctgtagtcccagatactcaagaggctgaggtcggaggatcacttaggcccaggagtttgtggtggcagtatactatgcttgtgcctgtgaatagccactgcattccagcctgggaggcaaaggtagaccccatctcttaaaacaaaaaagacagatattaaaagcatctttgttatataattcattctaacatctttatcaccttggtgttgacatctactgattgtcttttctttttttcccattcaccttgagatatttctgctttttgctgttatgaataattttttattgaaacatgaaattttgtattttgtgttaagggtcgccaggtctatttaagctttctgtactagctgatttcctttgacgctgctccagcatgggaaagggatggatgttccttgctactggcaggtcagggagaagaagggcaggttccttacatgatctatgctgacacctaagagtgggtgtcctctgtggcctccgctgatgtttttcttgatgagagaaaaaggaatgccttattattgctcccatgtgccttccactgccaccacagttggggtatatgtcctcactgacgttggttgggggcaaaagttctaactttccagcagggctcctatgacactaccatagtggggaggggtacttcataactgttgggcgtgccaggaaattcaggttccccaggtagtctacactggaaatatgggaggagccttgttaccacctgatagagatgaaagtcccaggtacctactcaatctctgtaacaccccagcaggaaagttagggtaacttgttagaggctggtgagggtggcaccccactcagcctatgctggcataggcagaggtggggacacagttctttctgtggtgtttagctggagtagaacagttacagtatacaagttttctgtcttactaggttgcccctttcctggtctttttgctaaggagaggaggctttatttatttatttatttctattttttgtctttactcactggcatttctgggttgctggcttcttcagctccaagtctgagatatatgaatccaaaagaaaacccaaggagcttaccaccatgtcatttcttgtgccctgtgtcccatagatggtctgctttcttctcactatcttttagagtctccttatatttattgcatataaaatgtccaaggtttctagttatcattagcagaaagaatgggaaaaatatgtctactacagtttcctggaagaagtcgcaagaattattttagataattaagtgattgaaaaaaagatcaaaggaagaatacaatttcatgacacatgagaattacataaaattcaaaattcagtgtacataagtaacgttttaatgcacatagttacattcacatacatattgtctacagctccttttgtgctacaatgtctgaggttgaatagctgtatcagagagtctatggttcacaaagcctaaaatatttactgtctgagcctttaaagaaagtttgctgatccctggcttacatcatggaattacttacattttattaacagtgagtagagtacttcctctatcaaaacttagagaaaaatgaatgtataaattcagatagactgtactcagttttagggaaatataattatctatagcaatcataagtaaatcctcatactgttaaaaaggtatatatacagttttcagtttacaccaaatgctactcagttaaggttgaataaattttccttaaacattgatgtcaaaatcactcttttaccattcttggttagtgcaaaattttttactcataattttttcttctagcaaagtctgctacaaatactgttatgtattttttctactgtcaaaatgttccccaggaaacctgaatgtttccacaaatattttttattataaatgtttttgtatgtttgtaacttcttttgcatgttgaaattctatagccaaggttgcaaggttgtcattgttgtaatgttgaccataagagtcataaacagcaagttgaacactaaatttgaaagacattgtgcaagaaaagaacaccaaaccaatagtattatttcccatttatctaacctttcaagggcacttagcagctagaaaaagattataaatacagacagatttcatgattagaagcttcattagtaagaaggtacagaatactaatcacaagactttcatttgcactgacaaggtctgaccttgctagcattcatcagtgacagtggaattgctccctggtggtatcaaccacaggaaagacagagaaaacatgtttttcgtggaggaattcatcaaaagtaagcagaactgtatcacacaccattgcttccaggagttcccccagagaatagctagcatcttatctgaatcagtttgtttagtctgtaaaatgtaaaatgttcaaagaaactttgcatgttaaagaaagtttaagctttgaaaccttggaacaacaactatcatttcacatgactcttcaccttaaatcatctaattgaccatgaataggtgctttggtcaatattaaatctagaaacatagatatagtatactctgatattaactaggaattataaatgttataaactcttgtaaatgtttccatttaaaaatattgtgaaactaaaatgattaatacattaaataaatcaaaattgtatattttaagtctggaagtgcattttcatattccaattataagtgtgtattaagcgactgttttcctaaatgtcattattttatatgaaaaatgccttcattgtctgaaagcattttactgagttccgaggtttgtgattggacaaaactgagcacaattttctcatctgcaaataatttactgctaatttgttgtaaagttagctaattaaataattattgtataaaacgaaatataatttagtggaagcgctaaggctctggagtccgacgggtctgattttgaatccttttaattgcttaccagttactggacctcagtttacttatctgtaaaataggaaaatactacccaacatccatgcaggattgaaataagtgttaggcaaatggtgattattataaccaaactccaaattgtgtaataaatacttcaaatacatttacagaaaaacaactaaagaagatcagcgagttaagtgaaaatctaattgagttgagagttgtctagggcttaaagattctctgtttattataacaaaaacattattattttacattttaatgtttctgaagttgatgttaaaataaatggacaatgaatcaggtcatgattaaattgtgtacagttagcattgtctacatactggccagcttatgagatcccacaagaatgtgaattttgactttaatttgggtccttattattgattaaaatgtctttgcaaagattaaactctgatacagaattaaaaagcttttattaaaacaaaatgtgatgaaaggccacagaaggaacagatgtcttaaagtagatcatgaaacttttatttctttaacttcaaaataaatactacggttagatttctcaaaattaaaaagataaatacaaaaatgtatattataaaacatatctaactcaccccctgtctctcagccacccaagtgttcttgccacagagaaatagctattggtctttcttttcatttcttgtaatgatattttatgcatatgtaaatagataaatttaatcatatacctttttgtaattcaagtgttgcatacacaccatacatatcatttttcacattgcttttttacaatatcctttggagatttttatagtcaagctaataaagaatttatcttttttgctttaacagctgtttagtgctccattaaatatacagaccatacattttaaccagtccccttttgatggacatacatttttttttcctaaacttgtataactacagtgaagtcatgaataatcttgtacaaagaacatggaattttcaaattaggaaaagttgatataaacccgttcattttgaaagatatgcatgcaggctcttggacatttctgagtgaaggagaacaggaaatatggttagagactagaagtgtataaactataggatgctttgaatgctgtggaatgataattcataatatgacaggaaatagtactgaactattaaaagtaacgagaggtcatgaaaagtagtatttaaggaagatgaatgttcagagtttttatttcctggcaccctggaattgtttggagctttgagaaagagctttatgagattttcttgttaaaataaaactattggtgtgatagagatacaagcaggcaagatgactaaatcagacaaaaattgtaggcagaggcagaaaattaggacctaaattctgaaagattaactcagatgagagaagcaagataatactctgacattttaagtagcaggcaaagtccagagtgcaaaaattcaagagtggatttagaaaagtacttcgtgaattttgaaactaaggaataggctatgtggtctttcccctatgtacacactattctgagtttgagtgaccctgggaaggtttatggctaagatatcaagttgtggtcaatatctacaagcaccatgcactcctgcttctcttttgccatatagattttctcagtttttcgtttgcttttcagtaagagcaaatatattaatattttttctttatagtgttttaatgttttattattagttgagaaagtttttcccactccaaatcatgtagtcacacctgtattctattctacagtttattgctctatatttttcatttaaattattaatctattggaaatttatattgatgtgtagtgtgaggcaggggaaaatcttttcaaaaccctttactattatcctgtggcattattttcttaatgtttttcctttaattcaatcaattcgtttcatctcttcatctttaatttcaaagatagtgcaaaactccttttaggtggcaaatcttttcataagacctgttttcccttctttactcatttttaaatatagatgactagtattttccaacaaactttacgattagattcttttaggactcccttcctgtctgctttcattctattaatgtcgtctttctgagatttacattacattacattacattatattacattacattggagggttggttgatatacgttataccagctcagtgattcagcagcattaggggcgtagagagggggcttgtgtagttacagcaaaggaatattttctctgttcaagctggtgtttgttggtattatagtacctgccattagctttcctgtctaatttacttttgtatctaaccttcattatggacacgtgtggctctgtctgacatccttcctaggacagtagcttactgcctcagggaggagctgcacctcagtcagaagaagccctgtttccttgccgtgtggtttttgtatggtatggtttttctttcccttgtgtctcctggaagagctgcttctgaaagtcattaatctgcaaaaaggttttaaaaatgaaataatttccatttgtcttccattctgcccacttggtagtccttactttatattgaagttttaagtgatttccataaaatgtagttatagccattttttattgaacaacagaaacacagacatcatgatactttccatactttatcttatttggagagataataaaacacagtggctaagagcatgaactctgaatacagagtatctgatttccaatcacaggtcttcccccacaagctgtgaaaattgttcaatttgcttaacttctctgtattttggtttccttacctgtaaaatggtgttataattcaaataaattaatatataaaatacttaaagcaatgctgagcacataataagcacaatagaagtgttttggttgttgttgttgtctttgttttaatggtggtagtggtggtggtagttatttgattttcacagtagacctgtaaggtactatttaagaaacgggcttgagaaacaggttcagagattttaagcttgtatatcatgtaattgcgtggaatacagttggtaattattaaatatttatttaatgaatgaagttacaatgatagcattaaagctcaggactggctgacatcaaagcttgagcttttaatccctattcctcaaaatatctcttctacttttgtcatggcaaatgaaaccactttctccagaatgggaattgcatattgatcctccctggcttcctttaatcttttatttatgacactgtatctgtcagaaattccttaaatttttttctatagagcttgtttccttctcaagttttcagtgcaatatgggctttccaaatttttttatgtgtttgtgcacacatgcatgtgcatgtggagggtgtatgtgtgtgttttaaataatttcacttggtaatgtggtgttaagtagaagaaggagagattatctgcttattgtcagtttgtccaatattctcttgtagttatatttttccttatttgggatctttgttagttaccagaaattgaactaggttaatatctgtagccattaatatttttaggttatgatttttacttatggcagtaggacctttctgactataactcatattagacctagctatccacagttttgttcataccttaaattaggggtcagcaatcttttttggtaaagttctaggtagtaaatattttaggctttgtgggccctatggtctctactcaattgtagtatgaatgcaatcatagataatatgtatacaaatgaacatagctgtgctccaataaaactttatggacacagaaacttgaattttatataatttttgcatgtcatagaatattatttgatttttttaaccatttaaaaacataaaaacctattccattcttagctttcaggtctcgaaataggtggctatttagagttcgtcttgcaaaccacagtgcattctctattcccccttcatgccctatatggctataatccctattattctagtgattccattttatccctcatactaagctagaattatcattcttaaacttaaatcactaacctgattatatcattcctatatcagtcagggctctacagaaaaaagccaatagattttatatatatatatatatatatatatatatatatatatatatatatgtgtgtgtgtgtgtgtgtgtgtgtgtgtgtgatatatatatgtgtgtttatattacacacacacacacacatatatataaaataaaacttattatgggaattggctcatgtgattatgaagaatgagaagtcctatgaactgcatactacaagctggagaaacaggaaagccagtgcagtaattcagctcaagtccgaaggccagagaaccaggagctccgatgtctgagggcaggagaatatggatgtcccagcccaaacagacagaacaaattcgcccttacatctgtcttgttctgtttgggttctcaatggattggatgatgctcattcacattggtgaaggcagatcttctttactcagattatcaattcaaatgctaatccctctggaaacaccttcacagacacatccagaaagtatgctttaccagctatctggacatctgttagtctagtacaattgacacatgaaattaaccatcataactcccctctttacaatcgtttgttgactctctaaactttatggcatgacatttccattcacaaaatctgcatagtctactctttcagacataccattcgttacttctctctcagcattccttagtcaaggcaatcccaattatttgctgattccgcagataagtacattcttttttcccctgggccttgaatttctttatcacactttgctacttggcatacttattcttacttattctttaaaagtctatttaaaatggcacgtattttatgaagttgtctctgaacttttaggaagaattaatcactttttcattcatggtttcatagcactttgaacattttttaacacagtgtatcattatgttataatccactttgttcatggttgtttataccaattttaatataaactcttgatgtaagagattgaattaattcacatttgttttccccaaacctggtatgtattttgtgcttcacaaatgatttttaatgctacaacaaagaaattacacatgaatgtttacatcagccatactttaccaaaaatctgctttttagggaagatttaaaaaatacagattatttttggaaagtacataatataatatatgggtttacctttttgcaaagcaaagaatcatttgataaagaaaaatttctctaaaatttctttgttttgaatttttttcttaatgggtttgaatttttaagcttatagtttcatttgccaaaaactatcaaggttttaaggaaataacagcttttgtgctgatagcttcgattaccacctataagtaagccaactgagaaaaaaaaatctagatctgatattttgagaggtttgtgtttgtttgtttgtttttgtaataaacacatcagcaaataaatattcccagagcaaatgtcctagggatgctaatggtgaaaatgcttcaggcagctattgatccaaactctgggccttcattctctgcctcctcatcctcctaattcatacatctcttctccttctttacggagaggctagatacatttatttatagatataagtgtagttcatgggaagaaagccaccgcacttgtatttgatagaaagcttcctggagattcttcagacttgtgtgccttgtgattatttgcctgggaaagcaacccaagttcgccaaagtaaagagtcagcacatgaatccctttgtacttttttggccattccttgtcctgagtgatacacagaatctatgcaatcattatttatagcaagatacaagaaaaaatactatagggagctaaaggtttcagtccacaaagtgtttttgaaattaatgttgatgtcactgatgacaaccactcagaattgttcatattcttttcttagtagtgtcaccgtgatttatgacatgaacagaatatgtttttttcatatcgtctctcttacctgaatgtcaggctctgttgctatttctacttctctgtagtggtgataattgaatgaggagaagcaaaaaagcttcagctgtcttaatttctgattaggaacataaattaactagaactagggctgcttccagaactccaaatcagttttttaaagaacacctttatctgtctttaaatgaaatataataatttctgaaggcaattataggctttgaataaagtaagtttatatatgccagtaagctaatcaaataattgctttatcttatgtgacttctagaatttataatatttgtgtttctcctataattctagaagtatacatcaattcaatgtttgcaaacctcagtaacacatatatgcacatttttaatgaagtcagtgattttgtgatggatcttatcttcaacagggtctaatttttttcatgtgccaccatgtacagtgacttcactcactggattttgttgttgttaaatttaaaagcatggtaaggacactcaagcctgtcatggattcttaattaaactttttggctgaggtctctcatggtcatttcctccttttggttgcctgcatccgtttctctttcatttgatagcagtgtgctaaattccttttggggagttatacttttccattgagtgtagttttaaaacactgtactgcaaatcaaggtgcactgccctaccctagttaggctactctgactctctcttcccacactttgatggaaaaataggaaaaaattaaaattcactcatttgaatggtattttccttatgaaattatgtgtgatgcttattgtcttgactccacaccaccatagttccattctattcatatctattctcttgaattctcatctgttctatgctgcactgggtatcctgccaataaattctttattttcttaaggtaatttgttacttgcagtccaagaactctaaattatttgatgtgaatctagccatggaaaatatttatcaagtcagcacctttcaactgttcacatcctagttggaaatgagcattagtaattataagaaggagcccacagttgaatgcatcttgattactggcacataatgcctgttttggagaaaaaaggacgcttctgcctgtcaatcaattgctcaaatgtgcaaagaaaagtgacagacctatacttaacacatactccattttcaaaacaaaaccattaccaacacctgaagtgttggatctaggggtaataaagcaaatttaatgagtgattcagtctaatacttcatgagtatctagcactgatgtggattaagtactaaaaacatagattatgaaacaaactccctttcttaactttctataggataggaggagagtagaaaggtgtcacaacttttcctatctactgggccattcccaacagcattcaaattcaaatgttctataataatatagaacattttatatatatatatatatatatatatatatatacactacaatatgaattatatatgtatgtatatacacatatcccttgcattttcaatctgcacttatttctcctttcattttctcttgaacacattgaaatttctcttgtcaaggtcatcaatgacctccatgtcaccaaactaacaaccagccctcagtcatcatcttctttgacttagtagtagatgactcgttaatcactctgttcttagagaaatacttattttgccttctaggaaaccatcttttctggattctccttctactcactggctgctttttcttggtcttgttcttttagatttactgaggtaggtgagccacagggagtagtccttgttgcttcctttattattattattttttataaataactcctcttacccactaagtgttattatctctccaaatggcttaatgtgcctcattatgtcaatttatatatgtaactcagagttctctcatgagttccagattcaaatatacaactctttatttgatatatgtacttatatgtttaagacacttcttaaaatttaatatgtgtaaatctgtattccttctttttttaaatgcccactgagcagaagggctccaagtggagtaaagctacgtggcatgaaattctaaatcttttgaggaaatgttttacataattttttactttctctgaacagcagaaaattgatttttctcctttattctacttctctctagctcacagaatatagtataagcatggcacatgtatacatatgtaactaacctgcacaatgtgcacatgtaccctaaaacttaaagtataataaaaaaaaagaaaatttcagaaaaaaaaacaaaaaaaacttggagggtgtcttagaagtctttagggaaaaagatatatttagtcctatattagaattctacaaagaaacagaacctataggatttgcgtgtgtgtgtgtgtgtgtgtgtgtgtgtgtgtgtgtgtaatttattagggaaattggctcacgttcactcccatgatatgccatctgcaaactggagaaccagaaaagccaaagtggtgtaattcagtctgagtccaaagatctgagaaccaggggagctaatgatgtaactctcggtccaagtccataggcctgaaaactggggggtgccgccggagtaagtcccagagtccaaaggcctaagaactaatgtctgagggaaggagaagagaaatgtcccagatcaagaagagagaggaaaattgcccttcttccacctttttgttctgtttgggttcccaaaggattggatgatgcccgcccgctttggagagggcagatcttctttactcagcctactgattcaaatggtaatctcttttggaaacacccccattacacacccagaaataatgttttacaagctatctgggcatctcttagccaggtcaagttgacacatacaattaaccatcacaagtctctcactcaattggtcctcatctacttgaatagctacttgtggaggtgaactttattaaatagctatttgttatatagttttcttaggctacacaaaagtctattttcttgcaatctccaccttggttccaatttagcctagatcaagcctaatcagttctttcttttatatttacagacttcagtatcccactgtctgaattcaaccccagtctcatttcatctgtttctctaccacataaataccgctaatccaatgaaacctcattttttccatgtctgttcataactgtcctcattagttgccttagttcccattgtctctaagcattgcttataagccctccacctattacttatccttccactctgaaagctctcactcttgaagtagtcctgtagcctcccagctctgctgctgtactagcactcatttttgctgctggaagggtcatgccactgtgctttttagcatcattacaaatgaatttagctggatcaattcagctggaccctttgctctgttatcaaagctggtaggtgactcttgctgcctttccatttctctgattcttcttctctctatttaaatacttgatattatcttttattctaaatagttagaaagaataaataagaactagtatttgataacacaatagggtgactatagttgctaacaatttaattgtacattttaaaataactaaaatagtataattggattttttgtaacacaaatggatcccatttttctcacctactcctcaggaagcttgctccatcaaatatttttatctttttcataccttcagtttttctggttccttccttttttttgcgtgtatttcatgttaaaaaaatacttggccataaatccctcttaaacgttgcctccccatcccatgttttctgcacaacccatcttttggaaagtgtactttgcacttactgtctctacttgctaatgttcaattcactcataaaaataactgacatttggattttgtcccaatgttccattgatatttctgtcaccaaggtcactaaaaatccccttcctgacaaatcaaattggtccttatcagacttcactttcctgcagcattaccactgttcatcactctctttcctgaccctctttcgtctcttccatgacaccacaatgtcctggttatttctcttaaatctctggcttcttatcctccaattattaagtattagtgtggctgctgaccctctccttttcttactctacattctcttctcttccagagtgacttattggctgtgctaactgagataaatcactggatctttgtatttttatcatctataaaatggaaaaaatagaacctgcttcatagtgttatggtagatattaaataaataatgcatagaaacgttttagagagcatctggtttataagaatgactcaatatgtgttaaatattgtaaggttattcagatactgaaaaatgcaatattgaaaaggtatcaattatcccgtcattaacttttacaataaatgtaatccccattatacttcaaatagtagtttttcaagaaacaacagatgctggcgaggttgtggagaaataggaatgcttttacactgttggtgggaatgcaagttagttcaaccattgtggaagacagtgtgatgattcctcaaggatctagaaccagaaataccatttgacccagcaatcccattactgggtatatacccaatggaatataaatcattctgttttaaagatacatgcatacgtatgtttattgcagtgctattcacaatagcaaaggcatggaatcaatccaaatgcccatcaatgatagactggataaagaaaatgtggcacatatacaccatgggatactatgcaggcataaaaaggaatgagatcatgtcctttgcagggacatggataaagctttaagcaatcatcctcagcaaactaacacaggaacagaaaaccaaacactgcatgttctcactcacaagtgggagttgaacaatgagaacacatggacacatggagggaaacaacatacaccagtcctgtcagtggggtgggggcaaggggagggagaacatcaggacaaatagctaatacatgtggggcttgaaacctaggtgatgggttgattggtgcagcaaaccaccatgacatacgtgtacctgtgtaacaaacctgcactttgtgcacttgtatacctgaacttaaagttaaaaaaagaaagaagtattgaaaagatataaattatcccctcattaacttatataataaatgcaatccccattatacttggaatagttgttgttgaaaggaaatagaccaactgcttagaaaactatctggaagataaactgtacaagggaaggcaaaaacttaaaacaaagtttcaggccgggcatggtggctcatgcctgcaatcccagcactttgggaggccaaggtgggaggatcgcctgagcccagaagttaaagaccagcctaggcacatagtgaggccccatgtctaaaaaaaaaaaaaaaaaattaaccaggcacacgatggagcctggctgtaatcccaggtactccagaagctgaggttgggaggatcacttgagttcaggctgctgtggccacaaactgagattgcgctactgcctgcactccaggctgggtgacagagtgagaccctaaaaaaagaaagagagagagaggaagaggaagaggaagaagaggaagaggaagaagaggaaggagaaaaacaactaagtttattggcaaaagaatcacaaaggtttaattaaacaaaatttttttttatatacgggtttcatacatgattttgtagtttggacattggctatccatctggaaataaagttaaatctataatttagaaataaaattaaaactgtaagttagatcattcataaaaatgtattccatgtgggttaaagtcacaaaattttaagaaattttaatatatgtattttaattttttaaaataaaatttggaataaaacccaatgggaacccctgtgttagtaagcctgataagaaaaaaaagcattcttcaataacacaaaaatcaaaagtcataaaaacttttcaaaatcaaatagataaagaaaaactataaactttaagagaaaatgaacctattgagaaggaacattttcaacatttatagcagactaagaattaagatcaaatctttataaggaaatgctacaactaactaatttttttttttttttgagacggaatctcgctctgtcacccaggctagagtgcggtagggagatcctggctcactgcaacctccgcctcccaggttcaagagatgcttctgcctcagcctcccaagtagctgggacgacaggtgtgcatgaccacgcccaactaatttttgtatttttagtagagatagggtttcaccatattggccaggctggtctcgaactcctgacctcgtgatccacccgccttggcctcccaaagtgctgggattacaggcgtgagccaccgcgcccggcctctaaataaaaatttttaaagagttaattgaaaagtgaatatgatatgagttggcaaatcattgaggagtaaatgcaaatgctaaaagaggctcaatttttctaaatatgaaaaatacacaaatttaaaatttcaagttttttgtaattaatttttaaaaatctatacaaacacagaataaatgatatgatatacctttacatacccaatagccagcttcaaaatttatcctcaaaatttctgtatttgcctaaggtaaattttagcatttaccctagagaaactcttgtgcatttgaacaaacgggtgtgtaaaatgatttttattaatcattgtttgcataaagtaaattggaaacattgattcccagaaaaatgaaatcattaaactatagtacatgcatactatgaaatgccgcgtggcattaaaaagtatgtgagttaaatgccaaaatcttcaagacacgctgttgagtgagaaaagcaagttgcagaataatacatagagtatcatactgttatttaaaaaaagaagcaaaataatatttatgtctctattcatctatccatcatctatcaatcatttatgtatttatcaaactgtagcatagagtggtataaaacgatattcattaacaaataacaatgattacttctggagaggagtgtgggattgttgttcatcaaagattctttatatttatcctaatatttgggatttttcacaataatacatttataattatgtaattaacaataaataccattataacaataattaagagcattggaataagcaagttgggtgtgaatctgaacagcagcacttattatacaggtaacttgggtctctcaatctcttttttgccattgtcaaatagggttaatttaatctactttgtggagatgctgtattaactgagataatgtgcataaaataatctataatatagagttggtattgagctgaagataaatctttgtactcttattaaatcaattttgaatatcagggaactgggagaaaaagtacttttttcctcagaagactgcatctgctcaccagagtttaattcaacaagggtgatgaccctgtcttaaacttgcaaattactgatgatgactctagtatctgatgtattgcaggtgtacatataatataccttttgtatagtacgtgtaaaacaaacaaatgcttgtacattaatatgacatcaatagtgtccaccagtaagaacagctgtcctactttctgaaattgtatctccagaacctactatgttctggatcttcacttggttttgaatagacagctcaaattgaatatattttaaaactgtaccttctatttttgtctataaatcttccttttcttctattttctttgttttatggcacctaatttattcttgaaaagtctttcatcattttgattattgttctactgtaaacattttagactttaacgacaaatgctgctgactttgtaagattttattttgcttcttttactgcactgtatgtatttatttttcttttttaaaaaatttaacttttagataccgggggtagatgtgcagatatgttacatgggtatattgtgtgacactgaggtttgaggtatgaatgatctcattgcccaggtagtgagcatagcacccaataggtagttttcagcccttcacccccttcttcttaacaatagtcctcagtgtctattgttcccatctttatgtctatgtgtacccaatatttagctcccacttataagtaagaacatgcagtatttgatttttctcttcctgcatcattttgcttaggataatggcctgcagctgcatctatgttcttgcaaaggacgcgattttgttgtgtttatggctacaaagtattccatcttgtataagtatcacatttactttatccaatccatcgttgatgggaccctaggttgattccacgtctttgctattatgaatagcgctgtaatgaacatatgattgcatgtgtatttcttgtagaatgatttattttcctttgggtatatacccagaaatgggattgctagatcaaatggtatttctgttttaagttctttgagaaatcttcaaactgcttttcacagtggctgaactaatttacattcccatcaacagtgtgtaagtgttccctttatctgtagcctcaccagcatctgttgttttttgacttaaaaaaaaatattctttctgactggtgtgagatggcatctcattgtagttttgatttgcatttctctgatgatcagtgatgttgagcattttgttacatgtttgttggctgcttgtatgtcttcttttgagaagtgtctgttcatgtcttttgcccactttttaatggagttgttttctgcttgttgaactgattaagttccttatagattctggatgtaggacctttgttggatgcatagtttgcaaaaattttctcccattctgtatattgttcactctgatgatagtttcttttgctgtgcagaagctctttggtttaattaggtcccaattgtcaatttttgtttttgttgcaattttgttgcactttaaatgtaatatttcctagggattcagtgagcttttctaaattggagaaatcatattttttcatatctgaaaactgtagtccattagttcttgatacttaccttctcccacttttttccttgcttctgagatagaactttctattttccgtgtctctttattgttcattctttttcaccaactccttatctcacattgatctattctaaaaaaaacttcagatctatcttctgtttagtatattgtagtgtcatctactatttattagttaaatttttgaaaaaattttaatgactttttttatttttagaatttatgttcagtttattttcgaataggcctaatcatttttatcatgtcttgttcttgttttataaaataaatacattcttttatctcttaaaattttttatttgtatgtatttaaaaggcacaagtgcaatttgttacatggacatattgcagagtagtgaagtttaggcttttagtgtatccatcaccaatgtacattatacccattaagtaacttgtcatcatctatccctcctccaactccctcaaccttccaagtctccatcatctatcatttcacactctgcatctatgtgtacacattatttagctcccatttataagtgagaacatgcggtatttgtttttctgtgtctgagttgtttcccttcagataatagcctccagttccatccatgttgctgtaaagacatgatttcattttttatggctgaattgaattccattgtgttatatataccgtattttctttatccaatcatccattgatggacatttaggttagttctatatctttgctgttgtgaatagtactgcattaaacatataaagtacaggtatctttttcatacaatgattccttttcttttgggtagctacacagtaatgggattactggatcaaatgatagttctattttaagttctttgagtaatttccttattgttttccgtaaaggttgtaccaatttacccatacacagtgaataagaacagtgcattcttcttttttttttttttttttgagacaaagtctcactctgtcgctctgtcgcccaggctggagtgcagtggcatgatctcggctcactgcaacctccgcctcctgggttcaagggattcttgtgtctcagcctcccaagtagctaggattacaggtggctgccaccatgcccggctaacttttgttttttttttagtagagacagggtttcaccatgttggccaggatggtctcaaactcctgacctcatgtgatccacccgcctcagcctcccagagtgctgggattacagacgtgagccaccacgcccggccagaacagtgcattctttgtttaacatattttctcaaccagttattttctttgattctttttttctgtttcttaacaaagtgttattttataatctcttaagttagctccattatcatgaatcttttgagtgtgaattttcccactcattgtgtccaatgtctgtcatggcagtgggtttctagtttgatttatagttttaagctgtgagctcatcttcggtagaggttggcttccatgggaaccatttgtgaactgtgaattgtagcatttccacatgagagtttagtttcatctcagttctcattgatttccctgtttctgaactactcttttctttatttccttctttcttcccttccttcctctctcctgcttctttctttcctttctttcttccttccttttgtcctttcttccttccttttgtcctttcttccttccttttgtcctcccttccttcatttttccttccttcttttcttatctttcatttgttccttccctccctccctcctcctctttctctctctgtctttccattccaaaagtcaagaattgtctacctcaattggttattttactttattgctgttgagctcacttacatatttctataaaagttacactttgctcaaatatagacatatatttaaatgtgtttgacttgggaaggatggtttttgctgtttcttgtataggtgcccttgtctatattcttcatttttatgaatgacaataatagcccaaatgccgaagctcaaaacctgataaaattcgttttcatgttgccttaatctctatatgtctttagatgtatctagtttattgctgttttgtttcattttatcatccccactgtctctgctttagttcagtcccttatcatctctcttgtggacaacggcaatatccttctcactggtttctgtgctttccatctgcccttttccaaacattgctacattgctgctagatttatctttctaagcacaactctgagtatgtgaattcactacttaaaacctattaatggtgtcttttcctcatactgaaaatcaaacttccttgattttgtggatttgctgagtcttatttcctgacatctcttcacacctatgtttctgcaatatcagaatatttctagtttcttgatttgcccaactgctttaggcctctattcctatatacatatcctttttctgtaaaactcttaaacttcactcttgccctatttatttgttatacctttagttttttcatactgctataacaaaatttagactgggtaatttataacaagagaaattgacttcttataattttggagactgggaagaggaacatcaaggtaccagcaaatttggtagctgccaagggcctgttcctcatagaaggttccttctatgtgtcctcatgtggtgcaaggggcaaataaactccctcaggcctcttttataagggcagtaatcccattcatgagggttaggtctaaccacctttcaaaactccccacctcttaatactatcacattggggattaggtttcaacatgtgaatttgggaaggggggaaaacattcagaccgcagcatacccatacttatgcttgaaaattcaacgtaaatattatatgtttttctaaaggaattcctgactagcccaaatctgacacatggtagccattgactcatttgtataatggctatatccacttacttttttatattcaaaccccatgtatataattcctataaccatcctttgtataacatgttctctcaaccacttattttcttcgacacttttgtcttttgaaaaactaattttctttgtttctttgattgtgacactcataattaaagacaccctaacagaaggctttctaataccataagattctttacctgagtctattcatttttttttccagtctatcaatcggccttccatgttgtaaattccttagtcttggggttcatggtggaggcctttttagaacgaatggagatcaagttggttcagtatgtagatgtcccagaatggtatcgttgcaaaaggcatgacagaaaacataagaataaagatgaaaagagacttcacaagatttagtgaagaactaatgttctagaaatcatgggaagactctggtcctaatgttgacactgacccaccagatgactctgggcacacagaataattgctctgcttctcaattctccaattgacaaaacacagggattagaatagggagttaataatgcttctgtaatctgaaattcttttactctaattgttaaattgcccaagttaaattatttgcatgaggggaggaaaaaatctttaaaaataataattgtcatgaattctataaaaattaaataattttaaatggataaatcctacttcagcaagtaaatctgtgagtatgtgagagaataatattgataaaaaacattaagctgactgtcaaaatattagagacatgggcagaaaatataaagacttcaaaatatatgttatatagttaaatatctggcagatttataaagctttgtaaaaatcagctatagaaattgcattttaaagtgtaacagtgaacagttttaacaatggaaaaaggctctgtactagcactaacaccaattagaaaataaagcattctggttttaattaatggatgttttcatggtgtctaataaaaatacaattttaaggacttgaacaatttaatctgagaaaatattgtgtatttaaagcaagtgtattttttaaataagcaaacatgtttacattcatcaattatagtaaaacaaaagctcaagaaatcccagagcatataatttcatgaaccgagaataaaatgagctctggacttacgacaaaatctgcccctgaatgatcttcagaactctgttcattttatgcagtagtttaagttttcttctgtcttggcccaacttacaaacagcagaaatctgagttgtgggaatataatttatgaacagaaaagattacttgtctgtgaattattttctgaagatgaaagtaaatatacaggaacatacggtattcctttaaaagttgccagatcataattgtgtggcaaggcagttatcagaaattaatccctctattgagagcaattgaagacactattctaatgtaggcccttttgaggaggcagcatgaacagaagaaaactcgcagcaaaggcttgaggggggaatgaatccaatccagcctgaaaaaatctgcaccaggtttgaaaaatcaccccatcctcccgtgtaagtgatgctaagaagcacaaactgcattttgaatctaagtccctgtattttctgtgaaggagctgtaagtagggtgggacagagatggcacctgggggttctgaggcacccgctcctctctgagacagacagggatcaggagccggactgggaccagaccaccagcaacacaccagaggatgttctctaaataagaccatggcacttaagaacattaactaccttctcatcttctacctcagtttctcactgcttatctacataaaaagtaagcctttcccactttgggcatttttcctggtttatttctggcttattatatttcttacaaataatggataatgttgcatgttctataaaatacaatgctaaaaaaggaagtttttatttgttttttttttaagtgtcctgtgttaaagaaatcagtgataccagtcaatgtgaacagtcagttttaagattctatgatttccaataggtattcaggtacagaaattttgtttttaacctttgtagtagtgagctggagaatgaaatggtcacatagactagaagatattttgttgtgtttacgcttttacaaaatagatttggcccttactaattgatatcctttaaaaggaagttattcataacctgtatttcattttattcccacatactatatatttatcttcacttttaaataactctgtgttgcaacatttgctctcataattaaggggatagtctcaatgtttcccagaggataatggttcaaagtgtttctttcaccagagaaatgggcttttactgttatgtgtttctgttttataaatgaagatattattttccacaaacttccccaaatagaagcaagagcaatgtttctgagataatcttgtcggttctatagcaggatggaaaatcagaggagaccaaattgccccagctgtgtgtttatgaagcacagtagctattcaacacgtttaaaacgaagacagggagagtgtgtgcttgtcaaaggggccatgtgatttgtgtctgttgaatctgaatatcaataaggcaaagcgtagagcagctgccgttgaacaagacaacttggcattagcacacagtgttggataatctgggtcaccttctgtggctgcaccagtgagattgttacttgtacggtttacagttgaacatatattagagactgagtgaagaaataagtaaatgctgtgggtaggtagctgatggcacatatagaaaaaccaagtcaaactttaaacaaatgatcagtataatacttgactgcaacgcacactcacaaaagattttttttcatatatatttactaaagagttgttatttaaatagttatttaccctccttgaaacttaatgtgggccccaggcaatgaggaatgaggaagagaagtgctgtgtttagttgtgcaggtaggagaagaaagggagaaaaagaaataagtcataaaatgaatgtgaagtgagtttatggtgcattttatggcaaacagctttgtcattcaatgtaatatatatggaaattcctggagtttgctgcagtttgttttaaaggaaatgaatgtatgatatctttaattaaaagtatagtaactatgaattgataaatatatatcatttgtttttgctctctttgagtaagtgattttattgatagattctaaatactttgtaattattttatttgttctccagcatagtatttttattcgtttaaaaaagtacatttgaagtctcattttcttcgatttttaagcaggtagacttttgtctgtgttgatatatttattggcaagatataatcatattgctttcccaatcaaaacacgtagtttagaccttgttagctgagtttttttcccacctgactttaaaacaatctagcatcagccttcctttctacccttattacctagtattcttgacacaaattctgtgttccagacaagtgaataacataatatctagcagtaaaaattgctaacattgtgttaagcattttctatatcatatatgtcatttacttcttgcaacaaccctataagatagatactatcatagtaattcacattttatagaagatgaaacaaagattcaagtcactataccagtgtacctcaaactttgaggcacctcagggagctggaatgcctggttaaaatgtgcagcctctcaagtctagccccaggtacttagtagatcctaggaaactataatttaattagctcttcatttcaaatacaggtaaccagaagctctgagctatacaataaatctttattaagaacctactacataatgatgctaggaatcatcagaatagttaaatataaacatatctctctcttcaatgagattatttaggagaaaagataaacactatgagctttataactgttgtcactcttatatacataataaccctgtcaagtagaatttattattaattccattttgcagctgaagaaactgaggcacatagaggtttattaatttgtccaaggccatactactagtgaatggtagatctggaatgtgaacctggagatctggctctggagtgtgggctcttagcttgcatgtagttattcccatgaagtgataatgcataaggactttaagtgataatgcttaagcagactttattatgttctgcttggaacataatagcaaacaaagaaatgtccattatccaggtatggtggctcaagcctgtagtcccagcactttgagaggctgaaatgagttcacttaagcctagttcaagaccagcctgggcaacataacaagacctcatttctacacacaaaaatataaaaaattaatggggcatcgtggtatgtgcctgtagtctcagctactcaggaggctgaggtgggaggatcgcttgagactggaaggtcgagactgctgtgagccatgatcctgccactgcactccagcctggtaaaaagggctacaccctgtctcaagaaataaaaagaaagggagaaagaaatttcagttattaatatcatattaattgaaggaatcaatgattctttcttcgaactttgaaatatgttcccttaaatttaagagaaaataatcacctccagctccatactgtattttgtatctaaagttctaccttgctcagctaccaggggaacgctgtttatgttttgatcaacctttatgtccttccagttgaggacatgtgacatgaggaatattagagcagagttcaggaagtgacattccctttctgttcctgagcaggtagacattctcctaacttggagttgcaatgaatttgtcctgattgtttttatacctgttccttgattttgcaaaactggttctaatgtgtgggaccaattaaattttaataattcaagaagagctattattttttgcttctgatgtattaaaagagaaacttattagagtgagactctcctgtgatccattattcagagactgttttaaataataacagtactttataataaactctttttgggaccttgatgtatgaatctgttctgaagggttttaaagaaacaaccataccatgaattagaaaagtaatgtctatctctctagtcctttataaatttgggggtaaacaatattttcaatgtaaatgccacatcgagattaatttaaaagtaactgttttaatctacgtttaaagtatgatcacaacatgtaaaaaaaatgtggtttgacaaaactactttagagttaccagaacaatgttaaagagtttggggtagcatccagtcttccaaaaaccattagcaattattaagtaattgatttgaatggcattattttaaaaagtactttctaaagtactaaaagaatgaagaacaaatagagattaaataagaaataattgaatttgcttaatatgtcagagaaggctgatgttattcattagggagtaatcacatactcttaaaattctacatgtgtagaaacattgaaaactttgatcgttactgtgcaagttaatatccttgcagtggcattttgtaaagtgcctacctaattattagtgtgagaaaaaggtatctttttgcttcctcataaatgaaataatctcatcagtttacagtaaaatcatcactactccatgaaagttacccagggtttcctacattacatagcagagttaactgtggcttcttttattagatacttctcttagcaaaattttctggagaattgcatgcttttttttcatcattggtgattttcaaaaattatcattcatggtctcacaataacaaatactggaattcaagtggacaagaaaagttagagtgagtgtttaagcaaaccgtgctacatctatataatggaatattactcagtaataaaaagaaatgaactatcaagtcacaaaagcacatggagggagcttaaataaatattgctgtgtgaaagaagctcgtccagaaaggctacatattgtatgattccaattttatagcatcctgtaaaagacaaaattatagagacatggaatgatcagtggctgccagagaatcaagggtgtagagaagaggcacaggggacttttagaatagtaattattctgcataatactttaatggtgcatttgtcaaaatgtacagaattttacagtacaaagagtcaatctaattgcatgcaaatttataaaatcatttaggaaatcaaggaaatcccaggaagtaattcagactctgactcaacaatctaactgcattacaaatgtatgagataatctcacagaaggggttggggaaaaactgttcacctaagtagtttatgtacatttccttagatattacctgacatgctttccctgttctagtatcccatccaagatatcacagtacattttgctgtcttgtattttgaggttcctcttggctgtgacagttcctcaggctttccttgtttttgatgaccttgaaggttttgagttctggccaggtattttatagattctcccaatattggagttagttttgtgttttcctcatggtgaaactggagttatgggctattggaatgaagaccacaaaggcaaagggttatcctcattacatcatatctataatattatcaatgatttatacaatcaacatgatatgtgactgctgatattgaccttactcacctgggaggtggtgttatcaggtttccctgataactataaagttatgtcttttattcttctccatactgtactcttagaaaaggaagtcactgtgtgtaacccacacttaagaagtttggagttatgatctctctcctggagggaaaaatttacataaattattcgaaattcttctgcataggagatctggctcttctctttcatttatttatttattcaattgtttattcatatcagtatgaatctattgacatttattttatactctgggttataagtcaatactattttattttgttactcaaattattccatctttggcctgtgggagttcttttcagttggctcctattttcttttcacgtactccccatcaatgtggggtgctttttaaaaaaggattttcttcctttatggctctacaatccctttcagactgatcttgtgtatttcctgacccaatcctagcataaatcaccatttctccaaggagctctgtttccttttattagagaatggtaaccaaaaccaagatctggatgtgaggtgtgcttgttgctgctggggtgtcaggtcttttaggcaatctcagctgaaagagcacagaaatatgtctgtgtactagtccgtgtatatacatgtttctatagatatctctatatgtaaatctgtgtctgtctgtattaagctaaatatgagttcatattgatgcctctaactccatttccacatggatcattctagctgtctccccttgcttatctgtaaatttcaacagtgagaaacctgatttccactatctgccatttattcacttgtttaaattcagtatacatatatagcggtattggactgttaacccatactcctatgggaaacaactttaactgtttaggtacagtacttatagctgtttcattttgtttttagtttttcagaatccacttgtttccaaaactacttaggtgaacagttctcccccaaccccttctgtgagattatttcatacatttgtaatgcagttagattgttgtgtcaaagtctgaattacttcatgggatttctttgatgtcctaaatgattttataaatttgcatgcaattggattgactctttgtactgtaaaattctgtacattttgacaaatgcaccattaaagtattatgcagaataattactattctaaaagtcccctgtgcctcttctctacacccttgattctctggaagccactgatcattctatgtctctatagttttgtcttttataggatgctataaaattggaatcatacaatatgtagcctttctggacgagcttctttcacacagcaatatttatttaagcttcctccatgtgcttttgtgacttgatagttcatttctttttattactgaaaaatattccattatatagatgtagcacggtttgcttaaacactcacctactgaaggacaactttgttactttcagtttggggctattagttcctagggctactgtaacaaagtactacaaactgggtggcttaaagcaacataaatgtattctctcatagctctggaggctagaagtctgaaatcaaaggtaagaagccccttgcttccactgagactccacttggaatccttacctgccttttcctggcttctagtggtgtcattcagtcccgggtgtttcttagcttgcaactgcatcactccagtctctgctactatcacatgatattctcactttatctgtctacctctcttctattcttcttataaggacgtcagtcatattggagtagattcaccctaatgaccccatgttaacttgattacatctgcaaaaaccctatttacaaataagggcacattcacaggtactgagggttaggactctgacataccttggggacacaattcaacctataacatctactatgaataaaactctgatatatgatttaaaaaacacttggttaataccacttttattgggtaaaattggtttacaattgattttttaaacatagtaagtgcttggtaaatatttgtggagtaaatagttgttatgtttcaagagacattatatcgatatccttgtattaacatgtggtagaagaaagattatgctaaacaatgtgcccatattgttctcttattttccccctctttacactgtccctaccttttacatattcagcctttcactttgaattaagtgttcagaaatttcctcctatgtaaatttgccctatgaaattaacttagagtctgatcaatatgtaaaatagcactagaattaggtgtaaacatgcctccatatttcctcgggacaaatagtttagctgtcttccatatgtgaatgttcaattttttaacctactttttttcacaaactgcattcattacttggggcaccaaaagattactttcctttattattgattcaaaacagtgattgcaagttattttactgtgcatgtgttatttgttgtgcttattaataaaatgtcatcttttattttatgtacatatttttgacttaacaataaacagtaaaatttctgaaaggaagaaggtactcagtcatctagtattagatcctattggttgctatggttagcaccctttatcagtcatctagtgtccttcctagtttaataaaaagtagtgattccttcaaagtttcgttgcaacatgctaagtagattgtcctatatttcctagtttttatcttcagaaaagttttattaaaagcaaaaccaaaggcagtgtacttttaataataacactatgggattcagtcatgctgtatcccatactgctgtatcccatactgctgtatcccgtacatgtaggaattagcatgactatttggagttgaatggtttgacgggaccaaaaattttactggttttagaggcaaccaatgtaaagttagttgtccctagccttaagataggataattaataaatattaaaatttactatttattccataatttttttatttacttatttatccaataagtatttattgagggccgtaaatctatatatctgacactgttctaggctccaagggtacagtagtgaatagaagagaccacaatccttgatattgtgaaatttacactttagtggggtaagagagacaaaaaccaaataaataagtaaattatgtaattgtgagctggcaaaaagtgctatagaagaaagcaaaagatgagtaacagagagcagctggaccatgaggatatcacagtgaataatattttgataaagaaaatagcaagtgcaaagaccctgaagcaggagcgtgcctatagtgtttgagatactgtaagttgtccaacataactgaagtggattgagtaaaacagggcaaattaggaaaggtgtcaggggttttacaataagtatctctcattcttgcaatcatactacatagtagctattaagaccattaggacaccttaagcaaatgacagcctagggtacatactaaaaacacagctacaaggggatacaactgagatttaaaacaagtttgtcagattctaaacctcccacaagctcacaccagcttatttattccaaaagataaacattgaggaatttaaaaggccagttattaaagcgttggtggcttaaaatcagccacggtggaagtaatttcatcacagaatttggcaaacactacaaatcagtgtttgggaagatttatttttttaaaaaaagttagtcctaaataataaaagttttcattctacctttaaaattttttcagggtaaaatgtttatagtttcaaccactatcccattcttgtgactaaaatctgccaaagcaggaatggctgatatgtaacctagattaaccgcattgtgtagtctttttggttctccacgtaattgtcctgataattcccagatggatgactcttttctctacattcagaattcttggaacctttaaatacttattttactttctgcaaattagtgagagcagagtgctaatgaggctgagtttacggttcaatctcaacacaattcagtttgctttgcacagagaccagctctgtacaacaagcaattatgtctagtcagatggtctcaaatttgtagtttttaatacaaggagagaaaatgaaattaactcaacaaattaagcaacaccattgaaataatcagttgcgggtttgcagcaataactttttcacataggtgatgcattattattattgtgtttctgtctataattttcattatctattcttttaatatagctgaagaataaatatttatattcagcattaatttttatatgagttgtgtcagtaaatacagattctggctctggcccacaattagttgtgtatctataaatgcatcatttaaactttctaggtctccaatttctcacttgtaaaatgagggggttatattatctaattaccacgttttttcaaggcctacattttatgatttcatgattattctaggtaatcgaatcatagacattgatgagcagagtgtttttagtgaccagtcactctacatgatccagcttccactaggttatattgcaacaaaaaacaaacccaacatcttagtgttaaaacaacaaggtgtatatcttgttcccaccacgtactgtgtgcaagttggctgcagctctgcctcgtttgtattcttcattgctatagtgaatgtttgtcccctctccccaaatgaacatatgtatattgaagccctaatctccaaagtggcggttttagggggtggggcctttggtaggggattaggtcactagggtggaggcctcacacatgggattagtgcccttgtaaaagagacctccaagaaattccttactccttccaccatgtgaggacatatggagaagatggccctctacctatgaaccagaagttggccctggacagaccccatatctactggtgctttgacctaggactttccagtctccaaaacaagaacaacaacaaaaattctcttgtttataaagccacttagtctatgatagtttgttttggcagcctaaacagattaagacattcattttaggacacaatctgcaggggcattcccttttagagaacactgttttaatggcagagggaaaaaggtaatggaggaagcatacaatagctcttaaaagcttcagctcagctttgacatacctcggtttggctcacatttcattaacaaaagcaggtcatgtggctaagcttgacatcaatggactaaagtccatattcaggcataaaatatttggaacaaataatgttttctactccatcttttttcctctttccaacttccagggatcaatttataaacaaatttctttaaataaccattaaaataaatattagaaatttaaaagacttgacaaaactattatttcagcaactatatattaagcagttaaaatgagcaaggtccactgttctccaggcacgtacactgtagtggggtgggcatatgtgtaaaggctgtccagacatttttgcctaagaaaatcatcacactttttaaaataatgtcagaagtctgtgcatggatctggctactattttcacatgtagatagaggtagaaattttattccgaaaaataaaactagtcttgtgtatgaagaaatgttttctgaaagaaaatataatcaagcttgcttcgaaattattagccctaatgaaagtagttatattttgaggttacggtcaactcagatttggcaaacagcatatacagtttgtagattaggaattcctatttctctttaacctcatttcacttatcattagcacctataccagaggttgggtaaggaaagagaggaaaaatgaaatgtaaaattttacattttatatatcaatgcctgaaaattacatcaaacacaatattgcaaggagctacttaatactttcacagactaggagccttaaaagaagcctttacagcctactcattatagtattgactgtatttctacaatttctcctaaagtaatcttaaaataattaaagcattactttctgtaattataaactcaaataattatagatgtaaatataaattgctttctcttcactaacctcattatatcaaatttttttttgtttgttttctggctttttttttttttttaacaacccctctatggagcaactgaaatcaggaaatgtatgtgttgtttaactctttctactcagctgcttcagttagcaggctagctatatgaactacttgaagttcagaatagccatagaactaaggcaaagtttgcataaacgtagttttttctgtaggctggtaaatagcaattgtgtccatgtagagggactcaatgtcaatagtgaaagcagcccactaccccctacccttttattctcatattccttgtttttggagataatacatctctaaagcctttttttttttttaaattagaggagtctatgattcatgttttccttgcctaccagatacaaccaacctctgttacccaatttctctatgtcagacattaggctgaatgtttttacatagtttatctcatttaattgaaaccttgtgatgaagattttattattcccattttgcagagatatctaaggcttggagtgcacaagtaaagccactaaattgttgatttagatacttaaattattttttaatatgagtagttttcacacaaccatatcacacggtcagaatttggaaataccagcgtcaccattcataagaccatggacaatttaaaacttttggtccttctgaattaaacagtcttctatagatacagcatggaaactctgcaaacagacttttggctttatgaagggaagcattaatgtaaatataattgttaatcgtaaatcagaaaaacataagggagagagatgcagtgaaaagatcgtcaatcaagcttgtaagtaggttccacctgtgaataataatctattgctcaaaccataagaaatacaggtattaaagataatttatcatgtattcatcaccagctacatgtgctacaagtataattttaaatatcaacatactgtatgccctcaaagggaatttgttgtgtgactgatgatagaatttcagagagccaagagctttgggaataaactggttttaaaaaatccagatatcataccaaacatgtattctatcaagtacatttctttaaggtattttttaaaactctaataggcagtaatgcgtactggaattgcctaggttacagattgtcacaaaaatatgttttattaattcttagggtcagttgtagtccttgccatcaatataactattttttaaaagaaggatagtttttattatgtcctttttctagtagatatttcactgttaattgttcatggctggtaaactcatatttatgaagactcaaacatttatttaactcaatatgcttttgtttcttcctgacatgtatgtaatcatattttataaagtacattggtcagtgagattgtatgtatgacatcggattaaaaaatttaatatgtaaaataaacacatcgggggcggtcattaaatgatgggtttctgtgctacaactcctgatgctatgatttcactgttcctgtgtaggaccaaaaaatcaatttaaaaaataagtcttagtaattgtgatgcatgtcatttacagactaggttttaagagacactaatccataagttaacaaagtgaaagttggtcgattattgattcttaaagtgtggcaaagactgatgtgagggaacaggcaagaaacaaccaagggcacagtgcatttgggacttaatagaaaaatgaagcagtggggagcgatgtgagatgagggtgtaggggcagtgtctgcataattaaaggctttaaatgctataatgaattatcttatactagagttttcttgtagtcagaggttcccaaatgttttcacactgtggcctgtagagagaggataatatctgtgcaccatacttgctcatgtagtcaggactgttgacaaccagaggtgatcacttggtggcttttgcagctctggcaccctttagcctactcttcacgtgttgggaagtgccatgaaggggggttgaaagccactgaaggactttaaataggaaccctggcatgctcagacttggccagaatgagaagggaataaagaagggaaagcaaggctgtagttagagagacctagcatgaaatgatggagacctcaaacagcgtggtcctggtaaggaagaagcagagtgggcttagatacttcaggggaacattaacttattgtttaatgagaaatgggtgagagcaaaagggaggatagcgaagaatgatttccaggcccctagtttatgtatcttaaataatggtatgactttatctaaaatagtaatgcacggaaaatataggatgaattgttacaatttaaatctctttattttgaaatattggagggactttcaggtgaaaatatccagcaggcagttggatatatccctccaaagttcaaaggggagacccagttagaagataaagagtataataaaaaaaattatagactatataaaacttgcgatataaaatattaacttgctgcttgggttaattacatttttataaataaaatataagctattcataaaaatgaaaaaaaaaagaaaatcaagtctctgaaatttctactgaggtaagaaatcataatcattccttttaaaaataatttattcctttaaaaaataactatgtcacataattgaatttaaaatgtatttgttagttgttttttaaataaaatttcagaataataataaaaaaagaagataaagagttgggtccttacttacaaattcagtaactatcatcaagtccatcctctggactacttattagaataagaagagagaacacaaaaaatctagagcgaagttctataaaataattttacactatggattcaaggcttaaatatgagtgttcctactcattggtccagtaactcttctaggagaaatagttgaaaatgagagcaaaaaatagcatgtgaaggaagccgtatgttatgtataatagtgaaaaattagaaataaccttaatgttattaaccaaatttgcacgtttatactaataaaatgtttgaaacataaattgtgttgctttgggatcaaagaaataaacacagtccagtaatcaaaagtaaattaaagcaatttaaatatttcctgcagtctcttaagaaacgcacacatatacacacatatacaattagaatataaggcacagagaaatattatttctccattttatgttctcaatgtcttgtaaaactattatttctcaattgttatgttctcaatgtctctcactacttcctaaggtctaacctctgaaaaaggttggacctttctcttgaaattctcataggttcttttcttctctcagaaataaatctctactctttcttatataagtcccctctcctgggttcccaaattttgtttatttctttctggttgtcttgattctgcatcacaaaagcccaggaataaagctagtgaaggtacattttttaatataggtgtatggaagatgagcaatcagagccaaaggtacaccagtgggcaaggaagggggaaagaatctcaacacttagtcaaaaggtcatttttgttttccaaaaaggttaagcaaaaataaaaaaaataaaaataaacacatcaggatgtcaaatcttatgtaatctacaatatgcaatttgtggtgtaaaaaatatgcttggaaaaaacaaagaaaaattctggagggaaacattttagaatttttttttctttttttttcctatgttttttggggggaacagatggtatttggttacatgagtaagttctttagtggtgattgtgagattttggtgcacccatcacctcagcagtatacactgaacccaatgtgtagtctgttatcccgcatccccctcccgccctttcctgccgagtccccaaagtccgttgtatcattcttatgcctttgcgtcctcatagcttagctcccacttatgagtgagaacatatgatgtttggttttccattcctgagttacttcacttagaataatgttctctaattccacccaagttgctgcaaatgccattaattcattcctttttatggctgagtagtattccatcatgtatctatctatctagatggatagatatatatcgatataccacagtttctttataccacagtttctagaaatttaatagcaattatcactggacattgaaattacaagggattgcaatatttttctttaattttgttataggttctacattttctgtaagtaggccaaaaatcttcaataaacataaaacagattattatttatattaaaataaattttattttaaaaataatttagttattcaaacaataaattttaagtcacagagctactaacagaagtagctatatatagacagaagtattaagtaaatatttgctatttttaaatactgaaaagttatattagaaaaataccagtttcaaaaatattcaagaaacgaaagatagtttatttcaattataagctatgtgggtttgaatcattttacttaaattctatgttttctcatctgcctaatgggaataattattttaaactgcataggagtgttgtgaggattaaatgaaaaatgaatgtgtgacactctatgacgtcttaacttgatttgatttatagtcagacttgagattcacaatagacttcatcaagcaccaattttacttgtcttgaagaaaatgcacaggaccagtgtcatagcatgcacaatgacaacacagcagaggtctcctgattctcagacacagctttggatgtcccagtcattctgcaccctgggtgtgtgtggccacaaggaataaagctgattgaatacaacttcagctcgggaaaatcatcagctctgagatcctcccttcagtttttatatcaagccatgtgtttgtgactgagtagtcacatctaatcaggtttatgtgattagccctatttcttcagggcagctccatttcattagttcccaattactcgttaaacaaccttgacaatgagttacacatgcttagtcatttccatggaactctcatttatcttgcatcaatataggtaaatatctaactattcctcagttgctgctgcaaatcagaggtctagtcttcagccatttccagagaggaggccaaagaaacagctgttagtcctttttcggtatataaaatgctcaggatagtgcctgacacgtagtaagcaaacaaaaacttcacagaatcattgaatttgttttttcaaaattgacaaataaagtgcatattctgatattgtaatttaaaaaaataatagaacaaaggaatccactgcttggttgtaatatcttttcttcattgataattttcaaaatgattgttgctaaaatcatatgcctctgtcaaattcctttcacgtcaaataaaattaaatcctatgatgtccttgaaatcatgttgtgttacaggtcagtggttatcatagatgactttaaatattcattacaggaatattgagggatgatggcaagtcatggtcttgagagtcgttgctgaaataggctattggagtgtgagttggtcattaaactgtgaaggatcattcatgtcaacatgaaagtccccttgattaggaagttacctagttggtaactgggaatattggttgaaggaagtgaaagtgtagtgaaaagagaagtttgtccaagagcacggcttataagagggttatgcaagaagatggtagctaaactattttttataataaataaccatgaatttgggggtcagagagtgaaaatagagagatgatggggacagaaataagggataagagaatagatgaggcaacttgttagaaggccttgccctttagagaaaaatagccagtaaaatactcctctcagtgggatgtacaacagactagttagaagaatgtcaaattctcatttttaacacatcagtgttactacttataaagcctctctgccttgccagatcttcagttcgattttattacttttatagcttagggagtagaatggtagcaaatattacaactgggctatgaacagatataacatgtcccacattggcctctctgttgaagccaatgtgatagaaacaactcttcttgaggcatcgcagtccagacgtttgatgtggtgactgacagcaaagtgaggcttaacctgtggtgtggtgaagcattctgtgcagcagtggagcacaggtggatgactcaggagactaagctccttctcccatatttaccaaggaaggccatgccaggggaaacacacatgctgagtaaataatgaaagagaatcaactggatagagttgaaacattctcaataaatattaatttttaacaattactagttaatttatttagttattctttgaatttgagcagaatctctttctctcctttttttaattccttgggcttgtgtgtgctctcaagacttagaatgtgaggtcacaacgtttcctgtgatacagacttgaaagagtataggcctttctctgtactcattgtagctcagtactattcctagcttcttagccccttcatggctttttaaaggaaggaaaagctaattattggtgctccaggactgggcaaagccgagaaaaaagagatttttcttttccttcatgtggcatcagtttgattgcttgttttctagaaaatagagagaaggttacctatcaaagggcacagtcttttcccaatagcaatcgtaacaacctcatttattgagaaccgaatacttagaattgtatacaaactctgaatcgtataaaactcctgcaatgtacctgttatctatactttaaaatagcgcacaattattctcatggaagttaagtgatttgacaagttggcaaagtaagtgacagagctagaacagaattaaaacttcttgttattcccactaaaccacctataggtcttgataaccatagaccttagaaaactaaacatttactaattgtttatttgtaatttatcttcccaatactaatgtaacagatttcaactttctgtccaaattaccctaattactaaaaggcctatacacctgtaatgaaacatgaattttgaaatacatttgcacagaatataataaagttttcttagagttaaacttcagtactattgtaggcgcttagtgtctgaagaccactggctgccttggatgacctctaaatgcaccctccagctctgtgatttaatgaagaaatcactgacatagttcccatgttttgcattataatttcataaaatttttgtttatatctgtaatttaatgcaaagccatatggttatcagaaataatggatatttaatttgattatttaagcatttgacttattttgtttcattcaagggaaaaagaaaaactattttgaattctattaattttctgcttcatagagaattagacatttatgaaaaaagttcataacagaagttctcaaagtaaagttaggttgatagattcatttaatgcacaattcttatacacttataaaatttcaaaaattcatatttgtatcatatattcataggtcacaggagaggtaaaatgagtacgtggaatatggcctgaatatataggagctaattagaaaataaagtaatatgctatattttagaaatgagaaaagcagaacttggtaataaagggcttagtttgataaaccatgagttgagaaccaaaagtggttctggcccttggaactgcaaaatagtttcacctactgtaaccaggctaatatattgctcctggtagcctgctgccactccaaaattttctcctcagagtttgtcatttttgtgaattcaagctcttcagaatgtttcaattacaaaaggacaattttacattaacccatcaacatagacttactttcagtttcctaacttaaagtagggacttgaaagaaaaagatctaaaataggtcaacggtagagagtttgtgggggattgtaagcatgtgaaattgatgatggtggtctctgtaacgggatccctgatggatcccacagcagcatggaggctctgacttcttgcaagggagagaggcgctagggaaagaagatgttagagacagtaacaaagcaaaatttcctcatgtgcagtttatccaaggatggctcacaaatagaattattctactcatgaaggaaaaagaaatacaactagccaaatgatccacctggaattatttcctccttagctacacaaacaggtaaaaacaaatccatacattacattttacaattatattctgaagaggtgtccacttctgagcaagatggagtaggtgggactggattcaccctccagcctgaagcaataaaaaaagcaacctggcaacacatatgaaacaatggtttccgagacatcagctatcagagaatgaagagtagtcatccctaagaaatggaaaacaaacaaggtgagccctattgcttgaacttactaccatgagagagtttccgggcaacagcacagggagagggattcatagagagccgagtgtttgaggagacccagacagatgaaattcatgagacggagtacctgaggggagagctgcacagagacagaccagagatctgcagaagctccttttagtattcagctgagtttatatcagcacatgcatgtaaggaaagttcccaagacctgggaaagaataaagctgaaatgattagagataataatgcccagcactcacagagggccaagaattgtacctgtgcccagtagccagactgaataacttcatgatttatgaaacatttggtaggatattgcttcggtagttacaaatattctcctccagattcgatacggtcttgtgctgcttaacaaatcttaaaagcaagacttaaaagaaccaaactgtttctaaaaaactgcattgcagaacacagctcaagaaggcatgcatagaaacaggaaaataagacccaaatgaggagaaaaataaatcaatcaaaacagatcataaattgatccagatgttagaattaccagataagggcaccaaaacagttattacaactgtattccagatgttcaaaaagttaagtagaattatgagatatgagaaagattcaaatcaaacttatagagaaagaatctacaaggtataagacgaaaagtacgttggaagagatgaatgacaaattagacgttgaagggaaggttagtgatttgaagacatagcaatggaaatgatccaaaattaaacataaagagaaaaaaggattagaaaacaaaacaaagcaaagcaaacgaaacacccacaaaactgtgacaactttacaaagtctaagatatgcaaaattggactccctgaaaaagagagtgagaataaaaagttttgaagaaataatgcccaaacttctctaaaaaggatgaaaactatgaatacataggttaaaaaaaaaaaaaaacttgaatttccagccaacagcatgtggagagtgatccatgtagagcctaatgtttgaggagacccggacagatgaaattctcgggacagagtacctgagaggagagctgcaacgggacagaccagagacagaccaaaaaaacaaaagcaaaacaaaacaaaacaaaaaacaaatcccaagtacaagaaacacacacacaaaaccatacccattttctttcttaattatatctcttacttttctctcattctgtcaataagcaggaaatgttttcctgaaatataattatcttctctaattcttgaataatattttgtttttgaaaatattttgtctgtcttttttcttctatggaaaattgtgctctcatttcactctaattttggttcctctgcaggtgctccctattttctttctggtttcttaatgcattttctttatcttcagtgtattgtgatgtgccttggttggggatttatatttactgtatctttattttttcaaatgttatttatgattcttaagactttttgagcttcttgaatgtgaagtttcacaaacctcgtgggtttggggaaaatttgaaccatttatcactttgaatatggtctcttcgccattctctctgttctgtctcagtattcctattagatgaatatcagaaccttttcttctatcattgttgtctattaatcttactaacatattttcctttcatctatttcttttcagctatgtctaatatgctctaatttgttgatttagttttaaatgtcagtgcctacattttccttttcaacagatctgtttgccttttaaaatggacctattcttttttatataatgtgctttatttttcatattacaatttaaaattttataaagatatatatcttacatagttatatatcttctctaaagttatatatcttatgtagatgattatatatctgtagctatttaagtatatagttgttatatatagttatttttatctagttatataaaagttatatttgtcagtctatcttaagggttggggatctaatctatctatggtttctgctaacttgttccttgtttgtttttcttatgacttataattttttattttgagtctttcttcaagaggtttttaaaaacatttgttgtatttatcctatgagtaccttttggaactgcatcctggtcatatccctgtagaacattttttgctgtgcttttgcaaagtagccaaggataccactggctcaaaatcagttttttatgttccctttcgtgtgtgtgtgtgtgtgtgtgtgtgtgtgtgtgtgtgtgtttgaagagaagtggatctcagatcatatgggtactgtaaatgggatagatgcagagtctcagggttttgatttcctggaggtaggatgtgaaaggacaggaagtcattagcttcattgttgctcaccacatccctgacagtaggaagattattttttaggccttctttttccctgaacagctcagtttcacatccccccagctcctttccatgaccattaaaaaccaaactcttgatgcaagggatccgttttttcttcttctctcccctctatcagccaacaggacagacacagtatgaacgtccattgagtgtcatgctgattttcagctctttcatcccctgtgttacctggtgatctccctttccttcacttacatatttaaataatatttgttgtatttgattcattatttctgattatttgtaatgggaggattttaagtttatgtacatttgccctctcactaaaaatagaagttaattatccattcactaaaataaagatatctgtgttaaaatgacatgctttttgtccatgcttttgcaggacaatttccatgcttttgcaggaaattgtgtttcttgtgcctggctctctggtactaaatgtatttttaattgtaatgagctctaatcaagaaagaatttttctttaaaataaatggctttcaaaatgagaaatgaaactaaaatatactgtggacattaatcttctcgattttatacttatatgacaatctcacagactagttcaacgtttgtaaacttgcatttgaataggtaataagtactaaaaataataacttcaagagctaggatgatgacattttaaaacttaattagtaatatttaaatttccatgcaagataattcatttcttggacaatatagtctttaaaaacttcatttaaataaagatgttaataatgaaaatacttaaatatataagtgagtggacatgtgtcttttatcccattctaacgaattgatttttactttattcaacactgtgggataataaacatacggcactttgcaagtattttattttagcttttaattacattgggaaatttaatatttcagtatttccttaattttctaagattagttggttacatgttttatcaaattaatgtttgtgattactgcgaaaatcttatactcaaagtagcttcaaattactgttcatgataaaatttcatttgattgacttttatctcaattcaataatcaaaaattcatgacactgttggattttagttcatgctgttatctttctacagtaaaagcaaaattagttagagattttatatttatttcaagatgtcacatatatttgtcttttcagtttccagagtccttagcatgcatagtgcttaatagagcacattcctggacagcctgttattattcattgaaattttagattgcatatataattataatgcattatatgtacatacatgtgtacatacaacattgcaagtttcattccataatgctctttgctttcccatctatattctccaggaaggcttgcatttaagttaagatctaagtttacaaagacacaacttaccagaatctctgggacacatttaaagcagtgtgtagagggaaatatatagcactaaatgcccacaagagaaagcaggaaagatctaaaattgacaccctaacatcacaattaaaacaactagagaagcaagagcaaacacattcaaaagctagcagaaggcaagaaataactaagatcagagcagaactgaaggagatagtgacacaaaaaaccctttaaaaaatcaatgaatccaggagctgattttttgaaaagatcaacaaaattgatagaccgctagcaagactaataaagaagaaaagagagaaaaatcaaatggacgcaataaaaaatgataaaggggatatcaccaccaatcccacagaagtacaaactaccgtcagagaatactataaacacctctatgcaaataaactagaaaatctagaagaaatggataaattcctatacagcatcccaagactaagccaggaagttgaatccctgaatagaccaataacaggctctgaaattgaggcaataattaatagcctaccacccaaaataagtccaggactagacagattcacagccgaattctaccagaggtacaaggaggagctggtaccattccttatgaagatattcaaatcaatagaaaaagagggaatcctccctaactcattttatgaggccagcatcatcctgatacaaaagcctggcacagacacaacaaaaaaaagagaattttagaccaatatccctgatgaacatcgatgagaaaatcctcaataaaatactggcaaaccgaatccagcagcacatcaaaaagcttatccaccatgatcaagtgggcttcatccctgggatacaaggctggttcagcatacaaatatcaataaatgtaatccagcatataaacagaaccaaagacaaaaaccacttgattatctcaatagatacagaaaaggcctttgacaaaattcaacagcacttcatgctaaaaaaactctcaataaactaggtattgatgggacatatctcaaaaaataagatctgtttatgacaaacccacagccaatatcatactgaatgggcaaaaactggaagcattccctttcaaaactgacacaagacagagatgccctctctcaccactccttttcaatatagtgttggaagttctggctagggcaatcaggcaggagaaagaaataaatggtattcgatcaggaaaagaggaagtcaaattgtccctgtttgcagatgatatgattgtatatttagaaaaccccatcgtctcagtgcaaaatctccttaagctgataagaaacttcagcaaattctcaggatgcaaaatcaatgtgcaaaaatcacaagcattcttatacaccaataacagacaaacagagagccaaatcatgagtgaactcccattcacaattgcttcaaagagaataaaatacccaggaaaccaacttacaaaggacgtgaaggacctcttcaaggagaactacaaaccactgctcaacaaaataaaagaggacaaaaacaaatgaaagaacattccatgctcatggataggaagaatcaatatcgtgaaaatggccatactgcctaaggtaatttatagattcaatgccatccccatcaagctaccaatgactttcttcacagaactggaaaaaactactttaaagttcatatggaaccagaaaagagcccgcgtcgccaagtcaatcctaagccaaaagaacaaagctgaaggcatcatactacctgacttcagactatactacaagcctacagtaaccaaaacagcatggtactggttccaaaacagagatatagaccaatggaacagaacagagccctcagaaataataccacacatctacaaccatctgatctttgacaaacctggcaaaaacaagcaatggggaaaggattccctatttcacaaatggtgctggaaaaactggctagccatatgtagaaagctgaaactggatcccttccttacaccttatacaaaaattaattcaagatggattaaagactttaatgttagacctaagaccataaaaaccctagaagaaaacttaggcaataccattcaggacataggcatgggcaaggacttgatgtctaaaacaccaaaagcaatggcaacaaaagccaaaattgacaaatgggatctaattcaactgaagagcttctgcacagcaaaagaaactaccatcagggtgaaaaggcaacctaaagaatgggagaaaatttttgcaatctgcacatctgacaaagggctaatttccagaatctacaaagaactcaaacaaatttacaagaaaaaatcaaacaaccccatcaaaaagtgggcaaaggacatgaacagacagttctcaaaagaagacatttctgcagccaacagacacacgaaaaaaaatattcatcatcactggccatcagagaaatgcaaatcaaaaccataatgagataccatctcacaccagttagaatggcgatcatcaggaaataacaggtgctggagaggatgtggagaaataggaacacttacactgttggtgggactataaactaattcaaccgttgtggaagacagtgtggaaattcctcaaggatctagaactagaaataccatttgacccagccatcccattactgagtatatacccaatggattataaatcatgctgctataaagacacatgcacacatacgtttattgcggcactattcacaatagcaaagacttggaaccaacccaaatgtccatcaatgatagacaggattaagaaaatgtggcacatatacaccatggaatactatgcagccataaaaaaggttgaattcatgtcctttgtagggacatggatgaagctggaaactatcattctcagcaaactgtcgcaaggacaaaaaaccaaacaccgcatgttctcactcataggcgggaattgaacaatgagaacacttggacacaggaaggggaacatcacacaccagagcctgtcgtggggtagagggagaggggagggatagcattaggagatatacctaatgtaaatgacgagttaatgggtgcagcacaccaagatagcacatgtatacatatgtagcaaacctgcacgttgtgcacatgtaccctagaacttagagtataataataaaagaaaagacctaagtttgttttacttgagtgtttgggaggcaagtattttttttcataaatgatatgtaagaactctaaattctcataaaatcataaacatttttcaacctcttggcaggctatagaattgttaatcctttttcaatggtctttaaatgttgtcatgttgccttctagcttgtagctggcccaaggcctgagtgagggtggtgctggattgtgtcgtcagggtactaaacacctgagtcctaaggatcaaagctgaaaaccaaagtagtgtgtcaaaacccaagaggcaggcaagagcaagggtcagaagcaaaataaggacaactgagagcaatgtgggatatccagcaggttagagcaattgaacttgaagaagtaacttggggctttgtcttgtaggatatagattccgcaagtaaaaaatttttgagccaaagaaagagaggaaccagacactcaagaacttcacagtatcactgagttgtgtgtctcatcatggtatattttgtagtttatatttcactgataatggaatgacacaactcaagcctttgtgtctgcagcacttcagcatttaatagctgaaatatatttgagcagctttattttggtcaccctcctttcttccacccacatgattaagatttgttaatggagatatttgtcagactgtacaagattgtgaattagatcttctctgaagtgcgacatatggctgaggatctaatcttatttctgcctgagaccttgtgtacctaggatgatcctaataaagtattatgtcttcataaagacaaaagccaggcttactgtgaaacacagcatcacatagctggaagagagctactttggtctctactattagatctaagaaagatagcatcttaactcttctaagatttaaaaaaaaatttaagacaaagtaaggcataatccttcattaatagattttatagacagaagactataaaaatatgagcactagacttgagaacctgagttctagaactgtctaaactacaaaatacaaattgtttaaatctctcttggactatttttctatctgcaaaatggagacacaaataatgttcatagtatattaacaagaaacactttttcatcacaggtaaaatcaggggctctagagccagactgcaggccttgaattctatctccactacttaccagatgttttgcctcagaaaattacctttgcaagcctcactttcttcatctataagatggaaataataatggtacttacactattttatgaagcttaattgacatcatcatggtaaatgatttaaaaagtgccaaactgtacctggaatatagtaaacagtacatttaaatttctacttgtgttatccaactagatcactgaatttccttcatattttcttgtatcaaaactgtcttgctacagatccagaagtcagttgtatctccaggtaagaagagagtgatagacttcagaactaaagtgaagtgatttatcattgagatcccatttatccgatattggaactccaggcttttaggaactgatctgtctggtaaccaagttgatatggtttggctgtgtccccacccaaatatcatcttgaattgtagctccgataattcccacatgttgtcggaggggcctggtgggagataattgaatcatagaggcagttcccccatactgttctcatggtagtgaataagtctcacaagatctgatggtttcataagggggaacccctttcacttggtcctcatttctctcttgccagccaccatgtaagacgtcccttttgccttctgccatgattgtgaggcctccccaggcatgggaaattgtgagtccattaaacctctttttctttataaattacccagtctcagttatgtctttaccagcagcatgaaaacggactaatacacaagtctcctccttgattgacttcctctctttattctctagtcctattaggtgagtttgttcttattatcttgttcttgctatattgggcttttctaatcctgagctctagttttcctatgactgggccactgaatcttgtggcatgggtcatctgaaacgccatcaactgcttgccataatctcaattctgtcccgtgtttgcaccttgtccaacactcctgatatccatccccttctaatgattttcttcatgttgattatctgctcctaattgttcctttctagacttgaaaaatattaaattgtgctattatacatatattagttgtctttgggagttagagtccacaagattttttggttaattgaatgtgttaggaaaagatgaggaaggatccacgatgaacctgaggattctggcttgatcaattgtatggccagtacttccatcaactttctagctgaggtatggagtatggcaggaggaaaagtactgcatgggagtgcaggatgaaagatgaccagtagcgttgctatgtttgcaagttgagttagaatggagatgtcagatagtgtgatagccttcatgctgaggaaagagggatgtgctagagattacaacttgggggatatcaatctatacgtagcaagtagagatctgatgattgaggatcacccaggtgagagtccacagggaaaagggaagagggcccctaaggtccagtcattttaaatgacaactgagaaaagagaattcacaaaggagcctatagaacttagaggggaaaagaaaaaagtcagaaaagtatgaagctataaaaaagaatagcttttaagagatagagagataagataattcaaatatcaagacttcaagtaagaaaatgactccaaatgtgttattactggggaccctggccagtaggttcatggggtggtgaggacagtagccagatggcagttggctgtgcactgagtggaaactgagtgagaatagatggtgaacatagacaactgttctgagaagtctggctgtaaagaggggaaggcagatactacaggagccatagggaaataaaggagagataaagagggttatgttatgtactttgcttcttttcttttgttctatttttagcaaaaatgtgaacatgcttacatacttacagagaaaagagaaattgcagatggaaaataaagagaggcaagaccctacagggaagtaaaagaatcttattctgagcacgctgaaattttatccttggataaagagacaaaacctagtagcctggttaataggaggaaaacaggaatagatgtatatggatgtagataagtctatatcactggtacagggaaattaaagaaggtacctctaacaggttctatttactctgcaagtaaattgcagacgatgaaaaagtggggtaagaggattaaatgcttcaggcgagaggaacctttaagtagtagttttctccacaaattttggaggttaataattttcagtgttttggacaaaatgaacaagttgattctaaaattgaggagaataacaaagaataaaactggctaaaacactcctgaggaagaataatgacttggagggaatatgtcctaccagataatatagcaagaattattataatgctataacaattttaaaaggatgacattggctcaaggggtaaatatataaaacaaagactcagaaacggccatatataagtggaaaattatacataagagaaatggtattgccatcattgggaacagaacaaatggcattaaaatttttttgcccaattatttattgatattgaaaacatagagttgatcttcttctcatttatacataaaaactaattccaaataaattaattacatgggaaaagcaaaaactttatactttacaaaagcaaaagaatatttcattacctcaatgtaggaatacatttatttaagacaaaagtggtaattatgaaaaaattaaggataaattcaattacattaaattaactataatagtcaaaaatactgtaagtaatgtagaaaaaaaatcaacaaactgggagaaggaatttgcatggcatacagtcaacaagataatgatgatcttagtatgtaaagcactccttcaaatcaatgagaaagtgacaatggaccaattaataaaatggaaatgagacatgaagaactatttcacagaagaggaagcacgaatggtcaaaaacataagaaaatgcagtccatctcactagttatcagggaaatgcaagttcagatcacagataaatgccattttgcatctagattggtaaaaatgattacatcttacaaagccaacctgacagacatgtggaacaacaagtaagagtgactcttacatagaactaatgcatgtatccattggcataagctctggaaagcaatttgaagttattttataaatttgaccataaatttactctaaattgactaagtaattccactcctacacacacactaaaggaaaaatcttcaatgtgtatgtgcaatcgtgtacaaatcaaaatatgtaaaaaaagttcatacagcaaaaaacttgaaaaataaaagtatttttgccttgacaagaaaaggaaaaaaaaaactgtagtatatttatataacaggttgttagagaatattgaaaatgaatgaactactgttatgtgcaactacatgcataaattgttaaaacctaagttgaaccaaaaaaggcaggactccatagaccatgatgtgctatacagacgtgcctcattttattgtacttcacagtaatgtgcttcacagatactgcattttttttcacaaattgaaagtttgtggcaactcagcatcaagcaatagcatgtgctcagtttgtgtctcggtgtcacattctgataatttttgcaatatctcaaactttttcagtattttgttacatgtgttagggtaatctgtgatcaatgatctttgatgttcctattgtaattgtttttgggcaccacaaaccatgcccatatggcaaccaacttaattgataaatgttcagtatgtctgactgcttcactgataggctgttcctctgtttctctccctattctcaggcctccatattccctgagactaaacaatattgaaattaggccaattaataacgctttcaatgttcaagtgaaagtaagggtcacccaactatcactttaaatcaaaatctagaactgattaagcttatggaggaaggcatattgactaagataggctgaaactaatcctgttgtgccaaacagccaagatgtcaatgcagaggaaaagttcttgaagaaggttaaaattgctactccagttcacacacaaatggtaaaaaagtgaaagagcctttttgctgagatggtgaaagtttgagtggtctggatagaagatcaaaccagccacaacatttccttaagccaaagcctaacccggagcaaagcccctactctcctcaattctatgaaggctgagagaaataaggaagctgcagaagaaaagttggaagctagcagaggttggttcataaggtttaagggaagaagccatctccataacataagagtgcaaggtgaagtagcaggtgctaatgtaaaggtgcagcaagttattcttaagatctagctaagataattgattaaagtggctacactgaaaagcacattttcagtgtaggcaaaacaacctcctgttggaagaaaatgccatctaggactttcatagctagaaagaagttgatgcctggcttcacagtttcaaaggacaggctgactctcttgttaggggctaatgcagctgatgactttaactgaaactagtgttcatttatcattcagaaaattctaggccccttacaaatggtgctaaatctactatgtctgtgctccataaatggaacaataaagcctggatgacagcacatctgtttacagtatggtttactgaatattgtaagcccactgttgacagctaatgctcaggaaaaaaaaaaaagatttatttcaaaacattactgctcattgacaatgcccctagtcacccaagatctctgatggagatgggcaaggatgtgaatgtttttatccagcccatctatgaatcagggagtaatttcagctttcaagtcttttttttttttttaagaccgagtatcactctatcacccaggctggagtgcagtggcgcgacctcggctcactgcaacctctgcctgctgggttcaaatgattctcttgcctcagcctcctgagtagctgggattacaggcatgtgccaccatacccggctaatttttgtatttttagtagagacggggtttcaccatgttggccaggatggtctcaaactcttgacctcaggtgatccacctgcctcaacctcccaaagttctgggattacaggtgtgagttaccacacccggcttcaagtctcattatttaagaaatacattttataaggtgaacactccgtagatagtgattcctttggcgattctgggaaaaatccattgcaaaccatctgggaaggattcatcattctaggtgccattcagaacatttgtaggtgcctcattaatgcagtaggtagcatggtagtctcataatctgaagaaacattcatgattcatgggaggaggtcaaaatagcaacattaacaagagttggaagaaattgattccaacccttatggatgactttgaggggttcaacacctcaatggaggaagtaactgcggatgtggtggaaatagcaggagaagtagaattagaagtggacctgaagatgtgactgaatagctgccatctcatgatcaaagttgaatggatgcaaagttgcttcttatggatgaaaaaaaaaagaattttgtgaaatgaaatctactcctggtgaacactgtcgaaatagcaacaaagattttagaatattacataaacataactcataaaacagcaatgaggtttgagaggattgactccaattttgaaagaagttctattgtggttaaaatattatcaaaaagcacagcatgttacaaagaaatctttcatgaaaggaagagtcaatagaagcaacaaattttattattgttttgttttaagaaattgccacagccatctcagccttcagcaaccatcaccctgatcagtcagcagctgtcaacatggaggcaagaccctccaccagcaaaaagattatgacttgctaaaggctgagatgatcgttagcattttttagcaatacaggtttttaaaattaaggtatgcacattgtttttgcaggcataatgcaatggtacacttaatagactacagtatagtgtaagtataacttttatatgcactaggaaaccaaaaatattgtgtgtctcatttcattttgatatttgctttattacagtagtctggaactgaacctacaatatctctgaggtatgcctatatttgtaaatcttagggataaataaaaagtaagcaatataaagacctaaaaaaggctaatatacacaagatggggccaaaaaatggaaggcaaagcctgcaatggtgagctaaatgttaggagtgaagtctgagtctgttcaactgtctctgatagagtaattgacaaaataaagaatagaaaattcagaataaagttggccaaagaataatatttatgccataaagtcgatgaaagaatataagacaagatctcatggcaaaatgtgggggaatattaactagggacacaagagcccctttaggtcagcttgggctaaaatctgctagtgttagaaaacacatcaaattaaaatcagaaaaaacaaacacatttgtgaaactaaatactcctgtatgcaactgaagggaagtaagaaggtatgtcaagttctctttaatagttccagatactttcccaaggcaccacaaatcacacatatttcctgaatgtctcatctttaatgaagctgcactaagtagaagcattttgtgtgtcatcaacttggtttccagccattctacttttccattatcagttatttgctaaaataagacccaggctcaaattaagaggccaattattcttttatttatttatttatttatttattattttattattattatactttaagttttagggtacatgtgcacaatgtgcaggttagttacatatgtatacatgtgccatgctggtgtgctgcacccattaactcgtcatttagcattaggtatatctcctaatgctatccctcccccctccccccaccccacaacagtccccagagtgtgatgttccccttcctgtgtccatgtgttctcattgttcaattcccacctatgagtgagaatatgtggtgtttggttttttgtatgaaaagaagatcttgttcatttttcctgtttctttttactctgaagtaaaggagatattactagtagcagtagaatataaaaataacaaataattgtaccatcagatgactgtatctagcttttgacattgtttaatattatctaccatctagctttactctccccaacaagtctattaagtgtcaagtcatctcaaagtcaaatatcatgaaattcagaccctgaaaaaaaaataagcgacttgtcctagctagattgatgatagaatcaaaactaacattcagatcttttgactcatgctttccttgaatcaatctaaataagccactttagatttcacatgtctagtttgcctttatctaatagctaaacttatttttattctaacattaaaagagaatattatgcatttggaaaaaatgctgttgaaaacatacattgaagctgagagtgttggtgtgtgcctgtagttccagctacttgggaggctgaggcaggagtgtagcatgagcccaggagttcgaggttgtaatgaactatgatcatgccattgcatgccaccctaggtgacagagagagacgccatctcttaaaaaaataaaaacataatattttaaattagacattgtgttttggaaaaatggaagagttatactctaaagatctttcaacaaatcttcagtatgcctttactaaatggagaagctatgtattgatatgtggtaatactattggtggatcagaaagtattaggtaattctaggtcattatgaataccaactgaaacagttcttccccaaaatcttcatagcacatctctcaaaaatggaatataatatactctttaataagattattgtctaattttttaacataagttaaatgcaattagatatttgattttctaatggttacattttaaaatatattgattttgattttgaataacattaaatgtttttccacatctagggaggacacatctatgactagcagtggcatgtgctcaggaaaggtaaatgtatgtcctggttcaggtgtattctcacttaacctctatgattttcatattcttcatctaaagttagaggagtttatttagatgcctctgtggtagatactatgggttgacttgctcagccttcatcccaccctccacctatgtggttttctatattgtagattctggaaggctaaaactacatttctcactttccttgcagtagggttctacacataaattaggtttcaccaattaaaaacacttggaaggcagaagtgaagtggaaatcattttcctcttttggctacatctacaggcttgcacagttatgatgacatgaggatcttggcaacagcattccattgtccactctccagctacctaagtgtcaagaggcagttttgacaaaggcagtgccaatcctacccattcaccagtgttcattcacttgctttgtgaatgttcagggaccatggcaatggtggcagtgacacagaggcagtcctaatccttggatcatagctatgaccttgtgttttgtattcgacaattccagcttcagcctgagagttctgtagtgttctgttagtcattactggaaggccctgcagagcctattctttcagccattccagggatgccttttgcatcttattctcaatactaaatttatttctacttaaaatacttagagttggtttttatgtcctgctctgaaacctgatatctaagtttgctgtgtgctctaatgttcttaggttactggggaacttggtgtgttttctaaaacatagtctccaatatttatggtaatttcttaaataatttaagtttctttctatgtagagtctatttgtaatgtaattttattactatcctataattatccttgttggtgttgagtacatgggagtcaagtgtataaacatatttgttaatgaatcaacagcttatattttcaggaattaggatagctattaggtgctattaaaatagagtatacatatatgttccaaaaaattttatgtactgatacaatgaattagaatgtctgaagtagatataagagtgtataattaactgtattttctaaaaggattttttgtatgaatatgaaaaaatattatttatatatacatatatatagagagagaagagaaataattatgcggatgactgctaataatctgtgatttttttatgagcgtccttttacagcattcatcttgggttaaccattacaacacctgaataactatttgatatttgccgtcacctccttaacgtcttgataatcaatattaactgcacatgaacactttacattcttcttgagctaaaactattcaaataccttcaatccttgtgaatattttcccaaattgcaaggagttcttgcaattcctctattctttatattttaaagaatgtaatacagaaagatctacataatataggtgataaattactcactttggaaactgatatttgagatctaattgaaaaaaaaaaaaacaaaaagcaagaactgagcaagcctgcaacattatcagtctcaattctgggaatatctttgttactgaattgtaaggagtgcaaccaaggatggatgataggtggggaaaaggaagtatagtgttcagtcctaatattggtaaagagtgcctggaaacgaacagcaccaaggaatgtaagcagaggaataggtcagatccaggaaaggaagcagggtagggcacatacaagaacatgtttcagaggaagcagctggccagcagctgctgaacactccagaaacagagagattcaaattgctatatagcaagctgtaaagtccaaaatgtaggagaatgggtgggtcccaggtggtctgagggaaattgaatggtcaaagaagaaaagtcgtgaaaacagtccagccaataataaaaaggataaattaggataaaacaaagataagatatctgaagtatcaggaatgagtatctttttgatattgaaggcagatatcctgtcctaaattttgggttttctattatactttggaaggaagaacttatcctacagtaaacagtccaggctgagcagaaaactgaaagtactacgctgagatggaatatatactcagaggcaaaaagcctgtcatatccattgggtggcaagcttaggattgtagtggagtgttatgtggagcagtcaggctctgggaagataattttgtgctgagagcaagacttaggcacagaaacctcaagggacaaggatcaaagaagagagaaaaattggtcctttgctgaaaattcacttgcaccaaaaagaaaatcacacagaaaggcatgaagtaaacatccaaagtcaagtagagaggggtctctgtctgtgctttcttgccatctacagtcattttcacagcagacaaaagcccacaggtgctcatttctgaagcagggcaaatgcaattagctattacaactcaatagaatgatctgtattctagtcacatcatgttgttagttgtgtttcttagcagcacactgaaaaaaggagtcgatttgtgtggcctgaccatttttccctcttatagtaaaaacaaatgttatgtctgaaaatttagatatttttacctttattttatttgttctattcaaagatattttgaatataagtggtacctgtaggcaaaaatcaactaacatttattaagcacctttttgcttgcattttacatataatagtttatgcagaactatatagttttcacagaacttagtaagttctcatagaactgatagtaaaacttcagactaagaatcagtattgcagagttcaagcttcagatgtatttctaagcagctaaaaccttgagcaaattacttccccagtcattggtttttacaactgcaaatgaggatgttaaaagctgttttacagcttgtttggacaggattaaaggggtttacatatgaaattctgttaagtttaatgaatatttattaacaaaataatgtttgccaaacagcatgcaaaggcttttgggatgatacaaaggaaataagctgtggttttggccattgaggtctgagtctaaagagggagactgaaatatacactttaaaattagagaaaatgcaggaactgtgagagtacagagaagttcagtatgaaagtaactaaaataatagccacatccaatcactcttgatgttcaatgagttattttctctttttgtttaaattatttctaatcaaaaggcaaggaacagaaatgtccattatcactgacaggtagatgatttacagttgtgaatgatgagttactcattaatgtattagtactggaggtattacgatgcagtaggtcagagccccaaggctcacagcaggctcttgtccattgtaacttaactatataacttggaaacattccagatcctctctctccctggtccttccacttactagctacgtgaccttgaacaagttacttaaactctcttttcgagctaccatttaacccagcaatctcattactgggtatatatacctcaaagagaataaatcagtctaccaaagagacacatgcacttgtatgttcattgcttcactattcacaatagtaaatacatggaatcaatccaagtaccattaatggcaaataggataaataaaatgggtatatatataccatggaatactacacagccattaaaaatgaaatcacgttatttgcagcaacatggatggagctggaggccgtaatcctaagcaaatgaatgtggaaatagaaaataaaatactgtattttctcacttataagtaggagctaaacgttaagcacacatggacataaatatgggaataatagacactgtggactacttggaggggggcatgggctaaaagctacctattgggtactatactcactatgtaggtgatgggatccttactccagtcctcagcatcacggaatattcccatgtaacaaacctgcacatgtactccctgtatctaaactaaaagttaaaaaacaaaacctctctgttctaatttatcatctacaaaataggagtaatgataggttgtacattgtaagattattatgaagattaaatgagctaatctatataaaaatttttaaaaagtgctagtaaacagtttggacttaataaatgttatctatattcatgaatgtcatttttactataatgatggtgatgatgctttggcatatctttttgtaaaatagagaataaaaagatttatctattagttgtatgatgaggattaaaatttaaaatgtctggtttaataggtccttaataaatatgaactattatgataatagtgattactactaaaaatcattccctatatatgtttagcatttcacaatataataaatgcttttatgtaaacaaataaataaaaaatataaatttataaacatataaaaatgtgtgtgtatatataggatttacagtatctacatatatgtatatatgtgggtatatatatgtgggtatatatacatatatgtgggtatatacatatatgtatatatgtgggtatatatgcatgtatatatgcaggtatatataaatatacagtatatatgtatatacacaaacgtgtatatgtatatatttatgttacatgtatatactgtaaatcatatatacacatatacacacacacaatgacacacatatatttatatatttatactcacatatattcatcagtgtgagtatatatatttatataaataattcacaattgcacaagagatgaacaggccagattgttctattcctatgtattattcacatttcatagtttgttcattagactactgtggtcttctacagaagatctttgaatttgaatgtcttactacgtctttgctgacacacacacacacacatacacacagtttctggttggtatgtggactaacataacaccttctgtttaattaattctgcattcttttctcctttcgtttcttccattgctttcctacttccataagtataacactggaatccacatatttagagaaatttacggccaggcgctgtggctcacgcctgtaatcccagcactttgggaggccgaggcgggcggatcaggaggtcaggagatcgagaccttcctggctaacacggtgaaaacctgtctctactaaaaatacaaaaaattagctgggcgtggtggcaggcgcctgtagtcccagctatgcgggaggctgaggcaggagaatggcatgaacccgggaggcagagcttgcagtgagccaagatcgtgtcactgcactccagcctgataacagagcaagactacatctcaaaataaataaataaataaataaataaataaataaataaataaatttacttatgtactgtagttgttcaagatgaaggttacacacagagaactgggtatgttatttatgagcatatttgcattcatgtagcatcttaaatgtagttggcaaccctcttctagcacaatggacacctgctggactaacaatatgtttatacaaggaaagtgaaaaatatctacgtttgcacactggctgatgaaatgaaaatagtttaaaccagtgatttttgtgtatagctttcttttaacttttttatttgggctgagaaccatgtgtgcaatggtatgatgtttataaacatttgaatgataaatttctctatgcacagagttacccaacagtgtaggtttacaagaagacactacattattgaaaacaaagtaattaaattttcgaggtcaaagttcaaggaggatcctgcccttgagactctctttccctcctcaaggagaatgagaagcctcactgggttggcaattttcggaatagaaaaatataaaaaaaaccctgacatcttccaggcctaggaacacatcgtcttttgtcttcgccctcaccaaacctatgcagaatgttgtggcacctaaatccccgtttctgggctggagactcagcattatctcttgtcaggaagttgtcagatccctgcatctgcagaccacagataatagggaaaaggaacgtcaaggtaagatctgtgtaattaattagcttgttgagcaaacagttgaaagggaaatgaatttattaatttttgaaatgtatttttaccagattaagagaagctttagagttctatcaaaaaacttccagatcaatcaacaagtgatacatatctatatctatatagatatagatatagaaaattcagtgaataaaaaagaagttacatactaataaatatattagcatattctatctggttcacctgataaccatatttgcatagtcatattagttcaataatgacttttgtttttaatagaaattaaaattacatagggcagtttaggggagtaggaaatatcatatgcttctctttgcattatgtttgttaatatcccattggccaaagcagtcatgtagccaaacctgacatccacagggtagagaaatatattctcccatggagatgaagacactaatgaatattttgatgaacaataatctcacctatgacacctgccattcatctgacatagaaatttccgatgaattaaaaatctaaacttaaaaagctaagctaacttttaaattttaatggttttatactgacacaatttcagacttctaaagttgttgcttgcagcattagtcacagtagccaagacatggaaataacttaaatgttccttgctggattcatacagaaaatatgatatacatatgcaatgggatattattcaaccatcaaaaagaatgaaattctgccatctgtgacaacatggatgaaccttgagggcattatgctaggcgaaataagtcagaaagagaaatgcaaatactatatgatctcatttctatgtggaattttaaaagtcaaacccatggaacatagaatagaatggtgattaccagagcctgcagggtgaggacatttgagagatgttgatcgaggaaacaaacgttccgttgtaagatgaataacccctggaaatctaatgtgcaagaataattttgctttccaagattatacaaaatatttcttgtatttcattaaaaattcatagtttttaactcttgttgcaactactttatttttttccggatttattgatgtacaattgacagataatattgtacacatttaagatgaacactatgatgcttagatatatgtatatattgtgaaatgattaccacaatcaagttagttaacacatgcatcacctcatatagttagtgtgtgtgtgtgtgtgtgtgtgtgtgtgtgtgtgtgtgtgtgtgtgttgagaagatttaagatctactctctctggaaatttcaagtatataatacactattaatattatttatatcttttaatgggaaattccccaattaccagtgcttatctgtttcttatagatttgtaggagctctttatctgttaaatatgctggattcttttgctcatcttttaaattttgagtgatatatctttctttgtacagaaacttaaatttcatatagccaagtgtaagtaaaacctaaggcttttctcatagtttctgctattcttttctgtaagtcgtaagtaaattatcacatcatagattttcccataaacaacataacttaggcatgttgctccagatttgatgagatgaaaaaatttttaatgtccctgaaaaaatatgtgtatataatcaatatacaaataaaccttagcaaggaaagataactacatagtaactgtttattagttgctattcactgaaacaaaagaaatcatagaaactgaatgaatatgcaacctctgtcagtcataaaacattgttaacaggctgggtgcggtggctcatgcctgtaatcccagcaatttaggaggccgagatggatgaatcacctgaggtcaggagttagagataagcctggccaacatggtgaaacccagtctctactaaaaatacaaaaaaacaaaacaaacaaacaaaaaagctgggcgtggtggcaggcacttgtaatccgagccatcaggaggctgaggcaggagaactgcctgaacccaggatggggaggttgcagtgagtcgagatggcaccactgcactccagcctgagggacaagagtgaaactccgtctcaaaacaaacaaacaaacaaacacccaaaaataaaaacaatctgttaagatagaaaaaatataatatggctacaaaataatgacaattatctattcaaataaaataaaagagagcacttttatattgtgttttttacacatagcaacatttaatattattcttgtatttttcattatctgtaatatatcaactgcattaatccctttccacaatattttatccagttaaatttttttacacatagcaacatttaatattattcttgtatttttcattctctgtaatatatcaagtgcattaatccctttcaacagtattttatccagttaagtttttttattttttaaattgacacatcattgtttgtattagtccattctcacactgctataaagaactacctgagactgggtaacttatgaaggaaagaggtttgattgactcacagttcttcaggcttaacaagaaacatgactgggaggcctcaggaaacctacaatcatggccaaaggtgaaggggaaccaagaactttcttcacgtggcagcaggggaaagagaatgtgtggtggaggggaagtgccacacacttttaaaccatcagattttgtgagcactcactcactatcacaagaacatcatgggggaaatctgctcccatgatccaatcacctgccaccaggtccttcccccaacactgggaattacaattcaacataagatttgggtggggacacagagccaaaccatactgttgtacacattttttgggtgaatgtgatattttgatacatgtatacaatctgtaatgatcaaattaggccaattgagatatacatcacctgaaacatttatctcttctttgtgttgggaacattacaattctttctcttctagctatctaaaaatatgcagtaaattatggttaattataatatcccttatttactatcaagtactagaatgtattccttttatcaaattgcgtttttgtacccattgaccaacttctctttatacctctttgcttcctttccctttccagcatctggtaaccatcagtctacctccatgatatccacttttttcactcccatgtataagtgagaacatgtgatatttgtctttctgtgcctggcttctttcacttaacataatgacctccagttccattcatgttgccgcaaatgacaggatttcattctttttgtggtatatatactacacttaaaaatccattcatctgttgatggacacaggttgattccatatctcgcctattgtgaacagtgcttcaataaacgtgggagtgcaaatatctcaagtctttaatctattttgagttagtatttgtaggtctggttaaattttaaaagggtaacagattcattaactagcacagttaaaaccagtttaaaaacgcctggctaagatttgctaaaaacctgactaagatttgctaaggttcttggatcgacatcttccaccaaatttgggaaatatttggccattattaattcagaatatttttcctccctgttctttttctcctctccctctggtactgcaattatatgggaacctacttggaattatcccacagatcactgcagctctctgcagttttttgaaatattttttctttccattcttcagattatgtaatttctgttaatcgtcttcagatatgtgaatccttccttctctggttccaatgtactgttcagcccatcaagattattcttcatttcagatattttacttttcaattctgaaattctcattgggtccttcttatagttttcatttctctgcaaagttttctcattgtttactcatattcattcttttatttaagtccttgaaaaatattaagttcttgcaagctaatttcaacagttatgtcatttcaatatttatacttttttcttgattataggttagatctaataatttttattgtatattggacattcagacgataattaaaggggttcctgattatgttaacttcctttaaaagatttggaattttgttctggcaggcagctaaaatatgttttttccctgtaaatcttgattttattctttgaatgcttttattttgtttttgaatgtatggcatctttctttctgtataatgtggtctctactcctaaagaaaggcctttctggtttctcaatgcttgagatgtttagtgtcatgtctctccctactggctgagctggaactccaactctctaatttctgacagttttgtttatctctcaatctctcagcagatgatatctgctaggcccctcagagacccatgatgattaatgagtcttttgagcccatcctctgagtggctctttcttctctggtgctctggcctataaactctaattgcttctgctgcctatgactctgacctcatcctcttcagctcagaaacattgctgctcatctcattgtattccttctgtctgcccacagcacaaaagccattccaaatccaaatcccaggagatcactggtgtatttatgtgtgtttcacatctagcaaaaatcatagttctgcactaacagtgctcagttcccaaaaatagaaacctcatttatttcctacctttttttttagttgtttacatcaggagggcgagtcttgtactagctaccctgtcattccatcacaatggccaaactagtttggtttcacaaaaggcatcaaatatttcctgtgtgtctttgtgttaagcactattttacacatatgaactatttattatctcatcataacaaatttcggaaaagcttggggttgacggtaaatgctatgtcaacacagatcagccaaagacacagtttcagacactttctttctctcagctccaaagctgtgcctgcataaaactaaaataaacagatggaaagcaaaacatgctgaggggtacaaaaatccacatgtgtggagaaaagtaccagaaacaacatctaatttttccattcatatagactctctaagagtgaaattatacttcatgaatataaatatccaaacaaagacaaccagctgaagcaaagtagtgtttgcatcaacttccacatatttgtttagactttcccaaataatgtgcttaattaaaaataaccttcaggtgcaatgagttgagttgttcagtttattcaaagtaacttgctcttatttgagtgactagatgcatttttatttttgttttgggtgaattcagtatcctgaaaatggccaacacttatttgaataatttaaattatttcttttcaaataaaatgtttaagatataacaattgcttcttacactaacattctaaaaggataatcttagaggtgaactgaggtcaattgccatgtataaagcttattctgacttcatatttttgaagattagccttttatttacaacaatttttctactcaatgcatcattgctacaggttttggtttaagaagtaaccctagatatatcttaagatcttcactaggggacaggggttttaaacatcattgccatcatcattcttgcatcatatcctcatcacatgagctttggttcaaaaatcagattttaaacgatttcaaagtcagacttttttttttttgagacggagtctcactctttcgcccaggccggactgccgtggcatgatcttggctcactgcaagctccgcctcccgggttcacaccattctcctgcctcagcctcctaagtagctgggactacaggcgcccgccaccgagcccggctgattttttgtatttttagtagatacggggtttcaccgtgttagccaagatggtctcatctcctgacctcgtgatccgcccgcctcggcctcccaaagtgctgggattacaggcgtgagccaccgcgcccgtcccagatttttatatgtgtctgttggaatataagaaccaaagcaccataaactccagctataaaatttgcttgttattaatacacaaagaaagtgaatattaagagacgaagtctgagccaagaaaataaaaaaagtaattatttttggtttaatttatacatgccatttttgcacaaaatagtgccaaaatttaatgtcacattcaaactttaaaattcattgaagcaaactctctctgtttagagatgccatgatattacatggagaacaccccaatgacttcaccaaaaaaccattaaaattaataaacaagttcagtaaagtttcaagatataaaatcaacatacaaaaatcagtgatgtttctatacaccaatagtgaattgtctgaaaagaaagcaagaaagcaatttcacttacaatggctacaaaaaaaaaaaacaaaaaaaaacccagaatgcctagtaataaatttaaccaaggaggtgaaagatctctgcaatgaaaaccaaaaaacattgaggagagaaactgaagaagacacatatatctcatgttcatggatcagaagaaataatattgttaaaatgtccgtacaatgtacacctctgcacctgcagattcagtgcaatctctatcaaaatagcaatgacaggtggggcacggtggctcacgcctgtaatcccagcactttgggaggccaaggtgggtgaatcacccgaggtcaagagttcaagaccagcctgaccaacatggtgaaaccccatctctactaaaaatacaaaaattagcttggtgtggtggcacatgcctgtaatcccagctactggggaggctgaggcaggacaatcacttgaactcgggaagcggaggttgcagtgaaccgagatcacgcctttgcactccagcctgggtgacagagtgagactctgcctcaaaaaaacaaaaaacaaaacaaaacaaacaaacaacaaaaaaccaatgacaatcttcccaaaatgagaaaaaaaaaatcttaaaatttgtgtgcaaccacagaaggccccaaattacccaagcaatcttgagcaaaaataacacggttggatacatcacatgacctgacttcaaaatataccaaaaggctagagtaaccaaaacagcatggtaaatggaataaaaatagacacatagactaatgaactgaatagagggcccagaaataaatccctgcatctacggcccactaatttttgacaatggtgccaagtatagacaatggggaaaggacagccttttcaataaatggtactgggtaaactgcatatgcacatgcagaacaatgaaactagactcctatctctcaccatatacaaaaatcaactcaaaattgattaaagacttaaacataagacctgaaatgaaactactaacagaaaacataggggaaaagctctgtgacattggcctaggtaaggattttttttttttgtaaaaaacctcaaaagtctgagcaacaaaaacaaatatagacaaataggattacatcaaactaaaaagcttctgcatagcaaagggaacaatcaatagagcaaagaggcaacctatagaatgggagaaaatatttgaaaactctacatctaataaggggttaatatccaaaatatataagaaactcaacaccaacaacaaaagtaaacccatcaaaaaatgagcgaaagacttgagtagatatttctcaaaagaagatatacaaatggccaacagataaatgaaaaagaagatgttcaacatcagaaatcatcagggaaaggcaaatcaagatgacagaaattttcacctcattccaattagaatgactactgtcaaaaaatcagaagataacaagtgttggtgaggatgtggagaaaagagaaattttacactctgctggtgggaatataaatgagtacagccattttggaaaatattaatagtttagagtttcctcaaaaaataaaaatagaactactgtatgatccagcaatcccactactgtgtatacatccaaaggaaatgaaataggtacttcgaagagatatctgcactcctatgtttattgtagtaccattcacaataaccaaaatatggaatcaacctcaatgctcatcaatttttaaatggatttaaaaagtactatcacaagggaatgttattcagtcataaaacaataaaatactgtcatttccaggaacatggatgaacctggatgacattatgttaagtaaaataagtcaggcttgggaagacagtgcatgatctcactcacatgtggaatctaaaaagttgttcttgtggaagtagacagtggaacagtagttgccacaagatagggaggttagggaacaagtggggataggagagattggccaatgggtgcaaagttatagttacacaggaggataagttctggtgttctgttgaatagcaggatgactagagttaacaacaatgtattatatgttccaaagagaagtttttgaactcattacaagcaaatgataaatgttatcagaaattgactttttaaatatgagactataataggacctgataatatcttctaataaatgaatataggaaaatcaccttgatttacactaaaaaagacaatattaaacaaaggtatattattgggaaattctctaaaatgctcaatgatggctttaaaaatagaagtttggggggctgaggtgggcaaatcatgaggtcaggagtttgagaccagcctggccaacatagtgaaaccctgtctctactaaaaaaaaaaaaaaaaaaattagccggacgtggtggcgggtgcctgtagtcccagctacttgggaggctgaggcaggagaattgcctgaacctgggaggtagaggttgcaatgagctgagatcatgccactacactacactgcagcctgggtgacagagtgagactccatctcaaaaaaaaaaaaaaaaaaaaaaaaaagaaagaacggagaatattttttaaatattctcctatttgaaaatagaatttcttaatacttttgagttcaaacaatggaagtaaagagatttggtcaccaatttaaaaactagtttgtctgtgtaattacaatttcttttctctctgagtgtaaacaaaatatttaggatcagtttattgcttgtaatgtgtcatcatttctctctttctttttttttctcacccatttaatttgtttactcttttttcccctgtgtttccagcaacataggaggatttagaaacaaaactgtcttgggcagagggagatgatggcaaatggatgaaaaactggcttcttgtttttggtggttactatagcaataatcatgatgggagatttttagccgcaagtggtttctataacaacatgatagggtgctttagaaatagacctgaggtaaacagattctttaagggcctcttaaccccttttatcccacaaaattagcatcctcttggaggatgaatattagttggcttatttgatgaaacgcttaaaatcttgcttttgttttgtaaagattaaatggttaattattctataaagacctggccttagccaatcagctcttaggctccttcacttcaggaaataattgatagcatccctactttatttctgcacagcaaattcaaatagccttaaagatatgcatttcatagtattcaccaaaaattggaaaaccataaatagtcctcgtgagaaagtgtgttcactctgacatagatcactcaagggctcttgctttactaatacttcatatacactatgatttcacctattgggctccctgacaggtggagcttttcctactctaactaatggagtctgaatactcatcctttattaggctattcagtgtgtgccagaatagacctggtccctattgagttataattcactaggtattacatggggaagtttagtaattttttgaatttattaaattttagtatcataaaaactgacatagaaaaaagcaaaggcctccatttcatacataagcatccttcaggagcccttataagtgaaagatcaaggggaatttatgacaggaatgtggtacaggagtagatggtggtaggcaggaaataatttttcaagagaaagaaagatggaaggcttaaatttagttaagtagttaaacagaggaagatggggatcaagtttggttgactttaatagtgagttattgattatctactctatgttgtacactataggtatatacaatgttgaatagtatatgggatttattttaaaaactaaattatcatatcaagtaaagcactcttattaaactattaattaaattaattgatttgaagtggccatatatttacaagaatgatttcatttatgttatgatgtctcatgcattttctacagtagagccatccttatacttttattcttttctattcagttaagctgccaattcaaaacatcagatattctctttcaaatctcagaaggatgtcagcaaccatgcatctccttctctctgatttcaaacagtacaagctattcccatttccctggtgttttgtgctcagcaatgaagcctcggaattcattacgtaatcacttgccatagccttctggggtggagtttgccaaatggatccctgggagatcaagacccattctccatgtgtgccatagggctatgcacatgagctgaggcatgtctgtattcaccaaggccctgctcagaacagcatgtgccagaatacactgggcaaggagccattcataaattcttgaaaaatcttatccagaccaaaggcacaatggcattgtagttgttgtgctcattgccatggggcttttagctgaataaaaagaaaataaaaaatatattcatgatgacttccaagttatccagtaaccacagtaacctaggttttccccaaatttggtccacaactttgagtcacctgacagaaacaaatcattctgtctttgttcaagcatagtgagccatagagtgagtgaaacaaatttccctgggataaaaaccaatgaatcagcaaagcaaacaatcatcatatatttattttactattagaaggtggtattcaaaatgtcatcaaaaccaaatacatacctcatacatacaggcatactgaaaagcatatattatagttcctgaacttaaagagtttgtttgctaattgtaaggacaagtcttcatatatggcatgaagaacactttaggttgcatatagataagtgttcaattgtatcttaacaataataaattctgtggctgctcaggccaggagctcaaggggtatgtaaaaatatgaggaggattaatgggaaaagtacactttgcattggacttctaacaatttgaatatacatcacagttaaactctcagaaagtattctgagatatttttattcatggctactataagaagaatgtcataaagaagataatttaaattctggaggaataatgtcttactcataaccacacattatttttctagactttagttctctgtacaaaaatgcgagaaaactgttgagagttgcactatccaacacagtagccattaatcacatatggcttttgagcacttgaaatgtgactaaaattaagtgtgctagaagtgtaaaatacactaaggatttcaaaggcttaatgttaaaaagtgtaaatatttcattaatagtttttacactggccaggtacggtggctcatgcctgtaatcccagcacattggggggccgaggtagacagatcacttgaaaccaggagttcgagacaagccccatctctactaaaaatagaaaaaattagctgggcatggtggcacatccctggaatcccagctactcaggaggctgaggcatgagaataccttgaacccaggaggcagaggttgcagtgagccaagatcgcaccactgcactccagcctgggtgacagagtgagactctgtctcaaataataataataataataataataatttttataccaattacatatttaaatataatgctttatctatatttggttaaatatttaaaattaatttgcctgtttgtttttcgttgttaacatggttacagaagacttaacattccatatgtagctcacattatacttccattagacagcactggtataggtgcttgctatttaagtgtagtatgtggaccaacagcatcagtattacttaggagcttaccataaatgccaagtctgaggccccactcctcctgactctgcaaggttaacaagatcctcagcagttcatatgaacattaatgtttagaaaatgctgatctagataatgttttagatgtttctttttatgactctgtcttccttttcatttggatttttttcaaataaatattttacagtctgggcatcctgacctagcacatattagatgcataaacttggggaagttatctgacattcctgaaactcaattccatatttataaaatggatgtaatacctccaatcccataatttttctataggggttaaatgaaacacaagaattatgaaaggaaccaataaattggagaaatttttataatatcaaaaataatattgaaaaattagattattctaattattttcattcttatattgattgccaatactattttgatgtacagtggaatgaactagagttcgaagggctgttttcatttattttacaaatgtcacttttttaacattaattgtgtataataaaacttagcacactgataagtctctagtagagatattaaaacttttggatcttcttttagaacaaaagtgttgtgtagctaaattttcctgcaccatcattatataattgacattgaaattatatctgttcgttgatcgattctgcaaaacatggctttatggagcgggaaaaaactttttcgtctttgttcagaacacttttagctttactgtgagaatttcaatttgctagaggcaaataaactagtaaaatatgtctattccatagtaaaaggggtcattcaaaagcctgtccttattaaaatatacattgattataataaggtcagtgatttcaggcctgattagctttaaataaatgtaatgtcaaaggaatataattagttcctcattaaaatttttcatgattgacagtgagtaaaaatgaccttcacaacttgcatcatttagtcatgttctaaggatgacaaagggcagggcatcttctatgaggtaaatgtgtatgattgcagcctgaggcacatgcacttggtcccttaccctacctaaccctaacgcccaagacctgatccaagccagaccctgtgcttaggtgtgtaggctgtgtaaaggaggacccagaagctttgattctcatggggatgctttgagagaaaaagaaacctttgaaccggcaggacctgatttcatctgtgatgatgctgatgatcagaaattatatataaaagcaaatagcaacgtgcctatcagatataggggatttaaaatatgttgacagaaaactttctcagtgaggccactgaccttctaaagaggagctaatagtagaatagggatattaagatacaggtgatgtcaatgaattttggccaaaaccaatcttcttacctggagtaagaaagtcgtgtttcaaggagtttgcatgagtattaattgtggttgatgatgatgggaacctgccctgattattaggtatgattctcagagaatgtgtgctggtgctaagcttgcatttctcagaacccccaaaactctctttgcaatattatatagtttcattttcttgaacttattcatttgttaaatatgcatttactaagcaccaactatgtacatggcactctgctagtcaatagacaaataataagatatatgtactttggaccctgcattgaaagaaaaagcaaataatgttttttaaaaaactactttatgcttgattgttataaggaactttatgtgtattatctcttttattcctaataataataagaacaaggatgattgataatgctcactctgtgccaagccctgttaggcattttatgttcattaatttaaccctttataacaactctatgagataggtgccatttttacaaaaatggaaactgaggcagagcgatgttatcttgataaaactcatagacttagtaagtggcagagccaggatttaaacccaggcaccaaacttcatgcgcttatccactatatatatggctccacatcattttctttagtaatcaggacactgaggctcagtgaaaatgttttttcttaaagtcacagagatggtaaatactagaaccaaaatttaaatctctgtctaccataaaaatgtcctcttctcactatattaaattggcctcaatttagtatttaagacaacgtgtacagtaggaatacaaaggaaaaatggtcttaaaggagcccatctacttcttattttaactgctccatgtggattctatcacgcagtacatcaaagtaagtgatttaaccaatcatttgttctgcttgattttatcaaaagaggtcaaagtaagaatttcacagcaaggcttaaatgggaattcaggtttccttgctcactcattcattattcaacaaatttctattgactgccttaccatgtgcaagccattttggctatgtcctgattaaagatgtgcccctcctgcaccgcctccctccccaccccaatcctggaactaaatttcattctctgcagaaagccaggctaaagagaattcagcaaaccactttattctcataaattggcattcttagacctggaaattttgagttctatctccagtagcattgtttataccttctatttcattctgattacatttcattagcaaaacatagcaaatgtttataaaatcgtcagtcttctaggtgaaacgatgtaagacaccattcatttgattttttggaaatatcaaattttatgttcacaattcctctattctactctgattatttaggtaaaattaggttaaatatagataactatagaattaaaatttaaaaaactgtgcctttacacgtttggaaaattactcaattttttttcaaataacgccaaccatatatattgaaaataacattattccataccacaggtgacatattcttttcctatccctagcagcgacttccccaagtccctgcttgtctcaacagtttgaggaaaaaaaacaccagaaatatacatgttccagaacaatgaataaattcccaaataactttatatacattagtgaggatacaatgaggagtgtttatctagctaaatatgaggcatattaaaaattgctactttaacccagatatgagcaataataggagttttatctacgcctccttcctttccttctgctgacaaaggatacatttaattcttgacgttaatatcagttaaaatgagatctagagacagatataattagagagctagggagagaattaagttagtaaatcttaagaaaagactgagtatactgatgataagaggatatttaaatagaattttgaaaaagatcaaggatcaataattatacatttaaatatacatatatgtatgcatatacatatgcatagttttacataaagaaactattaaggtaagagctatggctttgacagttaatactcaagaaatatttactgagcacttggtataaataaatagatatggagcacaatacaaagatacagcagatgctctgaacaattaagtccttatcacaactcaaattccatagctagcattttgctgagccaagaatttaaatggtacttaaaatttatagaggccggggactgtggctcaagcctgtaatcctagcactttgggaggcctggatggctgaggcgggcagattgcctgagctcaggagttcgagaccaccctggcggcaacatggtgaaacccccatctctactaaaatacaaaaaattaaccaggcatggtggtgggcttctgtcatcccagctctttgggaggctgaggcaggagaatcacttgagcctgggagatggaggttgcagtgagctgagatcatgctactgtactccagcctgggcgacagagcaagactctgtctcaaaataataataataataataaataatttaaaaatgtataatcagatgttaaatattttcttgcaaaaaacaagggagctggggaacagaacctttttaattcaatttcataattatttttgtccgatcctgaccattcccaggtaatttacaggaagggcatagttggcaccttgaattagtccattgttaggctttctatgtaagggtactcgtgtttttttgtttgtttattttgtttcattctctttcttaaaataaaattccttcagtgaaaattattagtgacttgtacctttttaattatttttattgctatgttttgtacttgttcagtaaattttctattaagaactcaaaactatttctcaacatcttataaaggtaagagctagcatttaccaaacacttacgatgtgtctgcaaagcatttaaatttagtgacttaattctcacacaccaaaaaaaaaaaaaaaaaaaaaaaaaaaaaaaaaaaaaaaaacagaaaccaaggctgggagaggcagagcaggcctggtacccatctgttgccccttcccactgtattatcctgactcgctggtaaatctcctatgattgctaaatagaaaagtcaatgaaaagattgataataaaaaccactgaatacaactttcagattcttgattgatgattttaaattagagaattacctgtttcatagaaaagtgcaatagaactatcaaggacaaaggaataaatactacttacaatagagaaattaacatgttcttccctgaaagtcttgcaccttgcactgtttcattgctctaaataaacatactcggcctcataatgaaacaaaattaccaatatggctattttccaagtcaatttaattattagaaaatacatacacacagatgcatacacacacacacaagaaatatatttactgttatttgggtcttcatcttccttaaaactggtcaaatttgtttttacttctcagcagacaaaaaaactttattttagcactagaaatacttaatgcaaatatagaaataattgcttatagtaactatataaaatcttttcttttctcttgtgcagaggttttcaaattgctggtctcaaaccctagctccttggaggtgtctctaggggaggcaggagactggtctgactgggctccaagggaccttccctgcttcgacctgagcagatctgctttccaattgtgtacattgggattcctcatgacattttccttgaaggaattctgctgctcttaaaaagaaaaaagaaaggaaaagagggaaaacaaaaagtctgaaactcacagtggtagaatttcttaaaacagccagtagatggcaaactttactgcaaggaaacaattttgcagcctatataatttggtctgaaaatagcaattaaactctacatccagtaaaatttgctatcctgtatataagtcttctgttaaatcaggaaacaaaattctctatggtactttctctgggaactaaatttcaattataatttaaaatatcctataacttctttctgtgtccatttaagtcttgctctgaaggtattatcactatgaaaattattgcattgttcactgaaagtacatacaatgtgctaggtatagtaatgtagatgacgtagttttttcattaggatgaacccaactatgtattttattaatgagtttggttgaggcagcacaaaggtcacaaagaaagatttttaactttgtcctcatttataaatttaatcttgttactttttatttccttgtagattccttttgcaataaaaacaacaccaggtgcctctcaaattcttgccaaaacaattctacatgcaaagatttttcaaaagacaatgattgttcttgttcagacacagccaataatttggacaaagactgtgacaacatgaaagacccttgcttctccaatccctgtcaaggaagtgccacttgtgtgaacaccccaggagaaaggagctttctgtgcaaatgtcctcctgggtacagtgggacaatctgtgaaactaccattggttcctgtggcaagaactcctgccaacatggaggtatttgccatcaggaccctatttatcctgtctgcatctgccctgctggatatgctggaagattctgtgagatagatcacgatgagtgtgcttccagcccttgccaaaatggggccgtgtgccaggatggaattgatggttactcctgcttctgtgtcccaggatatcaaggcagacactgcgacttggaagtggatgaatgtgcttcagatccctgcaagaacgaggctacatgcctcaatgaaataggaagatatacttgtatctgtccccacaattattctggtaagtgtgatcatatctgaatcacagatggtgtagttagctctttctaagtggcagaagcagaggtgacattttatttttcacacaatcatttatgaaaatggccaagttcttgacaggaatcaatcactagatagaaactccctaaactgctgaaaatccactgaatgcactgaattctaagtggttgcctgctgtcactgttgctgttttaaatggagctctacatgatttaaaactggattcagtctagaatgaatgaggtccaagagaaactcaagggcagttcaggtttcctcatcagtgcatgttcctttcattccagttcaagcctgctttctaatccccaaagcctggcactgcaaccttctgggaaggcagtttggaagttgatgggtttctagtgctgacttgagtattatcaacagatcagtggtagtaaagctgatggagcatggtatatcagataaaccacgatttttattaagaaaaaaagcctgttcttgttttacgtcttagagcaaacaattgtacctcatatttatctatctattctttacaatgtttctgttgatagaattttattttaataataaagtaacaagttgacaactcatcattaccaagttacatgctattcagcctcttcacactcagtatttatcctccctatccttttgaatcactgttactgttttaggtcaattcttcacgatggccacatttcttgctttgctttattctttggcttttccatttacttgtaagggggtaacttacctagcctatgctttctcacatgcattcattctaacttctgctcaccactttcttacagttcctgactcatatctctaagacaccacacacattttaataccatgttctcccttagcacttgccgtttttgtaccttcctgaaagccttcctgaggctttcagcttttaaacttgccttcttctcccaacactttcacacttagttctttattttgtcattctttttccaagtgttaagcaatatatctatttggaaaatatttctcttcaaaatttgcaccagaaccctccagcatcattttacttttaaacattctaaaactatatattttataaaatagacacattcctagttgctctaaaatgaaatttttcccctctccctcctcctttacatacaaccagtcttcagaatctgctgttttgacatctaagatatgttccaaattgagctcatccattcttttccttggttaggtttatttcaactcttgtgtgtactactacacaacctcccagacgttctacttatagcttctaccttctcgaagttgttctgaacactgcctttgaaataacttttctaaaatagacctatgccgtagttctgaagagccttgagagcttcccactacacagagaataattttagcctctccctgaaagcacttcacaatttgggcccatgacagtggccatgtcctcacacattccaccgaagccttctatttcctctaataaatcttcttcatttcttatacaagtcatttctttccccctggaatgtccttcctcacttcacaatgtctactctgaagttctgctatactttttaagacctagttcaaatatcacccaacacaagaagtgtttccaggttcctttccagctggaataataattccacactgctgcagtaattatattcattatgtttgtactagttgacacctgtattaaagaatcccctataattctttcctattttacatatatctatgtttttgcacccccccccaaatgttagtttctaaaggacagagtattgttttatatttattctttaattcatcaatactttctgagtttctattagatgtcagttagtggattaagaagaggagtcctcggccaggcgcggtggctcacgcctgtaatcccagcactttgggaggccgaggcgggaggatcacgaggtcaggagatcgagactactgtgaaatcccgtctctactaaaaatacaaaaaattagccaggtgtggtggcgggcgcctgtagtcgcagctactcatgaacccgggaggcagagcttgcagtgagccgagatcgcgccactgcactccagcctgggcaacacagccagtctccgtctcaaaaaaaaaaagaggagccctcttcctccaagagcctgactcagtatttgtgagtaatggctgcttaatcaactgttactaaattgttctaagttttacaattcttccatatatttctgggcacccttccccatcctgaaactcaggtaaatgaatattaaataagaattcactttttgtattattttatgtatactctatgatgctaaaatgcttatgtcaaatggaaaattattttatcaagtgacttaattgtcaatactatctaaaagttataggaaatattttaaaagcttataaaacaatagttgtatgaaaagctccttgtttgtatgccatactgaggtgtctctttctttggtggagttatggcaggtgaatttcaatattttttaaatttttgaataaaaataagaaatttttgtggggctggcttggaagtgctttgtttacaatggtcacatttaaaaatcaatacagttcattaagatagtgtcttccattttctgcttctatctcaatattgtgaatggtgattaaaaggaatagatataaaatcaaattaatgtttcattcatttcaactatagtattgtgtaatagtcttatatttgtaaaaaaaacacagcttgcaaaactatattttacaatgtatgttttttaaatatcttaattaaattggattttaatgaatcctttcagtcgtctaaatttaggcataaaagatggaaagggtggccaggtgtggtggctcacgcctgtaatcccagcactttcggaggctgaggccggcagatcacgaggtcaggagatggataccacactggccaacatggtgaaaccacatctctactaaaaatacaagtcccagctactgggaggctgaggcaggagaattgcttgaattggggaggcagaggttgcagtgagctgagattgtgccattgcactccagcctgagcgacagggtgagaccctgtctcaaaaaaacaaaaaacaaaaaacaaaacaaacaaaaaaaacagctagaaagagtatattctaaatgtgaaatgtagtcaaattccatcataaggcacttcaccttacaatgaattcatttatactgtaggttgtatcacatccctgtagggtccaatgggaatgagtccccttttctcactataacacttaggtccacaatgaggatgctttccttgtcaatccctgatataatagtgttgttccctatttgactatattcttcccttgttttctatgaaatcagctacatgttattatttcaccttttcaagtgacatatataaaactttcttgaaaacagaatttaaacaagagactcataaggcagataaaaatcgggtctattattagctggttaggcttgttcgggtaaaaaaaaaaatgcagtcataggcttgctcaccaatctcctacacaagtagaatggcctgtgttctagtagctcatgggtgtttctcagccctgactactcattagcaattacccagggagctctgaaacagaggtgctcagactctacttccagagggtcaaatttaattgatgagtctaatgtatagccagggctggcggccaaatattaagttcatgtgagctttatttggaaatttttcttgcaccataccatcatttagacacacagggaagtgtgtttatttcattgctatcccatgaccaccagtgtttgtggcagcccaggccaactaacgagaaccccaaagaaggtctgtagaaccaagggaaaagccaaagttgagaaggaaagaaaaaagaccatcagcaatcagcatggatgtgctggagtgctctgcctcaacttagacctcctgatgaatcctggaaactgtattacaatgacctagctgctgtgcaccacatccaaatttagagtgatcataaagaactcctcttacagaaaaaaacctgtgttcctctgagcagcaaagtaagaaaaggtaataaattttaaaaggcagagaggtagaaggggaaaaagagctgtagcacatagagagggttcacactgcgtgaattctcctctgtgcactccattatgcttcatgggcagtgattcatgaactacagaaatggtctcagagagagccactgaagaggctggtgagaatctgctgtgcataagcaaaaactccaattgaagctgaaagtaagtggatgcaaacttttttaatgaaaagaatattagctctaagcatgtgactgcttttagttcaatttcatgcaatgaatcatttcataattgaggccttctttaaaattagccagattgattaatgtacatttttctcattcagatgcctgcagtatgagaaaaatagggctgtaagagggcagagaaaggccagttcaatgtatgttgaaacaaatcaatgtagaaaaatatcttattcctctattacaaaatagatctttggtataaaagtaatcttttgggaaataagaaaatgcactatattcaatgtacttttcaactatatgatgaatttccttgcagaaataaaaatgtacaaaaattcatcatatagtgaaggaaatgtatttgtacttacagagtagttagaagactagttagttcatggagactagttaggaggccattgtgataacccaggtataaggttttaggacctggcctgggagagtggccatgggcatgaaaggaaagagaaagtataatgtctctagaaacaagactcacttaacatttatcaaggtcagagtattttcaaacttattgtatccaaggaaaacttgaaaactctgatatgaaacaaatgcattaaaagtttaactggcattgtcaacttaataagcttacaatgtagatcaatgggtctcaagtgttggcatgcatcagactcacctatacagcttatcaataaaatactgttttcagttcaacagatctgaggtgggggtccaagaatatgcatttaaaacaagttcccatgtgatgctgatgctgttagtttggggactacactttgagaaccactgacatagacagttatgtggatttccatgtgacatccttgactgttatttcacaaagtccatgaggcaaggaaacacaaatcaataaaagcaggcttttatataaagcacttattgctagtaacagttctaggtacttgatgatatgatttgagtgattgcctcctccaatactcatgtgttggagacataatcaccaatgcaatagtattgggaggtgggaactaagaggaggtatttaggccatgaggatggaaccttcaggaatggattaataccataataaaaagggctttttggagtgggttcacccccttccactcttatgccatgtgaggaacaatgttcctatcctctggaggatgcagccttcatggcaccatcttggatgtggggatttaccagacaccaagcccactggaaccttggtcttgaacttttaaacatccggagctaagagaaataaatttctgttctttataaattacccagtcctatatattctgttataccagcaccagatggactataagacacatgatatggattttttaaatatttgtcgaattcattagatcattaatttattcaacacatatatattgagtacctcaatgaattgggcattgttctatgttctgaaaatgaaagcgtaaagagaagtgatgacaaagtctcttacattctgcaaggaagagatagatgtctataaaacaagtaatagatatactgtatatagtaggttagagggtaataactgcatggagaaaagtaaaacaaaataatggtattagggattaactttaggtagaatgatcaagaaagtcttcactgagaaggtgacatgtgaataaagttctaaagaggagaggatgggaaccaaggaaatgtcttgtggaatagcattccaggcagaggaacagcagatgcaaaggccctgaggtaaagagtccttgcaatgtttgaggagcagcaataaagttagtgtgactggagtgaaggaggaaggagataggtcagagcaataatgaggtcagactgtttgggaccttgtaggccattgtaaggactttggcttttactttaagtgagatgggatgttattggagagttctgagcagagaactgaaatgatttgacttacattttaacaaggtcactctgcttattatgttgaagatacactgcagggggcgataagcatggaattcaagtgtctaagggaggttaatacaatagtccaagaaaatccactccttgtgggagagaagagtgaaagagacctatcaagttttttgtttctttttgttttaattttttttttcagatggagtctctctctgttgcccaggctggagtgcagtggtgcaatctcggctcgctgcaacctccacctcccaggttcaagcaattctcctgcctcagcctccttagtagctgggagtacaggagcgtgccaccacgcccagctaattttttgcatttttagtagagatggcatttcaccatgttagccagggtggcctcgatctccggagcctgtgatccgccgcctaggcctcccagagtggtgggattacaggcatgagccacctcgcccggcccctatcaagttttaacagtaactttctcccctccctgttccacccttaacatttaagatggaaattaacaaagaaggatcatggatcatgcaaacaaaatgaaagcatgcctttctctctctgccctctattgccctctgatggcaatgtctagattattcagaacaaatctgtcctttagaatattctaacaagaatgcagtctttcttagtagcttctgtccaccatattgccatgcagtgtctttcacgtacacaactgcaacatattttacctccctgggttacatgatggttactcatttaaagtgtcctatcagcacttcttttacttttaatgataattcctgttcctcttgggccttctccaatagtcctcatccatgctgatgcataagtctaagaggtatgatgtaactgacactgccattacagtggcacatatcaaagacataattcgaatttcagtcgttgtggaggtttgaatctgggcttggtgttctatcttttctaaatatattttgatcaactaaatcactttgaaggcatctgtggcaaataatatagataatttaatggtcatgggaaataatttgaggaaaataaaatatgttattaaatataagcttatttcatgagaaataatattattatatcaaagaaaaatggttgtttttatatgcgcttaattatgaaattgataatgttttatggtgtcttataaagaaaattaaacacttgttcaggcttttgctcagaactagagtcatttgaagtagtttttatgaataaatgaagtttccaggttttgacaaatgtttgttgaatgagtgcacaaaataacaaatattcactcagcaaatacttatatttgcaatgcactgggcattgtgcggacttcggagatgtaaaagtgactaagataaaatgtattcctgacaaaatgctcacaaattattctgggatcaggaatgtaaacaacaattaccatctgtctataaacatcatgctgtggaagaacaaagaaagaagctggtaatgttggttggagtcaggaaatgttcctaggaaaaaaaatggcctatgagtagagcaaaaatgcatccctttcagaatgtaaaactgaaacttgtatcttcctcctacatttactattattatttgaacaataacatgttgaatatcaagggagaaggactgcagagatattttggaaaggtgttgctatgatctgaaaagtttggtccttccaaaatgtatatgttgaaatgctgtccaaggcgatgaaaaggtgaggcttttgggaggtaatttggtcattgcggggaagctctcataaataggctatgtgcccttataaaagaggtccaagagagatccctcaccccttctaccatgtgaggacatagaaagaaattataatctatgagccagaacgacagctttctctctgacatgtgactgctatttctcctagtgcctacctagttatcagcagggtgtgtgtgccagtccgaatgcaaaggggatgagccaaaaaatatatagtaatataaagaacggatgtggtggaaagacaaatttggaagtagaagacagggattccaggctcagcctagatgttctctagtggtttggtactgataaataacaattatgaacttccatttcctcattcaaagattggcatggtaatacaacctaacttttagggtcatgatgagaatgaaatggattaacaaaagtttttccatagactatttaggctatgaaagagttaattgccaatatttctgtctcttaaaacattgctactaatgaatacctatggtatctaaacaatgtttgcctttgttttttacaggtatcattttcttatatttgaattgcattcaagtaatcttatacctgattacttgaaagtattattttttgaatactgttagaacccaactcaggaatagattaactgaagttcggtcaaaatctctctgccacacttataaatttaaagtgtaatattttaatatgtgtaggcaagaattcaacttctaaaatggccatatcataaaataaagaactaagaaattactactattttaacaatttcatatatttaggaatagtaattatcctaatgaagagaaacataagaaagtaatttgctatgattaaaacataattatggaagtacgaaaatatataatgtttaatactgatgtatttaacataaaatgagaatgttgtaatttttctataatctttcaaaaaaacataaaattaaagcataaaccattcataaaagtagtgtatttttcaaacatagcatcttggagtctctgaaatgggttactccagcttttaaaatttgatatatattttgctattttcataattcttttaaaaagtgtgggtgtatatatatgtataaaatatagaaagtgtagggggaaagtcattcgtttaacttgggaaaataatatattactatcttgtaaattttatgatatttatgatgcaagtgaagtgggagaaatggcatacagatggatttagagaaaaatggctggagaagaggaatgaagaatgagctcacagaattagaagaaactgttctccaaacagacaactgtaatcattagatacaaggaagtaggagaatttcctcccaatgccccactcctagggctgacaaagagaagacattctttctcttcctagaattagtttcagcctccatgatattctgggaagatggttttgaaactgtcaagaacattcttaaactttcactgatggtaaaatggtaccaaagaggacacaatgtgaaaaggattaagaaaacctgaaaaaaatgtttaatatggaaaccacaggttattacagttttgtctagcagtaaagcaaaacttgtagaaacaaaaaggattataatagtcacaataacaaaataataaaatataatcaaatagttaaataaaataatgacaaagcattaataatatttataaagacaaattttctgtatcatcagatttaatacatcatcagtcttacatacatttcagatatcattaagaaagaaaaattatttggttaagttgtaacaagaggctaaggcactgctgattgtaaagtgcatctcggttctagagagttaaaaatgtgagggagtaaaaaaggagtcagaattgacaaaattcggcagtccttcagagatagaatcctgggcttgtaaaatctgctttaagtgaatgattcaaaaagagaattttgttatttttggtgtccttaggaaaggtgtgtctaaattcacaagccagaaatctcattggctaaaacgccaaagatgttcccactgaaaataataattatccacgtttaatctcttacaacatcttgctaaacattgttatgcttatgttattaatcagagcaggaagtcatccagcctctccttattgctttaggatgttaaacagattgactataatatctaggaggagaacttactgtaaatctatcactataatgaaaaccgaatgctacagttccacattgctctgatacttgtgtcaccgacttgcactgataactgttgtacttgatatacataaaaagccccaaaatagcatacataattattattcaaaagaaaaatattatgcatagaggcctgttaggcatcacatacattgaatggaatttgaaatttaagatgatagtctgaagccagactacaattatttccaaagcgtggactctgcagataatgagaaaggcattcagaatggtttatcaacaccttgctgcgtgcatggtgtgctccctgcccactgtaaagaatgatgaagacagcgtcaaagtcaagacctgttccatcctgataggatataatgtccattatcttgtggcacggaatcttaacatggatctctaaatgccgaaagatgccaattggagtgcaaagtctctaaatactgatcacaagtttggggcacaatcattctgaaaccataataggttttaaacatttgccaaagccacaaatttgacttttgggcttttgatttatggcttgtggaagcactgagaagctctgtttggcatacagtttgccttcctgtagaggtggttgattattccatagctgtgacttgattattcatgcattcaacatttattgagcactttttaaatattcaagaatatgtgctaaatgccacagatattggtgttaaaggtcaaaggccctgacctcaaggagctcacaattttgtagataaaatagaaaaataagcaattgaggacaatatatatagacatttatattaaggggaattttgagagcacagtgaagcagcattagaggcaaatataagtaactatagtttccagaatcatgggatacacaaactggatatttgggaactaactggagctagcctggggaaggagggagtgaggagtggggcattacaagtaagggaaatacctatatgcagcctggagtcttgagatacagtggagctgtgaggccactgctgtgggtggcaccagtagaatctacatcttttagaagcttctactgcattacaaggcaattatgctttatttcagagacagggagatagagaggggatgatgtcaaaaatttaagcagacgagggtacaattatatttgtactttatagtgatcacatttctatagaaatgtagagagtgattgcgaaaagagaagtcaataatagtgagagcagatgagacatgatgagggttgaattaaggtcacagcaataaggatggcaccttagatccatttctaagagagagatgatgagatctgatgactaattaggacacggggaatagtggcaaataagatgataactcctagaactatggcttggatgacctggatgataataccattcactgagaggagagttttggcagggatgggggtggcgcaaatcagcacaggtggggagatgaaggttatcattatttggaattgtggaatgatgcctgtattagtccattttcactctgctaataaagacataccctagactgggtgatttatttaggaaaaaggtttaattaactcacagttccacatggctggggaggtctcgcaatcatggcaggaggtaaggaggaacaagttgcgtcttacatggatggcagcaggcaaagagagagcttgtgcagggaaactccccctaataaaaccatcagatcttgtgagacttattcactatcacaagaacagcacaggaaagacctgcccccatgattcaattacctcccacagggtccatcccataacacctgggaattcaagatgggatttggatggggacacagccaatgcctgtgagataactcaatgccattgagatctcaatgcctgtgagataactgaagaagacattctagacggtatcaggaggatgatctgggccagacgcagtggctcatgcctgtaatcccagcactttgggaggctgaggcaggcggatcacttgaggtcaggagtttgagaccagcctgaccaacatggtgaaaccccatctctacaaaaaatacaaaaattagccaagcatgatggcatgcgcctgtagtctcagctacttggaaggctgaggcatgagaattgcttaaacctgggaggcagaggttgcagcgagccaagaaagcaccactggtggcaaagtgagatgagtgagactccatctcagaaaaaaaaaagaaaagggtgatctggtctggaggtacagaatgctaatgtatatctacattcgcttatgtgaaaacgtcacagggaaaaatctttctgacttctgtgagaatgatcacctgtttctctacctatagtctcttctcaactacgaatagataaaccaaacattttttttcccaatgcacctttaatcccatggcttttgctgaaacttggcatttattcaatgaaaccactttccacacaatcctctttgaagagtccttatctccatgattcattcttaaggccaagagggaaggttggctttcttgctgaaaccactgttcccatgagtccactagtgggacatttaacttcagttttaaaaggatggcttccttgggtggacaagggggaaaaagcattccagacagagatcagtgtatacaaaaactttgagtggtagaggtatatggtaggtttgaggaaaagcaaacagtctggtatgacatatgactagcatgtagaatgatgacagaattttaataggagccattggaattgtatggaccatgcttttggaattctgtgagcttcttattctcagtcaccttcatctttattccactgcagccatacattgatccaatttcaagttagaccctggcgtcattcaaacctgctttacaacagaaattgtcaccacatcctgaggcttctcatttcctttctactattgaatttttagcagaacctctgtcgcctggcctttccatacccatactctctctcactccttctctatcttgacatctccccaacaatcatggacttaatgagaagcatctcaagaatgtgtctgtcattgctctctaaacattcttgtttttgaccttcaactttccagtagtggaaagccccattttctaccttcttctcgtctagctgtaaagctattaatccacttcaaatatttattacctaattttagctatatatttgctattgctttgtggctttttctacattaattgttgatttttttaaatggtatttgacacgctggctgctccaaatttttccagtctctatattttatactcccagtaatgtcatttatatttattgataagtgaatttaaggttattctaaattctcttttagagttgtctttgcttccagtcacttttcaaacattttttattctacctaccctgaagaattaagggtggaatgcaggaaatgacaaacacactatagtaatacctaccattgatgtagcatttactgtatccaacctcgttgttagtagtgatagagcagagctcagtcctggatggtctgtcaaaaaaatttatgttctttccactcttccatgaccttagttatgccaagtaaaatagccatggaaaatctcattcacagactgcagtagaaatagctaagcctcaaagagcaagccacttacctagaaacaagtgctattgcaaaaatttccattttcaccgacataaatttagagttttttattttttaaaaaacaatcaaatttaatatgctagcttctcttttaagttggttatttgttgaatctagtaacagttgtaaataatagatggtgttagaatatcctgctgcattttctgtagagaaaaatgggcacaaatcaattgaactactactgacttctgagttttttgaaagtcttttaataccattttaatatataatttattatttggggttagaaacaaagaaataaagatggataagtatagatattcttccttttgtgtcttttaaaacctgtatgcaaatgcaattattgcatatcaaatactattttggcacttaataaaatagtttgttatttaaatactactacaacttgtataaatcataaacttattttgcttagcaaataatacctactaattttggggggataagtacagtttttttttaacataacattaccttaaaatgaagtgttaatagcttctaatgatgccattaattacattgtcaccagtttttgtatttaagggtagtattttacaaaaagaaaaattaagataaaaatgtctatgcaaaatgagcacttagatcaataattgcacattatatttgtacaatagattttttgtggaaaaaagtgttttttctctagcaaatacttagtatgtatcaggtactgctataagtacttttgaacacatttaattagactaagagtcctatgagataattaccactatcgtctttttcacatgaggaagctgaaacatggaaaggctgagaagcttgcccaaggtcatacagctaataagtggctgtgccaggatcccgacccaactgtctggctttggagtctgagctcttacccactgttctctctgctcctttactaaattaagtgtttaaaaataatggaaaaacatcgaccagccacttttaggcttccaacaaaagtgcagttaacaataaactttgttctaaaaatgacttatttgttttcacggactaaacaccacaagctgttgtatgcaataattctttgtaacagctgctctgccttgtgcaacttcccacaagcacaccaaaagttaatatcaattacaattaagggggaaagttattttgggtaacagaacatttgacaagtgctctggtaaacaaagcattgtcaaattgctaaattatgaacactttgctaaaactttttctgttttttctgtgctgacttttttaaaaggtgtaaactgtgaattggaaattgacgaatgttggtcccagccttgtttaaatggtgcaacttgtcaggatgctctgggggcctatttctgcgactgtgcccctggattcctgggggatcactgtgaactcaacactgatgagtgtgccagtcaaccttgtctccatggagggctgtgtgtggatggagaaaacaggtacattttctctggcgttgggtgattggcttagaactccctgaccatgaactattttaccactctgttgaatttagagctctcacgttctcggcttaaaatttggggtgtaactttatactttaactgatgaaaacattcagatttcactaaaaagggtattcttggagaccatctgtctcaagagggaagattttacaagtcattcttgtaatagtttagaactgcttatcctatggaaaatggccaatttttcaattccatgaaataaagctgttgtagataggaaaggtgcaaaaacagagctagagattattatatatgtgtacataagtttgtatctatatgtcaaggatataaatcagatgacagcaataaatccttttaaagtgttatataaaccatgttggaaaaggcagtgatatttaattacttatatcttgaattaatttccatgtgttcagggaattgggtgaatatttttgagaaagcataatggcgagaaatagccatgtgattctgcttcaaattgaagtctatcattggctttcaggcaaaatagaacagcaataaattacatctcaatatgatgaatataataaatgtgtgtaacagtaattgagctcatataaaacatttttaaaagaactttctaatacttatttaagccacgacactgaagaactttctaatctttatttaagccacgatgctgagttaccaaatacataacaatttttaacaagattagcacttaaaattatcgtttgattcttcgacagctcagtggaaggcaagataagtatttatgtttccatattacaataaggagtctaaagtttagggaaatgagaagacgcccgcaagttcacacaattaattctttgcaaaaggaagaccagaatggttttcctttatttagtaaataagacataatttatgccaaatctaatttcaaagtgaatcagagtcaaaaggagagcaataaaaggcacatatgcttcaaaaatttgcaaaaataatgacttttttttttttttttttttttttgagatggagtcttgctgtgtcacccaggctggagtgcagtggtgtgatcttggttcaccgcaacctccgccttccggttcaagcaattctcctgcctcagtctcctgagtagctggtattacatatgcccaccaccatgcctggctaattttgctatttttagtagagatagggtttcaccatgttggcgaggctggtctcgaactcctgaccgcaggtgatctacctgcctctgcctcctgaagtgttgcgattacaggtgtgagccactgcacctggctctcaaattttaatagaacaatgtggttgtacattctttttaaaatataacttttaattacattccatgtcttgcctttgacttttagttgtaccccaataatgctctaggggcataaatctacattcctggagacaggtaactggccaacacagagacagacaggtcacaatggaagtttccacacaaggcctcctagaggaaaaggaggcttacccttccatacttcactgtttccagaaagcatcaggacagaaacgacacaactttttgattccaatggaaatgtaaacaaggctgaaactttgctatcttttattctcctcacttgaatatgccatgaataatttccctattgtaccattatctcttattgcctaaatgttgagatgatagtcataagatcaatccaatataacctgactttatgttcccacaaaaatttaaaatgtttgctatgagatacattggaaaatcagaactgaaaaaaaaaaaaagaacttcttgcataccaaaggaattatgcaaatggagcttctaattccgtgaggtccactagtcagccagccaagccctttggcaacagggtttttgtcgctaatgttttacctatactagatttttagtaggtattttttaattgaacaaatggaatactgaatagatttctaacaacacatatgaagattacagtcacttacaatatttggtttggtgataaaaacacacacagccatagcgaagaggactctacctgccttataaattcatagatattcttttcccaagaccctcattttgcctaagctgagtgtgcaggtacattttttacaatactaaatccttgaggagaccccgacctaaattaaaagtctcctcttaataaaatcaacaactttcttcattagatttgtattttggggctatttgataattccagtcattccgttaataattagaaatagtaaggcctaaatattcttgcaatctaaaaataagagaacatcgtaagtcacaattcatttaataaaggcttttcctgagtttttcataatttatggtttcacttttcatatggaaccttattaatgggctctctgtataacagagtgccatgatggtataaatcattctctaccaccttaaaaaatattaacaattttattaagtgctatttagtagcaacatatttagtacttcagatatgtggaatactgtgtctattctttatatgcatacttaattgtcacaataaccttgtaatataggtactatattcaatttatgaatgaagaaactgaactaaatagtcatggtttgcatgaccctgtactttaaattttttaaagttaataagacattaatatggaaataaatcatgcattcagtcctgtatagataattccccagagtttttgaggtagtaagatgatgccatgggtcttgggttgatagacagttgaagaaacagtataaagatatctgatctcaatatgactaagagttgacatgaaaatttcatttactttccagatatagctgtaactgcacgggtagtggattcacagggacacactgtgagaccttgatgcctctttgttggtcaaaaccttgtcacaataatgctacatgtgaggacagtgttgacaattacacttgtcactgctggcctggtgagtgacaaaataccttccaccaattatttttcatttgtttagaatacacatatcgcttatagcaaatgaaatgaaaaattattgttgttaaatgttttaaatcaatttcttctagctaatattgtttagttttattcttcagtgctcacacatatttactgctatactaaatgttgtctgaagtaggttaccaagctgcccaatgatcataaccctctagaggaatagaagggaaaaatcaatggaaagatgaaattcagcatgatcttcatggagaaaaattcactggaagatgctcttttcttccaagatgttctcttatatggcaggaatatatagaaatccatgaaataatgttaaactattagaaacttgtattctcttaggcatttgtaaagagttatatttgttaatataataaaaagttaattatctataaaccataattaaagtttacatatagaggataattagacgagtatagaggtgatacaagaatcaatagaaaacagtatgtaacatttgtgttacattacaggccataggcaaatattgatgctaattttgcaaaacaaactgcctgacatacagctttgcattgcataacaacattttggtcaatgacggaccacatatacaaccgtggtcctgtaagattacaatagagctgaacaattcctactgcctagtgatgtcatggctgtcttaacattgtagtatcactcactatccatgggattgtggtggtccctcaggaagtattccaaaagaacgcattgttgtcataggagatgacagcttcatgtgtgttattgttgctgaagacatttcagtgggacaagatgtggaggtagaagacagtgatattgataatcctgactccatgtaggcctagactatggtgtgtgcttggttcttaatttttaataaaaggtttaaaagcttaaaaaattcaaaatagaataagatgtaaagaaattatttattgtttatttatttatttttattttttgaaacggagtctctctctgtcgcccaggctggaatgcagtggtgtgatctccgctcactataagctccgcctcccgggttcacaccattttcctgcctcagcctcccgagtagctggtactacaggtgcctgccaccatgcccggctaattttttgtatttttagtagagacggggtttcactgtgttagccaggatgggctcaatctcctaaccttgtgatccgcccgcctcagcctcccaaagtgctgggattacaggcataagccactgcgcctggcccataaagaaattattttatacagctgtacatgtgtttgtgatttaagctaagcattatttaagagccaaaaggtttaaaaatttgaaaaatttataaagtaaaaaagttctagtacactaaggttagtttttaagacagaaaattttctaataaacctagagtagcctaagcatacagtatttataaaatctacagtagtatacaataatgttgtaggctttcacattcattcattactcattgactctcaagagcaacttccagacctccaagctctattcatgttagtaccctacacaggtgtaccacttaaaaaaatcttttatactgtgtttttattgtaccttttgtatgtttaagtatgtttagatacacaaataccattgtgtttcaattgcctacagtattcagtacagtaacatgctgtacaggtttgtagcctagcagcaatagactataccctatagcctaggtatgtagtcagctataacatttaggtctgtataagtacactctatgattttcacaccatgatgaaattgtgtaatgacttacttctcagaacaaatgtttgtctttaagtgatgcatgactcttttttaaaatctaattctcattaggattttttgataaaaataaaagacacagcatctcctatctcctcttgctttatttactgggaaaaaatgataaacttatgattactcaaggcctagttatataagcttactgatcatctgtctctctctccccactaactttattgtctaagaaaatgataatcttgtgggtggaaaggaaacctggagactagtcaatctaatcagtagtagcttctggttgaaagatatcctattgcctaagagacatttaacatctttggttaaatacattttataggaaaaataaatgaaaatataaaatgaagtttggaatgctgtggcttggaaatctatatatgttatgtcttcccacttgcagataataaatgaggaatatttgctaacctttggtcatcaacttgacttaaaactgaaaatttggctgggcgcggtggctcacgcctgtaatcccagcactttgggaggccgaggcgggtggatcatgaggtcaggagatcgagaccatcctggctaacaaggtgaaaccccgtctctactaaaaatacaaaaaattagccgggcgcggtggcgggcgcctgtagtcccagctactcgggaggctgaggcaggagaatggcgtgaacccgggaagcggagcttgcagtgagccgagattgcgccactgcagtccgcagtccggcctgggcgacagagcgagactccgtctcaaaaaaaaaaaaaaaaaacctgaaaattttccaaactatgtagtttcatgttcttgtcaccaaccaacactcatgaaagatctctgtccagaagcagagggcggagtggatggtttaggagtaggatatgtttcctgtttattaactgagtgaactcgggtgagtttcctcttcatctctaagttcctcatctgcaaaagagggataaaaatactttacttgtagtattattatgaaaagtaaaattgtaaaaatagagccttgcacatattaagcactcaaaaaagggcaactatgtagcaaattctataccatgaggtggaaattatgtaggagggcgagagtttgtaatggagtcaggcagttaagaacatctacctcaagaaacccaattagtacatgttccattcattcatggattcaagcatttaagccacatggatttcagtggctaatacaatagggatctgggaatataaaaggtatcgtcccttcctccaaggagcctaaattctagtagcgagacatatgtcaaaacgtatatagtacaatttttggtacaataagaggctatactaaattctgtaaaaatgaatagagaagaagtgcagggatagcttgatcaaagaggcaccattttagataagctaaagatgactaagttccataaatgtattcactagctgtgtgactttggacaaattactgctctgagcctcagtttcctcatttataatatccacaggatggagctgtttcagagataaatccagtaatgtatataaaactcctggcttatcctggaccacagtaagcactaagtaaaagttaaataaatatcaaaattaggaagttgtgtagtccattacttatttaataaatgaagaacggaaggagaagaggaaagaaagaagcaagaaaggtggcaggcacccatagaaaagagcatgtctggctgggcgccttggctcacacctgtaatgccagcactttgggagaccaaagcaagcagatcacttgaggtcaggagtttgagaccagcctggccaacatggtgaaaccccatctctactaaaaatacaaaaaaaaaaaaaaaaaaaaaaattagccgggtgtggtgttgcatgcctgtagtcccagctactcaggaggctgaggcaggagaatcacttgaacctgggaggcggaggttgcagtgagccgagatcgcgccactgcactccagcctgtactccagggcgagagggtgagacttggcaaaaaaaaaaaaaaaaaaaaaaggagaagaaaagaaaagagaaaaaaagaaaagagcatgtccaattgtggaactttgaatgattgcaaaaatactggactgtgtagggctggaggtagaaacattgaactggggagcaggactaaagccagatcacaaaactccatatctgccctgccaactacggggcagagaaataacaaaatttgctttgttaatttcaaaagagttccctggcttcatggcagatgatcaaagaaaataacactaaaggcagggaaatctagtgagtagattcctaggtagtttgaagagatgagcctgtttgctagaacgaagacaacagtggttaaggttggggcgaggggtagtcctgagagtcacataggagctggaaatgatgtggggagtgagaaaagggcacaggtttaggacagttctgcctctgggtttctgccttgggttactgcatggatggtaattttgcctagatagaacatcctgaatacccttgtaacctatcttgctgttgtatacaaagataaaagttaacactacaaactactctatatctaagaaaaggagaccatttcttcagctcatgacttcactgccacagaacacaatggcaagaatccactgatgtaattgcctagggtcctcatttcagaagtaattaataattacaagaagtgtcagtcaccttaaatgcttactttcaaagatttcctgatgcccagatgtgattggaattgttaacaaacataatataagaaccccagggatgtgactcagtatcatgttgtttatttgttcagagttttacagaaaaatttgttaaaactattgaatacagtcttgactgaaggagtctatttatatacatggttaaagaaagcagcaaataaaatccccacagggcctcagtgttggggacaggactggcaagactataaatcagaatcttcctaatgttcacgattggaatgagataatgcatgagccagaaaagcaaaaaaaggatttatgatgattctaaattactccctaacctggcttatgtgtgtctcgagtcttagaatgagaagaaaattgaaaatagtccagcctttcttcaataagtccattgtggcacaacaaataccagttaataaaaacttattgtaaaaactattatttaatgtatttgaagaaccttaagtatgaaataataatattcaaaaggtagacattcaagtttaagagactctgaatgatctttgttgcggggggtcactacaaaggattgttgggtcttgatctgacatgttattttactttcctttttttttttttttttaactttttgactctaagtttcttcttcagattgttgagaaaggccccaagggtctttttgtaaaaaatatattacactgttgagctgcagaatttatgttgtggttatgatttaacatatgatctcatttaggtgtttattaaaactaatacaaaatgagcaaacacattacaatctcattatttgcttattaatagtcaattccctggtttatgtgctaaactaggattataatctaaattgttattttcaatctttgagtagtactagtgattgaaggtctactgcttacatattgctcagtcctggactggtaaataaaatgaacacagtctctgttttgtgaagcacacagcctgctgagggaggaaaccatatacacaaatcaatatatatttaaaattacaatgagagcaatgaaagaaaagaattgggtggcatgagagaaaataaggggatcttatttatatctgcccatgatggaaagttattctgagaaagcaatacaagataaagtctgaaaattgagtaagagttagccaagaaaacacttgaaggagagttttctagaagagagaaaaacatcacgaaggctgtgggaatgcagggagtttttacagttatgttaaggatgttgaattcctttctatgtgaaaggggaagttgttgaatgattttaaagtaaacacatactatgatttagtttacaagttttataattctcaactgtaaattgtttccaaaacatttctcagcagagttaaatgatattgcaaagggccttaggcgactgtgaagttgaattgtgtttctttaaaaatatgaggtggctcacgcctgtaatcctagcactttgggaggccgaggcgcgtggatcacctaaggtcaggagctcgagactagactggccaacatggtgaaacttcgtctctactaaacatgcaaaaattagccgggcatggtggcacacgcctgtaatcccagctacttgggaggctgaggcaggagaatcacttgaacccagcagatggaggctgcagtcagccaagatcacaccaatgccctgcaccctgggctacagagtgagactccgtctcaaaaatatataaataaaaaaaaaaaaaaaaaaaaaaactttatacatttcttttaccacgttacaaaacacttgatattatcctattgaccatcagtgttatatgtgcatcctactaaatttacattttggggcgagcagtatacatagtatataaatactcttacaaatcaatatggaaaacaacctaatgaaaaaaacaggaaaaaatatgaaatggtaaaaaaaaaaaaaaacacccccaaaatgttcagctcaatattaactggggaaaacgtaaaccaaagtaacagtgagatactatattttatccaaccagctggtaaaatttatatatttggtgatagcaaaggttggcaaacgttttgagccacattcacaatcatccactgctggtaatgtgcaaatggtacaactagagatgtttggcagcttttattaaaattaaaaatgtacattacttatgacccacaaattccatctctaggcataaactgtagggttaaactcaaaacgcttacacagacagccatgtataattgtgtccgaaattggtgggttgttggtctgattgactcttcaagaatgaagccacagaccctcgcagtgagtgttacagttcttaaagatggggtgtccgcagtctgttctttctgatgttcggacgtgttcagagtttcttctttctggtgggttcgtggtcttactggcttcaagagtgaagccgcagacctttgcagtgagtgttacaactcttaagatggcacgtctggccgcgtctggagagttgtttattcctcctggagggttcgtggtcttgttggtctcaggagtgaagctgcagaccttcatggtgagtgctacagctcataaagtcagtgtggacccaaacagtgggcaacagcaagagttatttcaacaagcaaaagcacaaagcctccacagtgtacaacatgacctcagcacgttgccactgctggctccagcagcctgcttttattcccttatctgccccccgcccccccaccccccccccccgcccacccccccccccccgcccacccacccacatcctgctgattggtccattttacagcgagccaattggtctgttttacagagagctgattggtccattttgacagagcactgattggtgcattttcaaacctcgagctagacacagagtgctgattggtgtatttacaatcccttagccataaagattctccaagtcccactagattagctagatacagagtgcctattgttgcatccacaaaccttgagctagacacagggtgctgattgatgtgtttacaaaccttaagctagacacagagtgctggttggtgtatttacaatcccttagctagacataaatattcttcaagtccccaccagattagctagatacagagtgcccattgggcatccacaaaccttgagctagacacagggtgctgattggtgcatccacaatcccttagctagacataatccgtactagactcaggagcccagctagcttcagctagtggatcccacgcaggggccgcaggtggagctgcccgccagtcccgcgcagtgcgctggcactcctcagcccttgggcggttgatgggacccggcgccgcggagcagggggtggtgctcatcctggaagctggggctgctcaggagccctgggggattgcggggggctcaggcatggcgggctgcaggttccgagccctgtcctgaggggaggcagctgaggcctggcgagaattccagagcagcactggtgtgctggcactgctgggggctcctgcgtaccctccacagctgctggcccgggtgctaagcccctcaatgccgtgggcagcggcgcccaccggccgctctgagttttgggccggcaagcccacgcccacccagaactcacgcagccccgcaagcgcccgtgcagcctcggttcccacacacatctgtccctccacacctccccgcaggctgagggagccgactccattctcggccagcccatagaggggctcccacaatgcaacggtgggctgaagggctcctcaagcgtggccagagtgggtgcccaggcccaggaggcgcccagagcgagcgagggctgcgagggctgccagcacactgtcacctctcataatgatattaattgcaacatcacaatagcaaaaatgtacataaaacaaaggttaaactgtaagacaatggttaaggcatggcacatctatattctgaaatacttggcagtagttataaattgtgagttagatctatattactaacatggctagactgtgcaagggagtgaataaagcaagttgctaaagaatgcagataatacagttccagttatgttaaaacagtcacatacactaaaactgtatgtatttcttacagttgctcgtatttataaaagcaaagaaaaagttcaagtagagaactttcattgatatttaatgttttaattatctataaagtgacaaatcatgttttactgttcttattcctggtcctaataaaataatccagctaagtccatgcaaatttaaaacaacctcttattctgtttcattgaatgctatgaaataaggatttacctttactttgagttttaagagaatttagtttggttttgtggatatttgctgacttttcagctattgaaatatttttaaatacaaattcacaaatgagtatttgaaaaattggaggctttcattaaaatgttcaggttaaatccaggttatcctgacatctaattttatttcaagtcttattaatcaaatttttctttaaaattttttggtcaaaattatttaagtgattttactgatactagtacttgtttccactaagcctcctcttaccagattccccttaccagctccttgagggcaggcacatcaacttgctaaatcaatgccagtatagcagtcaacctccttttaggcaaatgctctataattcaacacctttgacttagcagcttctctgaattttcatcatgcaggatacacaggtgcccagtgtgagatcgacctcaatgaatgcaatagtaacccctgccagtccaatggggaatgtgtggagctgtcctcagagaaacaatatggacgcatcactggactgccttcttctttcagctaccatgaagcctcaggttatgtctgtatctgtcagcctggattcacaggtgaggccaaggagatgggatatgacttgactttctggtattttatggcagaccatggctttaaccaaatggtgtattagcaggaagagctgtactgtgtaaactctgctgctgtggtgcaaagggtcccccttgtgggcatgaaaagtatcttgtttcacatttcagaattcctcaaatcacgagagaaatattaaagagggataaaggaggaatgaaagggatgacatttttatatgctatactgggaactggagtgcatctcaagttctttacgttacacacagaaaatgttgaaatttttatgctatcaaatttgataatgatgttaaattttatgttattcaaatttgctagaaaagttattgtacttatatttacactgggaaaaatgacctagtctcaagtaatcttcctcaacgattctgtagctaaagtcattccacatatcaaatttaaattactctttttttttcacaacttgcttacctaaaacccagaggaaatttgcatgtatgttatccaatgaacagttttgtattgtctgctttctgttctgaaaattttcagaattattgaggcattccccaattcattaatggctagcaatttacctacaattgcattgatatcactgagaaaaccaattacaatctagatctctatcatatttctttctcaatagattaagtgatgcctctggaaaatatatcagttgttgttgaggatttctgagaaaagtaaatgagaaataagaaaagaagggggtgtctatttacacttaggattctctttcaatgtttcagttttgaaatttaatggtctttgatttgtggcagtgtttgctgcaaggtcgataaaaaaaatgtttatttccttattcactgacctttcaaggagaacatacagtaaaaaaattccccaggtgtcaatatcaggaaagtggtattttccctgaacaacttctatcatgcatgctttccaccctagtttaaaaaatgcatccaaataaatcttgatgtgactcaactgattaaatgcatgaaataaatcttgtaatatataatatttcccaattatgtaagctgctagaaataaatatgagatctgcaaacatacaggtctttctgaaatatatttgtgtatttacctcacctctggggatatttaaatttcctgtttctgtttcttactattgcctcttttcaaaaatttgtttctaaattatttgattttggtctagtgtatgcattttcgtcagctactttatatttttcttggaataaggtgaaggcattataaattattttttaaatattggttttagggtcataaaggggtgattctgtgaaagtcaaaggacattgctaatattacctcatcaaataaaaggaaatgggtgaccccttgaatctgcagatctaaaaggagagacagtagaatgttccagaaaagtgttgggcttgatttctgaagagctgccaggaatgactatatgagttaagatgtcctgactgccccaaatctctgtggcttaatgcaatggtttatgttttactcatgtgaattccaaaactgggttcccatcatcagttgtcctacaaatggcaattcagggtcacaggctcctctatgtttttcccccgcttcaaaatgttacttccaaatttgctgtgctcttatgaagcaagctactggagaaggaaagaaaatggagtgtgacacctgcagattttatgggccaaccactacaagtaatgaatatctcttttacccacatattactggtcaaatgtaatcatgtaactacatttaattgcagaaaagacgagaaaatctagtctttctgtgtacctaaaataaagagaaaataagttttgcaaacagataaccaatttgacacaatagctagaactggtacactggggatacgaacctagatcttctgattctaagtttatcctcctgcctactatgtcacatatttttatgtctacacgtttttctatattttgtttttaaataactttttaaatgataatagtatatttatgtgcagttttaagaaatacagggaggcccatgtatgctttacctaattttcccaatagtaccatgttgcaaaactatagttcagctatcagacttgcatattgacattgacaaagtccacatccagaacaattatcatcacaaggatgccacctctctccttccctgcctcctcatcccttatccctggcaaatactaatctgttctgcacttgtataattttgtcattccaagaatgttatataaatggaatcatgcaatatgtaaagttttagaataagagtttttttttttttccactcagcatcattctttggagatttattgaggttgtgtgtatcaatagtttgttccttttcattgctaagtaaaattcgatggtatgtatatatcaaagattttttaaccattcagccattgaagggcatctagattgtttcagttttcggctattaattcataacagccgctgaataaagctgctagaaacattgttgtacaggcttttgtgtgaatataaatattcacttctctaaggtaaatgcccaggagtaaaattgctggttcctatgatagtttcaggtttagttttctaagaaactgtcaaactgttttccagtgtgtctgtaccattttgcattcccaccagcaatgtacgagtgatccaatttctttgcattctcaccagcatttaatgttatcactgttttttttaatagtcatgttgataggtatgcagtgatatatcactgtggttttaatttgcatttacctaatgcctagtgatgttgaacatcttatatgtgcttgtttgacatctgtttgtcttttgcaggaaaatgtcaccccatgttttttgcctatttcctagttgagttgtttttatttttttaactgttgagtaattttccacatacagaccctgggcgttttttgtgaggttatacctaagtatttcattttcttttgagggatagtaaatagtattctgtttttaattcagtttctacatattcattattagtgttgggaaaggcagtattgtgcatgtggcctttgaaacccctactcagccacataagaatgggccttgggcctagaacacttccttcccaagagataaagcgtcctcgcagaccatgctggagttatcaccttgtgtgggaatatctttccctgtttcagactcaatatgtactccctcgttctgcttaaacatatgtatcatatggcacctagccagccccactgctgtaactttcttctgcggggagggcaaaaggttcttctgctgcagcatgaaatggttgcatgctgccaactgccccgcatctgctgaaaggaggccctgctgtttatggggactgcttatggggtcaccacatagctgaccttgctctgtctcttctctatgtgagtaaagcattgttccatctagtacttgactgtgttgtgttttccttggtaactccaatactaaaatgcagtggccaaacgtgtccagacttttactcctggtaataagcaacagatgccacttgccaaagagctagaacataaaaatatgattgtttcttggttgttgattgtgtatagtgagactttgtttaactcacctatgagatctaggaattttctttttgtagattccagggcattgtctgcatggacaactatgccatctgcaaagaggactggtgttatttcttcctttacaatatacatgctgtttattttactgtgttgagtacgagttgtgagagcagacgtcttgcttcattcaccattttagagggaaagcattcagtcttttaccattagctatgaatttttatcgatgctctttttcaagttgaagtagttcctctctactcctaacttgctaagagtttttaatcataaatgggtattgcatttggtcagatgcattttctgcaattgatttatcatgtaagtttcttatttagcctattgatgtggtagattgctctggttcattttcaaatattgaaccagacttgcacatctgaaataaatcccacttggtgtattttttttcagtttgctaatattttatgacttttttgcttctaagttcatgaaagttattggtctatagttttctttctctctctttttttttttgtactgtctttgtctggttttaagatcaaggtagtattgacctcataaaataagttggaaaatgtttcttaattttctattttctggaagagagtatgtaaaattgatgttaattattctttaaatatgtagtagacatattcagggaaatcagctgatcctggagattccattttctggatcttttgaattgcaaatttaatttcagtattgttatgagactatcaagaatacttattttcggcaatttgtggatttcaagggattggtcctttttttttctaaaaattgtgtattttgctgtcgttggatggagtatttctatatatgtcaattagatcatgttggatgattgtagtgatcggatcttctatattgctgatttttctgttgaacttctgagcataatgttgctcataatattgccttattactcttttaatggctacagaatctgtaatgatttctctgttttattcctaattttgactatttatatcttttctccccttttatgtccacctttttacaggtttatcaattttactgattttttttaaaaaaatagcttttggtttcatttattttctctgttttcctatttgcaattttattgatttctgttcttttttatatccttatttctgtttgctttgggtttattttctgttttttaaatttatttttatttttctagcttcttgaggtaggaagttttattactgatttaagaccttttcttttttctaatatataagcattataaatttaactctcaatagtgcttcagtagctgcatcccacatattttgatatgccatacttccatcttaatactgttctgtgtatttttaaaattcctttttgacatcctttttgacctatggatgatttagaaataagaattgaattgtttaatttctgtttagaaatttttctcttgtctttctgttattgattttcagtttgatgccattatgattagagaacacattctgtataatttcaaataattcaaattatttcaaatttgttggggtttgttttttggcacaggatacaatctatcttggtaaatgttccatggttgcctgaataaaaattaaaaaacaacatgtgttctgctattgtttagaggcgatttctatatatgtcaattaaatcccattgactgatggtgttgttcacattttgtatatccttactgatacagaatagcactgtctagcagtccattacttgtttagaggagaggtgttaaagtccccacctataattatggatttgtctctttcttctttcagttctatcaatttttcttcacgtattttgaggctctgttgtttgatatatacacatttagggtcattatgtcttcctggtgtgctgatccttttatcattaggcaatgattttttttctcatattcttttcttgctttgaaatctagttcatttgatattgttatagccattcctgcctttaaaaaaattatatttacacagcatatatttttccacccttatatttccaacccacttatgtcattaaatttgaaatgattttcttgtaaacagtatatcaaacagcaaattgttgggtcatgcttttttaattcatcttgccaatttctgccttttaattgatgtatttagaccatttatgtttaagtaattattaatattgtagggcttagctctatgattttattatgtgttttctgtttgattcctttctttctctttacttcctatgaattagttgactatttttgggatttcatcttgatttctgtatagtgtttttaaatatattactctgtgtaattttcatagtgattgctctgggtatgactgatcacagcctattggtttcagtattttaccacttcaagtgaagtataggaatttcacttctatttaggttttttttttttgccttcttcactttaaaatatccttgttttgaggatcagatggtgttataatttttattttaatcattacatataatttagaaaactcatgaaaagaaggatactccattgtgtttacttatgtgtctattctccattgtttgtcctccccaccttaggcctcaagagtctttctttttttttttaaatcattttatttaggtttacagagctttctttagccattctatgagggtaggtatgctagtgacaatttcttttggttttcctttgagaatgtgtttattgcacattcattcctgataagtagttttattcaatgtggaattcatggttgacagttcttttctcatggaacttgaaaaattctacacaacttttttttctgcaccccatggtttcaaatgagaaatctgctatcattgtaaagtggtgctgggtgcagggtttgggggaaggaaggccggctcggcaggaaggcaggtttgcaggcttttgctcccttttccaaagaccaacaaagagaactttcccaactcccaacccaagcccttttggaactgtgtgtggttgttggcatcctgtggtgcctccttgccatccctgccctttccatgcctggcaacgggtctttgtggctctgcagaatggagatttaaacccaagttcatggcaaaacatctgaagttcatcaccaggactgtgatggtataggaagggaacgtggaaggtgcatagaggaccctaaacagaatcctcactacggatgggctcactgaggacattaagcttcggcggtattatgagaagccatgcggccggcgacagagggaaagctatgaaaagtgccggcggatctacagtatggaaatggctcacaagatcaacttcttgatgcgaaagaatcaggcagatccgtggcggggctgctgaggcgggcagatccgtgggtgggctgctgaggcttgtggatgggacacccagtatgaaaccctcatccagttttgtctccatctcttttttttatacaatcccatttcctattacagttctgcaataaactcagtaaactcaaaataaactcaatatgtttgcaaaaaagaaaaagaaaagtggcgttgccctataggtaatagattatttctatctaactgctttcagtattttttctttgtctaattttcagcaatttatttgtaatatgacttggtgttaacttatttgggtttatcctatttgagatagtctcaccttttaaaatcagtagatttatgtcttttggcaaatttgggggcttgtcagccaatttttctttgcatattctttcagatccttttttatttttccccacttctgggactctaatcatacaaatattgggtcttttgctatgcttccagaggtttctgaggctctgtttttatttttgtttcagtctattttctgccttttgctcagaatgagcaaattcttttgatctgtactcaagttcattgattctgttcttttttgtctcccatctagtattgagcccattcagggagttacttcatctattgttttttacaagtctataatttccattttgttcttttaagcaacatatgtttttgctgatacttctgttttttcttcatctcaggagaatttgtaattgctttttaaatcatttttatgctggttgttttaaaattcttgttagataattccaatatctgatttatctctgggttgacatcatttcattttattttctcattcaagttatggttttactgatccttgtgatgacatgattttgaattgtatgctggacattttagatattaagttaggagactccatgtcttctttgaatttttgaatttagcagacaatcacctttttaggttttaagaacaggtcctggcctacttatgtggactgtgggtccaatgatcagtttattttctgattctttgctgtgttgttttgacctccttggcttaccttgtgccattgggcctcccaggatctctactgatgatccctgagtggtcagaaggtgtttccttaggtgagaatgttccatgtccttctgagaaatgggagtctttgatttatggagatgaagaggctcctttagtgggtgttgtggtgagcttctccctgtctctgggggtagagagcatttcctaggctgaatacctgttgtggcataatcccctttactgatcccccactcacagggtatctcttgatggaagtggggagtctcacaactgctaaggaaggaaaacacttcacataacaggccattgtggtagcataattccttttgccatggcccccttgcctatgatgcctctggggagggggggagaagggaggctcagcaacagaggaggtaagctctttctctggctgctcttttttcttttcttttctttttttctccttctccttctcctccttctccttctccttcttcttcttcttcttttttttttttttttatcagtagggctttgtttaattctctttgcccattcttccaggctcgccttgtgttgtaggtgggactctcgttcaatctggggaaagaaagagccaacctcggccaccttctcttgtttctgttgctgaccggggatcagcaaacaccaggacggaggcacctccttgtgttatgctggaggttataaaaagccctgatgctttgctgttagtcctggggcgtctaaccagttcaccttcctcttccacctttcagagttctgtttggttgttacatgtagtttttagtcatgcttagtggggagaaacagggagagagaagtctatgctctcttgtccagtctaaaagtccctatgtaacatttgttaaaaacacttgtgttatagtagtataaagaaaaaaaatttttttaatggcttcaggtagaaaagcaagtgttaactttctctttatcttcctgatagtaccaagaagttcaaaatatcatttatttttatcaatgactatatttataattaattattaataaataacttactatttcccttgcctttcttccatcccgaatagttggatattcaactttatttttatttgttatacgtccattttatattctgcagatagaaaacatacagtttacttttttacatgctatgtgtatttatagctctattggttgttagattaaaataaaatttccattatgttgaaaaatgtatttgtgcatagtacatttactgacagctccattcaaaagaacctttccaagtgttaaatacaggtataaactgttctttttttgtattataattaagaatgtatttattactcttcactacttgtgtaattaccttctatattgaaaatatttgcatatgtaacgtaatttttctaactttttataatgtaaaaatgatatataccagagtagaaaattaactgacagtctcagaattatactcagggagttagaaatagagagagcatgagaccatggaagatgacaaatgaaaacaggaactcaaggaggcagagaatcctagtgagaggaatcaagaccccctgaaggaggattaacttttattcaaggtttcttctagaatttccagccggtaaagcaagttaccatggcccagagaaaccaaaagtctcatttggtaaggtaattgagaaaaatctaaagatccatttagatattttaatgactagaattgaaccatgcctctagaggcagtagtggttactattctctaattctccaaaatcatttcaaaaaaaaatttggcaaaatatgctcatatcttgtcataactatttgtgaccatagttgcaacactcaaattaaaatgagaatgggacattgccacttgatttaaatgtctgtgcatttacttaaacctgcacatccacataattttaatggtaagcaaaataaatttataattggagaaggcctgtagttgaataatactattcagtccattccaaagtcagtaaattatctttattttgtatgaccacccttgaccactactagaaggaatgttggctgcttctttgtattctgtttgagctttccagtccggggcactgggctcagttctggggataaaatgatgagagtacatggtctcttcccaagggaaaatgaaagaacaagaggaaaatgatgcgcaaagtgtaagacaatatgataactgtcacagtggagccataaaaaggcaccattagataaatcaataaagaggaacttttgtgctgtttatgccagatagaagttagtggaaattataagaacccaaacagcttgataaattcacattttgaagtacaaatcaacgttactactgaaacttttacaaggatctcatgacctgtgtgcttacccttgaaccatcctgttctaaccagccaagtgaaattggaaacaattgatatgtctttcacgtgaacatttcatttctatttatcaaactatactcatgataatacccttaacaagtttccaaaccatctcatccaagtccaattttcatttctaactttccctcaccaactccaattagcatgtactccaactcagaggaacaccctccctggtctctggaacgctacattgttgcctctgaggctgggattttattctacttcacccatctgctctctgtatggaaagaactgagtgcagcaggggatcctatgaagtcctggcttcaaacctcgggcaaaaatatcgggtttcttaacaataaacaccccgatgagagccacctggcaaagtgactgcacacagggctttcgttctcaagttcatccgcttcaagcacaatgttgctaaaaatgaagcgttcacttttccttaaaagtcaaatcctgtcactttacctaaatccaactaaaatagccatagagggccaagcatatatcattcaaagcttcatatagtcatgaaggaattaggcaatggtacagtcaatatctcctgctggaagagaaattttcaatagaattttttcatttgctgacttcacatttcaggagcattgttcctagaaatgcacttttttttcttacttacaatttcaaatttgagaatataaatcctaggactctcaaacagatatttgatatgcataaataactgtaactctaaaagatgaaactttgcttctatcctcgtttacttcataaaacatcttttcaagattcatctgattcatttacctttgcctttaccatgcatgttaatttctatgaacaaaactattcatagtgtgtataactatttacgcttgtactccttttgattttactatgttagctgcaataactaggacaggtataccacgttatacatacattaatttaaaaaatgatttttgttgattgcttactgcctattatttagaaagatattatagcaaggaggaaaatttaaaggctaatatttggaagaccacatacagaccaaaacagaggcagatatgtttgtagaccctatgacagagatagataactatggcatcaagggccttggctgctgtctcaggttggcattcctctgttgacttgtaatcacacaagtaagggaaaagctctcaaatgaataatcagcagacaggtgccaactcttcaacttaagtatgctgaccaatacgtattagaaaaaatttctgaaactaaagaacaaagccaggaaatccatcattaaagtcttgaggtgctgtcctggcaacttagaagacctgaaaggtagattttcataccagagttctattttgatgagagagatgtgggcctcacccatttaaaagagctttcaggagagtaatgtttcctgagaatagccaaacgtttgttagagtaagaagctgatgaaaatgttcattggggaggttgaggatattgggagttgtcctcacagtagaccatcctgcgagctctcatatgacgtggtctagtgtgtgtttactactcatgaggatgcccatcttgacatcccatgctttttttctaactacccaagatcccaaaatgttttttattaagcatgttaatcattaagtacaatattattgacctacacctgacctaataaatgattaattatagctcttttcccaatgtctactacttagtttgttgagagagtctgtcttctgatattaacacagaagaccctcagaaacacccctctcctcctgcatcccctccccaaccaccatgacacgcacattcacctagagcttcacttcagtcccaagcaacccagttgcgagggcaagaaaaagtatccaaaacctcttcctgagaccaaccaatcctcttcctgaagaattacatatccctttctcaaaagaggttttattatacctgccattggcaaaaaaaactacccccttagtcattacttaggaaacaattaatttctgaagaagctataatcagcattgattacaactttccctaaagtacatcaggaacaataccactatgacttataagtctgcttacttcagtcacccactgaagtcccagcgtcccagttcatcatttctggtctttatcccagaatgctctctacataccctaatttcatgcaattttctaccccattctgaacttctctctgtatgctgaagatttaataagcccaattaccaatatcctcaactttttttctaaatgtttccttcacctgcttgcttaagctcaaatcatgctatattctcagggtaccatttcttctgcaatcttcttgaatggtggttgtcttttattcttcttccaaatctcatgtttgactagtcccaaaggtaagctaaatgtcctcatgtcattgcttcatctaggaaattagtcttccatcctcattcagaattttgtatccagcgaaactgagcctcataaatgaaggaaagacacaatctttttcagacaaacaaacgctgagagatttctccacttccaagccaggactacaagaactgctaaaaagcagctctaaatcttgaaacagaacttcaaaatacaccaaaatagagcattcttaaagcataaatctcacaggacccataaaacaataacacaatgaaaaaaaaccgcaaggtatttatacttttgttgacagaaaatcaacaaagaaacaatggacttaaactatactctaaaacaaatggacttagcagatatttacagaacgttctacccaacaactgcagaatatacattctactcatcagcacatggaacattctccaagatagaccatatgataggccacaaaacaagtctcgagaaattttaaaaagtagaaattgtatcaagtacactctcagaccacagtggaataaaacaaaatcaactccaaaaggaactctcaaaaccatggaaattaaataacctgctcctgaatgatcattggatcaacaatgaaatcaagaaggaaatttaaaaattccttgaactgaatgataatggtgacataacctatcaaaacctctgggatacagcaaaagcaatgttaagaggaaagtttatagcattaaatgcctacatcaaaaacccacctcatgttgaagtacatgtctttgaactgcactgctcactacctcttttggttgcaacattcttcctacctcacggtaccttctcctcagtcactgattaccttaatatcttactcctgtcatcattttgaggatttcagcatccgtgtagacaaccgatacaaaccattatctctgttatttgaaatccttatttccaatgactgtgactgccatgccacacacacttctgcccacttctttggtcataacttaggccttattatcgctgataaccttcctaaaaacatcactttaaatcattctgttttatgaccagaacctccaattattccagttcatatactttagaactttttccgttgagcctagtctgttgtcttaaccactttttttccagtcattgcctcacttaccttctgtctcagctaaggtttcaaggtccagcactataattattcccttgcatataccttcggctcacctgattctttctctcttcattgtacttgcctgacaaaggtacaattatggttaaatcaatcctctaccttctccacacttacaaccaatttgaatgtggttggagaaaaactcacaagccacacactgaactgttgagtgtcactttaaatttatggtgccaaatctcatggggcctttagcactagataaaaatccttctagagctctacttcccaagatgagcctttttaaatcttctatttcttcaaacttccaatacctcctccctcattgttaccctaagttgatcatcaagtctaatttcatcaggaaaatagtatcttcctgccaccaaaagtgttgtcagttctgaggtttgatttttatcctttttacaagctcatacgttatcctgttcctgttttgtgaatgctggcaaaagacataaaactttgtgtcaggaaaaaatgcacaaccagcagcatgagcctcaggtttacatgaattacccttgcacccaactcccacagggttggtactacatgggcccagatgagtactgcacagacagatttttgtcgcaactgatgaacatcaagttggggaattcatcgcttttacggtaagcagtaagaagcctgctccttgtcccagagggagacattacttcattcttcagagatgcttgctgcaaaaccaaccccaagaaatgggcaggtaaagatcagtcagggccttgcattcttaggattcccagtaagaaactgccaggacacacagggcccatgatgagttgcttcttccagcaatccatcccatgaccccacttgttcttggctgaactcgaattttcatatgaatatgccactccatgagccaccctgcttaatgtgactgacagagactgggattaaatctgttcaatttgcctcatgcagcatttaattaaggagactatcaagaggactctaagcaataagatgaagtcaacctgtagtatacatttcaactctactccccagggccctggactcagccaattgtacataagtcccaggggcaccaatcatcatcttaactttagatagccagaaagtagtctaaagccagtcagttatccattgtgacccacgtaagggagcttagattgacatactgatctttgatgtcattaccaataatgacaggggcaataaacgagcaacactaacccccaaaggagagacattcccccacatacaaacatataacacaaagggacagactctagttcagaatttctggttaaaattgatttatacctttgttacattggtttggttaattcagtacaacagaagcatcgcttgcagctcccattgccatttatggcaacacttaagctgcctgagtattaggaaaagcgtatgaatatatgttattaagattgaggttgggcacagtggttcacacctgaaatctcagtgctttgggaggccaaggcaggaggtttgagaccaggttaggcaatataatgagactctgtctctttaaaaaaaaaaaacaaataaaaaaactgaaacaaagttgtgggacctatctctttgtacgcatacaaggctgaggaggaggcagttcaggagcttccattagtggtgtcagctatggtgaagtagtttaggaccagccaagtttgcaagacttttggtgtttttataacacctggacagggatgacaaatcctgtagtgagtttagattgtcaactgcagctgctcctagattcagctagaccatacaattgttttgccagcctgcattgctgaatctaaggaataagaagcctaagtgcctctctcccctgaactgcctggggtttaaagtgatctgtgctcgggtgctagaattgttattctccctccatggccatgaaactagggtgtcccaacccagtagctataactttacctcttctccaatcatctgctcataccaataccttttgtccagagaggtcagacatgaataggaataggtcactttaaaaaatatttactgagattcattcattatatttcccacttagtccagttaggttactataagtaattatactagttggtgaatagtatattcaaccagtgttcattgtctttatgatctaagaccatgttaattcaataaaagaatccaggtagctacatcaagttaagtttgaatctcttagtctcccctttagatgtggctgcccttcaaagtgtgtacaaatcaggctgacatgaggttgtcactaggggaagaaaatacacttcaggttcataaatggtcaaggcataatcatgaattttcaaaataagtttacataatttttctacccatccatcttgatcattacctaggagttggccaacaggagacaaatctttcctgcccatggccatatttaatgctcaaacagccttaataaactgttttaataaaatctgtgggccagaaagaggcaaagaaggtagatacagaaaggagggagagtcagaaatcttcaggattggtttccaaaaagtctattccatatctcaatgatgccagcagccttatcagagaatgataagagtgtggaatgtccattgaatatgtttactactggcccattgctaggtggcctttatgacaaaaatacaccattgtcagattgtagatggtcttgaaaactgaaaataagaatcagattatcaaactgaaatagcagcaaaataatctaaaaatatgtcaatattagcaaggcaccaatggtagtcccaagagagggtcagagatctgacacagccaattttctagaagtgagcagggaaaatgctccttgtaatgtggcctcctttactgcaaaacaatcaggccaatttttggcaggagtctcctttggtatgcagtttctagattagaaacatatagtcctttgctgtagttcgtggtagtggatatgttttctggtaagaggatggatccagataatgatggaagccatctagatagatgctgggtaatccatttgattctagttgttctcattaggggttatagcaacagccaccagaaaaccatactatcccccagttgggagtgcaaggaatggaggatgatggggagattagcctatgggagtggacgtgggaaaaggcttggtcctttctaaggggctggtgaccaagtgccagagctgcttcctatccatgtatatcctgatatctgatgagtgtcagggcccagaggaccccttttttcttgccccccctgcatgccattgtgctctgccctgtcaaagggtagtcaccaagcaagaacagtgccacacctgagtaagctagtaacttgagatctcatataacaatgttatttcttcttaaagaagttgatgttgtggaatagggagggggaggaatcaggggtcatagagggagagagcagctcgacactagtaaacaaggttttacattcaatttcactttcaattcaatttctcttgcttgtggctcaatcaaataaactcatcatcatcaaataaaatcatcatttttttttctaactaaagttctatattgaattgaaatgatgtcattgttgactccatttatttcatctttcagtactccttgactcagctgtcacagatacgttgccttctggctggagccacagggcttgctgccctattgtcataataatgttttttcctcctcccacctagaggagagctagaaacaaccaaggcaccatataaggctgtttgttttaatcccaatctgattgatgggcaggaccttgggggtcttttgcttccctctttcacctaccatttcagtgggagtccagggaactcatcttctacatctgaacccatcccaaaggctcttaacatttttcttccagaaagacatgtctctttcaggatctcatctttgttgccataactgttgggtctgagatttaattttaccctgtttataaaggaatgagttagcctgttactgtttcatggatgctggcagaagacactaaactcttgggtcaaagacaaatgactatattactcacagcacagcagactgcatgagtatcatgtttatgtaggtttcttttgcattcaagtcttacaggggtgatttgctagatggatggtgtacctgcagtggatttgcatcacagctgaggaacaatagcttgataaattatctgttttcatagcaggcagtaagccaatctgttttttgtcccaactttgaacctcatgtttcaaagttgcttgctgcaaaaaccaatcctgagagatggcctgggtagaatggtaaggatcttgcattcttggtacaaccaacaagaattgcagtgatcctcagtgcccatggtatatggactctcccaacacctacctatctatctgtcactcatttacttgccgcctcccaattcctgcctatgtttggactacttttccattacaacattcccacctgaagtttacttatgcatggcaccctgttcattctctatgattcaggatctttagcaattattctttatacatcttgcatcattgattttccactctattctaaatcattctaattggcttgcctatctatcctctggaaaaaaaatgctccttagaatgcatacacctcctcagatatcctcttctgtattccaccctcctctaaagagatgtgtatacttactctctactttttcacttcccggtaacctccccattaaggcagtttttgttacttcggtgaaaacttccctgtcaacaatttccatttgctaatctaaaacttaattttaagtccttatcttaactggcctctagtttacagttgttctctctgacctgctggatataatttctttatttaacatctgcccccttttcttcttgttcactatcattctattgctagcatatcctctattttctagactctaaatgctggagtcccctaggattcaatccttaaacatattttttcaccccttggaaaatctcatgtaatctcttgactttaaattttagatagatgtttacaacatctaaatttttgtctccagccctagctcctctcttgaacttcccttaacttttgtatttagatagctaaaatgattttcaaacataacataacccaggcaaaactttttatttttttatcttcatgaaacccaaaagaaaaaaattaagctaaagcaaacaaacaaaataatcacaaaacaaaacaaaaattcacaaaacgacaaaaacacttcttccccatctcagtaagtggtaacagcatattcacccagttggtcaggccataaattcaaagccgtatttggtttctctctttctttaatatcccacatctgattcctccacacagtttgttggcttctcctttaagctgtgtttcaagcacgatcatacttcccacctctaccatttctactctagaccaagccactgtcatgtctcacctcaactacttcaatagcctaatgttttggtgttcttccattcttgactttctaaatcagttctccacacagctttggtagtaacataatatgcatcagatcatgtgagtcttccattcaaacagtccagtggctcacatgttctcaataaaacttgtactccttaacatattcttggaagcccttgtgtgatctgtccttggttatcctctccaaaatcacctcctgagtcctcactctcttcactgtagctaggctgggggtcttaaagttacttggttaggccaaactcatttctgccttaggggttttacatttatttttccctttacctaaaagactacagatttttgcatggtgattccctcttttaaatctttattcaaagaccacttttccagagaggtctatctaaacctcccacaaaaatgccacctctctctgcaccccaacacatacaaacacatgctctatttccttacccttattaatttcttcatattacttatcactgtgtgatcttacgcacacacacagacacacacacttccattaatttttaatctcccctctctcagtccttactagaattgtccaccatgaaatagactttgaacatcttgactactatagctccaggacctagcacagtgcctagcccataacaggaggcccaaccaatatttcatgaatatcaaaatgctgaaatcaatcagttgaagcttgagagaaatctcaggactctcagttgtaagcattgatcatcaacccacatgtcaggtaaagttttgcccttagcagctaaaaactttaataaaccttttgaagattctttcattctcctaatccggaagtaactagatgagcctcagaattcttgctctaattatagtgtatgccatattttgataaattaagttttccatgccacttgacatatcataatttgaaaaatgtgttctccttatttcagattgatcttccattttcaagagtatctaacaccttatctttaagtttctcagttccattttcttcctatcaagaatctaaggatttatttattcaaaaattcaaagatattatatgagcttacatttttatgagaaaggcttttgttaaaaatgaaacctttttttatgaactctttttttaatggatcatgacaaacctataggggtcattactggaaatgtgattaggatcatttgtgcaatgaagcacttcctagcttaaggcaaatttggcctagctctagcctgctgtatcctcccggcactatctttgagtcaagcgtatgttcttagttaattggcttatggcaaaagtaattttgtcagttagatgtttccgtagagctgcccttgctgagttagtgtcttaagacagagccacaaggttttgttgacatgtaagttttctggttgttttttccatttttacttcctgacatctcccatagtgttttaaaaaagaggaatggtggctagaataaagttatgtatgggcaagccatttttggcacatgcgaaaccatcaattcttcaagtatcaaacaatgatatagatgtcagccaatagcgtaagatttttcaaattcgatcaaacaaaatgtcctgctctccacaatctaatatttcttcagattgaatttagagtttagatcaagatgggattactattacattttcccaggtggctatattgatatcttacagctacagattaatctttctccattttttcctctcttttctcttccttgtttgctcttacctcctctttctctcaattataatggttcttaatgaattcattatgtaaaggattctcatatccaaaactctatgaaccctttccaacaaaagggaactagacctacttttgatgcctctaagatgcagctatataaatttcagacctgtttttcactcctctcatggtagtctgaccccaataaggaagagggtctgaatgaaacatttcataagtgtcacagataatctactgctgaagctgtatatgtttattgcttttttcaaagagtttcttcagaattacccctttcaaaataacagtttactctctactgataaaactgtaatcaagatctggttatcatcttttgttaacattttattgaagtatcacacacagataaaagtgtacacataatatatttatagctcaatacatgtgttataaagagaacatgctcatgtatctagtacccagagcaagagcatggttaaatggatgctactttcttttgaaggagatgactagtgccagtgtagttagtgacagaggcaaaattcagttcaatcatcaaaacattttcagataattaaaactgtctacaaatgagacaggcatccttgcaaagaaaaaagattctatgtgattagagttgtttgtggataggaaagatggaattcttgagtggttggttggactggatgacttccttgggtctttccaaccaaagatgtacgtaaaatcaaactctgaagatcaatgttctaatggtaacatcaaggcaattataaatgtacataataaaatagtattttctaaagatcagtgaaaatgattcttaggagatatttaaaaatcatttttcttttcttttctttcctttttttttgagatggagtctcgctttgtcgcccaggctggaatatagtgccacgatctcagctcactgcaagctttgcctcctgagttcacgccattctcctgtctcagcctcccgagtagctgggactacaggctcccgccaccacgcctggcaaatttttttgtatttttagtggagacagggtttcaccgtgttagccaggatggtctcaatctcctgacctcgtgatccgcccacctcagcctcccaaagtgctgggattacaggcgtgagccaccaagcccggccccggccaaaaaaaaaaaaaaaaaaaaaaaaccatttttctagctcattcaggaagtaaattaaaagaatggtggaatgggctttttgctttccatatcatagactattttaagttaaggatactatcagtgaagtctggatgaaaggatataataagtttcataagatggaagatttatatctaagcttgttccttgcactgggtaagctttggcaaacagtgaaattgttacatctcttcctgctaatgataacataattttatttcagcacaaaggagttacctagataattagtataacaaaatttttataactgttgccctcaaattcaacaactgaattaaggattcatctttgtgcactttttcatgagaaagtttgtttctttcatattctttaatacatgaccatctcactttgtgatttaaatgttttaattactgcagtgatttaatacgtcgaaaaagaggcagataaagaaaaaaatgatcgagattttctacttaacacctcggttctgcagagcccaaggtgattaaattgaaggcagcattcctttagagtcacctatgagacaatagtctggaatattatcaaaagttttggcaaagaaaatcatttttggggtgggaggttaaacagaggatagggcttcaaaatttatctatttatttgagtgagttttagcatcattgacctggccaaactccaacacaattcattatattttgcctgtctcaaatgcccttgaaattctaatgaggccctatatttctcatcttaacctactttcataatattgcttgaagcggccatccagctgtggtcattcacttaagaagaatctagatttatctagcagctaagggtatccagtatctctgatttccccacagaagcaggaaggtcagtgaattcgttccagtgaaaagatttgaacagcttacacaaataggtaagaacatccaaataagataatccaatttctcaagcatttctcatagtgctcttagtaggaaaaatgagagacacaagcaccaagctgggcacttaacttcaatcatagttaaattttgtaaagcccccaaaaggtaaaatgctacaagaaattaaaacaccaggaagctctacaccaagatgctttcctgatcatctgaagccttttttgcctttgaattctcatagttggctcttgtgtgctttgatccatcctgtctgagtgcatctccatgccaaattacacaaagcagccctgcaggactgacaaggcccaggagccagcgcaagtgtgtctggcgcatctctcgttgttgaactgtccttgttggtgaggattttttagcatgcaaagtgtgtccttagaagcagtaggaaaagggaagagattcctcagctcttcatatgttttctttcatgaccccaatatcgtatctgacaaccattcccatttgaattattactcttagatcctgaacaatcattaattaataccatctttgtgagcgttcatttaagcaataccactctagggccttcaataccactctagggccttcagccagcttctattaaatgggttcctcattctggtttactctcattctcctccttttaatattttagcctgttcaggcattatgcattgggagaataagagaatttttcagtgatttaaaggaatatatataatagaaaaataaaaggagactagattattactatacttgaatcattcaaattggcataatcctcacttacttcgtatctcataggtaaattcaaattataataaacatgcagacataatcatcaaacatagaattctcctttcagtggcacagaattggtaattattttctttaagtccttacagtgatatcttacaaagatttcctccgtgaagcattcaggcatcaatttaatctgcatatgtgtaactaaacgtgtttcctcaatgaacacaattacttttgttctttgtagtaaattctctcactataatacacatagtttggtcaaattaagaacctatagaaaatgattaaagacacaagaggttacacatgcagccttcaatttgacagatgacagcataactcattgcaatagtaataatgagtattgttcctatcttaatttaatatgaaaactttccacatccacttaactaacatgaaaaattttagaaatttacacactgattggtgaagtcaactacataccaaccattaagataattgacttccttaaaaatgtaagttctgcactccttattgtgaggaagccaaataatttatgggctttaagcagtaaattcttcccttgcagatgtgtttgatgctttccaaagggtctctcctcctttagactggaagaggtttggctcaggatgtaattttcgaacacataaggtgtgcctagcactgagctgggcagtcccttaggaagcaaagtgaggagaaactgtgatggtgacggggagtagggactgtggattcagaattcttagtgtaacagccaattattaatattatctgtggccctatatttcttcatctacaaaatatagacaataacagtaacctaacttacagggtggctggtaatgggataaatgagttaatatattcaaaatgcctagaacagcacctggtgcaaagaaagttcagtgtaagtatttgccatcattaaatatccccctagagggcaggtacttagggctcatgactgtatttccaataccttatactgctcctggaatagacttgataaccaataaaatgtgataaactagtgatgaaggaatagataaatgaattcagagaaaaactcttcttttgaataatatacagctattttaatttgataattcatccagtaatttatttatttactgataagaaaggaaatctcagaaaatatactataataattattcaaagacagcaagacgtttttcaaagaaacatctgggtttaaatcagtctgctttaagtatcaaatgaatgtgtttattcattatgtccaccagaagctgcaaaatagaaaatatgcccaaagtaaaattgtcatagaaaaaaatcagacacatataggtatccagatgtccaataacaaaaaattctggtcacatattcagcaaagatttattaggagcagactctgtgccaggcactgttgcatgccctgaaaataataagcagacaataatccctgcctttgcacagtttacagtcttgggaaggagagagacaagaaaggtacacacataaaaactcactttcagggcacgttttgcagctctcctaacctcactgacctctcaggatgcagacctgctccaaatcatccattctgcaggaactaaattaaggttcttctaaaacagaagtacaaaattggtaactaccctcaaaaatcataggttaaaattatttgtcctctacttttggtgcagaattctggacttctgttcgagaatcactcaagggcttgaatgggcccaaagttacattttgagaattcttggccctcctgtgctattttctttcaccagttcacccttcatcccacacatatccctggcttgtaggatcttttagtcaaaacacaagatgtctataatagagtttccataggaactcaaactaaaattgttgatattggggaaagctaaaatagggatcatactaacaattctttactcgagattttctaagcttcatctctgaatcatcagataacctcaagcagaatgcaactggacccgctacgctctccattctctgcctcttgcaaatgcctttacatgactatgaataagtgtacctggagctggtcctgaagcaagaattaaggagctgctacatacacgatttctccactttttcaatagaactgctacttaagatactctttgttgaattctcaaatgtcccttatacaaagacccttttcagaaatttcacagttaaaagttgaaagaaatgtcttttgacaacctgatatgcagcttcctcctgttgaacactgtgacgtaaacagactcatgatatttctctttctgtcttggctaccatgaagctcggagtttagtttttcttcctccatgccagtgtttcctgagctttggttttctggaacattttctctcctctttatacatcttcaactctattaaactgctctggtatttttattttgttttactgactaccagtttaattggaactataccatttagtgtaaactaccacaagtcctttgggcaaataaagagaatatataagcaaataaataattatgaacaatggctactgagccttaaaaccagtggaaggttataagagctttttaatagactcaaataagtttaatgcagaagttacaacctgagggccttgggccagattttgctcttggatatggtttattcagcagatgtaataattttaaaagaaaaattagttaccaacatccttaagttagaaaatttccaataaaaacctgaattgcttacctctctactttctgtgccagaccttgttttaatactgaatcttctaaaaaatcctctaaggtatcaccattctcatcatcccaaatctcacaaatgaggaaacaaaggcatggagaagttcaataacttattttacaggctcacacagcttgcaaatggtaaagctggaacctaaacttggaccaccaggctccaaacactcccaggtggtcgtgctattacctggaaagaatgatccaaaggcttggacccacatttccccctgacaacaatggatccactttccaacctggcatcaatagctggaagtgaaaacagcatgtctctttcaacagtcacctggtgtttgcaagcgtttccgtttaagacccttgtcttaattctaagctgagagcatattatcctgagatgggagctgcatcttaaatgtattttcgacatcctgtaggtttagtctttgcttgaagttaattaacattgatgagtcccacaggtctctatagcttcctgtgaagtcctcaacattgacaataaaatggccaaatgagaaccgaaatacatttcactgtagcacagcccataaaagcagttttacctaaattattccccaaagcatttcccacttaattgtttagcatttacggataataaggacatgaatgaccacatttgcatatttatattgctcatttgccctgtgtgccgtagtcagtgctttagaaagatttgtgtgccacctgttctctgtcagttatctcttctctctgttaaagattcttggatagaaaaaagtaaaactaaagctaatctccttcattaaaggtagagagacttttaataaaacgagacttgctctgcacttcagaggataagcagaaacctttgaaggattttctgtctgaggagtttccagggaggaaaggatatgatttagtcagctagtcagctaagctcattaattctggtaacttgtttctgaaaaaagggaattttcctgtgaaatgctgctactgcaaactaccctcccccagctcatatcacaacttctaacccttgagacaaacctgctattgttaattagtcgaattagttgtacaactgtacattatcattttttaaagttgtcttactgattctcaaattgtattttcttaaaaagtagttgagaattgcttttccaaaacaatatatctttaaaagaacaatgtaaatagacaaatgaggcatttcttgaagctgctttttggtattccctttgatattctatcaggaaactatatgtctaatatgtaagaatatatgtctaatatgtaagatattaaattgtggagtgagaagtaggttttcagatttttctcctcctccagagtctttctcctcatacttctcctcctgactcctcagggtgccaagttcaatagtacaagtgatatatacatgtacaatatacaagtaataataacatgttagaatatgtattattgttatactattatatccttgttattattagggttattatgattactattataatcttttggtgacctttaattctggattgcaggggactatagagagttggaggagactactcagaggcattggcaggtatactgaacgcctcaagagctcctagagctgacattcataataatcactttaggtatgaaaatacatagttaacatttaagattctctttttaatgacccaaaaatgatagagaacagttcagagctttaaaaaaagaagttaactacaatcagaagtggttaaaaaacaatctaagggcttgaaattgtaattgagttagattcaattaccttgaaaattatcaaaaaggaactatccatttcccagcaaagttgttgatctttattcttctaaagcaatttgtacaggaataaattctaacattcatatgtctaggggctaaaaccgacatgcggatgttagaatttattcctgtacaaattcccccagtagtggggggtaaaacactacccctgaaatcacatacccctggattgtgttcaccaatgttcaaataccagctcttgccagtttcttgctatgtaaccaagaactggttacgtaattgttctgtgctaataatggatctattaataaaggatcaaacgatatggtaaatatacagctcctagaacaccctggcacatagtaagagctttgcaaatatctgttattattattccacatctttgtatctcttatcatactctttaagatttagaaactgttgagatttttcaaacttgtgaggacccagttaccaatctctcagtcaatttagattgcagaccaaagatggagtctcccttagcagagctaaaagtccctgcatctctgcatgcaaagtagacagcacttccctgaattcatatctgtcccagaactttgatttaaaaaacaacatgatctggaagttgcattaattcatttttccacattttatttctcagaatttaatcacatggtcaaaacggactgcaagaaataatagtctatatcgtcttaatatagccatcacgtgctcctctttaactctggaggttctttatacaatctaagaaggggagaatatacatgggggaaaataagtcatctctattatgttgagtgttattgcattctctctttgaaatattttcagggatatgatattaagctcttttaagaaaatcggagcgaatattttccctgcttttatcctagtaactgtcaattgttaataattttatagttattataaaaagcaattccatagtaatagctatgtttttctatagccatgagtattggctacgacaatttcatttgtttactttctccatccaagttaacagtcttccctgatagaaacatttagatcacaagtagctcgctttctctcactcaacagttgacatcactccattggtccttggcagtagaaccatcatgttcacattcttgttcccaacataatctttttctttttttgagacagtctctctgttgcccaggctggagggcagtggtgtattctgggctcacttcaacctccacctccctggttcaagcaattctcctgcctcagcctccggaaatataatctttaaagcacaaagtctggagtattttggcaaatgtagctcaatgtagctaatgtagctacattatgttaataaagctaatgtagctaatgtagctacattcagcaaatatagctaatcaggaacttaattcttttggacactgtttgtagagaggcatgttttcctctgccatttgtctttggtaattctccctttcttctagatttttgtatatctttttaagtgtgaatttaacagaaagttccctgtgccgctccatagaattctctaaatctctctacatcttttttggagctatatttgattttggcacctggcgtactaaaaatgacttgaccttagatgtattataaataatttaataatgtttccaggaaccttcagttaaaggaaatgaatgattattttatttaattttatccatttattctacaattttttattgggtgcaacaatttttttctaaaaagtttgtttacatgaatacaagagccttctagttattttttaaactgtttttactacaaaaagaatacaagtttattaaaggaaaatttgaaaaatacagaaaggaaaaaaacacaaaagcgtggggaggctatttctattgccaccaaacgaaaataatatatgtaatatattagcagattctcttctgaaattgtatcttcttttttccccaacctcccctcaccaaactgagtattagtatgtatttatataattgaaactgttgtgtaaactcatctctctctctctctatatatatatatatatgcacacacatagtatttaagacatgatcaaattacataaacatcattttaatgtctccataatattcctccttatggatttgctttattatcccctattcttggacatttaggtagaacctactactcgatattatatataacactgcaatgaacatctgaaatgaaaattattttttgatggatttctggaagacaaattactaaggcacaggatatgagctactttaagtttcttaggatcaaataaatggcaaaagcacattttaaaggagataatagtagggcaaatgaattttctcaaaataagccacttaacctaaacaatgtcatcattatatcctaaacattttcgggagactaagaaaaaaaactcaatttcacagcattacaataaagcctgagtttttaagaatgtcaaaaatctcatgtttttctctcttccctattcatcaagtttcctcttcactggtccaatgaaatagagccacagcacttttatttaaatctctatttctcctgcattcccattagtgaggaaatcaatcagcagttaagaaatcaatcagttaaaagaataattaaatagccattccgaaaagaaaagaagtagaagataagatggctatggaagagtttataatctaataatgtagaaatcaatcacacatttaaaaacaaacaaacataaccatgaaattcacccctgaaatgcttcatgagagaattgctacatttctttatttttaaaatgaaattaaatattactcttattaattttctctttatctgtcccagggatggcaactgtccttaaaatttagaaaggacaatggcagcaacaacaaataaaaacctgattttaaaataggcaaaggacttgaattagacatttctccaaagaagacattcaaatgaccaataagcacatgaaaagatgctgaacatgactagttattagaggaatgcaaatcaaaaccacagtgagataccgcttcattcccattaggatggctattatcaaacagaaaagttacaaatatcaagtgttggtgaggatgtggagaaaatggaacccttgtgcattgctgttggcaaggtatcatggtgaaatgctgtggaaaacagcatttgactcctcagaaaattaaacatagttattaccacatgattccacaattctgctggatacacaccttaaagaggggcagcattattcacaatagccaaagataaaagcaactcatgtccatcaatagatgactggctaaacaaaatatgatatatatggtatgaatactatataaatataccatacatatatcatggaatataattcaggcttaaaaagcaaggacattttgacatatgctacaacatagatgaaccttgaggaaatatgttaagtgaaataatccagtaacaaaagacacagattttattattccttttataaagttcctggagtagttaatttcatagagtcagaaattagaatggcgactgccaggggctgaggggaagggaagcgagaatttggtgcttaatgagtagtttttcatttggaaagatgaaaaagttctggagatggatggtggtgacggttacacagcaacgtgaatgtagttaatgccacagaactctatacttaaaatgatgaaatgtcaattttatgttatgtatattttaccacaataaaaaaattggatagggctattggtttcagttcatcaatagttgtttaagtggtctctcagaggtctaggtggcatgtcttcaatctttttatgttagacataggagctgaggcattttgttgcagtttctaaagtcttgaaaacttagttttcagtgccctggcatccaggagccactccaccaaactccctgccaccctgctgcgtgctgaatgaaaatgatgtgagatctgccacagctttgtttttgtctctggtacatcaaatgtgcaactcaaaacaaaaacaactgtgaacttccttttattatggtattattaaaggattggggaggagtggcaggtgggactgagaaggggaacaggagacactgtagaaaggaagtcaaatctttaaaagagataatgttagcttctgcttcctgaaagaagtataggaagaagagcccagagaaggggtgtttgtgtgggggggagggggtggggcgggaaatataccagatataattgtgttcttttattaagtcactacattataaacacatttataaaaatgtgttttaaataacaatagagaagttcaaacatagctataacaattaaatattctgtgctcagaggaggtaaatggatgaatagacagcagacatttttcccatatgccctcgcttagtgccagcagtgggaagggtgcttatatttgaattagagactctgagcaagccaagaaagctgaacaatagctcccaacattctcctgggcagtagaaagatgacaaggtcagaaggcacatttgattgtttttcatatcataggtatgttcagcttttccagggctccaaggtttgacccagcatacagaatagaaagtgaggcagaagttactcggttcccttcattgtgcataacatgataccttgttttgtttacccataaaggtcctctgttgacattttaaaccagagtaaatataatacaaaaaaattttaaagacgtgaatttttttaattgtagctaaaatagcaaatcaaaatatttaaaattttccttcctcatcccatgaaaaagataactctaggagcttctatttgattcttggtgattgatctctttttaggtagagacatttcctgttaaaacttccatttctagcccgaggcccttaagaataggctataataggcattaataaggttatacaaatatactcacttatgcattgtagcttcatatattttgtgacaacattaaaaaaaattctaaggattgctgaaatactttctcaagaaactatttctccaggcaaagagttgcaagcagaaagtttcatggtagacagcacaaaggagtacatgccaattgtaattagaacaagcaggagaattcgcttggagaccagaaacacaattccttttatggcatattagaagcatcccaatcttcctcaatagtggtgttcatcaaacagacaacattctgaaattcccttaagagattgctggagtgaaaataaatttgtttttagtgtgatatcctcaggacagaaaccttataaaatcatttgccttgttggcctgtccacctcctataataaccattgatcccacaggctaatttcaaccaactttgatagaggggcaaagagtctatagctagacagaggctcataaatttcttgtggtttcttctgtttctttcagaagagttgtttaatggtatcattttgaagagtataaaaaagcaaaccaagtttctgctgtgaagttgtcactgtaatggaagatgattacatcagaagaagttcaaatggaaaaaaaatgtttgtagttgccttgtggtttcctgataacaagcaaagcaagcaccatatataacaccacacagtggcaggcatctttacttctgatagttgcatcctggaactttataataaattcgactcttgggttttgcacatccaagtggctgagtttttcttgtttattggagttgaacttaaccagttctcagttctcagaagtgtgctgacataattgaaaggctttcaaagagctgatggtgagttagtgaaggaaaaaataagaattcagaaaaaaatattaagaaggaagcaacagaccctcctacagtaatatacagcagggtgacaactcaagttcaagtctaggatagagtcagtatctgagagggtccaggtctcgatgtggtaggagatctgcttacagaatttgtagctgaaacttggggggcccagtgcaaaaacaggttttattctgaggaatgtattcaagaaactatgagaaattaggaatgaggccagcagagggcttacaaggctggtacagcatctcgtggtgtctaaatcctagggaaaaggggaactcaagcagctgggtagcttctcactacatgcaattagaggtaccagggtggtgctgctagtacctgaaggccttttggtccttactctacacttcctctacacctgaggtcctaagttttcactctggtgacaaggcaaaaaaacaaagatatacatacacacacacatacacacacacacatatatatataatttccttctttaaagtgagaaaagggctcaaaatctgagtctagctaagacctcaaagattgtatggctgaatgagaaaaccaggttaacaggatcataattatagacagctggaataagtcttgtgttgaataggaactgatactataaaggtaactcagataatttgtttccataattttcatctttcaattctttttacttgaacatgctctgagctgtaaagaaataggttacacagcactgggtattcattttccaaactctgctagcaatattgttcaatctcaagaaaagacccaaggaactaaaagggaaaagagaaacaggataaatattttttgatgaaactcctattttataagatgcaaaacataaaactatggggctctaaagcctcacctaagtgaatcaatatgactacagagcttgtaataaaatacaacactaaaaatactatgaatcaaacataaaatatgcaaagttcaccagatcttcagtggactagggaagctgtccttgcaaaggaattaagtattatttgaaatgagaaagtgtaactgaagagttgggaatttcattttctggagctgccacaacagtgcccaagtagggaatcagcttataaatgcaggtagcttgtaaattcggcacttgatgaagtaatatccagggaaaaggtacttaatgttcccaggggaatatatgttgtatgaatgcatatactgtgcaataataacaaaatatatactacataattagactgagtatatattttacaacataaatatagttagggctgttaatcaaattaaacaggacattttaaaacacagttaagaatgcagagaggaaaaaatagattaacatctaaaagcacatgcaaaagaggcacagcaatgaatgcaggaccaaaaagtaccaaaaaatagtattgcatgcacaatgtgttatctttctttctagaagtagtcatggaaactaatataaacaatgacttctgaaagctaggtttgctcctcctaccttaatggcttcagaatctcagcttctactatatagtagatggaaaattctcaagtgaagcccagcaacagcatagcaagagaagggctggctacagtggctcagtagctaatatttccagtgaaatagcgaggctgttttcagtcttcctttacaaatctagatgaatatgccaggcactctcattaatttcttgaaaagtagtcattttttttgaaagataaaacattcagtaagaggtgaaattaatggagaaatattctcactattattttactagaaaaggtataaggatttaaatgatttgaatgaccaaactctctaccaaaaaaagtatcacccaattagttcaaactaatactatagaccatgcttcacccgatgtaatttacatattattccaatcatagcccactataacctctgctttcatcaacaagaatagagtttttataaagattaaggcacatttatctgttcttctgcttttttcaaaactgcttaaatctataaatgtatttcaatatgtatcgagaaaacagaataaagttaagtgaatgtataggaataaaaggtgcttctgttaaattttttacaaaaactacgataatgatcttaagactagttttagaatctccctatatataaatagtgtttagtcatcgtttcttaaactttccacaaaatttatagcggtttgggtggcactatatatagttgaccctagaacaacatgggtttgaactgcatgggtccaactatatgcagattttcttctgcctgtgcccaactatgtgcagattttcttttgcctgtgccatgctggagacaacaagaccaacccttctacttccacttcctctgtagcctacttattgtaaagatgctgaggatgaagacctctatgatgatccactttcacttaatgaataatcagtatattgtctcttccttatgattttcttaataacatgttttcctctgaattactttattttgataatatagtgtataatacatataacatgcaaaatatgtgttaatcatttatgttatcaataaggcttccagtcaactgtaggctattagtagttatgttttgggatagttgcaagttatatgtggattttctactcttcaggggtcggcatcccagcccccatgatgttcaagggtcaactgtataccttttatatctacataccatagatattgtaaaactacctacattcacaatgattaaaataagttataattatgtattaatttatacactcaaattataattaatgcaattatgatacaaatttaaattatataattttaatttatttctttaatttttatagatttattatgttttttgccattccttttcaaggaatcttttctgatttcagttttattaaagtcactttcaacacagggacactatttctgtttaatgacaggattagctgccagtccctatttctccagatgtggagataacatttttattcagcagggagtctaaaccattcacagaaatcccattttataccataagagcaagcatattaggttgcactcaaataagatggggtatctccaagttatttctctattttatgcctcggttagttcctaaggcaactaaataaataaataactctgacttaataggcaatcaaggagcatcgtttgtaccatatggttggcatagtaaccctggggtattgttactgctaccaccttctagagaggaggaaggctgggcctcagaggttaagtaacttgcttgagattacagtttccacattaagctggaatctaaatacagctgctaatggatgtctccagagtacatgcagcagaaaaactaaaagaaattactgttctatctccatcagtgaaaattttatgtaaattagtaaatgttatgtaacccaagattattgagagtgagagttgaatgaaataactttctacaagtttcttctgacctccaagtaatgtacataatatctgaaactatttgaaaccctgatatttaccgtacaaggaagcaaaaaaacaaattattcataagccagaaatgttcccaccttaggtgcatgcttttggcagcctgcttagaagattgcatgatatgcactaaagaaatgtaaaaaattaacagagcagattacctggaaataagtcccaagttggaacatgagataaatactgtataaaagttaggtggtgattcaacatacccctctccctataatttttagtctttaaggaaccccaggtcttctctgtgctccagtgctccctccttatgcccatgactcaacacctactgtgtgccagcacggacctccctggttcattgaatgcaaggttcattcagcatttaaaattcaattaatgtaattcaccatgataaaacaaagaaggaaatctatgtgatcatctccatagatacagaaaaaaatgcatttaacaaaactcaacattcatatgataaaaacgttcagcaaacagaattaaaggaaacttcctcagcctgaaaatgaccatctacaaaaaaacctagagctaacatagtaatggtgaaagactgaatgcttttccccagagatcaagattaacacaaaggtgttcattcttaccacttctattctacattgtattggtgatcctggtcagtgcaacatggtaagaaaaagaaatagcagttacatatattggaaaaaagtaattaaaaccccctctattaacagatgacatgattgtttatacagaaaatttcaaagaatttgccaaaaagagactagaacaaataactttaacatggtcacaggatacaaagtaaatataaaaaattagttgtttttatacgctagcattgaacaatttgaaactgaaatttttaaagtactattaatttttttaaatgaaataattaggtatacatttaacaatagtagcaagattagaatgccaaaaactacaaaacactgataaaagaaattacataagcccaaataaatgagctatatttcacgttcactgattgaaatactcaacgttgctaaaatgttaatttttgcaaatttaatctctgcattcaatgtaatccaaatgaaaatatcaataggatttttttttgtagaaattgataggctgattctaaaatttgtatggaaagccaaaggaaataaaacaataaaaaccaatttggaaaagatgaacaaagttgaaggactcacactatctgacttcaagatctgttatagaagcacagcaatcaagataatgtagagttggcaaaggatagaaataaacacaataaagaatgcagaaataggctcacacacttatgattaattcattttaaacaaaggtgtaaagcgaatctctggagaaaaggaagtcctctcaacaaacaaagctagcacaatgcatgcagccatattgcagggaaatgaacttcaactcaaattttatacaatcaaatgcaaaaactaactccattaaaactcagatttaatataaaacttcgaagagaacacagaaaatatctgggatcttgggctcagcaaagatttttaaaattatacctaaaaaagtacaaatgatataagggaatctgataaattgcacttcaccaaaattaaaagtttcagctctttgaaagacacttaaaaaaataagaagacaaaccacagaatgtgaaaatattgcaaaacatgttttttcttacatattgatattcagaatatttaaagagctctcaaaactcaagaatgtaaacaaaccagtttaaaaatatacaaaaaatttaaataaatacttcatcacataagatagcaaataagcacatgaaaagatactcaatatcaataacatgtccattgaaaccacatgagatatcactatgcaactattaactattttatatacatgtattagtgtatgtgttgagagagagaaggaaggagagagagtaggttatatgtaataatcgacaataccaaatgctggagaggatgtggaataactctgatgctttggtggcagggatgtaaaatggaaaacagttgggcatttttttcttataaaactaaaaatacacttactgtaacacactgagcaatctcactcccaattcatacatattacccatgagaatgaaaacatacttctacccaaaagcctgtacacaaatgattatttcttctttactcataatttcgaaaacctgataagaacccaaatcttcatcagttactgaatggataaacagtcttaccttcttgcaattgaatgctactcagcaataaaaagacccaaaccattaacacatgcaacaacaaagaataatctcaaaatcatttttctaagtgaaagtagcaaggttcaaaaggctatatattgtatgactccattcatattgcatctggaaagggtaaaattctagggacagtgaagagatggagtgttgctgggagctggaattagggcatggtattgaaaacaaagagcattgagaactgttttggaggggaaggaagtgttctacagctcgattgtggtggtagtcgcacagtgtatacctttgtacacctaacatgatgaattataagtgaattacatatcaataaactcaactttaaaaaagtggaagtgacctggacctctgttgcctctgagatgtccatcctaaccccagtttctcactcttcaccctactgtaatccagtttctatctccaccactgcacaaaaaactcattttgttaaggtcagcaaaaacattctgattgcaaaattcatcctcagttcttcttatgacttctcacaacttttagcataatcaataacttctcctttgaaatattttccctttctcttccacaatgctgctctctcctaatcatgcattcttagcgtgatgaaaagttcctcaaccccctaaatattggtgctgcttagattcccatatttagaatacctttctcattttctatttacttatgactcgtttgttttaaagtaaagttgagcattgtaaacaagggcatcacttttgtattttagggtatttacctttgtatcaattggaagataaatttgaaaaaggcaaaactgaaggaaggcgggtaggttgggagatgatatggagaagtgatggatatccaaatagtagggctttggaagataaggatagattaaagagatgtagaagaaagaatcagtagggcttggcaatacattgaacacagctaggacagggaaatagaattgttagatgaatggtcaaatttatggtcaatttatacaatctgaataatggtggagtcattcggcaagtcagcgaacataagaaaaggaagaggtttgggtataaagtgattatttcagcttggaaaataataagtttgataatcctatcaggaagatatttaaagaaatcaatctgtatcccagggaaggagtagaggcactatatatacatatttccatttatatgacattctggaaggggtaaaatcccaaggacaacagagataatagattgccaggagctggggtcaggaaatgattgtgtgtgtgtgtgtgtgtgtgtgtgtgtgtgtgtgtgtgtgtaatatgcagatatagactatatatgtgactatatatatgtataatagttgtctatttctttcagaagtaaagaaggattcaagtctccatgtatttctctatgttattctctccacttgcaatgctcaccttcttcatctgttatttccaattcatcctccatgaaatgattcagatgccatctacttgaggaaatcttccttgattagccccattccctcaagcccacctttatcccctaactccacgctgttagatgcacatttttggacattttaatgtcacatttataacactctaatgaatgtagcatttagggtactttaatgcaactgttgattagtttagttgtcattttcccacaaaagattgtcagctccttgatgtctttcatctgtggaacatgagtgttttttacagtgcctggcttataggaaatagtcaaatagggttgcagcattacactgttggaaagaacatggtgtaagaaatcaagtagatatgagtttgaattttgactctgctagccatagtctgtgtgcttggttaaatcgttcaatctctttgagtttaggtttctataaaatagagattataatgctactttcctcatcaagtttttgtcatgtattagtaaactactgccgcataacaaattttcccaaaactctgcaacttaaaataatgtccatttattatctcacagtttcagtggataatggcttagctgtattctctgcttcagagtctctcacatggctacaatcaaagtgtcctccagggctggggtctcctctgatggctcaacagggaattagtccacttcaaagttcatgtgtgtggtttttggcaggtacaaattccttcagggtggttagactgaggatctcagtttcttggtggcagtgagccttctctaacaatggcagtttgaccacagtcattatgaaacagagtcttctggcaaggtggaagtcaagatcttttgttacataatcactgaagtgatatctcacgacctttgccatattctgttgattagaagcaagttgctagttccagtccagactcaaggggaggggcttatccaaggatgtgaatgcctggacatggggatcattgggagctatagagtcatatagaactctgcctactacatgtgaggaccaagtcaataaaaccaaaagattcactagatgcctaatattatacatggcaagtgctcaaacagctatttatgtccaatggataaatgaactcatccatcaatcaattgttctgcaattaaccggagtaaccactagatggtggtgcatccttcacagcattgtgccataaaagtagggtcagagattttgaatgtaagagctttttttttttttttttttttaaaacagataaggtcttgctctgtcacccaggctggagagcagtggcgcaatcttggctcactgcagcctgcagcctcgacatcctaggctccagcaatcctcccatcttggcctctagagtagcagaaccagaagtaaaagagcatttttttttttttgatgatgatgatgatgatgtaatacacaaagacacattttaaaaacagaaactatacactcctaactaaatctcttttgtatctctggaactcttacaaaacctatcctgcttcttccttccagagtaaattataaaatgtgcaaacaaaataaacagaaactcctctcctcactttgatgtacaaggtttctcactcggatactatccagccctgatttaaggtttctcactcagatactatccagccctgatttaagtttccttttgactcttaaagacttaaaagcttttgtgtttctgttttgaaatatgtctgttatctttttctaaattaaagtaaaacatattcattgtagaaaatttggaaaatatagaaaagaaataaaggaagttaaaaattctaatcgcacacctaaaaatactttagtatatctattctgctttccttcccttcttttcctctctgtttttctctattcttcccttccccaacacacacatacatatacacagagaaattgaaattatattatatatagttttgtatccgaataaattgctacctcacaatatctttaaacttcctttttgtaatacaatttttgagtccttgccttttactgctgtgtttaagcatatatatagctattattataccatttgtagtgccttgctcctaccttctcattttctgttattgtagagtgtgggtttttttaaattggtgttttaaaaataatttttgtattttttgtatattattttgttgatgtttatctccaccagtgttctggaatttccatattttgttttcattaggctacttttaaacttaaaaacattttttaaatgttttaatctattctcctctaattaccaaggtcaaagtgaaatcatattgttttgattgcccactatgtaagacaaagaatttagcatgttttaaataaaatttcatcttttccatgatagcatggtctttgctaacataatcatgagcttgggaacaaattgttgtcatccaattattattttaacattttggaaatttatttttgaagaataaccttgaacaatttgtcgtattttgtgtcttctgttttgcaaaatgatttagccatactttcaaattgaactggttttaatgtttatgaccagttctttaataatctgcccactaatatttgataatgtactattttatgctatttaactaatattcttcccaatgatattataatttttcccttagtcacatgaagtttatctttaagtatttttaggctatgcacttatcataagtagtatctctttctgttatctacaaatttgaatgacagtttctctgtgcacagaatttcagggtctcagtcttttatattcaaaatgttttaactttaattctattattttgatattcttttggcatttatttgtatcttttaaatttgtttatttttatgtcttttaaaatattttaatataaattaatatttttatgttttccttgtatccacagttaatttttattattgtttttcttctttttgttttgttttctttttaacttttattttgggattaggagtacatgtgcaggtttgttatacagttaaactcgtgtcacaggagtttgtcgcacagattattttgtcatgcaggtgctaagcctagtactcaatagttatttagttatttttttctgctcctctccctcaacttaccctccatccccaaggagtcctcagtgtctgttgttcccttctttgcgttcatgagttctcatcatttagctctcacttatatgtgagaacatgcagtatttggttttctgttcctgcattagtttcctaaggacaatggcctcctgctccatccatgttctcacaaaagacattaccttgttcttttttatggctgcatagtattccatggtgtatatgtaccacattttctttatccaatcacagttaattatttcatcattatttagatgtatgtcgtttaaaattaatgttgactaaaagatagtcatccattttaatatgctgtctcctgtcttattcaacaagaaaaataggtcagctgtcttttattgttaatccacttcaaagtattttgatttctctctcagttacatttgaaattttaaggtctaatttctgttctctagtccctttatctctgggatagtttctcagttttgttctcttatcacagatgcagttttaaaatttttattgaagtacaataaacaaaaaattacataaaccaagtatttagcttaatgagttctcatcaactaaacatatctgtataactaattcctagatcatactgctttgattatctgcagtaccagttttccacttttctgcccccaatgtagattttaatagcactattgcaatgctagttttagtttattcttgttattttacactgcatccttttcttctctgtctgtagtccttaatcccatcctgttgtcttttcagttattgttttcatttttgtgtctttttactttatttccacagaaatcaagttttcacacatattgtcatgaaaataatgtagtattctaaaatgttcttgatgttttgttataagccagattttgggttttcttcctttagctctttagcgttatgttccctttcttttgtggagcactaggaatacataatgtatgtatgtatatgtatagatactcaaacacacaacatgtgtctgtccaatcatcatgtattccctcttgctttacctcttcataaaagaacagtggtttctttaataaccttcttttcctagcagccaggtacattagaggaggctgacttcattctcagttccaaagaataatcctctttcctcccacttcttgccattgatccatttagagatgaatatgagtaaaggtttgctgatggcttctcgggaagttctcatttgttctttaggtagagacatcagggggacgtgaatgaggaagcatgtagatagagtgctacttgcaaccatcctataacttcaaaaatgtctttgaggtaaagctgaaactttgaccagtgaagtgaagaagtggtagatatctgagttcttgatctttttgagtcttcaagataaccctgctgatgttttttttttcttggactttctccttatatgagccaataaattttaatatttagggaagcttcatttaggttctctattgcttgctgccagatcatcctaacttacacataactacaatctgatgttgaaaggaattagttttctctttctctctctctccctctctccccctgccccgctcttccccacatctccttagcaagtgcacaaccagacctagtgtttgctaacaaaataaatctgtgagctgtcattagccaggttcactgaccaccttgaggaacagtcaaagctccacctcagatacatagtagaaattgctgttcaagttccggtagttggtaaccatctgttgtaataatactaaactgtactaggatctaaccagtttcacagatacttcaaaccaagcagatatcttctctgtcacttgtaagataaataaaatatagtcctctgttgcttttgccttgttttgttctgcaagttgtcatttctcaaagcatggagaagacagagtataagaatgacaaggaaaatagtattcagactagctctgtaaagcaactgagtgaccatcagctggctctctcattagtgcagacccagggctctgagcctaattgcatattgcaggatatgaaaaccacgtctctgtactttcctaaaagtagtggaacttcggacgcctgtagtcccagctactcgggaggctgaggcaggagaatggcatgaacccgggaggcggagcttgcagtgagccgagatcccgccactgcactccagcctgggcgacagagcgagactccgtctcaaaaaaaaaaaaaaaaaaaaaaaaaaaagtagtggaacttgtcagatgacgttagtcaccatttctgttgctactttcttgtttcacactggttttgtttaattcagcacctttggttttatggttaagcattttctccaattcagacagtaagttatcttttcattttatctgttactattgtgttacctctcatctttttcttgtcttcatacacattttaatgggatattgacagtaactgttaaatagatgatgctatagagtggatatgtgcccctgctaaacagcaattattattgttgtttacatgtttcaaacttgtttacattgcttcaatatagctaaacttgtgatagatataactgtaactaatttgtatttgggcactgccagatctaaatttaagttctggcactaccactgtctaattctgtgacttttggcaagtttcataagctgtcaaagtttcaatttattcagcttaattacctcactgtgaggttgtgagaaatgaataatacagtaaaatacttagcaaagtgagctgcacaccatacctacgcaatagcagtagctattgttaataatgtgctcgccctcgccctctccctctccctctccctctccctctccccacggtctccctctccctctctttccacggtctccctctgatgccgagccgaagctggactgtactgctgccatctcggctcactgcaacctccctgcctgattctcctgccttagcctgccgagtgcctgcgattgcaggcgcgcgccgccacgcctgactggttttcttatttttttggtggagacggggtttcgctgtgttggccgggctggtctccagctcctaaccgcgagtgatccgccagcctcggcctcccgaggtgccgggattgcagatggagtctggttcactcagtgctcaatggtgcccaggctggagtgcagtggtgtgatctcggctcgctacaacctccacctcccagccgcctgccttggcctcccaaagtgccgagagtgcagcctctgcccggccgccaccccgtctgggaagtgaggagcgtctctgcctggccgcccatcgtctgggacgtgaggaacccctctgcctggcttgcccagtctggaaagtgaggagcgtctctgcccggccgccatcccatctaggaagtgaggagtgtctctgcccggccgcccatcgtctgagatgtggggagcgcctctgccctgccgccccgtctgggaggtgaggagcgtctctgcccagccgccctgtctgagaagtgaggagaccctccgcctggcaaccgccccatctgagaagtgaggagcccctccgcccggtagctgccccgtctgagaagtgaggagcccctccacctggcagccaccccgtctgggaagtgaggagcgtctccgccccgcagccaccccgtctgggaaggaggtgggggtcagcccccgccaggccagccgtcccgtccgggagggaggtgggggggtcagccccccgcccggccagccgccccgtccgggaggtgaggggcgcctctgcccggccgcccctactgggaagtgaggagcccctctgcccggccaccaccccgtctgggaggtgtacccaacagctcattgagaacgggccatgatgacaatggcggttttgtggaatggaaaggggagaaaggtggggaaaagattgagaaatcggatggttgccttgtctgtgtagaaagaagtagacatgggagacttttcattttgttctgtactaagaaaaattcttctgccttgggatcttcttgatctgtgaccttacccccaaccctgtgctctctgaaacatgtgctgtgtccactcagggttaaatggattaagggtggtgcaagatgtgctttgttaaacagatgcttgaaggcagcatgctcgttaagagtcatcaccactccttaatctcaagtacccagtgacacagacactgcggagggccgcagggtcctctgcctaggaaaaccagagacctttgttcacttgtttatctgctgaccttccctccactattgtcctgtgaccctgccaaatccccctctgcgagaaacacccaagaatgatcaataaaaaaataaataaataaaaaataatgtgctcaatattctgcatattttaattaaatagctgttagaatttatatttacaaaatgaatggatctctaacataaatttaacatttcaaatatttcttttattaacttaactttaaaattagagggatttttattttttttaaccaaatgacaaattccagacatttagagaaacatattaccctatagttgtatagtgctttatattttgccgaatagagcactttatattttctaaaatatttacatattaattaccttttccagttctcacaacaactaaaggtaggtggtgcaaaggtgcttactcccatttcaccatgaacaaagttaaaactcagagaaactacatggctcctgtaggatcacatatttaactggagccattgctgggacatttgacctccaaacacctcctctctcttccatatttattaaattggcttgccaattaatatatgtaaacctagtaattaagaagctaagtcagcctatgtttgctacaatatgccacaggtaactttttaatcttaagattgtactaagaaagaatgaagtggaaaaatggttaaagcaaagacaaaatatggaggaaaatttcttgttgcatatttaagatattctttttattctatgaaggacataatgaaatctactcagttaataggcagcatatggtataatccaagtatgttagagatttcgggttttggccaaatagaagttttaaagaaatattttggtgaagtagtttctgccttttatcaagaaacctctatcaactaaagttatttcttctaaaagtcactgccattttttaggaacagtttaaatgccaatccaaagccagcttctttgaactgacacatttacatgggtagataaaatttgtgtctctgaaagtgttttatttcctgcgatcagagcttcttagcttttccagatcaaatattcctgtgaaaatttgttgaaattttagaccagttctgaggaagagtgctaacagaattacctggtatgctcataaaaaatgcagctatctgagcccgatcttgattcacagaatcagaatttctagtgatgtgtcctaagattttgcattttaatcacacccactcccactaagggactcttatgatattatattttatagagtcaatactataaattcttcccccagaaaatgcaaaacaacaaatcaaaaaatattacatatattttcaaatgatttacagacctgtcatgtccattcatggatacattagatatctgcaaatgccaggtttacaacctttgcattgaataaagactaaagttgtcttccaatacattaggctctttatgcaggagaaaagactgaatgcatgttcattttgattacagcatttcacacatttcatcaagatatatactttatagcagtactgtattatataataccgtacactaggaagtaaacatagaaagaggtattcacacttataagagttaccatgcagttgaggaaagtaaatcacaaatattaaaaaaaagaatacaatgtactctgtgctgggttccatatggataagctcagatgttcaaggacaaacatgagtgagagttaccaatagaaggcatttcaatatgggtaagtaacaattgggcagaactgtgaaagaaagttgggatttttaaaaaactgaagagaaagtagcagttgagcagaactctgaaagaaagttgggattttgaaaaaacgaaagagagagagaaaactttgaatgtgttttaaattttattctactaaaatatattttaatacaaccatttatgcagtaagcaatgggaaataatgctgggagatgaataaaagccagattgtggagggccttgaatgtcgggccttaccaggtcaataatatacttggcctttgatattttcatggctgtacaaaattaaagtattaataaatttgcaaaaaatgacaaacagcactgctaaagaatgtaaagccagttcttaccatggcagagagaaagccaacatttcttagaacagcaacatccaactccatacaagacaggtttttataattcactttaacttaagtgtttaatcattcacttttgacaagacaagggaaaaaaggaccaagcaagagcagagccctttctgatgatttactgatcaaagccaattaggatagttctggttgaactgggttgagtttctctgaaattacttttcaaagtaaagtcaacaagagtgagcatgtgcagtgctgtactttctacttgttagtccgtaaaataactaaaaatcacttacctatatccactgagcttcaaagtatgacttttgaagtgcaaaatcaagtgaaatgtgaaactgaaatgcaaggctttttgcagctattttgtctttcgtttgaagatctcagaatactttccacacaatagactgaatcaaatcttcctctgggctcagtattttttttatctgagctaccatatggttttgaacaaatatcaggtctggagagtgtgtatatgtatctcttgcatcagaactttagaatagtataatcataaagtagagcaaagaatggatgctgaagaaacaattccatgctatacgctgtacacacacaatcttaatatacaaaataagttaccaacatagtaacaccacatttttctgatattaaggttgacagtgacccacataaaagagcttttggcataacacatttttataattcttgtgggaaaaatgttttttttaatcatttcacatttaaatatttcagaaatatattacacattttcttgcatttctggtttaaaaatgttgcatacaattttgtatcttattgacgacaatgttattatttattgtcctatgctctatagattttgattttgttcctattttcaatatcttcaaggtactatactttttaatattattttatgccagctcatcatattattttttcggagggagcatgttgtagagaacaaatgacttatctcaggagtcaggcagactgagtaccaaccacaagttggcttggtttcatcatctgtgaaatgcaggtagcaatacatgcttcatcattcattagaatgattaaatggccacataaataaagcacttaccacagtgactggcacagatctgagactcaggaagtgttagttctttctctttttttttgagacggagtcgttctgtcgcgcaggctggagtgcagtggcgcaatctcggctcactgcaagctccgcctccaggggttcatgccacacacctgcctcagcctcctcagtagctgggattacaggcgcccgccaccatgcccggctactttttttgtattttttagtagagacggggtttcaccgtgttagccagaatgatctcgatctcctgacctcgtgatccgccctcctcggcctcccaaagtgctggcattacaggcgtgagccactgcgcccggccagtaagtgttagttctatccactcacattcattttctagttctcagctgtcatttcctgctggctgaaaaggtacacaaagttatcccttatccttttcttttgctgattctattccactgcaagctgaaatatttgataatcaagcttgctttaattgtatctaaaatagtaatgaatgatggattaaggcctgaggaaatagttaacaaacttcgccatctccagttttaaacatagacacttttaggacacatcttcgttcttgattatgttctgcatagttgaggtcacgtacagggactgacctccagaaaagtaaaatttaatggtaatcaatacggagaaaaattgtggacatgatgaaatctaactatgtttttaagcaaataaaaatagagttagtgaattatggcaagacaagcaacatttgataagcacctatgacctggaaccacatgctatgaacaattgcctcatttaatccttattagtggccttctaaagaagttactgctcttccctttttacagattttttaaactgtgacaaaattatgaatttatgaaaatgtcaactcttatattcagcatattttccacttataaattctctacttagaaattattcatgcggcatattctttacttaaaattatgatagaatcttaggactgggagaatcactagaggccattgaaatacataacataccttttcttaaatttcgatgataatatccatgctgaatgatgattctctctaaatctgcacagcttcaatgtcaggaaacatactgtctcccaagacagctggttctatgcttgatgagcatcaactgctagaagattctgcacagtgagcataaataaaccatccaaaggcttcttactgttggtactagttttcacagttagaaacaaataaaacataaaattccatgtgttagacctttagctacatgaagacccttctgatatgccctggtatctgcttttctcctggttaaacattcaattttctccaataatttctctaatgacatgatttcaagtaaaatcactatcatattagctttctttattggagtgtccatatcttatcgctgtctcctaaaacaaaaatatttcgagttcaaattgggagttagaaagggattttcatttcctttgccccagatactatcatcggtcatgacagccccaatgtcacataaaatttggaaagtcacatcaccatggatccatatttcaaagataagttgaggtaatacagaataaagtaaaccataggctgctgtacattatgtaagtgttaataataattattagtaaattattatcaattgaaactcataggtcttcacccaataagttgtatctcttctatccagttttgtggtttcttcacctcaagtgaaaagagttaactctttacttcagattatagaaaactgtcttctttagttgacatgagatccctggcttgcctgctttatatctattccattctgtcccaaccaatcctattctatagtttcccccattcctcattcatttttctcctttccttttgtacatcactctgatatattagctatatagactcatttacatgtattcatgtaaattattaaggtttgtgtataagtatatattgtgttaaagttctcattttctttcttccttttttaacttttagtttaagttcaagggtacaagtacagatttttttacataggcaaacttctgtcatggggggctgttgtacagattatttcatcacccagatgttaagcctagtacccattagttatttttcctgatcctctccctcctccaagccctctaaaggtacatctctttgttgtattggagaagaaaacctttttcagcctccccctagcagagcacccctcaagtcctattgaccaggattgggtcacatgcccatgacccagctgtaaaggagtgtgtgaaagaatatatttgacatgtgtattctatacggtggaacacatttctctctgtaaggaacaggcatgggacatgctggggaatgactactagaggtaaccataatttctgcctaaggatggtcattatttttaacaggttcatgttgcctataaattcaataagtatgccttatatatttttattcaagtaatatttatccaagttcacttatgctgtctacaaaaaagttggtgaaactcctttgaatgactagcatgctccaagcatttatagttatctcatttggttcacacaaaaataattgtttcataggctttattatttctactttataagaaatttcagcttaaataaattagctaatttacccaagttctcatagcctagtatcaaagctccgattaatataaaagtcagtgtcatagtctgactccaagtccatgtttattctacttcattattttgattccctgagggctattagaaatgcctctccaagtaggtccattgatcagaaccctgaatatgttccctctccttcttacaccaccttcaccctgtagcccccaatagatacatttcctcctttggtcctcaaggctgttgtctgcttaggcttccccactactataagcttggataaactgtatgcttcaaaaagcaagattatatctatttttcttcactatcatatctcctgcactcacatagtggcagtcaaactaaggccttgataaataagttttaaatatgaatgaataataaatgaatgaatacatgcactattgcaatgtctcttgcatcacacgttttctgccttattactggtttccatcacaacttatctgacctcagttacctggcgattattttttttaacttggcatacactgcccatgataaggcactaatgactatttcatgatacagttactgcccctctcaggtaacattttcacctttactgaggcttctaagagacaaggtctcaacctaaaggaattgctctgattgtgagaattttagggagtatggtagttctaggggcttcatgacctctcagcttatactgcctatgtgaaacctctctaggtcctcaggttcccctttaagaaaatgttaaaaagaaacaaaaaagaatcactttttttgtttgtactctaagtgtatctcaaacacctcacatattcaaattattctcttgtacaaaattaaatgccattggatgtagaaggagtggagcataactggtctttcatagaggctggaatttctctgagagcaccacacaagtaactcttgccacagtctcaattaataaaagcctttactcttttttcttaatttttctttcctttctatcccttgcatagatacttaatagatttgaagttgccattaatttcttaaccactattcaaaaggaaaacaaacaaaagaaaacaaaaacaaaaacagcatttcctttgttgtaaagcaaaataaaatcaggccctaattttccacaacagaagttgtccaaaatacttatctgtgtttagatttcccaaaattcatttcttcataataatactgtcagcgttcagtgttgtgatcataacattcactagtgtgacttaaaaaggggaggcaccatgtgttaagcagggataggatctaagaataacaaatctgcctggtaagcagcacaaatgagtcttacactaagccacactgatccagcttggagggaaatgagtcaaaaccaagtccccatactctctacctgcgagaaagaggtgacattgaagaacaagcccacacttctggatatggtccaaaatgatcagaaactcactctgtcaacctagtaggtgtttggatggatacctcttttttaacagaaagatgtttggagccaggacacatggttttcacattttaatggcaatgctcataggtaactaactctcttcttatatacgctaatttgcaacatgcttagtgtttttaagatgtttatttagcaactattgtttaatgctataacagatattactatcaaatgaaaattcaaacttttgagaaaggaaaagtggatatatttatgcattgagtttttggctttagataatttctactttgatttctatttattaaaatttttaaaatcctaagtcaatcaaaacagatcaagatgaaacttcctcatttgtatatgtctttgtatatatgtctagtatatatatatctagggtaaattatataacttcatattagatatttcattaaccatggcttcagcaaagtgagaattatgacaaaaatcatcttcatatccaatgatattaattctaaatataaagtctacgttccttttatccattaatatgatttattctcaaggaaatatgagatataccaagtggtagaaatttttgctatcatgattatttttgaaatacagtattattatggaatcagatactgaactaaaaaaattttaggaaagtaaaatgaggtgacagtttttaattaattaaattaattgactttaagcaaataacaataagcttcaagtaatccatcccatactataaataattgcacataaataagcaatttgtattcaactaaaatacccaattaagaagactgaatggccccaatggtcccataaatatgtcctaatccttttatcttgattgacaacagatcttgttctttgcccagctcctccaataaccaataggagacatttttatcttttttcccacttttagttttctgggttcatcaaataaatatgttggactttattttacattggacatgtcaatagaattgattttaagtgaagtaaaagcataaatcgctgtttatcattctacttttcatacctaattctgtttgctgttcttcggactattgatcttaatacaggctttctctcctttttttgttctttttaaagtgatggtaaaatttaaaacttgcttttctgtttatatttaaagaaacacataatcaaattattgacattttatgaaagatcaaatgcataaattttagcaatcataagaaaaaaaacagtaggcaatggtatagaaagcatgaccatctgcacttatttgcccacaaaggataaatgagagtgtactgtaaattgtaaagaaataaacatcttatttcaagctctaataagcttatgtgtcaatagttttaatagctgcctagttggtcttcctgtctctactttcttcccacttcattctgttacatatccctgtgaaggtgatctttatgagaaaccatgttggttttctgtccaacaattacgtatgactccccactgccagaaaataaataaatacagctaaaaacctcgtaagttcccagaccttctccactctggctacatttaacctttgtgtgtttatttttctaggtaaattgtacatgccaaccagattgccaaactcattgtcacctctaaatgttaagctttcccatcgatgagtgttttgtttattcacttatttacacacacaaagacctctttttcttttttcttttttttttctttttcttttttcttttctttttttttttttttttttgagacagagtctcactctgtcgcccaggctggagtgcagtggtttgatctcggctcactgcgagctccgcctcccgggttgacgccattctcctgcctcagcctcctgagtagctgggactacaggcgcccaccaccacacctggctaattttttgtatttttaatagagatggggtttcaccgtgttagccaggatggtctcgatctcctgatctcgtgatccgcccacctcggcttcccaaggttctggcattacaagcatgagccactgcgtccgcccacaaggacctctttatcaacttgacctatatttgaaaacctatattaaattctatttctataagaccttcccagccaggcctgaagagatacccttctccagaggctctgcagcagctactgcccaaactattcacttagaatctattgtgtactgtctagtgaaatctcttcagtattgtcttgacttgcactatcatttagtttttcacaaatttgtcttacttttcctttattaaattcattgaggacagggactagttcgaacttcatgttatctgcaatattttatacatgatatgtaatcaatatttattgatttgacttaaatttaatatgaagatttcatatctaaagatgtttcattatctatcattcaaagtatttttcctaaaactttcctaaatatgctctaatgttgcctgagttttattctcatatattatcgacatctgctgggaacatactatgtacaatgcattttcataaatatatattttgtccttccattatattgtaaatacattcaggctaggtctacgtcttctagtttgtagtctgagagtactctgagagtacatcatagagtagctattctataaattgagaaaatggtcaattgaaatttcatctaaggggtcaagatatggttgctgtcaggtaccaaagtgaattatgaaagaaataaaaacacaagatgttaaagtaaatacagataacagactttaggtttttgaaaggtttatacttttttattttttattttattttatttatttattattttgagacagagtctcgctctgttgccccggctggagtgcagtggcacaatctcagctcactgcaacctccgcctcccagattcaagctattctcccacctcagcctcttgagtagctgggattacaggcacacgccaccacgcctggctaatttttgtatctttagtagagacagggtttcaccatattggtcaagctggtctcaaactcctgacctcatgatccacccgcctgggcctccaaagtgctgggattacaggtgtgagccaccgtgcctggccaaaaggtttatacttatgtcagggatgtgtgaaaattcttcagaggcaatttgaaggagtgggtctataaggagatttcgttggagaggcttgctgctgtgttgtgagttgaaccttactcatcaaattgagggctggatgccacattctaaaccagagtgaccatagcttccaggagtgctccagtgtcatctaaagttggtggaagggaaggaacaggaaacttagactagattctccacctgcctgaggaatccaaagatgaaaaagcgtgatgactcttaacccgaggtgtcaggaaagagagagaaagaattgctgctgtgctgtgttggaaagtaaatgtgctcccctcctactgcaggttaagggtacgtgaatcctgtggtctagatggggaacccatggtaggagcattagtaggcagtttgtgtaaaaatagttcttcccaataggcctctgttggaaggtcaaagaatcccactaaaagagttgataaagaaggaagaaggagtaaacgtcagtaaaccaatagcaaaggggttgaggaaggagcaaatatgagccgccagtaaaaagagaggcaacgtctgcctgccttcacagttctctagagtgagtctcagctgcaggaatagagtgggctccaaggaagtcataagtgtcccttataacaaataccaactttaaacacctcccagtctcagaaaccatggagccatattgtatcagtcaagtgaataatttctgtgcccccttccccctttttttgccaccaagttcagtcttctaggggacaaaacacataaatctgaagatggagacaatggaaggatagaaagagggaagaaggcttccaaatcttccttcaagacagcctgaagttagcctagcagacaaagacgattttattctaaattgcattgaaatttttgatcattatatgtgactgaccattcttattgctttgtttttttttttaagagatcgtgacactactatctaatagtgagccgaaaagtcctggggtctgctgaagacttatctagaggcaatgaaacccttccccagttaaatatgtttcaagatagggtaggagaaaaaatcgtgttttgcttttgttatgccatatcagttgttcaatagttttaccctcaatcaaatacttgttattaatttttttgttcttaaaatcctttgaaaatcaagtttaagtaaaatatcttctaatacaaaagtttcaacttttcatattcagttatattaaacttgtattggaacacccctttagaatatactgtagtttacctgtaattcctgtgtcagttttctgtgcttcccaggataattgtataacaaatagattacttccattcagttctattctttctatccatcaaacatttaatcattcatacccttagcactgtacaggtgctgtgggcgtctctaagaaagattataatatgtccacggttttcacagagcttgaaatatttttgaattgacaaagcttgtatgaaagtaatcccagtacagtaaaatataagtacagtagagtccaatcaagtgcctagacgtgtagatcataaatggcagtacatcgtcagattaacatttcatacgtttgtctaaaagtttacacaaaaagatcactttggttttggatcagattaaatgcattatataaatatttaatcactttaggaaggtcatgatgaattcattcattccaaaattaattactaaatggtgaatacaagccaggtactatgctatgttttagacatatattggtgaataaaacaggcattttccttccttcatggaaagcacaacttgatgagattctagactaatatgctgtccaagtaaatttctcatataaaattacgcaatttacaggacactacacatgcccacactttctaaatagtctctctcaatgactacagtactatttgaattttgtcattagagggtaattctttcctactactttttagtattggccaaaacttattgagaacttgttatataccaaacaatgttatgaatatttacatgtcttaactggtttaatctttaaaagagcctcgtgatgtaaatactattattaatcccattcatagatgaggaaacaaatatagaaagtatatgtgacctgctcacaatcaagcagcatagctggggttctgatccaacattatcaatataggaatctttggtttaaatttttaaaaacacacatttgggcatagagttaaatggaaaaataagacatgcatattaataacaaacaataaatgagaatacactaaattattaattaaaaaactgtgtgtcagattggattcttttttttttttttttgagacaagagtctcgctttgttgcccaggctggagagcagtggcatgatcttggctcactgcaatcttcacctcctgagttcaagagattgtcctgcctcagccttcagagtagctgggattacaggcatgcgccaccatgcttggccagtttttgtatttttagtaaagataggatttcaccatgttggccaggctgatctgaaactcctggccttaagcaatccacccagctaggccccctaaagtgctgggattacagttgtgagctaccgagcatggccaggttggatttttaaaacctagttaatttaggccaggtgtggtggctcacacctgtaatcccagcactttgggaggccgaggcgggtggatcacgaggtcaggagatcgagaccatcctggctaatatggtgaaaccccatctctacaaaaaaaaaaaaaaaattaaccaggcgtggtggcgggcgcctgtagtccaagctactcgggaggctgaggcaggagaatggtgtaaacccgggaggcagagcttgcagtgagccaagattgagattgcaccactgccctccagcctgggcgacagagcgagacacgatctcaaaaacgaaaaaaaaaaaacaaacaaaaaaaactagttaatgtagggtctgatgttagaagtgctttggaacttagacttcactctttctacacctcaatttactctgtgaaagagaactaagaatatctgctttgaaaacctcagaaaattgtagtgagcacaaatataataatttgaatgaagatgttggggaaaccataaagtcctacgcatatgtctgttcttattgttactctttgttcatttgaatctccctggaaaagcaacagccacgcttattaaaaggtgttatacgtattcatattactttttttaaatgaattctaataattccctaattagatatattttttgacttggaatcagaaaaaaaaagtagaaagtgaagttaaaataataaacaggaaaggagcttgttatggtatagacatcatgttttacactggcattgcagggaaggaggaaatggggccttccattcaccttagaagtccttcatggtgagagttgtttggactatttatatttctggcaaacttttaggaattatggggaagtataaacaagatataaggcaaaatcactgtttccaagtagaatagagtgaaatctgcagccagggacagaatatacaatgtctgagaaaaaagtctcgaaataaataaattgtatcttacatcagtgccaagagcgatcttttttcttgtttttgtttgtatgatattcagtgctgcatgtatatctgacagtgatagttggaatcaatcacagtatttggcaaattattcctagaggaagaatacaaagcctgccatgactgcatcttttttcttcatgacacaggtggaatatagaattgattttacttttccttattaagtgtttacattttactccattacagtcctaaacctgagctattcatgcacttctgcaagattatacaagtaaattacgtgaaacttctatttttgatgtgaatatatataattttagcccttttttattatttaacaggaatccactgcgaagaagacgtcaatgaatgttcttcaaacccttgccaaaatggtggtacttgtgagaacttgcctgggaattatacttgccattgcccatttgataacctttctagaactttttatggaggaagggactgttctgatattctcctgggctgtacccatcagcaatgtctaaataatggaacatgcatccctcacttccaagatggccagcatggattcagctgcctatgtccatctggctacaccgggtccctgtgtgaaatcgcaaccacactttcatttgagggcgatggcttcctgtgggtcaaaagtggctcagtgacaaccaagggctcagtttgtaacatagccctcaggtttcagactgttcagccaatggctcttctacttttccgaagcaacagggatgtgtttgtgaagctggagctgctaagtggctacattcacttatcaattcaggtcaataatcagtcaaaggtgcttctgttcatttcccacaacaccagcgatggagagtggcatttcgtggaggtaatatttgcagaggctgtgacccttaccttaatcgacgactcctgtaaggagaaatgcatcgcgaaagctcctactccacttgaaagtgatcaatcaatatgtgcttttcagaactcctttttgggtggtttaccagtgggaatgaccagcaatggtgttgctctgcttaacttctataatatgccatccacaccttcgtttgtaggctgtctccaagacattaaaattgattggaatcacattaccctggagaacatctcgtctggctcatcattaaatgtcaaggcaggctgtgtgagaaaggattggtgtgaaagccaaccttgtcaaagcagaggacgctgcatcaacttgtggctgagttaccagtgtgactgccacaggccctatgaaggccccaactgtctgagaggtgagagaaagctgagtgctatggctaggagtgccatgcctcagagcagagcagaaacagcaaaaacagccagactgcttctgcctgctatgaaacataatgaccccacaagacttctgctgctggttgcccactgatgagaaagaaaagaagagggcagtgatgtgcgttaattaattttgagtggattcataggacatcagtttcactcatacagagaagtaaaaaaaataagcagatagctcttttccaaagaggttttcatctttgtgtttgcaaaatgctactgcaattttaccattggtcacatatcagaaatttattgtaaatcttatttgaaagagaaataatcttttgaaaaaaaaaaaccttagacataaaatttgtcagtgccacatactagcatgatatcttgtgcatagtaaattctcggtaaatattcatttccttgctctcctttccatgcaattcacacttgctccacaatcataattaagcatagcgtttttataaaacgccaattttattcaaaggtatcttttccaaggttgccctggagaagacagataatatactaggtgtcttaagaaaaaaaaaaaagaaaaaaaaatgtggaaagtaacaatagtagaacttggtagatgccataaactaattgatctaatttctctagtaaaccacagtttgcaaagtatttcaaaatccttaacttccaacattgttctagagattgctgttgatagtgatcaatatatacctgtttctttttattattattatcatacattgaaaaagtctgagaggtaattgtaacggactgctttgaagttcagctgtaatttaccccaagattttagagtaacttgaagtaggacaacatctggtaagtagtcttctctgctttatatgaagtaaaattaaaaccagtcttagcctatactctattccatgttcaaatgtctaagaattattagaaactactcaagggtttcccccgaccacaatattcattacaaatcacggacctgtttgacaatgaagtatggtatctactagctctacgtaatattttaagtagaatggcaagttgttttgtgattttttttaaggagaaaaagggaaattatgctgaggcaatgttcactttttgaagaaaaatttaattgacctaaggcaatatttttactacatatacaaaataacaaacagatgctgactcattttgactggcttccagatgcagtgacccatgaggttaatactgaccatggtgatgttaactgtcctagtaaatagattcaagagatgccaatccactgggttctggttttctttattttatccaacttggaaaaccatgaacttttcaaaccaagttcctgaattggttacccttcccccacttctcccagtttccttatactccaacattatttgaaactgcttaaccctcaagaaaatatttgacttcaaaagatcactttacagacagagagagttctgtgaaatcttttctttctgaaaattcttggtataaatttaaggaaaattatatttttcatatcacctcttcattataaaattaaaatattctgtattttctgttatcttgaaggaatgtttcctggagagtttattcccactaaaaactgcttttaagtggtaatgagaacatggagtctttctgctactgtacatatacgtgcaagagggaggagacatactaaaaagcacaaaggcaaacttcagcccattcatgacttgcactcatatttggctcaatgttttccaaccatggtatacattttaatgaacaaggagactggatagaggattttggtggctgactaaacacaaaagacatagtgatttccaatgtatcaaggttgatcttttttaaataatctaatttctcaacagaaagagtgctgaaaaggatttaactaagcttaggtcacagaagtgtccataaggttctctcagcatatcttgtgttgactgtttgtaagaacatgcagcattcaagatactactactcagaataaatggcatcacctacctcttgctctctggtgaacatttgacttacaaaagcaatttacatatctcttcttttcagccatatacctagattttgagaattttattctcttagaattatagtttcctagatatagaaaaagattcattctatgactgaatttttaacacaattgtacctgccaaatgtagtggctcaaatctctgctcaaacaccttcacaaatagagagatcactcactccatcttgccaaaaattgcccaaaagttatttccttatattgaaatagaataggatttgcccgtagctttccttcattgaccttgttgcatttctggaacacatgcaaataaaaatctcaacttgcctgctgcttgagaatacttaatatctgaagaaaagtatctcgagccatctaaaccatcacttctattcaggctaaacatcctgtttcttctaatgtttgccatatgacatagttttccgacacttcatcagctgcttgcaggttttggaatatatttgcttctttgtattccttctaagatgtgatgtctgtatgtgctggatgatacagtgacacacagggccataacctcccttattctagataatgtgcttctgtttttcagcttaatacaacattgactttttggcagccacacttcgtgattgcgtcactttgtatcattgtcactcatgatgccacatagtcctgtttctcccactctaatcttataaacgcacatttagatcgaagtggctcttatttattcttgttaaatttcatcttgttgtattccatcaatcattaaagcttgccaaaattgttttttatctgtatgtgttgttcctcttcatgacatgtcaaccacttgtatgagtatcacccttccaaatccacagccaagtcatatgtcttcaggtgtttctaaagtcatgtagcaaatcacacatgctgattagttgcttgtgatttctgagaaataggattgctgaagaatcaggcttctgagaaaaaaaaatactctgcattttggcttttaatccagatccacaaagtgatgctgaaggcatcctgggatgaccagcaggcaccccgctacccctgaggttgagtgattctgggcatatcttcaaacctcaggggcttcaagggccaaattttcttattaagcattttatctcatatgaaagtgctgcagtgtattcagagatgttaacctcttcaaaggggttattttatctaacagtacacttttgaaagctaccggtagttgcctggagcaggtggtctccaaatgcagattcaaaatgcaatgttcctgtattaaatcaagtcagagttctgaaaatatagccttttatgcagaagatcttcaaacacagttgattgtctaagcaagttttactatagttaagctaaactaaaatgtgtcttacctttgcccaaacttcagctgggccatatgatgacatttagacatgctgaaatatgctctttttttctggttagtactgggatataaaatcttgaagacagcaatatcttgaagacagtgatcttgtcaagttatcaatgctttctagactgcaaaatcaatggtcaattctgtccccatcttacttgatttctcaataccagttaacacaattaaacactccctcctcctgaaaaactattttctcactaggcttatgggacaccacactcccttggttctcctcttatcttactggctactcttgcatcatttcctttacctctacttgtctaatgcccaaggacttacttcttggacctctcattttctctatatatactcattctcttggtgatctcatccagtcttgtggctctaaatatctaatatggtttggatgtatgccccctccaaatctcatgttgaaatgtgattcccaatgttgaaggtggggccgatggaaggtggtatatactaacaaatcccacattatcagaacatcctgcctgaacctctatatcaactgcccactagtcacttctgcttggatatccaaaaaggcatctcaaatttaatatggactcccacctcacccaaaaatcttttcctccagttttcttccgtatctctgcaaatagaaagtccatgcttccagttgcttaggcccaaagccttagagatgaacttgctccagaaaattctgttgtatctaccttcaaaatattttgaaaatctgaccacttttgaccactttcacattaccactgatccaagccattatcatttctctcttgagttgctacaataatgtagtataactttgggcttttgctcagatatcactttctcagagttcctccctgattgttctatttaaaattacaattccacccctccaaatcgccctattccctttctctacctgacattttatactaaaggatttctcaccatctgacatattatatagtttgcttccttgtctgtgtctggtgtctttcctccaactagaatgtaagcttgatgaggatgggaagttttcttcctactatgtcacccatattttacaatgtcagtttttatttttatacatctcaagagttttcttgaggtgatgcacatcaatagcattgccacagatgagcatcactaactcctctgaccacaggaaatgcagggtgggtttaatactcagctttgccccaagttctctgtttcctgtgcctttcctactcccaaccaggaccacagaaggaagggtccttctttttccttgttcaactgccttgcttcttatgtgagatgtcatcccaagagaagatttaatcatctaattcttgatttctgttgtcccaatttatgttatttacagactaaaaacctgaagtttagaaaggttatgtaactagcctaaatcacatgttaatagcagacctgggacaaatacattccaggctctaaaaaatttctttacaaagaataattaggtttaatgacatgtttgcttcagcatgcctctaagtagcaaagattatgactccctgcacagtccacttgcagagggttgcatgaagtgcccttgtccaaaaatttcttccaccaggttggagtatagtagtgtctgatataccaccattaaggcccatattttagggcagcaaaggggagattctttagtttatcagtgcagagatctttttggtctgttttgtgatcaatatgcctgaagtgtaaactacaaaccaaaatatagttattttagggttaaagtaaactcagaagtccagaaagaggccaaatcattattctatttaataaacctgtcctgaactttaaaagctatgtatgagtgtgtatgcttgtgtgcatgtgtgtgtgtgaaatgtataattttcgtcttccatcccttctgtcttttgagccttaagatgtttctttttttttctcctcctcctctattttgacattgaagagtatgtggcaggcagatttggccaggatgactccactggttatgtcatctttactcttgatgagagctatggagacaccatcagcctctccatgtttgtccgaacgcttcaaccatcaggcttacttctagctttggaaaacagcacttatcaatatatccgtgtctggctagagcgcggcagactagcaatgctgactccaaactctcccaaattagtagtaaaatttgttcttaatgatggaaatgtccacttgatatctttgaaaatcaagccatataaaattgaactgtatcagtcttcacaaaacctaggatttatttctgcttctacgtggaaaatcgaaaagggagatgtcatctacattggtggcctacctgacaagcaagagactgaacttaatggtggattcttcaaaggctgtatccaagatgtaagactaaacaaccaaaatctggaattctttccaaatccaacaaacaatgcatctctcaatccagttcttgtcaatgtaacccaaggctgtgctggagacaacagctgcaaggtaatgattactcatacaaactaggtatatactgtatgctaaacttttactttattaaaaagataacttattaaaaccattctttgtatataaagatgatgttactgacccaccagtatagaataatatttcatctatattgttccaacaagactgtgaaatttacattgagccatagaaatgaggccttgatcttactggtatcaggatctatttaactaaccaaagtaacttcggctataggcttctctcaccctcacagcaatcaaattacttaggtataataatatttcaattcctaaactcctaatggcacaccagaggtttaactgaattaactctttttggatgatattgttaactttattttaaatgcccaactactattgttttgaacttttattaagtcagaaacaacaagagaaatctgagaggtaatttccttctggtagttgaaatcttccgaaatataatttctcaaagcccaagctttactttaaatattctatgtgctcttctaagagctgcttaaatacaagaacttgtcagctctgcatgacctttcaaaggaaaaaaaggaaacgcatttctgtgtgttgagcgtttgttgagctccaactatggccctacactaagcttggttctaaatatacacaaatgaattattgtaacatagttatggaacattttcaatgtactaggcactattttacatggattaatccacttagttctattgaaggactactgtggaaagcaagcattattgttgtcccaatttacattatttacagatgaagtaactgaagtttagaaaggttatgtaactagcctaaatcatatgttaatagtagacccaggacaaacacagttcatgctctaataaatttctttttaaatactttcattttgaatactttttgtgagcaaccttgtgagaactcaaataataatactatgtctctgattcagaggcagaccaatgtgggaagggcactcactgagttgggatccagaggacctaagtaccaagtttcactgtttcgcttctgtgtaggatcttgggcaactggaaacaccttctttttatcatctataaaaccaggagtaagaatcccttcctcaaatgataattagtgcatgtgaaaaagtgcctggtaatttgtaaattacagaggacactgctatacttgaaaaaccctccttgtgctatggatcaattttatatcttttctctctctctgccaccactctgcccttttagaaaggagttggtaatggcagtagtcatttttattctatttagttaacaatggatcttaaaagtttaaaatgtaaagatgcagggaaattagcattttaaaaaaacagatatgtggtttcaccgtcaacatttttctatttagttgccagtgctttttatacctttgatttcttttctgctcagtccaacccctgtcacaatggaggtgtttgccattcccggtgggatgacttctcctgttcctgtcctgccctcacaagtgggaaagcctgtgaggaggttcagtggtgtggattcagcccgtgtcctcacggagcccagtgccagccggtgcttcaaggatttgaatgtaggtagagttcaaacctaccatctcaccagttaagttgcgacatttgagttgttccaagagcaaacacagaaaaagagtatagacaaagccagtttattaaattaatctatggttgtttcccctatgcgagtaggctaatactgactggcctcttgcctcatcctgcccttggtggctgtctggataggaaatggaggtcacagcaacactaaacctagatgcttaatcatttaaaactgatttcctgaaaaagaattaacaaggcaatatttgaatttccttccctcattactgggaacacagaataaatatgtgcatgttacgcattgccatttattaactatgaggcctcaggcaattcatgtgatctccatcatctaaagcttcctcacctgtaaaatagggagaacactttctacttcttcggtttctttgtgatgattctatgaccttatctgtaaataatcaaacatgttaggcactcaattaatgatatctatgagaatttccctcactgtgaaaagttttcctgtccatcttctgtactacaaaaaacaattttccaaatgttagcaatttgaatactatacagtattcacaattttgacatatccacccactaactatactgttatttatattctgtcttctcacctacttcaaataattcacagtccagttaatagccaaccctctaagtttgcactgaattctaatttcttccccttattcaaagattgtgctcctaaaacttttctctcacacaccagtatcaatttttccatcattacaaaaaatttcttttgacacttcctcactcctattcctaccagttaccatcccatttctctgccttaaagaatagggagtaaaaaaccctttaatgtgttgtccgcaatatgcttctgatattctcactccattctctcttttgctccatacagtcaggcccacacaccaccacctccctcctgaactctcttaacccagagattcacaggtcacctttgtcacttcattcaggtttctacacaaacatcctccaacttggctttatttttatttttatctcttattgttccttgatattttgttacatatgcattgatatatttgtctatcatctctttcatcatgagaatataagcttcacaaggcaagaaacttttctatgtggtttcttgctcataaatatttgtaaaataaataaattgatattattttcttcaaatttacttaatattttcacttaactgctgtggacattaagtacattatcagcttactataaaaaaaatacatgctggatgcagtgactgacacctataatcccagcactttaggaggcagaagtgggaggactgcttgagcccaagaatttgagtctgcagtaagctaggatcacaccactgcactatagcctgtgcaacaaaacaagaccctgtctcaaaaaaaaataaaaataaaaataaaaataaaaatactgcactaaaataatggaatggaactagaggatagtttggcttaaggtcagtagcaatgacatactatctagactgggccccgaagtaactgagaaaaagagaaaaatgaatttacttttatgtttctgtacttcaaaatcatattatttaaaagacctgtatgaaatacattacactgtatatacacttggggaagttctctagaaaaacgtatatacttttatgtttcatacttaagaaataggtaccacacatgtatagaaaacatgatgcgttggcataaataaggtaaattggtttttaatggggcactaaattttaaatgatactttttcattctacttctttaattattctaaaataatttcttaattattaattttactgttgatcttttgatagaaatactaaagttgttagtctcagctatgttctacctggtgtccgaattgttttgaatattttcacaggaaaaatgaataggatttctaaaaacagtggcagccccaaaacagtatgcacactgctctgcaatctacacatcaaacagtttaggagctggacaaacatgtgtcagaaggaagtgaagtgaacttttactgctacaacattgccaatagcaaaagactagtaagtccagctctgacacccccagaaagtcccagtagcattttttaagtatagcttatcttagtgtagagagaaaacgtaaataaataggtgtacaataggaattataaatcaattttctaattgacaggtatgaacccagaattcacttttactactctcataattttaattttatgtaatcttatgactctattatattttctttccaactaaaatatattgaaaagattaagtctaatggaacaagatactcttgagagtacagctgataaattgctctgagtttgcctttaggactttaatcatctctgtatcgtaccaagatttaaacatttacaactcaccttaaatacaggtgtgcttattatggtaaagttccccaaagaaaaggtgaagtacaaaagtgattaggtatatcgtggtttttacccagatcagaagacatgatttcagtgtgctcagcagagttagtaaatatatttatatagcattatagaccatagtcttcatttcagagttggagaattttggagattttttattttaacatttacttaaaaacatgtaatgaaacacttgttgctctttttttccctaaattcccaactccaaacctggttgaaacacacacacacacacacacacacacacacacacacacacacacacatagtaaaaaacaataagatcaaaggaattgatttatttaattaagtcaaataatacacttgaatgatacactgaaattttctcctgctgtggtttctaatcattatctcacttttcaggatacaggatggagttattttcatagagtattcatttaattatgtttactgagcacctactatacatcagggacacacaggcttaggcataaggatttagtgataacctagacacagaggatccttggtttcataaagcttatgtcctagtgcagaaagacagtgaaggaacaagtaaacaaataaacgtaattttaagtggtaatgggagctatgaagaaaattaagcatagacagtgaatgcagggaggcggtttttttaacttggatagtcagggaaaagcttctcagaggaggtgacatttgagcgatattaacactaagaaaagccaagtataagaagatctggggaaataatattcttggtataagtaacagcaagtataaaaggcctgcgctgggaacaagcttggtgtatcttcaatgaatggcaagaaattgtggctgtggcctgtgaatgaattggaattggagagttaatcaggggccagatcatgtagatgcttttttttttaacatggcaaaattttgtcatgaattttttttttttttgaagagagacggggtcttattatgttgcccaggatagtctcaaactgctgacttcaagctatccaccctcctcagcctcccagatagctgagattatacccacaactggctcagatcatgtacactcttgtggttatgtttagaatttaggatttcttttaaagatgataactaatggagcttgactaaggagtggttgttatattgatctgcagagcagtagaagcagggacactaagaagtaattagtcttaatgaaagatgatggtggttgggtgtagtgcctgataatgtattaatagtgttttcaggtcatttgctactgaaaagtgtgatacaataaaagtagataattggccactgcattgagtaacatggaggtcattcattgtaaccatgaaagtggttttagtgaagtgactgggacaaaagcttgagtggcatatataaaagagaaaaatgaggaataatagagtgagaccatggggatataaaattagtaagttttgctggtaaagaaaatagacaaaaaagcagcaggattgggggatgtcaggatactgtttcgtgtgtatttttattttttaagattaaagcaattacacatatttgtatattgatgggaaacaacaaaatggaaggggaaatgatgatgcaagaaagaaaaagaatgcatagaggaataatatgtttaaaaggtgaaaagcagtaggacccagtttataactggtagagttgaccttggtgggaatacagacaatacgtctattatagcaggatagaatgcagtgtggatccaaataatattaggtttacagatttgatggatatctgaggtagctctgttttttcaagaaaatattaggtgagatcataagctgagacagaattagatattttaagagacagaacaagttgtttgttaatcatcttatagaatggggaaaaaagtttttaatagagaaatgcaataggattgcccaaagtgctctgctcacatatagcatgagagcaattgatatggttgtatatgaaagtacttgggtgtagatacagaatttgcagcttgtcacataattggagttttaccaggtaagtaaatcagtcatttggaatgctacttttaactgcctactcatcagcttaatcagaagccagactccactgttaattttctgggtcaccatagctagatttgtgatttctttttgctcaatttatttatgtgtaaaatgaattatcaatgctttatttgtgggagcaaatgcaaaataaaaattggcatgcattaggatttcactggaaaagaaatgtatagttttggttttgctatcagaccatcccagtttgatattctggctttgttatttattaattacatgaccatgaacaaaattacttaaattctgtgagtctcaacttcttcttccataaaatggggataataataatacctgtattcaaaagtttgatattagaaataatataaaagcaactagcacagtatgtaacatgtatcaaatagtcaatatgcaatgttattaacacaatgatcattactattaataacggtaattaagcaaactatagatttaataaagttattgattattatcaccttctctcattaggtattgcaaatgctgtttttaatggacaaagcggtcaaatattattcagaagcaatgggaatattaccagagaactcaccaatatcacatttggtttcagaacaagggatgcaaatgtaataatattgcatgcagaaaaagagcctgaatttcttaatattagcattcaagattccagattattctttcaattgcaaagtggcaacagcttttatatgctaagtctgacaagtttgcagtcagtgaatgatggcacatggcacgaagtgaccctttccatgacagacccactgtcccagacctccaggtggcaaatggaagtggacaacgaaacaccttttgtgaccagcacaattgctactggaagcctcaactttttgaaggataatacagatatttatgtgggagacagagctattgacaatataaagggcctgcaagggtgtctaagtacaatagaaatcggaggcatttatctctcttactttgaaaatgttcatggtttcattaataaacctcaggaagagcaatttctcaaaatctctaccaattcagtggtcactggctgtttgcagttaaatgtctgcaactccaacccctgtttgcatggaggaaactgtgaagacatctatagctcttatcattgctcctgtcccttgggatggtcagggaaacactgtgaactcaacatcgatgaatgcttttcaaacccctgtatccatggcaactgctctgacagagttgcagcctaccactgcacatgtgagcctggatacactggtgtgaactgtgaagtggatatagacaactgccagagtcaccagtgtgcaaatggagccacctgcattagtcatactaatggctattcttgcctctgttttggaaattttacaggaaaattttgcaggtgagcataaagtccatatgaagcttggtctttgaagctatactctgcatcactgttcttgtcaaattggaaagctctctcctcaaggtatacatatatactgtgctgaacagggtgacactggtagcttctgtcacaatttggtcatgttcagatgggatctcacttaccaggatattctacaggtcagaaaggtagtgtttaaatcagattttcagcaaaatattttctcagtcatctgtgtgaaaatatgtctcatgaactgtagccccagggtctaacagtttcaaggcctcgggaaacaaatgcatttacaataaatgcaaaagctgaaatgtagtattgttagggaaggcatgacttctattgctaaaataatgccttgagctatttcaggcaggtaaatactctaaaatcccgaaaacagtacattaaagtatacagctgactcttgaacaacgcaggggttagaggtgctgatgtgcagttgaaaatccacatttaacttttaactctcccaaaacataacaactatcagcctggttgaccacaaaccttaacaataacatagtcaattaacacatattttgtatgtcatattctgtcttcttactataaagcaagctagagaaaataaaatgttattaagaaaatcataggaaagaaaaaataaatttactattcattagtggaaattgatcatcaaagatctttatcttgattgtcttcatgttgattaggatgaagaggaagagaaggggttggttttgctgtctcagtggtggcagaggtgaaagaacatccacatataagtgaatccacaccattcaaacatgtgttgttcaagggtcaactgtaatttcaaaacagtggaattataattctcagacaaatataaaataaacatgttttaattattctgtcattaatgaggaaactagtaagatataaaaactaattcaaaggacaatctaaagaatatgtatacgtatatatacaaacaagaatgagtgaatgaatttattaataaatacaaaactgtttaatatcccatagggcaagaaaactagtatttgaagtcatcttcaatactgtgataatcatttgtatggctcactacagataaactaatttgcattttgacgaacaagattttcatattaatattgttttctacaacttacagaattgtaataaggcacagaccactgcaaaagtggataatcctggatagtcctttatgtaaacccagcagtgcattgaaagaatatgcagtgattttttttgcccatttcaaagtatttcacatttttctacaactacaaaagcagtattttagttcttgtaactacctccatttcaagctatataaacagagataagaaagactatttttcttctaagtcacattgcttcagtatttccatgtaagaagttattattgtttttacaacttacaccgctttaaatttactaaataattgagtcattatggggaggtgagagggttattattaacaagtaatacattccagaacttcggcaagaacacctggaatgggttggcagcctgtagacattacactaattcagaggtggtaccttaattgcatgaatctcctagcaaacataacatgtaggcatacctataagaagttgtacatctctccttaacagttactgttctgagcctgtgaaagcaaggcactgttgtaggtgctaagtgttcccaacaggtaacctgcctgtttaaaagcaagaagaattcaggatcaaatttagtatatttcactgtgaattttgataagtaaaataaacacataggccctagtaactacttctccagaatttttttctgcctaattcattaaagtcaagttctgaaagatgaaagccctcaaaaataccttctaatgagattcaggaattgtttattaaaaccaagatgtatacaaagcttcatatttgcattgctaattgacctctttcaaagctggttgacatttttggctcttttgaaaagtctttatgatatccttctttttaaagtagaattgattagctcttgcgggaagagacacacttagcatcatataagctagtctatccacattagctgcagcacacacaacagaacaaaattcaattcattttacacttcctgaatatttattagttatctgataccatgcacatacacagtgggtcaaagggcctaagcaacactattaaactctttaaatatcagtcccttcacattactagattttgtcttacagtgaagttccgcttagcttctaatacttgttccgccttttatgaggattctttaacatgtaaagctttgttgccatatcagagagccacactctgaattcacatgcagttaccatcgtgtgctatatacaaagctcctggacagcatttggcttgcattcttcgaagctatgaattattacatagggagcagcaagtcttggcagggcaactggagttcagctctgaaagccaatagagaaatcacatgagtgcttgggtagtagagtgctgtccttgcttcctggcctttatagagatgcaattttcctatggcctttattgatttattagcaaagcagcagcaaatctagttatagcaagttcttttccaacccaaaatttattgccaccccatggcatagatcttatctcacaaacgaaaactgtgtagaaatggaagatgtatagccatgcttgtcacagaaccctccagcaggagctttttactggagaaagtgattcttgcataatgcagcacaattaagcatttgtagctcctccagcctgagtacttaattagcttggcattgactacatacatgaatttatcagaaaacttttcttgaatgagatgaacaagatgaacagctgtggctcttgcttttatctctctagacagagcagattaccctcaacagtctgtgggaatgagaagacaaatctcacttgctacaatggaggcaactgcacagagttccagactgaattaaaatgtatgtgccggccaggttttactggagaatggtgagtcacattagagccttctggaagagaattctgagctaaagaatgatgggattactcaaagttcattttctcctctaattttttatctcagttcccataggaaaatctatgctgaaatagaggttcagacagaatgaaacaataaaaaagaagaaaaactacagtttaggtcaaaggggagaacattttattagacaaaacttcaaatagggaaaaatgatttttaaaaaatgtataatgtgctatttttctttcttataagtacttctgaattcatgtctcttttttgttgctaactctaatacatgatgcaaatatggttgctgtcgaggtaaaataaattacaactaaaagattgcctcatagaattgcctacaacccaaaagtatatataccttatccatatgagtctacttttcccagagaaactcttcaactgttcttcacctcatacaggaattcttaaaatggagttggtcaatggcttcaggcaatctgtgacctgctgaaaatacaggaaaattagaatatgtatttgagtggctaggggtaagttcaggggtagaaataatgcatactgaatagcttttatcagctgcttaaagggatttatgtccccaaaacagttatgaactggggctctatagaatacagatactatataagcagataattgttaaccttttgttttagcactgtgccatgcaccttacaaataccatctctaattcttatagctctgtaaagaaggtttcatgatttttattttgcatatgtgtaaactgaggctgagaggttgagtgacgtataaagggcctatccacacgtttgctgcagtaaggttgagctgccttcaaagcctctgctcttctatttgatgtgccagcataactgtatgaataaatctttgctcaacacaatttctttttttttaatgagaaaggtgttcttccatctcatgtatcatcgagggtaagataagtgatctctgatcaaacttcctacattgaaaaaattaaataaactgagctcagacatatttgacaaagatattttgactgactcaatatttcccataagcatagttaataaaataatggatatgtgagtgctccctggcaagtgccctttggattaattggaattttctgttttctagctggcctcttttgcatcacaaagacacaggtcttttgccatttttacaaaacagcggggagtctagggtatacctgaatttgacccttttaacgttcattttcatttgcagcctgccttctgtggttggttctttgtggtacaggcattccaagtctatatgtgcatgaaaggagatagccttgagtcacattctgctttctgttgcaccaattttggttctgcaacttattaactgagatcgtttagttgtattccaattccatgtatctttcaaaatattgcaaatattttcttgtcattaattttgagtaatccaactattgtcaagggtgggttgcttcctggttgaacgtcacactttctgcctaatggcacaatgcatggaactcatccaaaaccctggattatttttctctgccactcacacattgtttctatttacaacaaatatctccctgtcttctgatatttattagtttacaaaatttatatttgacatttaaattcagatatatttgaaatatagaaagaaaagaaagcttagagttttccttcttttcccaggagacttttcaactggaaaaacttacatgatgctagatatttctaaaacattgaacctgtgttcagtagattctatgctttcaaagtccttaaccatcattacttaattgactagatgttaatggatttatttttacttttcatgcattaattaacctctaataaaaatgccaatgatgctgataatacatgtgtatctattgttgactgtttagttcaacagagaaataggtgagaaagtgatggagtagttagaggaagacagaaaatagtgggctatctcccatggcctagggaaatgtgacttccatcacatccaaggatattgaaaagctatcctcaaataaattggcttctctcctgccttggttaaaccttcagcttaatagtgtcatcctggcaggttttgaatgatggatggtgtgaacactctggcccacccaagaccgagaatgcttggcaggctcctgagggttgtcaagttttgctcagatctaatcagagaagtctccctccagtccagaagcataagccaaaaaaggaaaacaaaatgtctcagctatgcttggtatccaaagggataaggagctgtttttcttggaagaaatctttgttttcctttataccttgggctggccttgccccactacctcaccccctttcattttgagcctagtgattagtctctgacccatacgtgcaagttttacattttggaaggtgagggaaagaataagggaaaattaaaaattgtttacatacaatttcaacattataagctgcactatagagatcttggagctaagattttatataaattttcaaaagtaaaatagccgccttagttgctgttctatcccaaggtcttagcagagtgtttgtcacatagtatgtgttaaataaatatccactgtgtgactgaatacatgattggtgacttaatccatgaatatacagaaaaacaaattcttgctggaaaattagtttaaaaaaatgacaatatcccaggaagaagaaaacttcaatttacctgagacttgatgtcacttgtcttggaaaatttggcttttgaaagtcattctacctcaacatttcagaaattatgcttggctattggaacacagatttattagcaagtacaatcttctaattattgatttttgcttttgttataaaaaaaggatttccacagaaaataattcaaaatctctcagaataaacctctcctcttcctcctcctcctccttccctccttcttttttttttttttttttttttttggtttctctttggtgggctttttccttagcctgagggctctgatgcatgaggatcctgatagcctgaatgtaggtctgccctgcagactccagatggcaaaatacagcctctctccttgtgcccctaataaactgaacatttatataaggtggcaaccacactaatgctcttgagcattgacactggtgtaggcatggcccacttttctcttggtttctaaatatttgcatctattttctcattctaattaattccgtgtgtatatgtatatatatgtgtacagattatttccattaaaccccaaatgtgttaaagaaattttaagaaacatctccgacattatcaagtatgtataaagtatgtgtggatgggtagataagactgtgctgttccagagagataaggcaaactttttcttcccatttcacaaccaatgtattcaacagggacctgggtttctgctgttctgtttattttgaaggtgtgaaaaggacattgatgagtgtgcctctgatccgtgtgtcaatggaggtctgtgccaggacttactcaacaaattccagtgcctctgtgatgttgcctttgctggcgagcgctgcgaggtggacgtaagcagcctctccttttatgtctctctcttattctggcagaatctttttcagcttctttcttacctcattttgcgtatgaatgacgagccagttgttgagtggggtgaacaggaagattattaacatacatttgaacattcccaaatgaaaaaaaaagccattgaatttcaagaaatgccttgattcattttagatctctggggaagaaaaaggaaataaaaaccatctcaataattaaggtaaattcaaggcttattttaaacatatcagaagcactttgtctgtgtataaaatattttcctattctaactttaaatatgaaaaaagtgttcttaatataactagaaatatctccttattgtgtgtatttagtacaaacatattatcattctcaacacttctatatgtgaatgaccactgcaatttcttcccactccatttctgggtattttcacattttaagttgccctccatcactatgattctattttcatttctgttctttcattcttatctattatttatgacacaaaaattgagaattacaggccaggtgtggtggttcactcctataatcccagcactatgggaggctgaagtgggcggaacacctgaggccaggagtttgagaccagcctagccaacgtggtgaaaacctgtctctactaaaaatacaaaagtaactgggagtggtggcacatgcctgtaatcccagctactcaggagggtgaagcaggagacttgcttgaacccaggaggcggccgttgcaatgagccaagattgtgccactgcactccagcctgggcgacaggtgagattctgtctaaaaaaaaaaaaaaaaaaagagagaattaccgattaaaattactgattatattcatctatgtttttacatgaagctattcaaatgaattgttacgttttctctgatatatgattaaatatataaagagaaatcaggaatttacatcgagtccctaaattgtagaaaaacaattatctagtatcagtactcaaattatacctccctggtataatttctgattccataaaactgtctctctaacaaagttacaaataatcctttctctatttcctttcctgcaatactttcccttttcctaacaaatagaacaatttttctgttgtttctaaatttatgagctccttgacttttctatcaaatggactaatttcagttgcttttcaatgaatatttaataaaaataagcactgtagtttatacataaatttaaaagtatatattgtaaaacttgaattttcttagaagcatggttttctaagatttgcaagtaaatttattttcttaagtatctttcagaaaaaaatatgaaagcatagtatacatcataaccaaaatatatttgacattatgattttttaaaataaatgtatacctgaaataatggatctataaagtatactaagatatgcaaaaattaatatattctttattataaatatttcagagattataaaataataatttaaaaaaactttcttaatgtttttattgtttccaccagtacgttatcatttatgctaaatatctttgtgtagatatacccttccaaagaagacgttatttgtgttcatttaaaggaaaaatagtttgatcctatgaattaattcagaaagcaactaaaataacaatggcctgccaaatgtcattttgtaaatatacgtctatgactttaggagctgtcctggtttgaaaacatgaggacagtttatccattggatgccatctatttagtcccaattaagaaagttgtttttttgtgagaatgaccaaggtaaatttaaatataccattcaaacaaacaaggacaaaataatatccttgttatagagtacatgtagcatatagtatgaagtaatatactacaaaagcaaagaaagtgtattctatcttgcaatagtaatagacaatttttatatagcaaattcatatcctttggagtagtgacaatcatttcaaactgggagcaactaattgtgaagattttccttcttactcatccattttcttcacatccaaggctgaacgtgtgatgctgctgcttcagatgatttgttccaaagttaaattttgtgacaaaagacatggggaaaaccttcccatcaatatttacattcacaagtatttgcaataagcataaaatagattatagccagaccatatgtatagttttcacatttactcccttctagacatacctgtacttatgtacttacaggctgttccaaatgtaatatgttctctaccaaatgtggttaagaaatattcactcacaatttctttctgtgtacaattctgatgcctctgttgtcactgtaattgtcagttgcttttctgttttccaaatgtcttcttgtcataaggtatctgactttaaaaaatgttttcccttttctttttattcttctgtattttccagctgcatgtgtgtgactatggcttttacatatttgcacagaaaaataaaacctttgtttctgtatcttctctttctcatcttctaatggtacttgtacttgtttgccttgactatgtcttgtatgataaaatttccaccagccatgcatacacacacacacacacacacacacacaccacagaagtactggtactgatcttcctgaatcgtgatctctttctgtgaaagtgtcactgtgagtaaacactgtggtatccaagtaaagttgcatgtactctggcaagtaatcctctagttggcattctaaagttgattacaaccctaattgttcttattattggtttacattgtccctgccaaagctagccatagttcaacctggttctaaagaggggctgttttacctaaatgacagaaatttacactaactcctctggaccaagcttctaaaacatagcctatatttacttgaataaaaactaattccattttgctgcgtttttcagatttaacattaaactaaacagggctatgtctctatgtttggccatgcctccttttttgtgtgcgtacgtggcaagtgggtttttatcaccctcccttttgcaaaataggaaaatagagagaataggcaaatttggaaaaatcagtgtttgaggaggagagacaactaagttcaattaacaccactgaggacttactctatgccaggaactgtgataagcctttttaaatactttatcttttcaattatcttttttcaatacaaggtcaaccaaaatctttttatcttccaaattcttcactaaattttcttaaaatatcttttggccatttgtaggtttaaaaatagaaactgttaagctttaattttgcaatattaaaattaaacttcttctgcaaatggtgctgcataaaatttgagtttagtgagttaggcaggaaatcagtgaagaaatctgtttctcaactgccagtattattactaatataaactattttacttctctgcttttgtacttattcaacaaatgtttaatgtatgtctactatttgccatactgtatactaggtcctgggaatagaactatgatttagacacaatgcttgctcaaaataagctgaagttatggtaaggaatgtgggttagactgggtgtggtggctcacacctgtaatcccagcactttgggaagccgaggtgggtggatgacctgcagtcaggagttcaagatcagcctgacaaacatggtgaaaccttgtctatactaaaaatacaaaaattagctgggcatggtggcgcatgcctgtaatcccagccactcaggaggccgaggaaggagaatcactttaacccgggaggtggaggttgcagtgagctgagatcacaccattacactccagcctgggtgacagagtgagactttgtctcaaaaaaaaaaaaatgtgattaaacaaatagtcttaggatgtaactaggatgtaactgagtgccagctgtaagggagcatataagagaggcattttgtccagtcttacaggtgggtatagaaggtcaaggaaagtttcctgaagcctaagctaagacttgagggagttaggctgtggaagaagcaatggcacagtactgtgtgtttcaggcagaaggggctggagaggttgtgcactgtgacagggatatcacagggtggcagtgctgaaagatggggctgtcgaaagaagcaggagtaagcccttatacaccttggcagaggccttggtttttcatcataagagaaatggagaatccttgaagggtttcaaacaagaaaaatgtcatgattatacttgcactttagaaagatcacttgggcttctacatagagaatggcttaaaagaaaggcaagactggacccagaaagacacagctaggaggctgctgcagtgataaagaaagaaggagaatttgcactaccatatatagttgtagagaagatagattttaaaagtttgaagcatgattttttgggagaagctgtgggtctaagggggtgataacttaaatttggtggataatatttttaatatctttgttgattggataaatgaatgaatttaagatctgttggatatctaaatacagttattaatcagtgtgcatattccattctggagttcaagaggcatatcagggtgtatatatttgggatatatattatagatctattgagtgttatattccattctttgtatatgtaatccatttgtattatttatttattgttctgcaacaatattacttcaaacttggcaacttaaaacaacacacatttattatctcacagtttctgtgttcaggagcccaggcatggcttaactaggtcctctgctcagggtctcacaagacagcattcaaggtgtcagccagagatgtggtctcatctgagctgaaccagggagggatccacttccagagtgaactcagtgatcaagttcactgaggctgatggcagaggtagccttcgattcctgaaggcagccctcagctccttgccacttggggctccccaacatggttgcttacttcctcaaagccaaaaaaggagggagagatgccagcaagatggatgttaccattttatataacataattatgcaattgtgtacatataatcgcatacttctcctcacctttgtcatagtctgttggttaagaacaagtcacaggttctatctacactgaaagcgagaggggcacacaaggtgtaaacaccaggaggtggggaccaaccatggggggttcacttaaaagggtgtctgccagctggttgcagtggctcacatctgtaatcccagcattttgggaggcctatgcagtaagatcacttgagtctaggatttccaggccagctaggaagcatggtaaaatcccctttctgacaaaaaaaaagaaaagaaaaaatacaaaaattagtttggcatgtgcctgtagtcccagctactaaggaggctgaggctaggtgggaagatcacctgagcctgggaagtcgaggctgccatgagccatgatggcaccactgcactccagcctgggcaacagagcaagaacctgtctcaaaaaaaaaaaaaaaaaaaaaagtctgtctgccaaaccttctctcacagtatctttttttactgtctgtgctgtattctgcatatattccctattgctatcttccaagcactgatagtccacatataatccactgatagatttttcaattttaaattactttaaaaaattctgacttttttaaatcttacaaatcaatcttttctcctgtttgtgtcctgtttttttttctctataattgctaccttcattttactttcacataattaggaacttatttaatagtgtctttcagactgttgtgttatttcaagctcttggagtgctcaccctcctatttttgtttctggggaattttactcacaacagagtttttcttcatgtggtttgttatttttttatgagcaaaaacaactttaagaggatttttctttttcctggggggtctttgtgtgctgagttgcgtaaatgcccctgactacagtcttagctttagatttttgctaggatgccaggagttccactggtctagtgcctgtttttgtgctcttagtttggggattcccacaacatctggatagtgtaaatttggtctccatatacaatttgggttcaagccctttataaatgtgacacaaactgtctccaacttcatttcttacctgtgctctcacaaactccactctccagccacatgaaactttgcacctccctttgaacttttcacagctgccacagctcttcccttacgtgctgttcctcccacctaacctgtcattcccttcttctctgtttgacatacttttgtccttccagaaatttcagatcttgtatagactcttctaggatcctttccctgattgccccaggaaaagcttactattttattcctgcacttttttgctattttgtacttctttttctagtgcttattatttggtaattatctatgcatgtacacacaaaaacagcatccaataataaactgctcaaggccagaggccatctaacatatctaactcagctctacaaatgtctgtaaaagaatgatcactttacagtaacatggagatcttgagaagaaattatattgcttccttattttaatatttttattttaatgaggataaatgcatagtgtagctagaataaaatttatcatgatacacttatagctaagtgagaaactgcaggctatttaagaatacaaattcatagtggtatttacaacaatgtcaaaagaatagcaactatgtcagtgtgcatttttattttcccttagttgtaacatcatagttatgacagctgctttaaaatccttttcagttaattccaacacctaggtcattttgtgattggtcaccatttattgaatttccttttgtatataagtttcatttttctgtttctttatccagtaattttggattgcatcctggtcattgtagcttatacaatgcagagattatgaatgaattcttttatgtttttcagaaaaatattattattattttattttattttatatttttgagatggagtctcgcactgtcgcccaggctggagtgcagtggcgcaatctcggctcactgcaagctccgcctgccgggttcatgccattctcctgcctcagcctctcaagtaggtgggattacaggcgccggccaccacgcccggctaattttttgtatttttagtagagacgggatttcaccgtgttagccaggatggtctcgatctcctgacctcgtgatccgcccgcctcggcctcccaaagtgctggaattacaagcgtgagccaccacgcctggcccagaaaaatattattttattttggcaggcagtctcttagctgaatcaaacttctagtcctgtagcagtgccctctgtggtgtgtcacagctgcaatctctgctcagttattttgtctttagctgggtgacttggagtgtacgctacatgggcatattacaagggtgaaccagagatttgagcagaaatcattttcagaagttgaggctccacctctgtagctgtctcctttctagaatttttccttcactttctagctgctgtggtgaaccctcttttctctggttcttcaagcctgtaagattgcaaacgtctctcctagttttagttaactggcatggtgctgagcagagactgcactccaaaaaaataaaaatcacatagtgccctccgctctgcttagttcaaattctcatacaggtcgatgcatacttttggttattatctgagtgccctcagattgttgttttttgctattccatctggattttattgctgttatatgccgaagggttactctagtagaagctactttgtccacagaagtggaaactgtaattttaagaaggtaatctgagattgtaatcgcataggtatttggtcccagaacaagatacatggttttccttctgatttctgcactgaccacatcaattcagaagcgcaggttttacttctgggcactacattccggggaaaacattgatgaatgccagggcctagaaaagggcattttagcttattttagcaggtttgttacataggtatattgtgtgatgcgtgatgctgaagtttggcatatgaatgatcctgtcaccaggtagtgagcatagtaacccaacagttagttttttttgtaaacattataaggataaacggatattttgtctagaaagggaagacttaaggaaagcatgaaactgccttcacatatttgaaacgttatcatgagaatggaaaaatagatttgttctatattaatacagaaagcataggccgggcgcggtggctcatgcctgtaatcccagcactttgggaggccgaggtgggcggatcacgaggtcaagagatcgagaccatcctggctaacatggtgaaaccccgtctctactaaaaatacaaaaaaaaaaaaaaaaaaaaaaaaaattagctgggcgtggtggccagcgcctgtagtcccagctacttgggaggctgaggcaggagaatggcgtgaacccggggggcggagcttgcggtgagctgagatcgtgccactgcactccagcctggaagacagcgagactccgtcccaaaaaaaaaaaaaaaaaaaaaaaagaaagcataaataagacaaagggatagaatttattgaaagaagatttcaagtcagcataagaggaagcaagttaacattagaagtactcaataatgtaatgcattgatttgcaccaaacaggactcccatccctggaaacattccaatagaatctgaatgaccgtatttcagaaatagtgtagagaatacttaagcactgattgaaagagagacatggacctgacatttcttaagcatctgtgattagctgattagcacaattcatgcattttctatgtataacatttctcaagattatggcatagattactcatgataacaaaattatgggccaggtggaaaaatgacatttgcgaattttagttgagcaaagtgtagtacacagggctaaataattggccgagatcacctgatactttggagaaagggaggactgggaatgattcatctagatttttcaggtcattaatacgttggaccatgttatagtaaagaaatgtttgagaatgagacatttccctaagaatgtgatatttttaaatgcattgatttattatgctgctttctctgaaactgaacctaacactgtcgattctgccccattcagagcaaggatgggctgggcctggatgtttgccatgtgcttcatatacacttacaggattttctgagcaaacttagaggtctacattgcttcatcctcaatcatttccaaacaagatctgaaacagaatcgaggcatatagccagacaatagcaagagagcaattgggaaagtttgtttaaattgcgcttttcttcttaatgtcatatggtaaaatactaacattagaaaaacattccattataaattgtaggatgtcccttataggaagattaagtgaatgctatttccaccactacatatgccactgaaacattagattgaatcatatgaacttgcaaatatttgacattttgactgataaaaatgacaatttaatacggttaaactgactccataatagatgcctgatatttgcaaggatgcttcttctaaagtttaggttgttaatgcagaagggagaattaaagagttaaaaaggatttcgggaatcatctaatccaacttctttatgtatgagatgaagaatctaaagctcagagagagagagtgctttatttagactctacaagtatcccggtctgtcaacccacagttcaatattcttcctgctgttctaagacgacgaaggaaattccctatcccatttgccagagagattgtgaatgagagtctcagagtactctaggccactgcagagtccctgcatacgtgacctattttaaagctacaaatttataaaacccaatcaacatcagcactgcattcatcaaaatgtagtcttagtctaatgatattaaaagtactttaaagaaatatgatgacgaatatcaattgtcattatataggcctaggatcttagaggatgtaggagacaaggctgagtctggcttgatttcgtgatggaaaaatgaaagcatgtatgagatgaagggaccttacatatcaattttagtaataaatattcacagaaaccttatgggataaatattataatgcccatcttatagacgggggaaataagatttagaagggctagttacctgccccagggccacacaacaaatagggatcagagcaaggtttagaacctgggagtacttacttccaagccacaggtcttcctaggatgcagcactatctttagtaacaaaccctgtaagttgattcctaaataagttacacatatgtagaaatggttcagccactataaaaacctgtatgaagtttccccaaaaaattaaaaatagaactatcatataatttgttaactgtcatatgattcatgattctgagtatatatacaaaataattgaaatcaggatttcaaagacatatctgcattcccatattcatttcagcattattcataatagccaatagatggaaacaggctacatgttcagcgaaggataaatgaataaagaaaataaaaatggaatattattcagccttaaaaagaacaaaattctgacacatgctgcaataggaatgaaccagaagtacattatgctaagtgaaattacccaattatagaaggacaaatattgtttgagttcacttatatgagatatctagaagagtcaaactcctagaagcagagggtagaattatgagtgctaggagctagggggaagtggaaatggggagatgtcattaaataagtatgtgtgtatacttgtgtatatatatatatataattaaattagtatataagtatatatatttatatataataagtatatataattaaattagtataattaaattaatatacataattaaattatatataattaaattatataacatacttatatactaatttagcatacttacaagtatagtagtatactaattataaatatattggtatataaatatatacattaaataactgtgtgtgtatatatatgtgtatatatatgtgtgtgtgtgtatatatatatatatagagagagagacagagagagagagagagagggagagggagagagagagagagagagagacaaggtcttgctctgttgcccaggctagagtccaggggtgtgatcacaactcattgcagcctcaaacttctaggttcaggcaatactccttcctcagcctcctgagtagctgggactacagccatgtgccaccacacctggctaattttcttcttctacttcctcttcttcttattattattattatattattaatatattaataataatatattgttaattattaattattaatatattatcaatattattattaatatatattaatattattaataatatatattattaatattattatattattaatatatattattgatattattatattattaataatatatattattgatattattatattattaataatatatattattgatattattatattattatttgtagagatgaggtctcactcatgttgccgaggctggtctcaagctcccaggctcaagcaatcctcctgccctggcctcccaaagtgctgggattacaggcatgagccactctacccagtggtataaaattttaattatacaagatgaataagttttaaagaacagctgtacaacaattgtgcctacagataataatactgtactgtgcacttgaaatcttgttagcagaatcttatgtaaaatgatcttaccacaattttttaaaaagttacttacttaagacagaatttaaaatacttcaaatggaggaaaaataaataaaataagaaattgttcataaatgttattttgatgcattatcaagcaccaaaattaggtctaatttggttcactaatctcttttcctttcatcttttcatacattattaagatttctgcttcaccaagtataattaatgttcttcatttcttaacgtgaggtcattgctgcaggcttcacggaaatcatgcaacataggtttttcccgtcagaacacattttttcatgtgttctgaatagaatggaaacaggcaacatacagagtggagctcctggattatagatgcaaccaactaaattggttggtttgttaagccatagacaactgtgggaaataactaggttgatgtttgctactgagttgactagctaaccaaatcatgcagcatttttgttagctgtcaaatcaatctcatcatctactaaaatctccctaaaatgatcactgccttggtacgatactggacttacggaaaccggtttttaaaataatgcatttattcattcatccaccatttatcaaaggcctttttcaggcaaagctctgagctaggcatggtaagcaactaaaatatacacaaaaaagtgtgtttgtgctttcaaagaacttaggtaagaaaatcaggtacatagcttcgtacataagagttctctaatttcgtgaatcataaagatatttttaatgtgtctataatgacatatgttggttatgacaaggttggccatattatttcttgtccaatttggagcattttcaaagtgaaagagagcaacactattaataattattctaggacagcagcctaaactgatactgttctgggcaaactaggacatatcctagttattacccacccaggagaatgcattatgttttacttgattctctttaaaatgccattgacatctatcacagatcattcagaaatcaagtctacatgttccaaaccaattaactgacaaaaataactcaaacaataaagttgacagcatcgtgttagttaccaattttcttgaattattttccttattttttgctcaaggagaacttttggcatcagttccatctatgaaaaatagagctgtcaaccaaaccgaaaactgccagtatgcacccagataccatgccgttgtcttgtttaacatgacatgaatttagtttctactaatttttaattttaagaatggtgtgtatacatttttttcttttataacttacattgcctttaggaaatgcagttgcacctcattgaattcattgctaaattttttcttgtgagaacaaattgaatagcatgtagaagactgtaggaatttactatctgaacaattttaaataccaagataattgacttgaaattggcaattgctttaatattgtttctacttaaaacttccatgaatcataatacttattcatggattatatgtgtataattttcctaaatttctttaaattaaaaatgatttttcatcctaaaaggttataaagatcatggctgttatatttttctcacaattgtaattactgaaacacaggtttgtttcatgtaaaccgtagaaatattttggagactaattatagacagaaaggaagccacatattaaatataatatccaaaaccaaataggctatttgcaatgaaagttatttgatgttttggaaattatattcatgattatttcattgtctatttgaatgtattttaatttagtttcacaaatagctacaaatatgttacttttatccacttcccttaacatttctttgataatcctatgctgataacaacagttataaaggaaaactgaagtacttctatatttgttatttaaagtgggaaaatatgtattaatgactgataaatggctgaaattactctagttgatacctagaactcaggaaaaaaattatattttgaaaccagttcatttccttgactttttcagtagccagcatcatcctgagtaagtatatactcaataaatattacctaagtgattgagataatgaatgaggtatttttgaggtaattttgaagtgtcaatttccagctttgagaattttgtttttgtgtgtgtgaatgtttttattcatcctgccccatagttactgaaattaagatgaaaatgatagtatatagtaagtacaaaattgtcccatttccctttcaaatttacaggatgaaaaaggcaaggcttgaccattagtcaccactttgttgatgacagtgtcttggagacaagtgagccacactgtccattaggaaaacatttccatctaagaacccaatgcacagaaaccccattattcatcttgaattagaatttgatataaatttaccctttcccgaaccaatcccagatgcagtcaagatccataaagacatatattgcttaccatgcctagctcagagctttgcctgaaaaaggcccttgataaatggtggatgaatgaataaatgtattattttaaaaaccggtttctgtaagtccataatcacatggacacagccaaggacactctcaaggcagtcctgcaggttatactcaatttgcttaaaaatcgtagtggtttgagaggaggagtggattttctcttcaaagtaagataagtatggttgaattgtagaaaatcatgtccttttcttccatttgctctaaagccagtaagagttgaccactgctgcaatattgaaaagacattttaaagaatatgttgctcattgttcttcgaccctaaaaccctcatttcattctcctttgcctagtcaaatacatttgttctcataatgttccagtaaagatttccttgcttccctcccccacacaatcagcatttggagtgtcttgttgccatacaatcctaagtacgcctctatcatagcatcgtataataatactaatagtggctaatatttgtcgtgtgcttactctgagcccgaaactatgctcaggtcattataagcattattttatttattattcacaaaatcccaagagttaagtaatattattttcctcattttattgatgagaactcaaaatcagagagaggataagtatcttttccaaggctctccaattcagaagttggagccacgctttcagatcccggagcatctgcatctattaccaattagctatactgcaaaagccttcatttgtctgcctcatcctccatcctgagagctataggaaggtggagaaaatgtcttgtttatctttataacttcagtacctggcaatcattcctggcagagtagtgcttcactatttaccaaaggactaaatgaacgaatgaaagaattgtatgtggtgtgcacagaagaaattagaacattcccagggctggcggtagggtagaaaaagcttcgtgcagaagatatttgatccagctcttaaagaataagcaagcattatctcagaagaacaaaaagcacatttctccttgacatgtttttttgtattgttgattgtttatttgctaccaaagtgttaatttttaatttaaacagtttttcactggagaaattagttcacaaataagttgtatacctgtcagcaaagagagcttagaatgtcagaatgcccatgtttttattgatagtgtaagtgccacactgtgtttataattatcccttgcttttgttgattattagttcttcttaacataactgcattttaaatttgtgagagtagaaaagggaaattctggaaaacaaccattaaagccataaccttcctcagggatcaccgaacgagggttatagacaaaagggaagaaaggaaacttaaggcactggtcccaaaagataatcaacgtcaacacacatttttgaaggggccctaagcaatgagagcagaaatatgccaaggaaaaatgggtggtaccagaagaaaaggaggatccaggaaagagctagtagagtttacaagtagaaggagccctacagcagccacaggagtttagggacatggatgaagatttctgcatttgccccaaaagtgccattaagaacactaaagcttatctttttttttacaaatctagttgtcagaaaagccttacaacaaattttctaaatgttctcttctttccaaattcagttgagcctgaagggtttatgctgtccactcccacctattcattgccaattcatcttccctataagccaccttcatctgcaataactgctccccacaggataagctgacattctgggcttctaggcaggaaatccaatgttctgtcctttcataagtcccatggcaatgcagagagctgctggagtcagtgccttccacatattctctacagctgaaagaatgcaagcatcttcccaaagtcaccattccatccacacgtttgtttcttcaatacatctggcaatgggtagtacacagggagagaagaaggagagcagggaatctgtaaaagataacatataattcttatgacaatactttcaaggaaactataatctagctgtcaagaaaaaagaaactacaaaacatcctgaaaacaattaatccctaatttatgttactgagtaaaagcacagtataaattcacagaagtctgatcgctatgagctattgcaagagggaaagttttcatggaggatacggaaattaaagtaggccatgacatatgagaaagattatttatagaacagaaaatgggagcacattcaagagagaaaaatgtcgcaagtaaagatgtgatagtgggaaaaaaaagtttggatgggatgaagaacagagactaggtaggcctgattttaatagataaagaatgtcaggaaatagtaggatatagaagtggataaattaagagaaagattagatgatggattccctcgaccaaactttggtaaaaatccagccagagaagaaagaatcattctataattctgtgatttaggtatatgccatgttttcttctcaaatgtttcctacaggttttgattatgtatggctacaattcactttctgactagaaaggacctactttactctgtttggactgctgtaacaaaatgccattgactgggtaacttttaaacaacagaagggtattagtactggaggctgggaacttcaagaccaactaaccagcagatttagtgtctggtgaggaaccacccatttcctggttcgtaaatggtctcttctctctgtgtcctcacatgacaaaggaacaaggcagttctccaggacctcttttataaggtcaccaatcccattcatgaaggctctaccctcatgacctaattggccccatcttctaatacggtgacattggcgattaggtttcagtgaatgaaatctgggaggacataaacattcagaccatggcaggatcttacaccaaaatggtagcatctttccttcatgatggatttatcaataaaaactcctgaattatattctcagacgaattctttcattttggaactcaaagcaatacaaactgtttattcttccagaattttttaaaatatataatgttatgtagacagaaagtttttcctgagcagatttttttgggagtttggtttttgaaactagcttattaaatccacaaaatcttcagtccaatttttgatttctgctaattagaagttttcactaggcatagttttgttagtaagtcttgctttaagcccccctcttttttttttttttttttttttacttcacttgaatctttctaaagttcttaattgaggattttaattgaaggtttttagacctatgatgctctcctatttctctcaaagggccaaagacatgttttgttctggggaggttcagatatgatcagattaagtcttctttcactaaaaattgagcaaattccctggatcagcatcactaaaaaagagtctctggggcaatagactgatgttattactcaccattttaatgtacataaaattaaggaactatatttactcacttcagaaaatttctaagttgtgcagatcaatataaaaggtgccttatactgagcagtggttggtttgaacatttctgtgattagtgcaatctattttcagagctaaggaagccagaagattaaaaaagcagacccttcactacctgaggggagttaacagtctagtgcacaagaaagcttgcatcagatgaccaggattcttacggtgcctctttcagccaagggttgtgccttctctgatattaggccataatgatcacatgcactcaacatgcaatgcctcatttagttctaaccatcatagtactgttatttccactttacagatgctgaaacgaaggcccaaagaagtgaagtgacttacttggggtcacacagttcatttaacctcaaatcctcatttttttctccagtgtataattttggttttctgtttcctagtttgtgaagtgcaacatttggagactgtttttaagcagactgtcctaccagaaaattctagaagtcttaatatttcttaattgtaaaataagtgttttagaagagatgccattacacatagtttacaaaaacacaagtttatcatgggaccaactgtgtccagggaactctggaatttcttaaagaacaggtctaggggcaaatatggaatgtaaatgggaaagaaattgtaaattttgctctacggccctaataggatccagaatctatttgtttttaccattaggtcctgtgaacactaaagataatcacagctggcaatatgtaaattatccatatttgcagcttcttgaagttaaaggttgtgtgtgtttggctggtataactgcattgccacttaattaccaatataaatgctctcaaattatagataccaatgtaagcccctcaacttaaagatttatttgcagaactctaagtaatgacattgagcttcacattcacattgtgaggtgagctgaagaggatcagcttctgtgtgtaattgtgcatgattagtcttctgccttgaaacagaaaaggagtatttcataggattcccaccatggctggggaggacaggccgtggctggggaagacagaggactactctgatggagaaaatgcacacctttgtaaagaggcactctgggatggaaagagcctggggtgggttatgagagccatgaaggtgatgcacatgtgcataaagggaaagcatttgagtggctgcctcttcaaattaaatattctgtgacagaagagtaggctgcatcctgtgtgttagctctcatggcactgcaagctagagagacgtataacaagaaccatcatcactggtcaatttccttttaaagacctgtccactgatttactcattccattgatcagacattgcaattcacaagctcctattacattctcttggttaaaagtgaggtccagattgggctcgacacatgaatctgtagagctttcccctctacctggcaaacaatccaagtcgcacctggatatatcagaccttactcatcatttatgtccaggagtgctgcatttgttttacaatgccatctaatttgtcagctcagttcaaaaaaatttcagcacctgcaaaacatcatgaactctgaagttgacaggaaaagatggcatgttgtttgaatagttttctcaagatagaaatgtatgagtcttgaaattgtacataaagacaaaagcacagcatgccatgaattgcaggaactcatcgcggaggacatgcctattagaatttatgctacacaaatgcaaaagtatgttcttataaattaaatagtttgacttttccacattttatacacatgtaatgttgtcgttcttgattttgtacatgatagtgtagaataagctttttgccttagactttttataggcagaaatgtgccactgcaatgaaaaaacttaggagcattttatggatgactgtattaccatcctcatcaattggcatttattgaattcaggcaccataaataatactgatatatcttacatatagtggaatatgtgtgtatgttttaataaatgatttaaattattttcaggccatttttacattaatctataaggaaatataagctcctttaaaatggttttgaaacttagtgtctcaaaaggagtacaaaaacaactccgaagttcccctatgcttctggaaacattaaatcctcttggcaatgggtgacatgtgaaaggactccctcagtttgccctgaaatactccctttggtcctaaaaacattacgcactcctttagggagttcgaggcaaaggagccagtgtgttttgagggacaaggtataaatgctacggcatccaagaggattagctgccttttctggaaaattaggaaattgatgtataatttttaattacacataaatttcaaactttccatcaaagtcaaattgtgctgatgtagtcaaacgtaatctaagcattgattcaagaacctgctgatggagtgaaaatacatggaaacttgttaacaggaattacaattatctacatctcagcaaataacgccagagtgtcatgtaatatgctgagctcaggcagcctatagccaatgcagatcttttttttttttcttcaccattaatatttacagttggaagcaaaacatggctgcaatctaagtgctgcacctaacaaggaagttgttggcttgataccttgtttcctgacactgtgaagcactgaaacagctaccttcttaatcatcgcctgatgatattgtgttgaaactggaggggagcacatggctgttttataagagccacaaccctgggagattttcttcattgtttagttgttttacttcttgatagacatactgggatgttaaaagcataggactgaaaattgtgcattatggagttttttctttgttctcctgctgaatttttctaggtctatgcagacactgtttgtaaagacagtttacctcctgacacctgctgtgtgctaggcaccttcctagaactgaaaacaaaacccttccacccatcagcctactttattgtagttattctcacatgcaaagtccaaaaaaaacaaaacacacacacactaagcaaacatcagtaatcagagaagcatgattggttacataagcactgtgcatagtaagagacctgaaatataaaataaccatttttactcttctttcagtctgcagatatgccaactaagggtaatacagttgaaattatggggtagatttggggttacatttatatagtgctctatctaaggatgcagctgtgcgtaattaaacaagccctgataatttggattctaagctgcttactagctgtgtgactttggacaaattgcttaaatcatcttttaaatacatgcaataatctctatatcattagattgtggtgaaaattaagagatgacatctaaaatgccagaaaatattaaatcctcagcttgtagttactttttccatatccctatgttccaccttttagttctaacgtattttacaggtaatcccagtgtagcgaatgaaccagatacaggaaagattaactacctggatcgaatgctcaaagaatcaaagacctagttgtcatctttgtcatagaattaatctatttactctgggttcctgaaactagtaaaagaaccctaacaaatagcagcaaacgaattttagtgaaagagaacaatgaaacatttaatagaagaccaacttctaagaactacttaataaaaatgccttttaatattgaggtgatttctgctcaggtccaccccacaaagaggacctggactgagttgagctgtgttgcaactctttctcgcttgtcaaagttgtagctcctcctcgtgttgctaaatcacagcagatggcttccttttacacccaacgccgtcagtggaatgtaaatgcgtctcctcacaacactgaaaatactgaggctgtgtgtttaatctgtgctgtacaagccgaatgaccctgaaaagaacatgagcactgagcacgtttggagaattggcatcaatccttggaaacaggattggggaggatttttcaggcctagtgactaatcatggttttcttcctgaggctcctaactcagccatatccctgaggacaagcaatctaaatggtgattgaatagaaaagttatagacccaagggaagtatttttttttttaaaggggcagtgggagtgttgtttggggtatgggaaaaagtagagagagttgcgctgcactgcaaaattgaagaggcttagtttatagtttgaacattcaattctatgtctccttgggagttaaaaaaataaaatttccctgtttcagattatttaagtcactaagaggaatactttctctaagcaattacttcaaaattcagaaataatgtaaataattcatgtcagtatgataccaagtatgagacaagaattatccagaaaaaaaactatattttgagagtatgaatagcaaattatagaaataaaatataatcaagcacattagccaggttatctcagcttctttcttaaatagatctccaagctgcttagaaaacagagaacctgatcttcattttattaaaacagtctccaaaaattaaccagtggctaaaggagaagagaacttgtcatgcaatttgtcttttgagccttttgtagcaaaggaacagagttcttgtcacttctgcttcccacctttccttgggcaagggtctcaaactattatttcaaaaaaagatgtggtcattgtgaatatcataattaccctatgtactgtatataacacagacttagagatcccaaagcataaaataaccactttagctttattgtatgatctaattttatagcaggttattaaattctgtgctaaatttatacatagagatggagaaattttagttcagcagtatttttaaactaataggaaaatgctgttagactttatttttgtcccctccaagaataaatgctttagattcctcaatacaaatgaaaacctagcctttgcttctgttgtgcttttgcgtatttaggtgaactgttagtaaagtcatacataaggtttagggtttgtttttattttttttttaatcctgctaactttaaaacctatagacttttaccaaatggcttatgaaagcctgacttctgaaacaaacctttagttctaaaactaaatactatttcaataaatcctcataatatgaaggtttctatctttgctggttgtcaggttgcttggtgttttaagttgctttgagttcatagattttagaaatgttcacttgggatctgaccagcctctcagcttcacaggatccatctctgtttagacataccaagtctcaaactattttgaagagaaaaggctgtgcagtgaaaggctacccattaaagcatgatgtgtgtctttcatcttccactaggcagagttcgaaactgaaagtctgataatttgatgtaaactgacagtgacaatagaaatggctacttttgagattatttaagagaaggtgcaaggtatagacattcatcaatgaaacactaaaggaaaggtttttatttctgtgtttgctttttaaaataagaatagagtaaatggcacaatagattatataaacaaggacttcaatgacaagctgtcaaagttaaaataatatattttacatgggtgacttgacgccacactttatcacttacatgaggggaagccaatttgagtctggtcaataaaacacaacctccaaagttgggcctggggcaaagctgacatagtgtggcagagcctggtggtttggcatccacttctgctgggacacagcaggagttggcactgctaccatctggggtatgtcctacatttaagccctatttgattaatcaacacttatgcaggttgaagggacgatgcattggctctgctctgaggcagttcaggctctagtaatttaatgcaggtctgaggcataaatgggactagtgattcaaaaactggatttactgcagtctcacaactgttgaaaattaaagtacatgtgctgcaagttaggggttactagggtatctcattataggaggctattttttttcagaggtttgaatctttgctgaattactgagagacttattcgaatgtaggcttggaccaaataattttctgataaattggccataaatcctcagtaaaataagcttggtgttctcagcatatctattggctttttgatcatttttatggctttccttttgctggtcaaattatccttatatgctcctaaagctcctctgacatggattaagtcaacacaaaccaatagaccttcattactttggcaactggttttgatttgggggcaataaatatgatgacacagactagattacctctgctgaagggatatgtgataagccgtagggatgtcagggatcctgcattattttttctgcgtaatgtgagaatgaattaatagcagcttttaactagctgaagaaagttggaaagaagaaagaaatctgaatgaaaagagagccaaggtacggcttataggttaagagcagtgacaccagtcgatcataagaaagtccatgaacacccaatgtgtgtccaacaccgtgcaaggcacaggcaggcagggtcagggccaaatatgtgaggaaactaacatgtgatgtgatccatatcttagtgtctgggagaggagataagaccatcaatgagagcaagatttattgtgcaataaaagtgtagagcagagagaaataagcaaggcctggtatagccaaggaaggggtaatggaagaagcaagatctgcaaatatgggggttggaggaactattttccttataaaaattgtttgttaaattattacttttccaacattttgcttggaaaaaaatgcaaacctaaagagaattgaaaaaaagttacaactaatgcgtgtaactctttaacccagattaccaactttttaacattttgatacctttgctttatctctgtccatatacatgtattttttttttgctcagtaattagaaagtagattgcagatgtcatgacactttaccactaagtattttagtatctcttaagaaagaaggcttccttctataaccacaatgctagtatcacactcaagaaatttaacatcttatatactatccatattcagactttctaattgtcccaataatgtcccttatagattttttaaatccaggatacaatcaattgcatttaatcatcatttggcatgtctttttagtatctttttttatctcaaactgtcccctgcccttttaattcttttgccactgaatattctcttgcttttggaattctgtataaaatcaattggcatatttatcccttgtcttctaaaattatttagtatggcagaaatgggatatgaagaaactccaatctttttctacactacaaaatgcaagttagtagacgacccagcagatacataaaaagggaactcaaataatgaagctactatgttgaaaataagtggtataagtcatcagcctaggaaaggaccagtagtgagtacacatgaaattgctccctccattctggccctcctgagagacaggaaatcaggtttcttgacatggtatctagatgggttatatgcccagttttggtaaacactttcctggcacatgagctgtctgccacttcctattctagttcttctccatttgtggctctgcataaggagttatccttctgtaaagtttcccaggcatgcaggaaatatcccagaaccacaggcatgctttttgttctccttaaagcaattggatcatggtgattccttcagcctaaaacatacttctttacctcattctcccagcaacttcctttgagaaacttagcgatcccatgaggcaccttcctttctccttgtttttccttcatgttcacctctaaactaacaccacccatatggaactgtaattgctttatatagctgccccacccccaggcactatcactaaacagtgaattattttaaagataatggttatgccttttacttccatatctccaggatctaatatgctgtctgaaagtttgaaggcattcggtaataatttgttgagtaagtgaatgaaagcatgaaaaaatgaatgaatgaatttcaccaccaacaaactttctgggttctatagaactcttcttatgactgagaagaacttagtaatgtgttaaacagggcaatcagtgttacaagtgtgtgagtcgataataattgatcagccacttgggcaaagcactgcattttatattattgggaagttccagagtaacaaatagtcatgccttacagtcctgaaggaagggatagatttggcttaactcacattgaacaacagctacacattcatgcgcatatgttatgccaggcaggcctagctacagctcttctcaaaaatgtgctggccctggacattgctgtgtaagagttacaggtgagtggagtcacatgggcttctctggagaggctttgcaaagtacagagaaagtttgaattatcttttaaaaagaggagaggcatgattgaataaacggcatgtttcaggatagagaagtggtttggaggaacaggtgattcctgtttgaaaagtggcagatagagagagttgctctgctggaaccccccggccccggcactagctaggctgcaactggtgatgaccctcatgaggaaatgggactcattaataaagagcctcaacttaaaaattgttgggtggagtggcgcacgcctgtaatcctagcactttgggaagccaaggtgggcggatagcttgagcccgggaggtcaagtctgcagtgagccaagatcatgccactgcactccagcctgagcgacagagtgagaccctgtctcaaaataaataaataaataaaatcaaaattggcaatttatatttgatatggacaggtttgatatagttcgttcccacgacttcctagtcacgtaagtacggtcatttttttctgtggggctggatggaggatgtagattctggaggaaataaaagtgtgtagagaatagatgaattacctagggagaggataattgggccaggattgtgactgtgggaatgcagagagagaaattagaacagaattgtaggggaattggttacaaatgggtctgggcatagagtaatgaagagatgaaaaggatgtgctttgaaaactacaagagtttgcagctcatagcactgaatgagttacacgctctgaatctttagttagcaaccactgttttctaaaatgaaataaagagaagaaaagaaaaaaaagggagagaagcatgaatgtccacacagcttttctgagaccaaaataggccaagctaatgtccagtagttcacctaacggaaacaaaaagaataattcacatgtagcaaatgatagctggctcctgcttattttttacctttatttttgtttttaatcctcactagcagctcctgattgtatcacgtgataacgtttccattctagatacgaggggcaggaaaaggtaaaaacaaacacattgtttgttgatttcacaaaaaggaataatgctcgtgtctggttggctccttggtcatattatcccttatctgccactccaattcctgccagcagcacctcagagatggcacctccccttgctgcttccgttcctctgcaggacacatggtgaggtttttattacgtaaaaatcccaagaggaagaagctctgtgttgataaagtcaatagctcattgcatgctgctagacaagctctaacttttaattctcttctgccaagtggcagtctgcaatgtctttgtggaacagacactgttccaggtgccagggaaacaattgggaacaaggaaggcaaatatctgcacctgaatggggcttccattacagcaggatacacacaaaaactctatagacttcacatggtactgaatgcttgagagaatgaaagctgattgcaatcaaagaggatggtcagggaaggtctccccaagaagatgacagcaaatagtaacacctacctagttgagttattaggagaattaaagcattttctgtgttaaaaacatctggcaaaccactgacacagggtcagaagaaatggctagccattatctttcaacaataaatttacaaagcataatgaaatataactgagtttgagctgctgggatttggttcttgtatgagatgaggcgataatttttattcacaaggccatgtgctccaaagaaaacaatgctatcacttataccacctgcttatggagagaaaaatatgaaagcaatgtcctcaaacctctagctgcatctatgcttctgcctaaaatctggtatcctaagtaggagagaggttgtgaattatcagggctttttcttgatacttatttttacagatctaatgcctatgatggctcctgccagggactgtttggcccaccactctacttctagctagcattgtggttacacagtttgtagaatgcagaaataaacttgtctatttatgaccaatgtcacagcacatgtcaaatctcagtgtcactgggccctttccctaaaggtctacaagaggaaatatgtcatgcttgagttaatgttgaggttgattgtttaacctggaactagaattccaaacatatatccttatgttacatcagttttttttttctcatttatctccaatgtgtccacaggaaatttccacagtagctgttctagcctcttccttcctatcatagctataccattccttctggtatggaaatcatatcagaaggttcccaggaagcgtcttccaggctgcggttccctggacggtcccatctcagctcagtttttcctcccccagctattgtgatgacccccaatcagcatagttataagaaattgtaatcacatggtgagaattaatgagaaagcctttatattggattccttctttttccagcaagagacttcaaaccctgctaactgcagtcttacagcccttggagggggccgtagctcaccattgttctgttctcggcaaacccagtgggagcttatctgttttctgggagaagcagagcagccagatgaagagatggggcagtgccaaggagaaaatgatactcagcatgcagtgcagatccctccctcccctgttccctgctgtcggcctgctgctcagagggaaaggtgcctggtggctctctgatcgccatcctttcttcacattcctaagccttttatttggtggaaggagcatctggctggatagcctcctccttatcccaggacacttcccgagttctctcttttggctttttaataccttattttccccttatgactgtaaagtggacagtgtatttatggttgaaaattggctgctatagcaatattaattttaaaaacagagttttggcacatattcaatattactatggaaacggccgcttctaacaattcactcataagatatagttcaaggactgaggtctgtgtgggaggtttttaccatccaccaaattgacgatctacttgtcagaatagcaattcacaagaactgctctccaaatttgtattccttttttaaaaaagttagtggatgagcattcgagagatgcctttattttactttatatatgtagatggaagataaatattccaactggcatgttaaagacacaatgtgtttaaaataatttttccatgaatcactaattctcttaattgcacataatggtcttacttggttatttgatgtaacactaaatacacacacagacacaactagtttcagaaacgcacatattgaagctggaatgtaacctgtaatcaattgacacattcaaacattttaactttccatcttaaactgtctccacatatttctatgtaactgatatacatacaactgaattccaggaaagacttgaagtaattcattccagtgtggtgttttccaggagccagtttttaaccccaaatattgccttcatttttaaccgcaaacatacttctgttggttttataaaacgcaggcatgagagaaaggacctctgggggctgatggttgcagcattagttcttgaattccctcactttaagtcaaagctttcatgtttgcacctctgttcacttgggaatgtgaggttacattttccaaaaaatcctgcaatgtttcatattttttcagagctccttctgatatgtttattgttttcacattatttcaaatgctgtcatcggccctaaatatcatgaaagataggtcctgatgctgacaacagaatttgtctcatttctcttatttccagctcattttgtgttttccaaattagattaactctcaagcaattagtaacagttgattctgataggcccaggttgcacacccttccaccagcgccacatcagcacagtgagagtgataacccgaagcgcctccttgttcacaaggatggccctgagtggatggtaggagttctgaaatccaaacaggatcaagaaaatcaatcaggggaaggtcacttggggtaataaacaagagtaatcacatggatcaaagttcttgtcctgtgcgtatgtcctatgagaagctctttatccactgaatgctgtaattcttagaacaattctaagacgtgggaattgttgtccccatttattatacttatcctacatatactgtgggaaaatggtatatgagcagagctcttaaccacttcattacacagccaggagtggcagaggtagggctgcatctcaggccttgaatttgctctttcattcttatgacatttctgagagaagtgggaaaacagtatatgtaggctaagtatactaaacaagtatcgaaattggattcaaatccctttctgtctgcttagcaagtgcatgctgtttccagttccccttcagaagaaacaagatgaaatttcttttctgggattaagaggaaaacacacattaacctatggtgctagcacattccagcatacaataatcaggatggaagtttcaaaataggttttgacagtctcaccatagaataccatggaataaccttgcttgggtcctatataggccagaacccagttaatgtttcagaataaattctctttgaggagaacaaatgaaacatctatttattttattctgcagatatggagttcaaagtaatcacagtttaaattaatcatacatacaatatacattttttaaaagatgttaatatgataactgactgcagatagcagcatgtcatttttcagaaaaaaaaaaaacaattctacattatatttataattaatttggggtatgtcttttcaggaaaaggttattcaaaagctcagtgttagagcacaaccaatccaaatagggctggccttaaatctcgtcctgcacctggaggcctccatcatcagttcatgtgtcccagcagtttcaattatcaaaagatccatcctagtgccgtatattttaagcacagttgaagaatagtggagcaaaaaaaaaaaagcctttcaaccatgggaatttaaaagcaaagggccctgaagaggcgatttcaaaaccctactcattcagttcactctaaagcttaatgacatgccctatttgatacagttaggggaactctttcatcaaaaactttatatgaggctgggaattgcaatattaggtttgtaggttggctcccttggtcatactgcaacgtcctgagggaattctagtttatcttttaaaagcaaatagaattagggaaaatgataaatggtatactaatgactactaatatgtttgtgtatttgagaacttcctataggctgtgctttttgtattttacattctttgtgttttatttggtcccatcctttgaagtagatgttaatattccattttataaatgatgaaaatgagttcctaagaggtgaaataacttgctgtgtttgcacaagtaattggcagagccacgaatcaaacccaggtctctgcctctgaagactgacctcttaaccacttcattacacagccaggactggcagaggtggggctggatcccaggccttgaatttgctcttttatttttatcacatttttaagaacagcaaagcaactgtagatgaaggacttggttcctcaggagtcccaaaatatgtgaaacaggtcagccctctggttcaacctgaattgaggtactaacaaggactcgggacccacccccatgagtccttcttcctctcctgttgcagcatagcagatgagaggatctgggaagcctcagtttacccaatgtaatcaatctcaggctgaatgagaagagaagggcctggaaaagtttagaaaacagagacaaaccaagtgatttttctcttgtgtgcatgggtgtgggcactcccaactctctcatccaggagaaccgccatttactccaacagatgacatgatttaccagacagattaagatgaaatcaacatctaagaacaagagtgtgcattttctaaagatcattggatagtactaaggtgtttttctggtcagatttcatctgctcttctgtgtcccagccttttgacctttcaagcccaactctgcggttctgttcctctttcccaggccagagttatctttattgataaaacatataattatttacaaaagcatggccacacagtatggatggagagtttgccctctagttgacataaactattttttctaaaaaactactgaactctatgaaattctatatgctttacttcaaaagctccagtcattgtcataacccagaatttttcacagtaatatgaaggagagatggagtagtaaacatatttctaatgatctaatagtactatattcttgaatgtctccaaggcacctaagaccagcttttcccagcctgacctcatattcttcctacacaaacctcatgtgaacccagtttttcctcatgtgagcccaatttcaatgactgacatcccaatccacctgctcatctaatgtggtatcaacagccatcttcatccttcctctcttccccactaccccacacaatctgacatggggtgatgctgaatttacctcagaaatccctgtcaaacattctttcccttcaattctcactcctttgctaaatttagacctaggtaatctcttatcatgactaataagataaactaacttctctgcctccaatttcttccccacctacactatctcccatcctccaccctgttaccagagcttatcaagtcatgcttttgcttaaatatcttcagtggctcctcactgactacaggacaaagtctgagtttagtgtggcattcacatttcttaacaagacccttctactttatagtattttctctcaccaactcttttcaccctttcccaattcaaacatacacattcatggtcaatgtattggtcaatatagtattttctctcaccaactcttttcaccctttcccaattcaaacatacacattcggtcacactgggtttcttactctttccctaaattctaaggacttttatgtcttcttgcgttttatgttttgtttttgtttttgttttgagacagagttttgctctatcacccagggtggagtgcagtagcctgatctcagcttacatcaacctccgcatctcgggttcaagcgattcttctgcctcagcctcccaagtcgttgggattacaggcacccaccaccatgccctgctaatttttgtatatttagtagagatagggtttcaccatgttggccaggctggtctcgaactcctgacctcaggtgatctgcccacctcagcttccgaaagtgctgggattacagatatgagccaccgagattgtctcattaaagtggaatttcctccttgaagtacttgagcatccactaatccttcaaaggacaatcatgtctcattccaatcttgctccacctactcctcaacacaattaattcatcacatggtcataacacctatctgtaatgtattatgattatttgtgtgtgtgtgtgtgtgtgtgtgtgtgtgtgtgtgcgcgtcttcctcttctcctatctccagaatttgagctccagattccaaacttttatttgtctttgtattttcatttcctagctcagtaaatgctcatagtaaatggtcaataagtattgctgattgaatgcacaaactaatgaaccacatttgagcaaggattattgtgagtagatcccagacaatactatgaagctgttaaaatattatattaattgtataataatttaaaccaagacacaggggacaataaaaagagactaaggatagaaaagatatttaaactctctaggatgttaaacacagatttcatttgtaatagattggtttggtaacgtggggatgagtcctagagaaagctaaataagaaggtaaaagagtttactactgatttactctgatagaaatatgtctttgaaaaaatcagtttaaaaattcaaacagtaactcctttctgtctttaatatttctgtgcaactcagtcacagtttcatgttagccattgttaaactgataagagctcaggtttgctaaaaagtgtttgcaaacacatcggaattaacattaatcaaaccactgtgtaaaaataacaactttgagagcccaggatccagctccctttgacagggctctacctgccgttgtctgctgctagatacttggattcagcgttaagcacatgtgcctttacaaccattcaattgccatgttgaatccgaatcagagtgattcctttggaaaccccctgcgagaccagcgtatcacagtccctcctctgtgtcaagaatttttcccacaagacccaactaatttaatttctttcctttcccaaagcaacaaaacaaaactgtaaaataaccatttcttcagtcccaaattagaacttttggcaagggaggaaagagatcatgaataatacgtggctatagatctagaatcattttataaatataagtgtgggctcatcttttgcctttgttgctacatgaatcatctcagtcactgagattaagagactgagcaaatatagtaggtatttcatgccatattttctgactgtagactttagattctagatatatgattatttgtaaatgatttgagaataagaaaatctgactttcttttaataccttggtctttttacagtactgagtggtaccagcttgctctggttggtcttcattcctgagtagttccattgtcctgaatatttatttgcctttgctatagaattcgcatcccaatgatttcaatctttccagttggcagatgacttgatctccgacattttcaccactattggctcagtgactgtcgccttgttactgatcctcttgctggccattgttgcttctgttgtcacctccaacaaaagggcaactcagggaacctacagccccagccgtcaggagaaggagggctcccgagtggaaatgtggaacttgatgccaccccctgcaatggagagactgatttaggagcattgtgtcccttcgagatggggatccacacactgtgaatgtgatgactgtacttcaggtatctctgacatacctgacaatgttaatctgcaactgggattacactggaactacaggaatgattcctttgaccaccttaaaaactttcacagtggttccgctcgacaccattgttttattatattatatcagccaattgcaaaaaaagtctgtgccagtaatttcagccttataattagcaaaaacatcttccagagaataaagtcttctgtggctttagtggctatcactgaaactctttcctcttttcaacctgggaacaaattttagttttcattttaggtttctgtactttctgtagtttctgtgtaaactgccatatgtttacatggaaactacaggaaaaaattggctacatttctcacttctcctatcatgtggtcaaagttattgttgtataccagcgatgggatgtatacttttgtccttcattcatggattcagagaaagctctgggaatgacttatggtccaaaaaagtgacccaatggcaacaaataaaaattgaaatgca

SEQ ID NO: 2362 - DNA, 210253 bp, Homo sapiens; identical to SEQ ID NO: 2359

SEQ ID NO: 2363 - DNA, 210253 bp, Homo sapiens; identical to SEQ ID NO: 2359

SEQ ID NO: 2364 - DNA, 210253 bp, Homo sapiens; identical to SEQ ID NO: 2359
